United States Patent 12,378,586 (SYSTEMS, METHODS, AND COMPOSITIONS FOR THE GLYCOSYLATION OF CANNABINOID COMPOUNDS) - sequence listing, part 2

SEQ ID NO: 4073 - protein, 1546 aa, Drosophila guanche
MLRLLCVFVLLQSAAPILARAESSQSYPITTLINAKWTQTPLYLEIAEYLADEQAGLFWDYVRGVAKLDTALNEYDTESQMYNAALELVKAHVSSPELPLLKLVVSMHSLTPRIQTHFQLSDELRSGGACQSSTFAHVGTELACSYVELEKKLELSRAEDSLDSPVDTYSFDHIYPGSENNTRTVVLYGDLGSSQFRTYHKLLEKEANNGKIRYILRHHLAKTEKKPVRLSGYGVELHLKSTEYKSQDDAPKPEAGSTLDEDLDNESDVQGFDFKALKNKHPNLKRALDQLRQRLLQGNDEIAQLKAWEFQDLGLQATAAIAEIQGDESLQILQYTAHNFPMLARTLLAHKVTESLRAEVKHNTETFGRSLNVAPPDGALFINGLFFDADTMDLYSMVETLRSEMRVLESLHSNNVRGGLASSLLALDLTASSKKEFAIDIRDTAVQWINDIETDAQYRRWPSSVMDLLRPTFPGMLRNIRKNVFNLVLIVDALQLKARSVIKLSESFVIHQAPIRLGLVFDAREASKENAEDYIAITCAFNYVSQKKDARAALSFLTDIYAAVGETKVVKKENIVKQLIKEFSTLTRAKAEEFIEEDSTYDYGRELAAEFVQRLGFSDKGQPQALLNGVPMPSNIVTADSEFEEAIFTEIMTHTSTLQKAVYKGEMTDNDVAIDYLMNQPHVMPRLNQRILSQEDVKYLDINGVPYKQLGNVAALNRLSNRDMTATVMENLKFFGGKKSTERIGRASLQFLTIWVFADLDTEEGRNLLTHALEYVQGSESVRLAFIPNTENVPAGDSKNLNRLAWAAMQTLPSTQATEQVLKWLKKPKEKLETPSKVLDILGSTELHLKMLRVYAQRVLGLNKSQRLVIGNGRLYGPLSADESFDSADFALLARFSSLQYGDKVRQVLRESAQDVGADFTSDTLLKLYASLLPRQTKNRFKMPTDLKSDHSVVLLPPKQEKLPHFDVVAVLDPASRGAQKMAPLLILLRQVLNCQLSLFMIPVPQHSDMPVKNFYRYVVEPEIQFEANGVRSDGPLAKFSGLPANPLLTQQIQVPENWLVEAVRAVYDLDNIKLSEIGGPVHSEFDLEYLLLEGHCFDASTGTPPRGLQLVLGTKSKTTLVDTIVMANLGYFQLKANPGAWSLRLREGKSTDIYGISHIDGENANYDAGSSVVQVLITSLRSHVIKLRVSKKPGMQQAELLADETDQAAQSGIWNSIASSFGGSNGNQAAADEDTETINIFSVASGHLYERLLRIMMISLLKHTKSPVKFWFLKNYLSPQFTDFLPHMATEYNFQYELVQYKWPRWLHQQTEKQRTIWGYKILFLDVLFPLNVRKIIFVDADAIVRTDIKELYDLDLGGAPYAYTPFCDSRKEMEGFRFWKQGYWRSHLMGRRYHISALYVVDLKRFRKIAAGDRLRGQYQALSQDPNSLSNLDQDLPNNMIHQVSIKSLPDDWLWCQTWCSDSKFSSAKVIDLCNNPQTKEAKLTAAQRIVPEWKDYDAELKALLARIEDHENSHSRDIDEDPVDDHVVVTTQPPPPEPKHGEL

SEQ ID NO: 4074 - protein, 1787 aa, Leishmania panamensis
MSSSMAGTGRGAMASPLRSFFALLRLLVLLSLGITSPTVHGKGIRATVEASWNETSFYQEGCEWAARSFGDEAFYSCLEALWSPPLKGNKSSVNPEEAREAMSARFRTQQQQYMTLLEVLFDLPETRGANRAFFEVEMAARVYSPAVEAHYALTDKALRETTSPQYFSERAYNDEDKRGSGSSSSCGDPFAVVYTRTAPGALLQALRVETPSALKSAVDGVGKSHRGALVSVDEVTFARFDHRYMSSSPSATREVPAVVVLYGFLGSAATHALHRAAVELSSLADAASASTTSAPAYFWRHLPVSVSRLCAAAGVPGRSFSAATTSMWDSPLVVQGYGATVDIKNIEYNVLDEKKAAQQRSKEESLAATATGSLHDATNAAAAAKGAPEAHGGRIVGGFRVARLKERYPGLAALLDEFATLLDEEVGNDDMKVGFDVWELQKIGLAATQYILDVKNHSRRLYVLEDMVMRFPTYATALSRIATQPERLVEVQNTLSILHQTISPGQSALFVDGWRVGEEELSLFGVLHALHEEERLIRCIKTVLTTRAVPAKAEVSSEDVKREVRTVSWLPAMLEKVSGYVKQATRRAISTPENGADMEVAYAIPAKHTIWINNVETSPQLEGLSSELSIFTATDDITQIPRRNVLNYVFLWNPVSKTSLQILSLLFRHRQEGLNARYGLAVVDPTWSPVVETGVQSDARDFKGEPTRSQAALQVFALVYHLAAMDENAVLAFLVELFQTSMKINTDTIPDAVVFRVCKKTAGRLLRTSVAELTSKADFLTYYHETQAVLRRFPVPQYPATFLNGVLLGDDLAGMSAALRRELALLRRWVSSGVLRDEMKDMYNAILKQRNAVDHLQPALVRTPVTMRWSDRPSTVAYVEGMPYVYSAAYAGDALALTQLVTLPCELTTTMLQQVLTVLKSLEECGAVLEEDTVTHEVCRSLRLSLVSCPTATSLVHRHIEALQQQLTRSRAPKVTWHTALRRYVLHVVESVTSTSVDMNAVLCTETVLAALTESPLPDDLQTLVGVSSSTGENTSPQWDREQVHFWTAFEDAYKSSADNVALITNGRIVAMDTSFSTADVLTAARLVAPITKAALHVVMNVNFAEMISAADAGYTAEELDTNFFAGKAACLSSVFVDEISRHVAKESLSAPELMREENMVSSAKSWKRLQGVLFTVRNFRAEGVPSDNAGEAEEESVTASGLQPLHHVTAVVDPSSRDAQVIVSLVHYLVKSQLQVHLTVLLNPSLDVKYPIRNFYQYVASPTLAFEETSGRVIVPPATFTQMPSLTLLTLGIDEPPSWTVFSQDAEVDLDNVMLSRLPRGTLFATAVYRMHSVLITGDATYVQTRVPTNGLPLSLHSSSRAGGAPEAAPTARSTDTQVMANKGGYYQLQANPGLWYLSVKEGPVAAAYCIEAMDGHAVLECAGGGKGLSLTNWSQGQHIPLLVDSFLGRYLSLRVGHTPNSAVAADLHRILQQIASGVEPTWPPFRSTHHTPPERPRKPTLNIFSVASGHLYERFLRMMMYSVHNTSSDKYGANTTRIKFWVIENFLSPQFKRYIPLLAEQLGFEVGFVTYRWPWWLPRQTEKQRKIWAYKILFLDVLFPLDIDRIIFVDADQTVLVDLHELYNMNIGIKPVAMTPFCQKFKNKATASFRFWEQGFWKSHLGLKPYHISAIFLIDLRRFRAMRAGDQYRGTYAQLAGDPNSLQNLDQDLPNYLQNIIPIFSLPEEWLWCETWCSETSKSRANTIDLCNNPLTKVPKLENAKTIIPGWEELDNKLQNLSDSVLASL

SEQ ID NO: 4075 - protein, 1298 aa, Sordaria macrospora
MIRLSQLPWGLAAAIVTATWLPSNHVAASPSVDVALKAAFPSPPYLVELLETAASENATAYFPLLNRIAKGDFAQAKSDQELYEKFLEVLQQDGHVNHEALSTFKLALSLRSAAPRVEAHYQYYTTDVEPSVVADQDGCDLWFLYNGKQYCKASLEASHGDVDSNSQERTLPFDRKFGSGPQEIVLYADITSPAFGKYHETSMELARKGEASYRLRYKRSLAQSDDALSVNGYGVELTLKRTDYIVIDDRNTGADKATGDDSQKTIKSDSELVLDEDEEVADIKPLEKSELSPLAVKAASFVMQSDSPFDTLLKLTQDFPKYSTKLGKHNVSKEFLAEHEYNRQLLVASGANVLWMNGVQLVDRQVQPFGLVDMLRRERKLINGALDLGLTGQQALSLLGHDEVAAAKATEEEPRRFDWRDESEGGQVIIWLNNIEKDKRYAEYAPSVWALIQHYGQGLPQVRKDLFNLVVPVDFTKADHVTLVTRQLLAFMKRGIPVRFGLVPLTPTGEAIEQAKVLYHLLNTYGLAAMSTYLEKSLEASSTDKPNVDIFNLAIKDREVRPEHETLAFKDIFTSGDLEKQVHRAKHWCERLRADTEIPPAFINGFAIPREEDWLRNMNHKLMVDLQVLQQAVYYNKVNDHTDVPGFFLENAIARRNTFISPEDPNAIKVLNVNKVYSEHQRLFSKVPVIEADDSAPKEDWAVLTIVTDLDSVEGQKLLYFALRFRQEHQGVRLDIIHNPADLTNSPSVMSQRLKTKEGSLLEVTRLVELETILEEGKPEADQEFDADLAIFLSGFDLKSGDNMLILNGRIVGPIASANDFVKEDFAEFLKTERANRILPVYKAIEDLGLGDKVSGPLAAAKLTSVTALSGIPDTPQGIFDSATPIRTTAYNRWNTTYTSFEVGNPETASIFFVAAINPASQMGQKWAPILKVLSELEGVNLQVFVNPETELSELPVKRFYRYVLESAPSFDESGKPATDKSVSETAQHAEINIFSVASGHLYERMLSIMILSVMKHTTHTVKFWFIEQFLSPSFKSFLPFLAAEYGFQYEMVAYKWPHWLRHQSEKQREIWGYKILFLDVLFPLSLEKVIFVDADQIVRTDMYDLVQLDLEGAPYGFTPMCDSRTEMEGFRFWKTGYWATYLRGQPYHISALYVVDLRRFRELAAGDRLRQQYHTLSADPNSLANLDQDLPNHMQFQIPIKSLPQEWLWCETWCNDETLGKARTIDLCNNPQTKEPKLDRARRQVPEWTVYDEEVAGLAKKVREEQEKLEQVVELKKKVEEKNAEDKAEKEHVIDEL

SEQ ID NO: 4076 - protein, 1737 aa, Thalassiosira oceanica
AGWLGLFDEKEEKGLPGGENKNAARTLSSFEDYSRGLSKDTPVNPLGRRDVEVSVKTGWPTTVFSPLCEAWSYLDAGSSDKNSLSWKYLDVFADLGGSESLDRWIDEPKDEYSWGVHNSSLLALEVAAKVDIGALDHNLLPLALSLRAHSPHCEMHRSLARDASISFGLYNTSEPGNLPDAFAIISKTGVDEITNQTKVMAAQVVMDGVLVSNAIESLHSIGDDSRHIAAGYSKLLLPLSDEIVNPGSDSDGGASAVVYGQVGTSAFASMYQSFKNSNIAFVVRHMGYIQYEEDSPTSPKASRTKLQGYGVRLDIRNIEYKAFDEPDDGNDDSDVDLSDAGHDPSEASRDEYLAGINLHRILRRLEADGRLPLDTDLNAMQTGIIQSQRAQQRYESIIPPAWQRRPLSMQATTIVLSSPDPLGTLKGLSQNLPSIAHFLASVRVPPSLEKLAEDATALASRVGAVSPGWGDAAFGLYVNSNPVDVERPSFNVFQLLSVIREEDKKLRELESRVRPVLKFASESLGSSSDWKTLLAVRNAMDMGMDKLKQIGNNLSGAMVESELYGDKELPVSKKYRIDVGRGGKNAVLYLNDIEKDPEYRSWPSSLQEMLMRSQYGGAPTVRRNLFTLLVVMDPASGVAQPSLSVAAQLMNSQVPLRIGVLIVNENDVANGLASPHPSWNDGQRRFHARDSSLILRFLAKEFGGLTSFSCLVQMSHMSDTDITVSEYIDKHVAFLNEMGVVQGMGVRYNLEAIVKSGKIDSVTKRIDITYEQAVSFASDKLIAPGMSFFNGLPLPDASDRESFGAAVNEIFSYEQQNIMELVVKGIISDGPKSVYAAVLRKGDNLFKQFHPLLRESEGVYFALDSSELDSDVDSLLVPSSPSISLEEVRALYLIEAFVDFESTEGVGAAIALLDINISPPEAWYESKTAVASKISPSGPVESPGGLAMFNILRSVSQFNASDVKAALLSLLPGNFDSTSDVAAVINQLEQVDKEVRQKLIDVVSVEHTKVSPSPRPEKNFYIANGRVFVPPKGRSISISDIEMLIDLEYDLSSAFSHLVLPKLVGEVTVGGGIPPATYLAMGKAASVLFEMLSQPTSRVQDFTSVFDSVDEDSPLFFSWNEESDDEHLQVLQVKVSCILDPLTEPTQRVAPILMAIRDSLKIPLRLLLAPRLTVSNELPLSSYYRFVVDADSEDPKASFHNLPTNHLLTLRMDVPEIFDVQQSSAVEDADNLRCIPPFGCGDKAHLLAKGQVPKEGAQAGPTRIEYQLKNLLFFGQCHDLLKNTSPNGLQLTLDRSSIINPSSPSAVEIDGKGVISSSLPSASMGSRKEHADTLVMKTVGYWQLRANPGVWELKIAKHSRGSQIFDMVEGTATATGRLKLKRSQKMESKTLSMKDFTNQGRVLTVLRKKGFEQTELYEENTLESTEPQTRVDTVHVFSLATGHAYERLLKIMMLSVTKRTTSPVKFWLFENFLSPSFKSSAKYMAEQIGCEVTFVTYKWPEWLRGQSEKQRLIWGYKILFLDVLFPLSVKKIIYVDAEAKIPRDKSRSPDFSHVYSLQVIRGDLTELANLDLEGAPYGYTPMCDSRVENRGYAFWRTGFWEAHLRGKPYHISALYVVDLERFRRELVGDKLRAIYQQLSADPNSLANLDQDLPNYAQHEVRIFSLPQKWLWCESWCSDETKIDAMTIDLCNNPEHKEAKITMAKRIISGPLFEESWEELDKMVGQYDKEYLDNSKTR

SEQ ID NO: 4077 - protein, 1559 aa, Genlisea aurea
VSAQTRRPSKNVQVALRATWSGTPILLEAGELMSKQWKDFFWNFVDAWIHSETVEPEPSTSKDCVAKILAHGKSLLSEALASIFEFSLTLRAASPRLVLYQQLAEESLSSLPAAGGVVTNNKEAESIEYDEIIERKKTHESLFSCKRPSSPRSRCCWVDIGSSLFFEVSELQIWLLDPDVIITGAVPHPEIFEFDHVHPDSKAGSQVAVLYGALGTKCFEEFHMVLSEASRTGKVKYVVRSVLPVGCESKSATCGAIGAGGPLNLGGYGVELALKNMEYKAMDDSSIKKGITLEDPQIEDLSQDVRGFIFSRILERKPDQIAEIMAFRDYLLSSTVSDALDIWELKDLGHQAAQRIVHASDPLQLMQEISQNFPSIVSSLSRTKLNESIKAEIISNQRMIPPGKSLMALNGALVNIDDIDIYMLVDLVHQEVSLAEQYKKLKIPPSVVRNLLSVLPPSESASLRVDFRSAHVHYINNLEVDAMYKRWRSNINETIDMVISLFENNLPVRFGVILYSAKSVEKIEAKNDVLSSSDLKSDLEDISDLIIRLFIYVKEHHGVLAAFQFLSNVNRLRIESAAEDSLEVYHLETAFLDTLLPTAKSPPQETMSRLKEDKTLNELSQESTSFAVKLGFATLGCSFLMNGLVYEPNEEALMNAINEELPRLQEQVYYGQINSQTDVLEKFLSESGVQRYNPMIIAEGKDKPKFTSLCASVLTEGSVIDQLRYLHSVKTVDDLKPVTHLLIVDIDSKKGTMLLREGIRYLISGSRNSRVGVLFNSNEQTTSSSLFFMEAFKITASSFSHKKGVLQFLDELFLLYEQEVLASEVDGSYDAILDKVTQLADANGLPSKRFESDLSGFSPESTRSYLNEVTRFLYKSLGIQEGVNAVVTNGRVILLTEGSIFLSHDLHLLESLEFKQRIKHIAEIVEGIKWEGVDPDLLTSAFMSDVIMAISSSISSRDRSSESARFEILNADYSAVFLENQDSSIHIDVVIDPLSPTGQKLSSLLSILSKYIQPSMRLVLNPVTSLADLPLKSYYRYVVPTMEDFSSTDDMIHGPRAFFTNMPLSKTLTMNLDVPEQWLVQPLVAVHDLDNILLENLGDTRTLQAVYELEALVLTGHCSEKDHEHPRGLQLILGTKNNPHVVDTLVMANLGYWQMKALPGVWYLQLAPGRSSDLYFMKGEGKETQNTTLSRRITIDDLRGKLVHLEVVKKKGMEQEALLIPSDDDDNHPLNKKITQSKWNSNILKWASGLIGGSYQPKKGESSSLDSGSKVRRGQTINIFSVASGHLYERFLKIMILSVLKNTDRPVKFWFIKNYLSPQFKDVIPDMAAHYGFDYELITYKWPSWLHKQKEKQRIIWAYKILFLDVIFPLALEKVIFVDADQIVRADMGELYDMDINGRPLAYTPFCDNNKDMDGYRFWKQGFWKDHLRGKPYHISALYVVDLVKFRETAAGDQLRVFYETLSKDPNSLSNLDQDLPNYAQHLVPIFSLPQEWLWCESWCGNATKSKAKTIDLCNNPMTKEPKLQGAKRIVAEWTDIDLEARLFTARILGETTEPPQIQ

SEQ ID NO: 4078 - protein, 1492 aa, Penicillium brasilianum
MRAPTRPRASWHWYAALGALLPACLANASPAVNVALQASFDSSPYLVELLETAADENATSYFPLLNRIADGAFEEAISEKELYDRFLQVVHEDGHLRTPESLSSFKLSLSTRSAAPRIQAHYQYYNTSVQRSMMGAQDAACPVWVHFEGKQYCSSLMERAQQDVDGELDPRELPFDRVHGDVSLPPAVLYADVSAPAFKEFHEKLSEMAKQGEISYRVRYRPPQHRASRPLFVSGYGVELALKRTDYIVIDDRDTEQRDGSGKEDALSGSEELKEDAPDDLRPLSASEVSRLGVNSASYVMDSEDPLNTLIKLSQSFPKYSATIAAHNATAELLQEIRGNRARMIPAGYNVMWINGMQIDTRQIDAFSLPDILRRERRLIEKFRDLGLSAQEAVKLLSHPTLAESQADDDSQRYDYRDTLEGGQVIIWMNDLEKDSRYESWPSDLQTYITNTYPGQLPQVRRDLHNVVIPVDLSSPEHVLLVVNQVQTFIKRLIPIRFGLVPTASSPNAISQLKVAHYLQETYGLSSLLHYLEESASKGKAGETDKASFGTAIKERTPRADKEVLSFDQVLKSEYYDTVATRSADYQRRLGLQGAAPHFLVNGIPVSRESNWMQELSMLISRDLKLIQQGIVEGVLEEDAVLPEFFLAGAFERRNTFIMPEDPKSVRIVDLATIFGSDSTILDQIPQVEPESGVLGGIHIIVVGDFESETGLKLVTDALKFRKENGEMELLLVHNGATESEGSMSRLNVLRHALAKGADIDGMVDAITSSEPLESSEYDSQEAIQVHRRLAETLGFDAGTEGLVVNGRAVGPIPKEYSLSVEEIGQLVAYERTKRIEPVARASLSLRLNKKLTKPLDLAKLTSMVTLSTMSDVPEGIFESMPDFRMDVSEKWKTEHSVITVSNSEDPAINVAVVLDPASETAQRWLPILKVLSELAGVQLKIFLNPKDELKELPVKRFYRYVLESEPSFSADGSLSRPGASFTGVPVEALLTLGMDVPTSWLVAPKESVYDPDNIKLSTLKAGANVDAIYALEHILIEGHSRDVTTNSPPRGVQLILGTEDNPHFADTIIMANLGYFQFKAQPGVWQINLKPGRSEKLFNIDSVGGLGYRPQPGDESTEVTLLSFQGRTLFPRLSRKPGHENDDVLETGAQPGSARDYLSKGFNFASGVLSSVGVGSKSEEQQADINIFSVASGHLYERMLNIMMVSVMRHTKHTVKFWFIEQFLSPSFRAFLPHLAEEYGFSYEMVTYKWPHWLRPQKEKQREIWGYKMLFLDVLFPLSLDKVIFVDADQIVRTDMYDLVTHDLEGAPYGFTPMGDSRTEMEGFRFWKQGYWSTFLRGKPYHISALYVVDLNRFRAIAAGDRLRGQYQMLSADPNSLSNLDQDLPNHMQHHIPIHSLPQEWLWCETWCSDEDLASARTIDLCNNPQTKEPKLARARRQVPEWTVYDDEIAALAKRVSAEQVGFVQTGEDAGQKEVSVDDVIVEDVDRKDEL

SEQ ID NO: 4079 - protein, 1457 aa, Eptesicus fuscus
FNSEFMAEESNEKFWQFLDTVKELAIYKQRESGYSYYNLILKKAGQFLDNLHINLLKFAFSIRAYSPTIQMFQQIAADEPPPDGCDAFVVIHKKHTCKINEIKKLLKKATSRPRPYLFEGDHKFPTNKENLPVIILYAEMGTRSFGKFHTVLSEKAQNGEILYVLRHYIQKPTSRKMYLSGYGVELAIKSTEYKTLDDTQVKTVTNTTVEGEIETNEVQGFFFGKLKERYSDLRDNLTAFQKYLIESSKEMMPLKVWELQGLSFQAASQIMATPVYDALKLMKDISQNFPIKARSLTRISINQHMKKEIQKNQQDLHNRFEIQPGDAHLYINGLRVDMDALDPFRILDMLKLEGKMMNGLRKLGINGEDMSEFLKLNSHVWDNNYVLDIRHSSIMWINDLENDNLYVTWPASCQELLKSVFPGKIPSIRRNFHNLVLFINPAQEYTLDFIKVAELLYYHKIPLRIGFVFIVNTDDEVDGTNDAGVALWRAFNYIAKEHDVSQAFISITHMYQKVKNQNILTVDNVKSVLQDKFPHANILDILGIDSRYDNKRKAGASFYKMTGLGPLPQALYNGESFNHEELNIQKLERALLQKMMDMTIYLQREVYMGTLNDRTNAIDFFMDKNNVVPRINPSILYSKGQYLNLISTSVTADVEDFSTFFFLDSQDKSAVIAENMYYLTHEDEDVISSITLWIIADFDKPSGRKLLLNALKHMKKSFHSRLGVIYNPTSKINEENTAISRGILAAFLTQKNSFLRNFLRKLAKEETATAIYSGDKIKTFLTEEMDKNAFEKKYNTIGVNIFRTHQLFCQDVLKLGPGEMGIVSNGKFLGPLNENFCAEDFSLLEKITFTNLAEKIKGIVENMAISSKKKSDLVMKVDALVSSLPTRESRHNVKFLTENYSIIKISPQENDMFFDVIAIVDPLTREAQMMAQLLIVLGKIINMKLKLFMNCRDKLSEAPLKSFYRFVLEPELTLVTNDLIEPVAKFLDIPESPLLTLNMITPEGWLVETVHSNCDLDNIHLKDIERTVIAEYELEYLLLEGHCFDRTTEKPPRGLQFTLGTKSQPVAVDTIVMANLGYFQLKANPGAWILKLRQGKSEDIYQIVGHEGTDSQSDLGDVIVVLNSFKSKILEIQVQKKPDKIKEDILTDEEKKGMWDSIKSFTRSLHKEKDKKETDVLNIFSVASGHLYERFLRFYEVRVSFSNNSKEFTFSKPKPMEVIPYMAKEYGFQYELVQYKWPRWLHQQTEKQRIIWGYKILFLDVLFPLAVEKIIFVDADQIVRHDLKELRDFDLGGAPYGYTPFCDSRTDMDGYRFWKKGYWASHLLKRKYHISALYVVDLKRFRRIAAGDRLRGQYQALSQDPNSLSNLDQDLPNNMIYQVAIKSLPQDWLWCETWCDDESKQRAKTIDLCNNPKTKEPKLKAAARIVPEWVEYDTEIRQLLDHLENKKKNAILTHDEL

SEQ ID NO: 4080 - protein, 1610 aa, Jaculus jaculus
MGSREAAQPACAGKGTNIADSVLDMCPKGLLRQDEFMAEESNEKFWQFVETVQELAIYKQTESDVSYYNLILKKAGQFLDNLHINLLKFAFSIRTYSPTIQMFQQIAADEPPPVGCNAFVVIHQRHTCKINEIKKLLKRASSRPKPYLFAGDHEFPTNNENLPVIILYAEIGTRAFAEFHKVLSEKAKNGKILYVLRHYIQKPNTRKMYLSGYGVELAIKSTEYKALDDVQVKTVTNTTVEAETEAGEVQGFLFGKLKEIYSDLRDNLTKFQNYLIESNKEMMPLKVWELQDLSFQAAAKIMSTPTYDAIKLMKDLSQNFPTKARSLTRIAVNQLIREEILENQKDLHNRFGIKPGDARLYINGLLVDMDVYDPFSILDMLKSEGKLMSGLQNLGFRGEAMDAFFKLSSAVREDDYVLDVRHPSVVWINDLENDALYASWPSSCWELLKPPVHDSIPSIRRNFHNLVLFIDPTQAYTLDFIRLAALFYYNEAPLRIGFVFILNTDNEVDGTKDAGVALWRAFNYIAKEYDMSEAFVSMIHMYEKVKSQHVLTVDDVMSVLQNKCPDSNILEILGLYSKYDSERKAGASFYGKTGLGPLPQALYNGEPFNHKEMTIEELEVALLRKMMRTSINLQRNVVMGTLNDQIDVINFLMDKNNVVPHMNSLILHTEPRYLNLISSSVTADIEDFSTFSFLDSQDKSAVIAKNMHYLTLEDDVACAVTLWIIADFEVPSGRRLLLNALTHMKTSVHSRLGIIYNPTSKINEENTTISRGILAAFLTHKNSLLMSFLKNLAKEETSAAIYSGVKMKTFLSKGMDKNAFEKKYNTIGVNIFRTHQLFCQDVLKLKSGEMGVVSNGKFFGPLNENFYMEDFHLLEKITFSNLVQKIKDIVERLDIHSKHVSDLVMKIDALFSSLHMHATRHNVNFHKENHSVVKISPAEPDMVFDVIAIVDPLTREAQKMAQLLTVLGKISNMKIRLFLNCRGKLSEAPLNSFYRFVLEAELLSGANDSPYGPVAKFLDVPESSLLTLNMITPEGWLVETMHSDCDLDNIHLENIEKTVVAEYELEHLLLEGHCFDVTTEQPPWGLQFTLGTKHKPALGDTIVMANLGYFQLKANPGAWILKLREGKSEDIYEIVGHEGTDSQLDVGDVIVVLNSFKSKILKVQVRKKKDKIKEDILADEYENKGIWDSIKSFTRTLRKEDPKKENDVLNIFSVASGHLYERFLRIMMLSVLRNTKTPVKFWFLKTYLSPTFKEVIPHMAKEYGFQYELVQYKWPHWLHQQTEKQRIIWGYKILFLDVLFPLAVDKIIFVDADQIVRHDLKELRDLDLDGAPYGYTPFCDSRTDMDGYRFWKTGYWASHLVKRKYHISALYVVDLKKFRIIAAGDRLRGQYQALSQDPNSLSNLDQDLPNNMIYQVAIKSLPQDWLWCETWCDDESKQRAKTIDLCNNPKTKEPKLKAAARIIPEWVEYDKEIRQLLDHLEQQRESAAFAEETIIFSLSDLVTLSEDEFDPICSLFLPFVFYWDEGSNLYDEKLEKEERIIVLLPPWVTWTLQYTEAAAELLVPWQYVSQSDAYQEPNPCYRAQRKPDETCGLQIMTVSIFHARTSLQFT

SEQ ID NO: 4081 - protein, 1294 aa, Pogona vitticeps
MYLSGYSVELAIKSTEYKAVDDTWSEGAVNVTEEESNGENEVQGFLFDTLRQNYPDLKDNLKELKKYLIESADDTEPLKVWELQDLSLQAASQILSVPVYNALKVMKDIAQNFPVKARSLTRVLVNQQMRKEIEENQKHLHETLELQPGEARLFLNGLPIDLDFHDPFSILETLKLEGKAMHGLHSFGIKGDTLHKLMRLAGRSDDDTYALDIRHSAIIWINNIEKDHMYNKWPTSFQELLKPTYAGMMRQIRRNLYNLVIFIDPIQEEASTFMNLVEVIYSQKVPLRIGFVFVLNTDEEVDGNEDAGVALWRAFNYIADEMDIPEAFASIIKMYREVKDGGMLSVEHVKRVLRGAFPHADMQDILGVDSEYDEKRKAGAVFYKKTGLGPLPQALFNGVPFNRKEMNVGELGSSLLKIMDATESFQRAVFMGQLNDHKDAVDFIMEQQNVVSHINEKILSSERRYLNFISPSAPIDTSDFSTFSFLDSQDKTFVISENVKYVTRKDEDIIYPVTMWIVADFDKPDGRQLLSNALKHLKSSSHAQLGIVNNPASKITEDNTVIARAILAAFLTQKNASRKSFLSRILKEEVAKALATGAKIKKFFVPGMDDDTFEKKYHTLGVDLIQAHRIFCQEVLRLLPGQMAVVTNGRIIGPVHENEFSLEDFDLLEQITLSAATVKIKSLIKEMGIESKRGSNLVMKVNALLSSMPKMDARRNIEFLKEQQSVLKLDPQENEPFFDVIGIVDPLTREAQKLSHLLIVLGQVVHMRLRLFMNCRSKLSEVPLNSFYRSVLAPELTAGIHDLFPLPPGANFLEMPESPLLTLNMITPESWLVEAVNSSYDLDNIRLKDVDGIISAEYELEYLLLEGHCFDVTSRQPPRGLQFTLGTRNDPVQVDTIVMANLGYFQLKANPGTWILRLREGRSEDIYQIFKHEGTDSSEALEEVIVVLNTFRSKIIKVQVQKKPDEISEDLLSDRLTEEEEDLMASSIGGTQTSEKEKKMDILNIFSVASGHLYERFLRIMMLSVLHHTKTPVKFWFLKNYLSPTFKKVIPYMAEEYGFQYELVQYKWPRWLHQQTEKQRIIWGYKILFLDVLFPLAVDKIIFVDADQIVRSDLRELRDLDLRGAPYGYTPFCDSRKEMDGYRFWKSGYWASHLGKRKYHISALYVVDLKRFRKIAAGDRLRGQYQALSQDPNSLSNLDQDLPNNMIHQVAIRSLPQEWLWCETWCDDESKKKARTIDLCNNPKTKEPKLEAAIRIVPEWAEYDSEIQKLISRIRNEKKNVIQSRHTDSKHDEL

SEQ ID NO: 4082 - protein, 1684 aa, Amanita muscaria
MRSAFIALLYATAAINDVRAITAGRPPAVNVSLRTSWPAPPFLVELLESFSLEFPSSFFPLLNLLSDPNIAQKLKSSNPKEIRDETVKLALEHGILEDSTDVAALDSTLALHAATPAVQAFYSFYEEKYGDRGRLCAQKDGGGQAWVDWYGEVACTAAELRGLVDERPANVNYTRPQLLTFDHVHPVPSRSLTRSPRTAILYTSLDGHPSNLGELHNALYALSKSDKEDNSVEYVVRYTPPLQGGKESGNGEGEAKGSYLTGYGVALDLKKTDYMVLDDRHSRSLEDKEGKKDIQEEKVQVDPLLDFIQSFEAKEKNNDEDKDHADTNTPLTEAEIVELGYQASQLIISISSLSSTNNLAVPLSSSHSSLSPLSALTLLSQNFPKYTQSLSRRIPLSSSVESELRQNALRAQAGANVVWLNGGIIFSPGGDVAGGGGLINGVDVLKMKRVMRREKAWVRTLESLGLTRQEAVQVISDSGAIIGEDGKPKNHGGGSVSSESSVLDGRVDASDRTEGKDVILWWNDLEKDERYARWGASFYGLMRPMFPGQFPTVKRNLFNIILILDLSNPTALELVGGTISNIIERGIPFRFGLVPSMASEENRKMAKAIYWLFENAGRKRTMHWIKLLAGIEGRGFMNMGSSVPENQIDWTRAKEEFNKLVDEIKEKEGKDETVDDLEIVTFDSVVNSQDGGGSLKEVDAYIDRLDVKTIKAGLLGHAFFNGKYLEVGKDLLGGLQQDIGYQMQYFQELIYQGTLTDGDSPDMANWFYDQPGVSKRRNTYIIPSVGFGPNESGGGRPLRLVSLPQVFEKTGFQWEKVKGGFVYPPGKGALPFSTFVVADLDSEEGLELVKEALKSLVYVPKMRVLFVHNPSSDVKKSVDHVSPRSEIVAKLAMPGRMLESTVTPQALATVLGIDIEFEVQELSTDETQVPLGQSAVELLTVDKIDEKTYGEYTEASRLLARELEFGPGESGVVINGRVIGPMERGSFNAADFKALAEFEYKKRMEVALDSIENACHRVVDLDRVAYADLVSLTASVLGVMQMPDPSDVGMHDATPKPRRRNYLALERNLTMFTHGDSSAAMYHVVFVLNPLSETAQKWSSLIKWLTEMPEVYIEVHLNPNKQAEIPLKRFYRYNLQSALVFDESGNEVTAQTSFEELPVEPLYTLAMDVPSSWLVRPREALYDLDNIQLTSLSPSDSSVDAVFELDYFVIEGHARDPATNAPPRGLQLQLVDSHNKTIADTLVVANLGYLQFRAKPGVFKLEIREGRAKEVYHMDSAGNEGWDSPTVDVGGTDITLTSFDGLTLYPRFSRKEGMESASVLEGDETEQMSSGIIGTVTSRFRSFFNAGKGPKSATGVVERRDLAEINIFTVASGLLYERFVGIMILSVLRNTNSTVKFWFIENFLSPSFLEFIPHMAKEYGFQYELVTYKWPSWLRSQREKQRIIWAYKILFLDVLFPMDLKKVIFVDADQIVRADLKELVDLDIHGAPYAYTPMGDDNYDMEGFRFWKKGYWAETLGGKPYHISALYIVDLVRFRQLAAGDILRGQYQQLSADPNSLANLDQDLPNNLQRMVPIHSLHEDWLWCETWCNKDRLHRAKTIDLCQNPLTKEPKLARARQIPEWEEYDAEIARFTRKLAEEGKIRSGMAAADVNALASAGNTPAVPPTTGSAESEPGTATTSIHEEL

SEQ ID NO: 4083 - protein, 1415 aa, Zymoseptoria tritici
MAVLSGWKAGVLASLLAWANAVPSINVELRTSFGAPPYLVELLETAAEANASSYFPLLDRIADGYFDSSKTDRDLYNSFRSVLQQDSHLSSEALSLFDFALSIHAAAPRIEAHYQYYNTSIVPTLLADESEGCETWAHMSYKRQRYCSPELRESDVIKDYGPADDDVRSLPFDRVLGDDFNEKPSVLYADIESEAFRKFHKKLSPTAKEGSTSYRVRYRATPGYESRPLAVSGYGVELALKRTDYIVIDDRQAEEAKSEDNAGDATLSEEELSDLRPLSSSELRRLGLKASSFVMASEDPFETLLRLSSDFPKHSSPIAATNVSKEFLKEHEHNRELLLPAGYNVMWMNGLQVMSRDVEAYALLEQLRRERKMINDVQSIGLTGAEAVELLSHEAITKSQVGQEAQRYDWRDDAEGGNVIIWLNNIEKDKRYASWPATVNAFLQRTYPGQLPSVRKEVQNLVLPIDFSDLSDVSLVADSIRGFVERQVPIQFGLVPRINSPASKEQAKVFYYLVDRYGVAVALDYLERSVAGSTRKLGGPDEKHFTTAIAERILRRSKEALEFSKIADDEELSARLKPVQAYLARLGDIDAAPHAFINGVPIPRTDEWLQVMSQRIGLDLRVVQQAIYEGTLSDDDYLPDVFLSKASFRRNNIVIPGDDKTLRHLNLGELPHFELLPSLPASKDTIERELVHLTVAADFDTTEGFEQLMEALVFREEHDNVELAVLHIPISPNPAIHMYKKLQGEVATGDNLSARREVYASMRKTAMTGDDINEPGFEKALVINGRVVGPFAQETVLEVADLEALFSYERKRRLLPAALAIESLKLQDKASTPLAFARVSNVIALSLISEVPEGIFEQAPSVRMDTFKKWDSTYTAIRIGDEKTANIQIYAAVDPASEVAQRWIPIIKVLSELEGVYVCLYLNPKERLEEIPIKRFYRHVISSKPDFEDDGSLRAARAQFGGLPADALLNMGMDLPPSWLVAPKHTVHDLDNIKLSAVKSGSDIDAVYELEHILIEGHSKDASSGPPPRGVQLVLGTESDPHFADTIIMANLGYFQFKANPGIYNLALQKGRSEAIFNIDSTGAPAWRTKTFWKHRSKYLSKAAQLGSGLFSSKDDVQAPKHADINIFSVASGHLYERMLNIMMVSVMKHSSHTVKFWFIEQFLSPSFKDFLPIMATAYGFQYEMVTYKWPHWLRGQKEKQREIWGYKILFLDVLFPLDLDKVIFVDADQIVRTDMYELVQHDLEGAPYGFTPMCDSRTEMEGFRFWKQGYWKNFLKGLPYHISALYVVDLKLFRQMAAGDRLRQNYHQLSADPNSLSNLDQDLPNHMQSLLPIHSLPQEWLWCETWCSDESLKDAKTIDLCNNPQTKEPKLDRARRQVPEWTAYDDEIAGVAKRYKDSRSGDLRKLRATKRRRT

SEQ ID NO: 4084 - protein, 1365 aa, Kazachstania naganishii
MGCCRFILNVLHLAACLWAVQVEYGEGLTLGAQEAVRIYSILVHIGVDKVILAGLYPTITGLDSAEDRDDADDAGGAGIFESVLESLSTTAGDGANWAPLFDKYYHLYPMGFPLDQATGLTDENYFVLNGDVYSKPDDVFYMKSKDLKRQTAVPDTDILNSRFDVVIGWNAAAPLITFFGCPSSQAFREFNRNLFAEAIGSGKIRFVWRPTCSYREATPLEVDFPLELTFKKDGEHWDSIVPYVKLPYGLSLPQSLDYEPTEEELEDLDIKIASLIAKHYSGTKDFDATIEYFQRIVNNFPLLFEELTKMEISDAEINEIEKSNHVLEQYGIDYFLLGLFVNGQNIKLTSLDPYSLVNLVQVEYDRLKLLTKALHKAIPGFAYHDARNLVNLFSEISMPTMQELQPIKVDAHRIPAFSHNVIYFNDIEKDDVYNELRNDASQFFEKTKFGEIPEFRQNWNELVFVIDFSNLEEGTVNSDALTALVRVLDVVSQGYPQRLGLLPITNKESEKVLSTIYKLKEQSLSQLKEFFVDLIAEKDLPLDSKFPHPDNSELLSYLDIDDTAIIIDGEIFPFQKNAWHYLLAKVIKRDVEQIKFKLERRRKEEDFTTGNIDVRGLLHLKSATLKHHKYTPDYFSDALYTVMDNDALTNCGIELSSTTKNKNFKILHTISLVDDFGTLSALQRLYNMITVKFSGVRVRVIHTGEAKDGNWLSVKTALAKSGSDMKKSLRKTITSFKQQKRRSLGVNLNWIKQWLPDIALEFLEAGRFMVLNGRFIHFNKDEIPSKEHFEAIVKREAQRTLDMVRALEGLVPEDHEEISDPNTYEVVSSILAKTYYHSLQINRKGFEFTTETTLSRLDLQGHVMINNFTTFESKDKSKPVLVTLVVDPVEERTQKILALIPMLQNLSFVDIEIVLLPTLELKVVPNQRVYLPDRDVQLSTDVLSSYDVEVDVPKTFVMSNITTLESIVIEVYCFDKDRKLSQGSVNSIGGVSLELLDSAGISVGNATTMETFGYAQFHVKTLAQNYTIRSTDPRFEVKGMSTQFNSEFVLSDRFSVDTFDPVRVLVTLEEHEDVDVREDVVAIDDATNVFTVLSSLEEEEIYKDMILKIATSRSERIVFWLLSESFYSKSLYRFVDAVNNNAELNVEVRFISYSWPVWIRPQRFIERRTNVARVLLLDVLFPRSVHHLVYMAPTSTPVDPVLMLRSTMKSKRPVNMFRMKGKGYWDEGYWKKLKEETGFAFYSAEPAFVVHMDRVRALSGGEVFRIHYQRLSADQNSLVNIGQDLLNDVQGQMPIGALKKSTREPLAFDQSKVDATLQSIKAAAEAEADAFNRTGSQREKTQQAGKQPQEVQEDVDEFDLLHDEL

SEQ ID NO: 4085 - protein, 1496 aa, Spizellomyces punctatus
MLSQKGWLYATTLLLFAAPATTNPQESSAPVITRLKTEWPAPPLILEAIEFVAQDRGAQAFDYISQLASTGVLSRSSAANSNRIYNEIIGGLDEGLSKTPGDSQRESFLLSAASLSLLKLSLATRSSAPRIQAQYRFYTENVLPAFGSPSAKFNQKCDVWLDWYGTQSCDVSEVEKLVSASVSNASAPLVFPSDHIYRLDNSVNSRPFAVLYADLQSDAFPPFHSALLASARRGDLAYVLRYKPPSAMPEEPLHVSGYGVELALKSTEYKVVDDREVQKGDESTSSESGTRSVMNEDDPLFESPPRVMALTANETQGLGLKTTQFILNCTNPLRALVDVSQNFPKFAHLLKGVQVEAAIASELSYNRAYLAARRHGLWINGIELDPERIDIFSLQRTLRMEVSRVASLTALNLTSDQAVDLLTTPISEKSGSDLEWGETFDVRSDLVVWWNNLEKDSRYKYWPASVMEVVRPSYPGQLKYLRKNLMSTVLNLDLANPSHLQIMTQVFAFIEREVPLRFGILPLVDIQHHDSASSLAAGAFYHLLKHAKLKDAKNFIQALRDASGDETLTPNAVDSAYNKVAGKSLKAALAEWNDGYSGHVRRLHEFSLRFGTSLREGAVFANGKYVPLNEEWQQSMITTYFKMLDYLMQKVYNGQISDRDNLYDHFLTLPNVNSKRNEFIFGEPVMKNFLDCDECELLSDIVWLSPETVPSTISIIVVADFAQKEGIDFALQAVQYLSFSEGVRMTFINSGAEPVSKVPRSTRADAEVQEEGLDELDKVFQVTGESLHTKTQAFIRSLGLATGQRAIVVNGRIVGPIPSEIPFDAQDFELLIAREFRQRIGNVATKMAGFFGIPDRQSDAISMAIFKATSALATIAMQEISKPLSTSPQTRRPLDTFAKLKKEHSCILVGKEENALLRIIAIVDPVSQVAQKVSALLQVLSKLEGVRIEILLNPEPDMGGSLPIKRFYRYVVAAEPEFDSLTGAMKPPSAAFYGLPEEPLYTLGMDVASSWLVFPSRSIHDLDNIRLSTLTNRRKGVDAEFLLENILVEGHARDSRTNGPPRGLQFVLGTKQSPSMYDTITMANLGYLQLKANPGVWHLRFREGRSRELYEFESITDTLEAQTTTLAGEDGPTIVVNSFEGVTVLPVVKKKLGREQEDILAVENAESGEGKGLWNQIKANFFSSSASTSANATINVFSVASGHLYERFLSIMMLSVVKNTQSPVKFWLVRNFLSPSFKEFLPHLAKAYGFEYELVTYNWPHWLRQQTEKQRTIWGYKILFLDVLFPLNLDRVIFVDADQVVRTDLKQLVDLDLHGAVYGYTPFCDDRKEMEGFRFWKHGYWKDHLAGKPYHISALYVIDLKRFRQLAAGDQLRQQYQMLSADPNSLANLDQDLPNNMNTARQLPIYSLSQDWLWCETWCSDESLKTAKTIDLCNNPLTKEPKLERAKRILPEWEGLDAEVAAVAKRVGHSQVHGNVTKTSGVTESISQYSPVRDEL

SEQ ID NO: 4086 - protein, 1543 aa, Priapulus caudatus
MDAPMKRIMHYMVVVVALLLSLGLSTTEAVRRNKPVIVSLDAKWACTSFILETSEFLAHVNPATFWKFVDEVSEREISIENLTEKEQYELALEIAGALLSPAQLNLLKLSLSIREFSATIEMYKQISKDRVLPEACDAVVDINGALSCKPAEIIQMIDNAKKEKPATYKIDHYYPASEENEPVAILYGELGTPSFKDFHKMLRQAAMDGSTAYILRHYTKPQNEAPKKTRLAGYGVELDIKSTEYKAQDDTKVEGEETAEDEDEDEEEDVEGFIFSKLKSLHPERKDDLAKLKSHLIESNLQMAPLKVWQLQDLSFQAAQTVLSSPKEEALTMLRSISQNFPTVARSLVRTQVPAQLKNEVKENQQSFENYHGIMPGDSAMFLNGLSLDLEVVDIFTIQDVLRDELYTMEGLWALGLRGDDFSAVLRQDLKQESMEYAIDIRHEAIHWLNDIEKDSQYRDFRTGVHEMLRPTMPGMIRNVRKNFYNIVFLLDPSEARSKDLMLLAETFYVHKAPTRIGLVLVVNTDPTVKGRNNAGVAALEAFNWISKNKNVHEGLTFLNELHASTDAGSNIEVKDIVKLLLTKYNLEDMDPIFGDDSEYDYNREFGMKFLEGTGLAHTPQALMNGLVIDENSMDKDSFEDAMLAKMMAATPEIQRAIYMGELVDSDNVVEFLMTRDHVLPRINKYILKTEGKYLDFSGSADEAARTDAIAFSSLSTRDMTVTMSEIQNYMTRKGDPFLRSVTIWVVGDLERAKGRELLAAAIKHMRTSNDIRLGVVHNPKKKGKAPSMLVRSIEAALATLSHQHCKLFINKLLKEENAAQVITGKMAPSELEVGGMDTAMFQSYLESMSDDFINIHQTFSTQVLGFTPGDIGVIVNGKVVGPLSVGEKFLEGDFALLETHTYKASASKIRSKVKYMKSVEENGDEIGSDLIMKISAICLQKEQTRTRQTVRHTGSEHSTLEIAAADAGAPAFDVVAIVDPASRAAQPLSHLLLVLQSALNANVHVLMNCRAMLSEMPVRSFFRYVLDAEPGFTASGERARGPLARFTELPHNVLLTLNMKVPESWLVASVRARHDLDNIRLEDTEAGVTGEYELEYLLLEGHCYDKTTSQPPRGLQFTLGTKANPVLFDTIVMANLGYFQLKAKPGAWMLRLRDGRSSDIYTISDHYGTDSPRNSSDVITLMDSFKSKIIKVRVQKQAGKENEDLLKEEGDDDSASIWSSISNTLSGEKKKEEEKDQTLNIFSIASGHLYERFLRLMVLSVMKHTNSNVKFWFLKNYLSPQFKESISYMANEYGFEYELVTYKWPRWLHQQTEKQRKIWGYKILFLDVLFPLNVKKIIFVDADQIVRADLQDLADLDLGGAPYGYTPFCDSRRDMDGFRFWKSGYWASHLGHRRYHISALYVIDLKRFRKIAAGDRLRGQYQGLSQDPNSLSNLDQDLPNNMIHQVAIKSLPQEWLWCETWCDDSSKKYAKTIDLCNNPKTKEPKLDSAKRIVPEWTEYDNEIATLLEKFHEEQGSSSKVNAILDEKSTASKQKPVHVHTDL

SEQ ID NO: 4087 - protein, 1639 aa, Triticum urartu
MATTGGSRSGVSWAAFALLAVVLVGCLGGGVSVAEIRRQKNVQVALRAKWAGTPLLLEASELLSKEWKDYFWDFIGHWKELDKGSECLTAKCCAQKIVEDVRSFLSEPLASIFEFSLTLRSASPRLVLYRQLAEESLSSVPVKDDALEQISGSGAVEGTCCWVDTGNTLFFNSDDLHKWLEGSGEGATDSTGQPELFDFDHVYPRSNITAPVAIFYGAVGTKCFKELHVHLAEASKQLIVLITGSSSSTCFLCHHITLYVFFCFSNFAALAGKVRYALRPVLPSGCQATSSFCGSIGAADAVTLSGYGVELALKNMEYKAMDDTAIKKGVALEDPKTEDLSQEVRGFIFSKILERKPELNAEIMSFRDYLLSSTVSDTLEVWELKDLGHQTAQRILHASDPLQSMQEINQNFPSVVSSLSRMKVDDSIKDEIIANQRMVPPGKSLMALNGALINIEDLDLYLLMDMVREELSLADQFIRLKLPQSAARKILSAAPPAESNSFRVDFRSSHVHYLNNLEEDALYKRWRSNLNELLMPVYPGQMRYIRKNLFHAVYVFDPASACGAEASLFLTFSLKNDGSKSDEDTSTLIMRLFLYIKETYSTQLAFQFLSDIHRLRNGGDDYSEEPVEVHHVEEAFVDSLLSGAKSHPQDVLLKLQKENLYKQDAEENSRFVHKLGLYKLQCCLLMNGLVHDPNENVSLTAVNSLVLRKLHKNAEAIVVANVVPFYYSYILKDATMNAMNDELPRIQEQVYYGHIQSHTDVLEKFLSESSYKRYNPSITGKSTEKKRFVSLFASYHQEDSVLHDISYLHSHGSGDDVKPVTHLLAIDLSSVTGTKLLHEAIRYLMDGSNRARIGLLLYARSDSISTILLMKDIIDRTISSFSGKEKVLDFLYGLCKYYEGQHMVASSAAGDTLSSIKDKVYSLAAETALPVDDYKAWLTSFSADTILEGIDKLSDFLFGQLGLEFGSNAVITNGRIFVVDDGDSFLNDDLGLLESMEYELRTKYIHEIIEEVEWGGVDPDYLTSKFYSDITMLVSSSMSIRERPSERAHFEILNAEYSAIKLNSMNSSVHIDAVIDPLSPAGQKLSPLLRILSRQIQPSMRIVLNPISSLADLPLKNYYRFVLPSMDDFSSTDFSVHGPKAFFSNMPLSKTLTMNIDVPEPWLVEPVVAIHDLDNILLENLGDVRTLQAVYELEALLLTGHCMEKDREPPRGLQFILGTKQRPHLVDTLVMSNLGYWQMKVSPGVWYLQLAPGRSADLYELPSKLIAIDSLRGKLLHIEVQKKKGKEHEDLLNADDDNHVQEKTDNKGWNTNLLKWASSFISGDASLKKKAEKNTVSISSSNVAAANPSYTSYTILLLEEYHTERYERFLKIMILSVLKKTQRPVKFWFIKNYLSPQFKKEKQRIIWAYKILFLDVIFPLSLRKVIFVDADQIVRTDMGELYDMDLKGRPLAYTPFCDNNKEMDGYRFWKQVSYQLSTNHTTAVDPIIHGSALYVVDLAKFRQTAAGDNLRVVYETLSKDPNSLSNLDQDLPNYAQHTVPIFSLPQEWLWCESWCGNATKARAKTIDLCNNPMTKEPKLQGAKRIVPEWVDFDAEARHFTARILGENVEEIAEATPPSSESDAPKPDHEDSSQDSKDEL

SEQ ID NO: 4088 - protein, 1500 aa, Neurospora crassa
MIRLSQLPWGLAAAIVTATWLPSHHVAASPSVDVALKAAFPSPPYLVELLETAASENATAYFPLLDRIAKGDFAQAKSDKELYEKFLQVLQEDGHVNAEALSTFKLALSLRSAAPRVEAHYQYYTTAVEPYVVADEDGCDLWFLFNGKQYCKASLQASSDHVNSNSRERTLPFDRQFGSGHQEIVLYADITSPAFGKYHEAAMELARKGEASYRLRYKRSLGQSDDALAVNGYGVELTLKRTDYIVIDDRDTGGDKATGDDSQKTIRSDSELVLDEDEEVADIKPLEKSELSPLAVKAASFVMQNESPFDTLLKLTQDFPKYSTKLGKHNVSKEFLAEHEYNRQLLVPPGANVLWMNGVQMVDRQVQPFGLVDMLRRERKLINGALDLGLTGQQAVSLLGHDEVAAAKATEEEPRRFDWRDEPEGGQVIIWLNNIEKDKRYAEYSPSVWALIQHFGQGLPQVRKNLFNLVVPVDFSRAEDVTLVTRQLLAFMKRGIPVRFGLVPLTPTGEAVEQAKVLYHLLNTYGLAAMSTYLEKSLEASSTDKPNEDIFSLATKDREIRPDHEALPFKHISASEELEKQVHRAKHWCERLRADTDIPPAFINGFAIPREEDWLRNMNHKLMVDLQMLQQAVYYNKVNDHTNVPAFFLENAIARRNTFIYPEDANAVKVLNVNKVYSEHQRLFSKVPVVEADDTAPKEDWAVLTVVTDLNSVEGQKLLYFALRFRQEHQGVRLDIVHNPADLANSPSIMNQRVKAKESSLLEVTRLVDLETILEEGKPEADPDFDADLASFLSGFNLKSGDNMLILNGRIVGPIASANDFLKEDFAEFLRTERMNRILPVYKAIEDLGLTDKVSGPLAAAKLTSVTALSGISDTPQGIFDSAPPIRTTAYNRLNTTYTSFHVGNPETATIFFVAVINPASEMGQKWAPILKVLSELEGVHLQVFVNPQTELSELPVKRFYRYVLESAPSFDESGKVKALSATFNGVPPETLLVAGMDVPPAWLVASKVSVDDLDNLRLKDIKAKRNTEHVEAIYELENILIEGHSREFPSGSPPRGVQLVLATEKHPHFADTIIMANLGYFQFKANPGMYSIHLMEGRSSDIFTLDSVGAQGWSPVPGDETTEVALLSFQGATLYPRLTRKPGMEREDVLQDETTPQDESLVSKGLKFAEGLFGSKKPTEKSVSETEHAEINIFSVASGHLYERMLSIMILSVMEHTDHSVKFWFIEQFLSPSFKSFLPHLAAEYGFKYEMVAYKWPHWLRHQSEKQREIWGYKILFLDVLFPLSLDKVIFVDADQVVRTDMYDLVSLDLEGAPYGFTPMCDSRTEMEGFRFWKTGYWANYLRGQPYHISALYVVDLRRFRELAAGDRLRQQYHTLSADPNSLANLDQDLPNHMQFQIPIKSLPQEWLWCETWCSDETLTKARTIDLCNNPMTKEPKLERARRQVPEWTVYDEEVAALAKRVREQEEKKAGEVLEGKKVEEQVIVEEKHEEKEHVIDEL

SEQ ID NO: 4089 - protein, 1478 aa, Exophiala aquamarina
MHPLNLPWRVLVTAPLALSVFSTLSQCGPSVNVALKASFSSAPYLVELLETAALENSSSYFPLLDRIADGAFADLTSEQELYNKFIDILQQGGHLADPESLSSFKFALALHAAAPRVEAHFQYYNTSIQPHLPAAQDAACPVWVYLDGQQYCSPALDRSQQSVDLPNVDDELPFDRVLGQSSENPSSILYADITHPLFGQFHQVVSQTARDGKTSYRVRYRPSTSLESKPLYVSGYGVELVLKRTDYIVVDDRDAQKSDSKDPGQQSLETAEEEELTDLKPLTASEVANLALNAASFIAASTNPLDTLLQISSDFPRYSSLLAASNASKEFVTEHRANREQFLPSGYNVLWINGVQIEPRQINAYSLLDHLRRERKIIASVKDIGLTSSQAISLLSSEVIAEAQANETPQRFDWRDQTESGTEKVLMWLNDLEVDKRYAQWPSNLHSLFQRVYPGQLPQLARDIHNLIVPIDMNDLKDIELAATSLQSLVRRLVPLRIALVPVGTGEVADTYGKLSYYILDTYGLAILMNFFSDVVSAKKLSLSAAEKSFVAVTKERNPREGSEPLSFEDVLKSEHFRRRLDARDSYTERLAIEGPSIPFMINGVVLPRTDNWFELMSARLYADLQLLQQAVYQDVILEDSSVPEFFLVEATPRRNQLVFPHDPKDVKIADVSSLAVTYAEDFANLPRILGWEATLLSDRVHLLLSIDLNSADGLALLSEAIALQHQRPHTDVVILHNPVLESTPSEVACHIFSMVEDGRRDVHIEKLWDLLGGEQPLPTLADDAIHACKKYWAGKRDLLHDIGFSPGENGLWVNGRIIGPLSMTFTSVDMEALLDFERTERIAPVTTAITSLGLEQQFTDALNLAKVTSLIARSLKSDLPEGMRESAPLIRMDRFKRWNSTHTAINIANSEDPSVQVVAVVDPASELVQQWIPIIQTLSQLSGVNVKIFLNPKDRLTELPVKRFLRHVISAEPAFDSNGSLSNTGAFFKGIPKDTLFNLGMIVPPSWLVAPQDSIHDLDNIKLSSLAEGQNVDAIYELEHILIEGHARDVTSGPPPRGVQLLLGTEDEPHFTDTIVMANLGYFQFKANPGYWHISLKPGRSSKIFNIDSVGQNGYSAHPGDETTSVALLSFQGVTLFPRLSRKPGMEEEDVLEAASGAMDYFSKGASFASSALSSLGLTKATSTNAEVNIFSVASGHLYERMLNIMMVSVMKHTKHTVKFWFIEQFLSPSFKATLPHLAEHYGFEYEMVTYKWPHWLRGQKEKQREIWGYKILFLDVLFPLDLDKVIFVDADQIVRTDMMELNKVDLKGAPYGFTPMCDSRTEMEGFRFWKQGYWETYLRGKPYHISALYVVDLKRFRQVAAGDRLRQQYQALSSDPNSLSNLDQDLPNHMQHNLPIHSLPQEWLWCETWCSDESLGKAKTIDLCNNPQTKEPKLDRARRQVPEWTIYDEEIAAVIRDAQVETARGSEVPERKRDEL

SEQ ID NO: 4090 - protein, 998 aa, Saccoglossus kowalevskii
TFIVDPTSLISGELLQQADSFHINNAPTKIGIVFVVNDEKVIDGRNDVGVAIMRAYNFAKSDRGAGRALTFLTRIYKKAGTDEVTVDHVIEQLNKVFPGEDIDDILGEDSDYDDKRMAGKAFFDRTGLGELPQVLLNGVPMKKDEMDPNAFEEAVLTDILQQTTDFQKSVWQGDITDQTDLLDYLMSRPNVMPRLNPRILTPDIKHIDLSSPTGDTDANVYEAFSQLKPGEMSATVANSMKYMTKRDDYSVRPVTNWIVCDLETEQGRLLLRDGIKQMKNSNKVRVGILNNPFREPSDGSHWLARAVNAALQSQTKNNAKNFIVKLLKEENIVEINDGKKTVQDLAVSGMDLAAFNQLFDNKSTGFVKSHQRFCQYILGVVPGGRAIVSNGKLFGPLKQDEEFGLEDFNLLEKYVSGVAAENIQYKMRSLNISRDEIDGLSDLVMKVDALLTANPQTEERKAYDFKASEHSFYRYVLEPEVGFRPDGSFTAGPIAKFNDLPHDILLTLNMMTPEGWLVESVRSPYDLDNIKLSEVESYVYGHFELEYLLLEGHCIDLTTGQPPRGMQFTLGTNNQPVTVDTIVMANLGYFQLKANPGAWLLRLRQGRSADIYEIANHDGTETLTDSDDVVAVMDSFKSKILRIKVQKKPEKMEEDLLVSDDDDEDEDGGIWHSISSSFSSFTGRGGEDNKDSKKKKKSDEDKDQTLNIFSLASGHLYERFLRIMMLTVLKNTKSPVKFWFLKNYLSPTFKEFIPHMATEYGFEYELVQYKWPRWLHQQTEKQRIIWGYKILFLDVLFPLDVQKIIFVDADQIVRTDLQDLADFDLGGAPYGYTPFCDSRKEMNGFRFWRSGYWASHLSGRKYHISALYVVDLKKFRRIAAGDRLRGQYQGLSQDPNSLSNLDQDLPNNMIHQVAIKTLPQEWLWCETWCSDEELKTAKTIDLCNNPLTKEPKLTAAMRIIPEWTDYDNEIKALQDRIANSSVKTKTESSKTKDIHVEL

SEQ ID NO: 4091 - protein, 1489 aa, Rosellinia necatrix
MTIRLLNLPCGLAAALLAAVCIGPSHVTASHSVHVAMKAAFPAPPYLIELLETAAGENATAYFPLLDRIAEGIFVESTTDKALYERFLDVLQQDGHISSSQALSTFKLALSIRTAAPRVEAHYQYYDTAVTPSLAEAKSECEEWVLLNQKQYCSATMANSDGRVTGESQIRMLPFDRSLGSGAEAILYADITKPGFIPFHKALAEMARKGEISYRLRYRNSRRGQLQALPVSGYGVELQLKRTDYIVIDDREAAESSADQPRKTPSAEVVLDGEEEVTDLKPLATSELASLGLNAGSFIMDSEDPFQALIKLTQDFPKFSSSLAARNASDAFIAEHDRNRETAGPSGLNALWMNGVQLTERQIDPYTLVDSIRRERIFIKGAMDLGLTTKEAISLLGDREVTMAKTDDEGPRFDWRDELEDGRVIIWLNNIEKDKRYASFSPSLSTLMQMSYMGQIPQVRRDMFNLVVPVDLGSPEDVSLVVERLQGLVKRALPLRFGLVPLTPTKTAEERAKLVYYLTENYGLPALISFLEPFSAGDQATQSEQKSFEKAIKNRKPKEDAAELSFHDIIASDNYEDQLQLSKRWVERLQANTQVPPVFLNGFAIPRETGWLQTMSMKLSADLQQLQSGLFMGTVTDDTWLPSLFLEGALTRRNPYTYPDGDNPLKVLNVHRVYSEHDDLFSKIPVIDADIDTEKDKWAVITLVADLSSPSGLQLLRSTLAFRRNNPGIRVDIVHNPRSTVNSHEVNSILVDNADKLLDTKNMETLELIASGSASTSDDGYGLALTRFLAFSGLALGSQALLVNGRIIGPIDTEFVFHEDDLQQLFEFEQSKRILPVYQAAENLGLAGKISSPIAAAKLTSITALSTISDLPEGIFESTSIIRTAIFDLWGSSHTAFDVGNPETADIHFVALLNPSSELGQRWAPILKVLSELNGVFLRIFLNPNDRLGELPVKRFYRYILQSEPSFDDNGALHSQGATFKGLPSEALLNLGMDIPPAWLVAAKESVHDLDNLKLSSIKSDVEAIYELEHILIEGHSRQTPGGSPPRGVQLLLGTERDPHFADTIIMANIGYFQFKANPGYYNIHLQEGRSSDIFDIISVGAKGYEAVPGDDGTEVALMDFQGTTLYPRLNRKEGMETADVLEEPNVDDGSDLLSRGLKFAEGILGGSKSKSKSLSAEIHAEINIFSVASGHLYERMLNIMMVSVMKNTKHTVKFWFIEQFLSPSFKEFIPYLAEEYGFKYEMVTYKWPHWLRSQKEKQREIWGYKILFLDVLFPLSLDKVIFVDADQIVRTDMIDLINYDLEGAPYGFTPMCDSRTEMEGFRFWKQGYWKNYLRGLPYHISALYVVDLRRFRQLAAGDRLRQQYHQLSSDPNSLSNLDQDLPNHMQFVIPIHSLPQEWLWCETWCSDESQKEARTIDLCNNPQTKEPKLDRARRQVPEWTVYDDEIAAVDRHRRGTNGSQKAPGGEETNTKSRRFEEGDVHTRTKDEL

SEQ ID NO: 4092 - protein, 1600 aa, Hypsibius dujardini
MQLLFLLSLLTALFSPLARTDPAPPPVKLKPVTAALYTRWAQTPLLVEASEFFFDESPTLFWSFLSRVQAHLKARTQGPWTDEQQHDLAVEISQTLLSPVKQNFLGLALALRFYSARVQMYRQIVETENITRVCADVLVDFGDGMHACGLEEVKAAWTLTSDLENPEKIKKPQLISVDHHYPGSRDAKRTVIVYGNILRPEFWAVHELLVAHTDQVRYIFRHYADSRDLVNVSKIRIPGYGVEMAIKSTEYKAQDDSKIKEGDGALDEQTDEVVDEELDTDIEGFDFGKLKSRLPEKKDQLEQLKSFLLLSSGTELQQLKAWQYQDLSLQAAEKSLRVASLHGGSSTDALRTLRDISQNFPTQAPTLLKIPVREDVKAEIERNREFFAHYHSIEAGGAALFVNGIQHDTDVTDIYVLFEKLREENRLMESLHGFGIQGPDMTSILELDLHPTGGAKYGIDIRHPAVHFVNDLEKDKRYAEWPTSVRELVRQSFPPTLLKAIRRNFYNLILVVDPAEMKANHDILQLTESFYVHKLPIRVGLVFITTDSTDSTGLTDPSIAMYNAYRYMQEKKTPQAALSFLTDVYYSKEAKEKGSLTPEIVIDAFKAKFPQETLEEVFGAGSQYEEGRNDGRKFLEKLNINQTPTALLNGVLLDGSRLNADEFENEVLQNLVAVYGSLQRDVMSGSLTDYSDVVEFLMSKPHIVPRLNSLILAPSEYRILDFSGQSLDPERYTFANFEALKSADKVATMASASFYLTKHEEGDAHPVTLWIVTDPETAAGRELLYAAVKHSKASNDVRIGIIYNPSESSLAGDLRISKAIQVALETQPMNLARNFITKLLKEENVAEIAVGTKTLQDFEVNGMDMVAFNSGLEQVSTDFLKIHSSFAQHELNLKPGETGAVANGYVVGPLQKDFGADDIDLLEKYIESYGAVKLSNELHRLHIFPSGEKLSDVVMMTSALLSGLGSTEDAKKRTKVLYSENENSIINIESRNPQQPAFDISFIVDPVSKEAQKIIPVLMVLHEALNCRIRVLMNCRDKLSELPLKSFYRMVLEPRLTFTDNGSISPNFAVARFPALPQTALLTMNLLPPDNWLTEATSAVHDLDNIRLEEVDGWGVYGGFELMNLLLEGSAKDQSNEQPPRGTQFILGTSSNPNIVDTIVMANLGYFQFKANPGSWTIKLREGRSRDIYAIASSDGAEKDGTDEEQLRVVLGSFSTKMMKIYVKKRIGMEKEDVLSDPKAAGVEKIAGTGILDSISNYWSPEEKKALEASGSDDVINIFSLASGHLYERFLRLMMLSVVKNTKTPVKFWFLKNYLSPQFKEFIPFMAARYNFQFELVEYKWPRWLHHQSEKQRVIWGYKILFLDVLFPLSVKKIIFVDADQIVRTDMKELRDLDLEGAPYGYTPFCESRKEMEGFRFWKNGYWASHLGHRRYHISALYVVDLVRFRKIAAGDRLRAQYQGLSQDPNSLSNLDQDLPNNMIYQVPIKSLPQEWLWCETWCDDASKVDAKTIDLCNNPLTKEPKLTAAMRIIPEWKAYDEEVRRLQDEFQADKKRLSGGGQGAEPRLSGAGQGAEPMQPVLEDDSENDVFVHSRPAAHGGEL

SEQ ID NO: 4093 - protein, 1346 aa, Metarhizium acridum
MEPLKELQDCDIWVLLDDRQYCTPDFDAEAKNELVSAVVKPLPFDRILGIGRDAILYADPTSDGFAEYHQSLSKAARTMNLRYRLRYRRSKSHISRPLPVSGYGVELALKKTDYIVMDDRHSSQSTEQSPKEPVEVLDGTDDVADLKPLSTSELSSIGMKAASFIKDSDHPFDTLVKLTQDFPKFASSIASRNVSIAFAAENKQNRAKKMRGGINFLWMNGAQLTDREIQPFALVNMLRSERRLVDGIRDLGFDGEQAVALLSHKAVSAAKEDDKPFRYDWTDKLEGGRVILWLNDLEKDDRYASYPKSLSSLLQGTFPGQFPPIGRNIFNLVIPADLSNTEDLDFISEVESIRERGIPIRFGLVPLQLSDEAKTRAKVAYFLTENYGIESTISYISQLAKAHQKIADSKTLLSTITENHTLLPGGEDMSLSMILQASAFTKRLLQAEKWVKRLKADTVVRPLFVNGVLVPRDQSWMQSLSMTVSQDLQTVQRGIYHGVLDDDTWTVGVFLEGAASRRSLYISEANEKTLRVLNIAKIYRENADLFDAVPVFDSYAESTQENWAVVTVLADMSSRAGLDVILSALEFRRNNPAIRLDFVDTQDNAKMSSQVNKALKANEAKLKDIETVQDLEELLSEASNYDASDDFAVSVARFLADTKIPTSSQVVIMNGRVIGPIAPEASFDAEDFQQILAYEQTRRILPVYAAVADLGLNEKISDSMAAAKLSSIIALSTLSDLPEGIFESSSPIRSAIYASWNSSHTVIESGDPKKSSIHIVGLLDPVNETSQRWAYILRLLAELDGVYVKLFLNPKVQVEELPVKRFYRYVVEPTPKFDENGSVKALTATFSGLPLNALMTVGMDVPPAWLVAPKLSVHDLDNIQLSAANSDVEATYELQHILIEGHSRDDQGSAPRGAQLVLATESQPLLTDTIVMANLGFFQFKANPGVYNIQLKEGRSAEIFTIESIGAQGWEAAPDDEGSELALMDFQGTTLYPRLKRRPGMENQDVLEHTSNLSQGNIVSKGLKFAEGLLGGKGKSTSDVQHAEINIFSVASGHLYERMLNIMMVSVMRNTKHSVKFWFIEQFLSPSFKEFIPHLAKEYGFKYEMITYKWPHWLRQQKEKQREIWGYKILFLDVLFPLSLDKVIFVDADQVVRTDMMDLVNLDLNGAPYGFTPMCDSRTEMEGFRFWKQGYWANYLRGKPYHISALYVVDLRRFRELAAGDRLRQQYHALSADPASLSNLDQDLPNHMQFQIPIHSLPQDWLWCETWCSDESLAKARTIDLCNNPQTKEPKLDRARRQVPEWTIYDQEIAALDLKRKRRLQSDATETYRTTSEDGEVGDHRSKDEL

SEQ ID NO: 4094 - protein, 1201 aa, Trichomonas vaginalis
MNIHFALMFFSILFSFSISQEIEKQLDVSMTAKWEKTKLIAESLCFFGEFKKDQYQCAVNQINSLEKFSDSIEENIQSFKPCLSESDQKFLQFNLQYHVFSPRIAFYSTIKDNFTTETFDFEPNHKNIKYIDFNSPVKLPENTIIRPITKLNPDKNPQILNGYGVELRPFKYSMEYGVKDPSQLQKGSLSILNDESYEYIKKFEESEEVTFDNLVYKHLESYIMNSEDPLKELKEVVENWPIAMKKVYQSKIDENSQEEEISESVMTLNGRVIPFETFDPFTFSSQIFEIQKIQKILTEKFGLTPKKANILMETETRKSNLVIDVRGDHIIWLNNLETDKRYSKYSRKIDSLFGKLTEPPKVRHNLVNMVLFIDPSSSKDMKLLLEVHKLLEKGYAMRVGLSPLHRNNNENQIKALYDIFTNYNPFKYVSLLVKGDSIKSAYEKTTKKEYSEDFSEESEEYISLIDSFCEASNINETAIWTNGDLYTGNDLEDKISISPLETLQILRNLLMENEISGDYLSFILRKRHAVKRLIPEISKIRPISTKISQEKIEKIEEFIQFSKSINYQKRDEEKSLVTCWLKIYNNKASIEEKIDEFFKSRHQSSVRLSFVSEFPSLVEQEILNKNNDAVLFLNGRIFYFNESFEYFDDLFSWQSLLSSQLSETIEDEDLLMFWSSYLLSLNEREIEIKHFHPNEFNPDEKFALNIDGELKSLEVKCVIDPFTKNGQKIIGFLCHFSDLSFGRISLHICPSTRDLKIPKSYYRYVTDERALLSSFNNSMIYSILLETPETWMVEQNRVDCDVDNVLGSDLQNGYRYQFEYVLSYLVVEGFSYDLQNNPSENVQIKSFESDTTVMSNNGYFQLKTTFPTILDISLFSDFSKGNFEIMSGNKIVFDSFNWRHFSVRIQRKTSKIQRFPYVDDGKIHVFGVCSGRLYERLMKIMILSVKQNSQNSTTKFWLLKNYLSPKFRSELQKMSLEIGFEYELVSYHWPHFITRQEEKQRVIWGNKILFLDVLFPASLHKVIYIDADQVVRTNMRELMTMDLHNNPYGFTPMCDSRKETEPFRFWHQGYWKEHLQGKKYHISALFVTDLQRFREMKAGELLRDYYNSLVLDDQSLANLDQDLPNYAQERIGIYSLNQEWLWCETWCSDETMDKAKTIDLCNNPLTKAPKLKIAKERIKEWPGLDKLASTFEEKQEKNDEL

SEQ ID NO: 4095 - protein, 1877 aa, Asbolus verrucosus
MKQFSDLPSPENQSDSGSTKNSFNISSSSEDNRSFQLRNAYRSKSLSNISPDNYTPREIHRIKERLLRTNSRLERSTFRSFTRKQKMTLTSLALVDFVSFCSMSIMAPFFPREAAEKGLSDTLSGFVTLEYVTNYTWFTTFCIVIRGFEALGASAFSTASYVFVVNTFPQNIGSVLGILETFVGLGMSTGPALGGVLYSFNLTPEKIGLIFLLFSGLYGVSSPAWGWLADKINNHWSMMVVGLFMCTTGLLLLGPCPYIPFLSSTLWLNLVALSILGISVALALLPTFQGLLSSAISSGCGDTLSTYSVVAGIWSCVYSLGEVIGPSLGGFLLQHYGFPITSTIMATMTFCLAVLTFFFFIIKNNYCNDQDCASDSGISESWRSSSSEDVSTETTPLIMSTMDASYKMYTEEKLQYYGKSRKHDTENGEIDSNQVTDIRGTVTITARGSCEQSSAVKCDHFVDFQDAVSDFNTGCVGVFTVYVRRELSYEKVKISAERNLPNCPVIADVGGTLTCDATALKQLIENYDKNGDKRIDLFNMDTHYPGSENRTKVVVLYGELGSKEFASFHNILKQEAEEGTIDYVLRHYVQNESNKKLRLSGYGVELQMKSTEYKVQDDTQLHDDPTSEESSQEEEEVEIEGFDFKKLKTLFPDLKKDLDKFRQHLEESSNEMAPLKVWQFQELSLQAAERIMSAPKDEALKVFTNIAQNFPMQAKGLVKTVVNPDLKKEMKLNSDIFASTLNLQPSDTALFINGMFYDVDLVDVYSILDVLRQELRAMEGLHKIGIENNRLASLLALDFSESGSGQEFAIDIRDSAINWVNDIENDSKYSRWSSSVMELLRPTFPGMIRQVRKNLFNLVLIIDPTEPKSRDLVKLLESFVVHTAPLRVGIVFAVDSSTELTGLADAGVAMQCAFNYLSQKKNPLAALSFVKTVLGSADEEVKVENVKDELKKQFGDDYLDVLGEDSDYDFGRQLAIDFIQRTGQRVLPQALLNGIPLPSSSLNVDDFEEAVLQEVMSQTSSLQKAVYRGKLSDGDDVLEYLMNQPNVMPRLNERVLNKDQSLYLDMTGTATSTMDPEALAKLSARDMTATAIDNLKYFYVPKKGKQLHTMTYWITGDLKYLESRQLLLAALQHAKSENHVRVTFLPNVDGSVRNMINKLVLTALNEMPAEKALDYVLSLLREDKAAVDLESGGRVKFPPEFAGKVNLQELNLKMLRVYSRRVLNLKGGERAVVANGRVLGPIENGETFTTEDFALLERFSSATYLDKINKALEKDSEEAEEISSNSFLKIVSLVVSRPQTRTRFEISSSGDEYSVLKIPAAHQDKVAFDLVAVVDPVSRGAQKLGPILQVLQDVLNVNIKVFLNSVEKNSDMPVKSFYRFVLEPEIQFTEEGKQTAGPIARFNNMPTSPLLTQNYHVPENWLVEVVRSVYDLDNIRLEDVDSNVHSEYELEYLLLEGHCFEATTGSPPRGLQITLGTESEPVKVDTIVMANLGYFQLKANPGAWILRLRQGRSAEIYDIVNHDGSDTPANSSDIKVLISSLRSHIVKLRVQKKPDKYNMDLLSEDEPNSGIWNSITSSFTKTEEEGEEKLNIFSLASGHLYERFLRIMMVSVLKHTKTPVKFWFLKNYLSPQIKDFLPYMAKEYGFEYELVQYKWPRWLHQQTEKQRIIWGYKILFLDVLFPLDVKKIIFVDADQVVRADLKELQELDLGGSPYGYTPFCESRREMDGFRFWKHGYWRNHLQGRKYHISALYVVDLKRFRRIAAGDRLRGQYQALSQDPNSLSNLDQDLPNNMIHQVSIKSLPQDWLWCETWCDDESKAKAKTIDLCNNPMTKEAKLTAAMRILPEWKGYDEEIRELQKKIDSGLLDADPAESVDIT

SEQ ID NO: 4096 - protein, 340 aa, Lingula anatina
MASAGNDRLKKHSHTLRVGIVHNPRSPSTKLYRGSQIPLAIHTALGSQVPHIARSFVTKLLKEDNIHAILEGTESLSDLEVHGMVMEVYLKALDVQTMAFLQFHSAFCTQVLGFEPGAQGVIVNGRIIGPLKDQKTFIEDDYNLLEKYTQKSSAEKIVQMLTGFTEDTKRVSDMVMQVGSLLMSNQQASIASRTDVQFAGDQHSVLKIPAKPEEPAYDVTFIVDPVSREAQKVTPLLRDLPNNMIHQVNIKSLPQEWMWCETWCSDDEKSKAKTIDLCNNLQTKEPKLNAAKRKVAEWEEYDNEERRIFENFTSNKPTLGSLSADHIEAQETSTQPRDEL

SEQ ID NO: 4097 - protein, 1694 aa, Rhodotorula taiwanensis
MRLAGLLVLVLTGAASSAEAYRSPPVVTSIEASWPAADLVTQYFETLSLEAPKLLFPVIDFIVSFPHSHRALKHLKLHPATVATADRYAAQGINPIFAAEREVRGNDTLAMIEASLIRSQLVVRKPGLFDSLRLSLANREASVRIEGTRRIWEDRVAELEGGERVATAGRSMTPAEENPLGEVNAARTCESWIDVAGRVACTVQEFWSIVGEEQRQGFDPLILPPVISAVSPLGFYELDHISPGGPNQHLPRVVLYASPVSGAFPELFTFLYQLSWPRGETVRNVETGKTTRRPRPHPPRLQFALRWKPSAAAQAAPRKLVLSGYGAALDIKKSDYLAIDDRLAGGTAAAAGAASAKGDLPLLEIEGEAPLKMEAVRKADVADLAVRTAQFVLSAEDPFDAFVDITSDFPRLAAHLPKLVPHPDPHLIGEVSTNQMRSPLTRRPAFFLNGKLLAEDEVEPFALLRLMRQERQIITDLLGLDVYMTGAMARHILIAGGPKEPVVSRDRIDAELLGDLYDSTDRHEGGKVILWWNDLEKDRRYKSWSKSVRELLRPSYPGSMTQVARNLNNLVFIIDLSDPASIAHITNNIRQYVSRGIPIRFGVVPIVGPFGDTSMRTLMAQMLWYLSDKAGRSVTMSFLDQVAQATQGARISEDLLQRAYSQLRAQTEDVDGDELVPFERVRAYETGQRSRTVPGRLASTRNYLERLGIAEEAETERSGAVFLNGAHFPLNEDFAQNLQRTLGLHTQFLAQEVYMHSLTDDDEVTTYFAELPRTHKRRNPHIVPSDDNHPLKIVNLLHALEGATTSWLEEGFFEGTSGKMNQTTGNEIEAPPAPASLFVVADLDTPIGAELARNGLRLADSTTKVRVVLLHNPADSTIETHPWSLSRVYWHLIETKAVFDTLPKELAQWIDLELTKEGPSSTAGRDWNAENPLKKLLPSGVAGRDAGEAALYWDLLQLTRYRFGFEAGQSGLVLNGRVVGPFAAEYFTLFDLRTLLNLELEKRVEPLVAAVNSSGLALEGLLRAQISRIYMIANSVVGAAHLPDQATGMFATSTGERRRDYLQLHGNHTAIPAKFANSALYEIAVIVDPASPIAQRWAPILRTLNKMNSTTVSVYLNPTLHLTEVPIKRFYRFSFEHAISFDVAGAEAQPEIRFDAIPPDVLVTYAADVQRSWLAFPRSGLHDLDNIKLADLAPQHAQRGIEAILELEALTVEGHAREVPSSRPPRGLQLELFRPVSSRDDDTSASIVMANLGYFQLKANPGRWHLDLRRGRSSEVYEIDSVGAEGWKSRVIEQTGQTFSVSTLEGKTLYPRFRRRPGHEQTELLDDADAPASRTPSVVASLWDRLKTMLPFVAPASTDLVVSGKRADINVFTVASGHLYERMAFLMIVSVLRHTKSTVKFWFIQNFLSPSFKAFIPHMAREYGFDYELVTYKWPHWLRGQTEKQRTIWGYKILFLDVLFPLELDRVIFVDSDQIVRADLKELVDLDLQGAPYAYAPMGGYDGEKPEMEGFRFWKTGYWAKHLQGRPYHISALYVVDLDRFRQIAAGDLLRQQYQALSADPGSLANLDQDLPNNMTPNLPIYTLPKEWLWCETWCSDEALATAKTIDLCNNPLTHEPKLQRAKRLIPEWTEYDDEVAALAKRVAEAQGSGESAAFGARADELEQAVQQQEERDAFVGEVVTGEQVSPDHVKDEL

SEQ ID NO: 4098 - protein, 1708 aa, Rhodotorula graminis
MLLGGLVGLLLAASSACSSASPPVTARIETAWPAPDLVTQYLETVELEAPGALFPLIAFLASHPHSTKFLRDPLPPLSQHRAQRFANAGTNPVFAPEGTLTPADTFALLEASTTRSVLVRDKGVRDGIRLALANRETTVLLEGMRRVWEERESEVGAALAADEGAPARAERVRDDDDDEAAPSCESWIDVRGERACSEDEFWDLVGPEQKDKSTPIQLPDHLDSHPRPRLYPFDHVTPRVAALPRFVLYGSPTSPSFPRLFTFLFSLSNPKSPLQSNPKAQPPSALTGAPSPTVAPPARSYSPRLQLVLRWKPSTKAQLEQKKLVLGGYGAALDIKKSDYLVIDDRLTGASSSSGAKPAHEVLGIDGGAAAKMEAVKKADVAELSVRTAQFILGSDDPFSAFVDLTSAFPRLASHLPALVPDPSPHLMSEVSTNQMSSRLAMRPHFFLNGIALSDADADPFALLRLMRKERKILADLAALSPHLSGSDVRDLLINGGPKAKASGGMRDRIDADVLGELYDATDRDEGSQVILWWNDLEKDRRYQSWPTSVRDLLRPSYPGSMSQVAKNLNNVVFLVDLSQLVSLALITENVKQFVSRGIPIRFGVVPLVSPLGAEDAIETHLAQLLWYLTDVVGRGPAMSFLASLQKAANGRRVTVELARRKYEQVAGRLPPIDGGELASYDEVQKGVGRYKASASHSRLNKARQYLRRLGVALPNSLEEEDDDELAQPGSFFMNGAYFPLDDDFGQNLQRTLALHTQFLQQEIYLQSLTDSTDAKSFFANLPTTHKRRNPFVFPSDSNPLKVVNLAKAFDGVDRTFTHGSYIEGASGDLNETTGYDIEGPPAVATMLVVTDLDTPTGAQLAKAALQLADQSTKIRVSFLHNPPSFDDVPHAYALSNTLWALHKNKKLDEILPGELISWIDLSISSEGPEGGAGLSWQPENPLKELLKTKGVDKERAFDALLWWEELQWLVAKLGFGPGENGVILNGRVVGPFPDGIFGLPDLRTLLAHELEKRIEPVVAAFNSTVFDLMHASRSTISQAYNLATSIIGFAHLPDPAQGMFGGGPVERTRSYNALLSDHSSVIGNLSRGALFEVAVVVDPATELAQRWAPVIKTLAGLNTTHVRLYLNPSLHVTEVPIKRFYEYVFEPEPRFDSTSGNEIEPSIRFDNVPEDVLVTFGVDAQKSWFAFPKTSVHDLDNIRLADLPEWSKAEGVEAVLELEALVVEAHARELPSSRPPRGLQLELKSGVESSPHEQRVDTTVMANLGYAQWKAAPGVWRLGIRPGKGADVYELESTGADGWKSGNVATTGDSFVVSTLEGLTLYPRFYRKPGQELTELLDESAASGTAGKRESGGVVERIKSMLPFFGGSSGKDLVSTGKGAEINVFTVASGLLYERMAFLMCVSVMRHTESSVKFWFIENFLSPSFKAFLPHVAAEYGFSYELVTYKWPHWLRGQKEKQRTIWGYKILFLDVLFPLELERVIFVDSDQIVRADLKELVDLDLDGAPYAYAPMGDDREEMEGFRFWKTGYWEKHLQGRPYHISALYVVDLDRFRQIAAGDRLRQQYQALSADPNSLANLDQDLPNQSWRDIPIYTLPQEWLWCETWCSDESLAKAKTIDLCNNPATHEPKLQRARRLLPEWSEYDDEVAALAKRVLANDSSSSSSSAAAFQAHAHELEQAVQQEQERESFVEEQAQAVPAASERVKDEL

SEQ ID NO: 4099 - protein, 1603 aa, Capsella rubella
MGTNLRSWLYLILLFFVVVGVNAQNRRPKNVQVAVKAKWQGTPLLLEAGELISKESKQLFWEFTDAWLGSDGDDTGDSDCKSARDCLLKISKQASTLLAQPVASLFHFSLTLRSASPRLVLYRQLADESLSSFPHGDDPSATDCCWVDTGSSLFYDVADLQSWLASSPAAGDAVQGPELFDFDHVHFDSRAGSPVAVLYGAVGTDCFRKFHLSLAKAAREGKVTYVVRPVLPLGCEGKTRPCGAIGARDNVSLAGYGVELALKNMEYKAMDDSAIKKGITLEDPRTEDLSQDVRGFIFSKILDRKPELRSEVMAFRDYLLSSTVSDTLDVWELKDLGHQTAQRIVHASDPLQSMQEINQNFPSVVSSLSRMKLNESIKDEILSNQRMVPPGKALLALNGALLNIEDMDLYMLMDLAHQELSLANHFSKLKIPDGAIRKLLLTTPLPEPDSYRVDFRSVHVNYLNNLEEDDMYKRWRSNINEILMPAFPGQLRYIRKNLFHAVYVIDPATACGLESIGTLRSLYENQLPVRFGVILYSTQLIKTIEENGGQIPSSNSQVIRLFLYIEEHHGIQTAFQFLGNVNRLRTESADSSEEDIIEQDYVDGAFVETILPKVKSPPQDILLKLQQEHTLKEASEASSMFVFKLGLAKLKCSFLMNGLVFDSIEEETLLNAMNDELPKIQEQVYYGQIESRTNVLDKLLSESGLSRYNPQIISGGKNKPRFVSLASSTRKGESMLNDLNYLHSPETSDEVKYVTHLLAVDVATKKGIKLLHEGVRYLIGGSKSARLGVLFSSSQNADSNSLLFIKFFEKTASSFSHKEKVLYFLDKLCSFYEREYLFKTSVDSASSQIFIDKVLELAEEYGLSSKAYRSCTAESLNEELLKRLAKVAKFLSWELGLESDANAIISNGRVIFPVDERTFLGQDLHLLESMEFNQRVKPVQEIIEGIEWQDVDPDLLTSKYFSDVFMFVSSAMATRDRSSESARFEVLSSEYSAVLLGNENATIHIDAVIDPLSPTGQKLASLLQVLQKHVQTSMRIVLNPMSSLVDIPLKNYYRYVLPNMDDYSSTDFDVDGPKAFFANMPLSKTLTMNLDVPEPWLVEPVIAIHDLDNILLENLGDTTTLQAVFEVESLVLTGHCAEKDHEAPRGLQLILGTKNRPHLVDTLVMANLGYWQMKVSPGVWYLQLAPGRSSELYVLQEGSDGSQDRSSLKRITIDDLRGKVVHLEVVKRKGKEHEKLLVPSDGDDGVQQKHERRSWNSNFLKWASGFVGGRQQSMKGTSEKEHEKGGRQGKTINIFSIASGHLYERFLKIMILSVLKNTNRPVKFWFIKNYLSPQFKDVIPHMAQEYNFEYELITYKWPSWLHKQKEKQRIIWAYKILFLDVIFPLSLEKVIFVDADQIIRTDMGELYDMDIKGRPLAYTPFCDNNREMDGYRFWRQGFWKEHLRGRPYHISALYVVDLVTFRETAAGDNLRVFYETLSKDPNSLSNLDQDLPNYAQHTVPIFSLPQEWLWCESWCGNATKSKARTIDLCNNPMTKEPKLQGARRIVTEWPDLDLEARKFTAKILGEDMELNEPPVAAATDKPNPPPSNEVEDSEQDLESKDEL

SEQ ID NO: 4100 - protein, 1614 aa, Apiotrichum porosum
MPAGFQLCPLLPAKSARLETPHSAWPVTCFATLSIAISTLSTAAPTPKSTIMWLAGAVLTALAGTSAVSASLSPPFSVTVETSWAAPPLLLEILEVAHDEDPSAYFPLLKLLTKHSLTLGPSPTPQKVLETALDVVHSHDILPKPGSRSTFELALALHTAAPRIAAAYADYTVDEAKLDVAGCASWVEWRGKGFCDAEQLQRDVERSIDERGRAPDPRTPSRPFDRVSHSPLGDGPQAVLYYSPSPEALPLLEYLDTHARAYPAFQYVVRYRPFPADESSDAPRAPRTPLAGYSVEMALKNTDYLVVDDRITAGGDGAQTAFKDSKDASRSNPFSEILGEDPWSESAIPLAKEEILDLGLKAVALIKAADKPLDAFIELSQDLPKYSAALARHVEVPEDIRKTSQRLAVRHPLGPAAFLNGRVLKDTEMNAFGLLKAVRRERDIMTSLLAIGYTPKQAFQLVSDELIGHAETEHDPLEGLVDVSDRIEGGGVITYVNDIEKDRQYARWSPYMQEYLRQIYPGQLHLVRKNTWNTVLVVDLATARGIEAIASTAGSMLQRNVPIRFGVVPLFGHVNEDSGQIARLVLYISGKWGAMKTREFLNIIHASVPKGSSPMIRVHPQVMQGAYERVARGEGLTFEEVMESPELATQLEVTLKYLNRIGASRDDSPLGSVYVNGKYAAFSGTWTQHLTGTLSQHLNHIQEMVASGVDFEEGDGEVATYFYDLPTTAKHRNRHIVPTEESTLRIFNLMDIFPDNTEYIDTEFMYPDAEDAGTPLTTWIVGDLDSDDGRSLVLDAVKHIQGPEASSRLGFIHVPSPESSNVQGYRLSTLLFQFYESGAFSLVKPDQFQSILEEIETKGNVIDGGDISAQSNTDPLNVLTADGWNVADAARAAEFWKLGTAVADSLGLQSTKPHILMNGRLVGPLTADEFSEVDFDTLEVYELRKRVHPVINLVQTFWEDPKELSRDTVAGIVSLTSSVIAWAYQATGAEGIFIQAPGPRSRGYEQIDDGEVSFTIGDSSTALFHVAAIIDPLSELAQRWTPLLKLLANIDHVAVTVYLDPNTKATDFNVKRFYRSAVPSTLHFDVDGYEVAPAVTFSDLPSTPIFTLALDTPGSWVVRPKDSPLDLDNLLLGRLYEPTHVQFDLYQLVLDGHGREGGNVPPRGLQLQLKDGDDVVSDTQVMANLGYFQFKATPGVYNLAIRPGRGEEVYDVESVGGDGWDSPTVNITGPSVTVDALDGTTIYPRFARQPGMENADVLAESVVPESFSSSVLSRMKSMVGLNEVKPKSRHADINIFTVASGLLYERFASIMILSVMKHTDSTVKFWFIENFLSPTFIKFIPHLAEEYGFEYELVTYKWPSWLRAQTEKQRIIWAYKILFLDVLFPMDLDKVIFVDADQIVRVDMKELVDVDLHGHVYGYPPMGNDRVEMEGFRFWKTGYWKEELRGLPYHISALYVVDLKRFRQLATGDRLRGQYQALSADPNSLANLDQDLPNSMQRQIPIFTLDQDWLWCQTWCSDESLATAKTIDLCQNPLTKEPKLVRARQIPEWDVYDREIAAFAATLGSGESGALAANVDDLAAGPGSAAAKHQEKEAALEPEPHADADIEGAPHDEL

SEQ ID NO: 4101 - protein, 1564 aa, Rhizoctonia solani
MRSLSALGTLGVAASLAAAESTFSPPVKVSLTTAWAAPPLLLEILETAAAEHPGRYFEILDALTDRSSAGLLGPITEPVHKPQYVYNTALTLLQSRGFLTEPNALSAFEKNMALHSATPKIQAFYQLFGDPSKAPGCESWVEWSGKQACTPEEADKLLTEAPTDVHIQTFPFDHIQKFADRECKHPAIFHAALSSQNFYDLHMYLSSKSENPEFCYVLRYTPPKDATIAGEHSRNTLSGYGVALDLKKMDYLALDDRGLHGKGDASDETTEESAKWEDYQEISSLPLRATHLVMSSEDPLKALSHLSQNFPKHAVSVARRWDTGRTDELKAKHESVEAEVQANLHMVSGAGNMVWLNGVALPEADINPFSLLRLLRREHQTVGSLMKANLTSEQAIHVLTNPAIGKASTTSGPTDGVFDASDREEGGGAIVWLNDIEKDQRYARWPTSLTVLFRPLYPGQFPTVRRNCFNVIAALDLSRTSSISFIVQLANNLISRMLPFRFGYVPLIETAESRQVARLMKWMMDEYGLEKASQYFSVVLTPEDTVNFTVLEGAYLQFTTQMPPPSGIVPDFSSFTADPLQIQMVGHEFVPDEGLQPAAAYAKRLRLGAQDGAGKGHVFINGKYLAYDDNFLRHLQTEMGAQVNFIQEQLYAGALADAPETDVSIFMYDLPTTAKRRNKFIYPSGNTKIYALDNLFDSAGATKQLKDSFIYPTGENPTPLTIWVVGDMDNDETLTLAIEGLRGMSDGAKYRFGFVHTPSVDPSDVPSTQQPLVSPMLARLAATGNYAEFPPSELAQILEEAKQLVVNAAELNIQDNPTLLNLNNRLTGITNEGVDLEELKRTNAAGNALAKAIGLKSGERAIVINGRVIGPLAGSDFVAEDFGSLVNYEAAKRVTPVEVALTSVREDLAELDRPAYADLVARVSSIISSVSVPDPSEEGLFQSKSLARQRSYNELTGKDCTFEIGDNSTALFHIGLLLDPLSESAQKWTSIIEWLATVPQTHIHVRLNPATALTEMPLKRFYRYNIQPRLTFDQDGFETRKPVEFHGLPVEPIYTLAMDVNPAWLVRPYISEADLDNIHLASLSDPKAGVEAIFHLDHLVIEGHAREDNNAPPRGVQLQLTSLDGTPTADTQVVANLGYFQFRTGPGAFRLEIRPGRGRDVYTIESAGNEGWNSGHVNVTGTEITLTSFEGHTIYPRLSRKPGMESVDVLAEPEKEESLWDRVSSLWGSKPTEAVPESKQADINIFTVASGLLYERFVSIMILSVMRNTKSTVKLWLIENFLSPSFLEFIPHLAEKYGFQYELVTYKWPSWLRAQKEKQRVIWGYKILFLDVLFPMDLKKVIFVDADQIVRTDLKELVDLDLQGAPYGYTPMGDDNEAMEGFRFWKQGYWKDALRGKPYHISALYVVDLVQFRKMAAGDRLRGQYQGLSADPNSLANLDQDLPNNMQDQVPIFSLDKDWLWCETWCDSARFDRAKTIDLCQNPLTKEPKLARARQIPEWTSYDNEIAEFARSLADSGKLRSRAISGSVDALASVGKKVTSTNEESSAPTPDEETTEMPREHEEL

SEQ ID NO: 4102 - protein, 1440 aa, Candida orthopsilosis
MIPWQWITKLSFTICIFSILGSADSARSLTIDVKAPWKKVDFVSNFIESIAGFNSSLYVPTLEGIFGLGESDEVEGRSDRDIYEHLLNQLQLEPTTIDFINFNLVNKKYSARVASHYAHYEMVIEQFGERLKKACAHDSFGNVVETKNGLVPAWVLYNDKIYCSVNDLFALQTDKSNQETFLFDRIIGHNDESPLLAFYGDPTVDQTKGFLKVLYEEARNGKLRFVWRYIPSFSKQLDSLPGYAVELPFRDAEYSPQFRKDLNKDFDLIKGSTAISKVGEDVNDLGIKLTSFILSNRVKSTKFELLQTLVNNLPKFYFYLNKLPQSANYKKVKSKVVGNEQMGLSKESFGIYINGSPIHPLELDVYKLADKIKEELSMIQDLIKHGFNSVQAKLLLSKFGLLSAVKQAQFRTGNTLMGNNENRFKVFQHAFNRKDSSKGGVVFINDIESDSNYGEYSTDRQEVYLGVESRKLKPNQIPPLKENIHDLIFALNLASKKQLKAFFKFSKIILDSGIPQQIGIVPIIGEDPLDEQLATRLYHITGLSDQKEALALLYKYMESSGPDEVHDLLEKVNIPSGFVVDFDTVLNKFSIESPSVIVNGVIHDLFASNWQIAMSKQIEQDNALIKSQLRSGDMNGSLKDILYNNAKSERNLRIHPLDPSEIIYKRIDHDLMRSSIAFKKIDKELENHATIWLVSDFSNSKMVDQLINLLNLMRRRSIQIRVVNVGNSEMFSKLVEKRRLNALTNAEINGIISSLKESELSTGLDEEILHVLEEKHLPVRHSYLLVNSRYIRLDPVILSVDELSQLIEYELSQRLRLMNEVALTYVDEFPQALYEYNSVVSGIDDMDWFDLVSSIITKSFHVDDKTFINDVNRFDFGSLDMSNSIDYEKYDESKLVDVLVIIDPLEKKPQKLINILDAVKDFSFVNVRVLLQPKLEYKREELNERFYQGVFPPSVPQFEDSGYWNDKYLANVVSLPLAIYSINMDVPKRWVVIAKSSPSDVDIGSFKSNKSPISLSFELSNLLIEGNARDIHTGKAPKNLQLQISNGTHSDDTLVMTALNYFQLKALPGVHLLSVESNHSLLSASDNKFDPNVAEIDAVPVSMFSLDGVALQIRTTSRKEKVDQKTKHADINIFTIAGGHEYEKLVGIMIASVKKHNPRKSIKFWILNNYISPQFRALVPLLVKKFDIEIELVTYKWPNFLRKQSSKQREIWAYKILFLDVLFPQDLDRVIFIDADQICRTDLGELVNMDLEGAPYGFTPMCESNKETEGFRFWMSGYWSEVLQDDLKYHISALYVVDLPKFKSIEAGNRLRAHYQKLSSDPNSLSNLDQDLPNNMQRQIKIKSLPQEWLWCETWCSSDTFNEAKMIDLCNNPLTKENKIDTAKRLIPEWVEYEKEVLALIDQTDDILKEEEEEKKDLTIDDNLHGDEVTDDDDFYHDEL

SEQ ID NO: 4103 - protein, 1490 aa, Monilinia fructigena
MGGFRLPWGLSGALLASTYLHSICVTAGPSINVGLQTSFPSAPYLLELLETAATENVSSYFPLLDRIADGYFAKASTDKDLYEKFIQVLKEDGHMNAEALSSYQLALSMRVAAPRIEAQFQYYHTAAEASIKTEKDSSCPTWVLFNGHQYCSPTLDEPHGTVTGDSQIQELPFDYVLGNPTGPHSVLYADITSSTFGQFHKTLVKTAREGKTSYRLRHRRAIDAGSKKPLIIPGYGVELALKRTDYIVIDDRNDEDASKSTTETEVKFEDEEVADLKPLSTSELSSLGLKASSFVMQSEKPFDSLIKLSQDFPKHSSAIASHEISSDFLAEHNYNRGQLVPAGYNVWWVNGVQMIERQIDAITMLDILRKERKLINGVRDLGLTGPEAVQLLSHSNISEAKSVGDVQRFDWRDEIEGGSVIMWLNDIEKDKRYADFPAALGALLQRTYPGQLPSVRKEIFNLVIPVDFSTLEDISLVAETLANFVKRKLVLHIGLVPITTSPAATEQAKVLYHLLDVYGLSGAIAYLEASVVNGVANPTEKVFEAAIEGRAIRAEKVATSLKDLLKSDHYNDRIDASSRWTRRLSADGEFPPIFVDGVALPRDENWVQTMVQRLTADLQIIQQGVFNEIFKQDSYIPDFFLSEATARRNALIVPESDKNLKIIDVTSLSNQHGDILSRLPKIGADLASSKENWAHMVLIADLSSVSGLDLLLSAVKFQESAPSLEITIAHNPSTEKEISDFSTQLFSHIQKSSDKPFVAAQDFPDLASPETLELDHATKGSAQAYWKTAGPLIRTVGLLPGENAILLNGRLVGPIPTGSELNQDDFEQLISYERAKRIAPVYAAMKALDLSDKITDPLASAKISSVVALSSVSDTPEGIFEQAPTNRISAFDIWNSSYTSIKVGDSSTATIHMTVVIDPASEQGQKWVPIVKVISELEGVYVKLFLNPKERLQELPVKRFYRYVLESKPNFDGEGALVAPGASFTGVPQEALLTVKLDIPPAWLVAPKVSIQDPDNIKLSSIKSDVDALYELEHILIEGHSREMPSGSPPRGAQLILGTEKDPHFADTIIMSNLGYFQFKANPGLYKIDLKNGRSSEIFKIDSIGSKGWSPVAGDESTEVVLMSFQGTTLYPRLSRKPGMDAEDVLEAKADSAMDYVSRGLHFAQGILGSKTKAAAVEEQAEINIFSVASGHLYERMLNIMMVSVMKNTKHTVKFWFIEQFLSPSFKDFIPHLAAEYGFKYEMVTYKWPHWLRGQKEKQREIWGYKILFLDVLFPLSLDKVIFVDADQIVRTDMIELVNHDLQGAPYGFTPMCDSRTEMEGFRFWKQGYWAKFLRGLPYHISALYVVDLRRFRQIAAGDRLRQQYQSLSADPNSLSNLDQDLPNHMQQVLPIHSLPQEWLWCETWCSDESLKEARTIDLCNNPQTKEPKLDRARRQVPEWTVYDNEIAAVDRKRKGTNENLNGNESGGTKNTKSRTLEEVLDTKTKKDEL

SEQ ID NO: 4104 - protein, 1514 aa, Ooceraea biroi
MGRLIFFYTFLLCSTQLGADKKINKYVTTLINAKWNETPLVLEAAEYLSDENPNYFWKFIDAFSRRINNLVIATEKENYDIILELAKMYLSESEMAVFKLGLSLRIYSARVEMFSQMAVNKNVSTHECNNVVDVGGTYTCSLEEIDTLLEQDTWKTADTYDVDHRYLTTPESEKVIILYGQIGTPTFAKFHDKLKSIAETKGINYVLRHYVKDRVDKKLRLSGYGVELQMKSTEYKATDDSDIKDNAGKNSEVANDGVEEIEGINFMTLKKLYPEQHAELDKIQTHLLETSHEIGAFKVWQFQELSHQAAERIMKSPSAESLNVLTDISQNFPMQAKSLIRTKVNGDMKKEMKLNQEIFMASLSIQPTDTALFINGLFFDLEAIDVLTLLESLRSELRVMEAFHKIGISNKKMGKLLALDLSSGTDNQNFAIDIRDSAINWINDIENDSRYSRWSPSLTELLRPTFPGMLRNIRRNLYNLVLIIDPLNEESMSLVTLAQSLYAHSAPLRVGFVFVMNHNTSLTGLTDARVAVNNAYHYFVDTRSAKEALHFLAELGNYIGPDGADVEDIKKVIKSKDSSANVNYILGDESEYDVGRHLANDFIKRCGLKKFPQALLNGVPLTPGQINSESYEEAVLSAIMSQTPMLQKAVYRGEVTEGDDIVDFLMNQPNVMSRLNERIWKVDKNAWLNLIGTIPENEDYTKWSSQDLSSYLMTKMHYFFVPRRSNTLHQYSFWIVADFNSLLGRQLLREALEYVESNSDVRISVIVNAEERANPKSDVNKIVLAALAALSPERAILYMRKIIKDDAAALIANGNFEIEDEVAALLENQSSILSLHQHYVKTVLNVDKEARVILCNGRIIGPLDSDEEFTDDDFSLLERFSQKTYGDKLFLKLVIFNDDDYEESEITDDMIMKITSLLAPRPQTRSRYDVPFHGDDHSVIKIPAANPDEVAFNFIAIADPVSRGAQKLGSILKTLQQALNCNIKVFLNCLDKNSDMPLKSFYRFVLEPELQFTAEGDISGSIAKFTKLPTSSLLTQYIHAPENWLVEVVRSVYDLDNIKLDNVAMGVHSEFELEYLLLEGHCFEAVMGNPPRGLQFTLGTENQPVMVDTIVMANLGYFQLKANPGEWILRLRQGRSAEIYDFTTVDGQDIIQNGNDVKVLISSLRSHVLKVKVSKKPDKAGMDLLSDNEKDSGLWNSISSIAKFWTFTATDESEEQDEKLNIFSLASGHLYERFLKIMMLSVIKHTKTPVKFWFLKNYLSPTLKDFLPHMAEEYGFEYELVQYKWPRWLHQQTEKQRTIWGYKILFLDVLFPLNVKKIIFVDADQVVRADLKELATMDLGGAPYAYTPFCDSRAEMDGFRFWKQGYWRNHLQGRAYHISALYVVDLKRFRRIAAGDRLRGQYQALSQDPNSLANLDQDLPNNMIHQVAVKTLPQEWLWCETWCDDASKQYAKTIDLCNNPMTKEAKLQAAMRILPEWVGYDEEIKALQQKVENANRQTERDSETVDDVSKHEEL

SEQ ID NO: 4105 - protein, 1490 aa, Tribolium castaneum
MRWRGVVFVSVTTLLEAKWETTPLVLEVVEYLRDESSDFFWSFVNSISSLNPPLATLENDRVKYNIMMDHASKLVTTSELSVLKLGLSLHIYSPKVQMFRQIATERELPSCAAAVDIGGIITCDSSKVQSLIANYNEQKKVDIFNVDTHYPGSENRSKVAILYAELGTKEFADFHNVLKQEAEEGNIDYVVRHYVQTPADKKLRLSGFGVELQMKSTEYKVQDDAELHDDPSSEESSQEEEEIEIEGFNFKKLKTLFPDHKKDLDKLRQHLEESSNEMAPLKVWQFQELSLQAAERIMSAPKDEALKVFTNIAQNFPMQAKGLVKTVVNPELKKEMKLNSDIFASTLNLQPSDTALFINGMFYDVDLVDIYGILDVLRQELRTMEGLQKIGVGNKRLSSLLALDFSDGSSGQEFAIDIRDSAVNWINDIETEAKYSRWSSSVMDLLRPTFPGMIRQVRKNLFNLILIIDPTEPKSRDLVKLLESFVVHTAPLRVGIVFAVDASTKLTGLQDAGVAMQCAFNYVVQKKSPLAALSFVKTVLGSASEEVKVDDVKKELKAQFGDDYLDILGEDSDYDFGRQLSIDFIQRTGQRVLPQALLNGIPLPSSSLNIDDFEEAVLQEVMSQTSLLQKAVYRGKLSDTDDVVEYLMTQPNVMPRLNERILNKDQSLYLDMTGTATTSMNVEDLAKLSPRDMTATAIDNFKYFFSPKKGKQEHTMTYWVVGDLKYLEARQLLLAALEHAKSENHVRVTFIPNVDSSMKNMISKLVLTALSELSPEKALDYVLTLLRDDKAAEELEHGGHIKFPPELSGQVNNHELNLKMLRVYSRRVLNLNAGERALVANGRLLGPFEVDESFTVQDFGLLERFSSATYLEKIQKAIEKSADEEEELSSNSLLKVISLLVSRPQSRTRFEIQFTGDEHSVLKIPASQSDKVAFDIVAVVDPVSRGAQKLGPILQVLQEVLNVNIRVFLNSVEKNSDMPVKSFYRFVLEPEIQFTEDGKQTAGPIARFNNMPTSPLLTQNYHVPENWLVEVVRSVYDLDNIRLEDVDSNVHSEYELEYLLLEGHCFEATTGSPPRGLQITLGTERQPVIVDTIVMANLGYFQLKANPGAWILRLRQGRSAEIYDIVSHDGSDTPANSSDIKVLISTLRSHIVKLRVQKKPDKFNMDLLSEDEPNSGIWNSITSSFSKNEEEPDDKLNIFSVASGHLYERFLRIMMLSVLKHTKTPVKFWFLKNYLSPQIKDFLPYMAKEYGFEYELVQYKWPRWLHQQTEKQRIIWGYKILFLDVLFPLDVKKIIFVDADQVVRADLKELQELDLGGAPYGYTPFCDSRKEMDGFRFWKLGYWRNHLQGRKYHISALYVVDLKRFRRIAAGDRLRGQYQALSQDPNSLSNLDQDLPNNMIHQVGIKSLPQEWLWCETWCDDESKARAKTIDLCNNPMTKEAKLTAAMRILPEWKGYDEEIRQLQKKIDSGVLDPDPENHIPDTTDKHIEL

SEQ ID NO: 4106 - protein, 1495 aa, Ophiocordyceps australis
MARCRFARLAWALCHACLQATVASPAVNVDMKAAFSAPPYLLELLETAASENETAYFPLVDCIASGRFATARSDAQLYTAFLDVFDTQGYISSPEALATFDLALSLRATAPRIEAHYQYYSTAVEAAVSKLSCQNDWVWLDGKQYCSSSSLDEGIRDGLFSTKVKELPFDRTLGAGPDAILYADMTSNSFAPLHTTLSRAARQLGLRYRIRYRHSTLDKAEPLTVSGYGVDISLKRTDYIVIDDRAAEKDGLQKPLASAAFLDDNSQAADIRPLSTSELALLGMKTASFILESENRLETLIKLTKDFPKYSFSIVAHNVSADFAAEYEQHRADIGRGGINFVWINGLQLAERQIEAFALVQLLRRERKLMDSVRDIGLHGKQAVSLLGHRAIVASKSNKDPLRYDWTDRSEFSKAIIWLNNIEEDARYQEYPTSLNAFLQYTHPGQLPAIRRNVFHIVIPADLTESQDLAFVNDIMSLMTRGIPIRFGLVPLTLSANAMARAQVLYHLAASYDTAALATYIKKLSHHEGPESEEKLVNHVMAYEQLLPGAQKSCMEDVIRSESYLQQTEMARKWVDRLNADGKIRSLLVNGIPLPLEGEWMHMMGAIITQDLQTIQKGIFQGIIDEETDIAATFLQDAVKRRNAYVSLDDDKALDVLDVSKMYHEHADLLAMIPVLGSCSNSSKDTWAVLTVFADVTNVHGMKLVTAALDFKRSNPGLHVEIVHNPKDDKASSRVNSALKSAERLLPSIDSVEALSKIIDMADGLQDLDGYWTMLSRLHESTNVSPGASVVMLNGRLVGPLAANVTLTPDDLQQLFEFEHSRRILPVFTAMDSLGLSDKLSSPHAAAKITSMVARSTMSDIPEGIFDSAPSIRSTPYDSWNSTHSAIEIGDAETASIHIVGLLDPASDKGQRWAPIFAVLSELKGVYVKLILNPQETLTELPIKSFYRHVMESKPSFDQDGNVMQLRATFRNLPSEALLTTAIHVPPAWLVAPSKSVHDLDNIKLSTARADIDATYKLEHILIQGHSREDQGVPPRGAQLVLATEKNPLITDTIIMANLGFFQFKANPGFYKIELKQGRSAQIYTFESTGAHGWEAVAGDQGNELVLMDFQGATLYPRLKRRAGMQDEDVLEPATKPSGDSLLSRGLELASHVFNSASSPRVLSVEAHADINIFTVASGHLYERMLNIMMVSVMRNTKRSVKFWFIEQFLSPSFKDFIPYLANEYGFKYEMVTYKWPHWLRQQKEKQREIWGYKILFLDVLFPLSLDKVIFVDADQVVRTDMMDLIKLDLEGAPYGFTPMCDSRTEMEGFRFWKQGYWASYLRGRPYHISALYVVDLRRFRELAAGDRLRQQYHALSADPNSLSNLDQDLPNHMQFQIPIHSLPQDWLWCETWCSDESLASARTIDLCNNPQTKEPKLDRARRQVPEWTIYDDEIAALDATRRQQPQNRAGLKQEQVQVQIHMQNSHGEGSHHVNTMSRNWDELKLGQSHTIDEL

SEQ ID NO: 4107 - protein, 1542 aa, Zootermopsis nevadensis
MINIYRKLNERGCSTKMQFLVLVLLVHVLYGATGGASRKKTKSVTTLIEAKWEITPLLLEISEYLGEENADFLWEFVDGVSALHPPITDLESDRAQYDNALDIADHLITPAQISLLKLALSLHIYSPKVEMYSQMAVGRGVSNISCPTVADVAGKLTCHVEEMKKLITQKQGDDLGHAETFGVDHHYPGSQNNSLTVVLYGELGTREFAEFHQVLKTYAVKGAIDYVLRHYVKERPNRRVRLSGYGVELQIKSTEYKVQDDTEVKGDKAQDSDEQDDDDDDEIEGFNFSRLKHLYPDMKEKLDKLRLHLLESSNEMAPLKVWQVQELSLQAAERIMSSPKEEALKVLTNIAQNFPLQARSLVRTVVKEELKQEIKRNQELFSSSLNLQPTDTALFVNGMFFDLDVVDMISLLEVVRQELRVMEGLHNVGISDSRMSSMLALDFSGSGSSSSPEYAIDIRDSAVMWVNDIEHDKQYRRWSDSLMELLRPTFPGMLRSVRRNLYNLVILANPAKKEARPLLKLAESFYVHVAPLRIGLVFAVDADQSVSGNVDAGVALLNAFNYISDVKDAYSGLAFITSVYATIKEDRDVTVEDVISLLSTKYRSADVNEIFGEDSEYDTGRRLARDFVEGSGFRKIPQALLNGIPISEKHLNAEDFEEAVLSEIMNQTPVFQKAVYKGEFTDGDNALDFVMNQPNVMPRLNDRILNQDKSHYLDVTGSPLAGDITLTVESFSNLSHRDMTATIISRGVQYFVKKQYADKAAKVPPHIITHWVVTDLGTAGGRQLLAHALDQMRSSGSPGHATQFVNKILLDDSLVKEINSGQKDPRDISIPGVDLTAISEVTEQDSIEILKVQQLYCRNVLNVPAGGRAIVTNGRIVGPLEETEKFILDDFSLLERYSMSSYGDKILQTLKRKTVDDDDDDDDFDDVPRNSDVLMQAVALLVSRPQSRSRFDIPVHTDIHSVIRLPPHNASEPAFNIAAIVDPVSRGSQKVGPILSVLQEVLNCHIKVYLNCVEKNSDMPLKSFYRFVLEPEIHFTSDGRQTSGPMARFANMPTSPLLTQNMQVPENWLVESVRSPYDLDNIRLEDVDSVVHSEFELEYLLLEGHCFETTMGNPPRGLQITLGTETQPVVVDTIVMANLGYFQLKANPGAWILRLRQGRSADIFEIVSHEGSDTPANSTDIKVLISSFRSHVLKLKVAKKPDKMHVDLLSDDTDPSSGIWSSITSTFGGSKTAEEDGDGRINIFSLASGHLYERFLRIMMLSVLKHTSTPVKFWFLKNYLSPTLKDFLPHMAKEYGFEYELVQYKWPRWLHQQTEKQRTIWGYKILFLDVLFPLDVKKIIFVDADQVVRADMKELRDLDLGGASYGYTPFCDSRTEMDGFRFWKQGYWRNHLQGRRYHISALYVVDLRRFRRIAAGDRLRGQYQALSQDPNSLSNLDQDLPNNMIHQVAIKSLPQEWLWCETWCDEASKQHAKTIDLCNNPLTKEAKLTAAMRIVSEWKDYDSEVKNLQNKLNRIETEKDGDLRSGKSAFQKTDDHERHSEL

SEQ ID NO: 4108 - protein, 1643 aa, Hevea brasiliensis
MEARSRSGFCVLIILLCVSFSGIVSVCGESRRPKNVQVAVRAKWEGTPVLLEAGELLSKEWKDLYWEFIEVWLRAEEDESDSHTARDCLKRIIKHGRSLLSDPLASLFEFSLILRSAAPRLVLYRQLAEDSLSSFPLSDDSISNNDSGEIAETSEENESKRADPLLVGVNPKSPGGKCCWVDTGGALFFDVAELLLWLHNPAKLAEDSFQQPELFDFDHIHFDSHTISPVAILYGALGTDCFRQFHVTLVEAARQGRIKYVVRPVLPSGCEEKVGNCGTVGAKDSLNLGGYGVELALKNMEYKAMDDSAIKKGVTLEDPRTEDLSQEVRGFIFSKILERKPELTSEIMAFRDYLLSSTVSDTLDVWELKDLGHQTAQRIVHASDPLQSMQEINQNFPSVVSSLSRMKLSDSVKDEITANQRMIPPGKSLMALNGALINIEDIDLYLLVDMVQQELLLADQFSKLKVPHSAIRKLLSTMSPPESNMLRVDFRSAHVHYLNNLEEDAMYKRWRSNINEILMPVFPGQLRYIRKNLFHAVYVLDPATSHGLECIDMIISLYENNFPMRFGLILYSSKFIKKIEDGGGDLHLSAVENDSQKEDTSSLIIRLFIYIKENYGIKTAFQFLGNINRLRMESAESVDDSPEMHHVEGAFVETVLPQATSPPQDILLKLEKEKTNNELSQESSMFVFKLGLYKLKSCLLMNGLVFDSSEEALMNAMNDELPRIQEQVYYGHINSRSDILDKFLSESSISRYNPQIIAEGKAKPRFVSLSSSVLEGESVINDISYLHSPNTIDDLKPVTQLLVVDITSIRGIKLLHEGILYLIRGSKAGRLGVIFSAKTDTDLPALLFMKAFEITVSSYSHKKNVLNFLEHLCSFYEQNYIFASSIAAESVAFTNKVYELAESNELSLKAYKSDLPEFSIDIMRKRLNKVVQFLYRQLGLEAGVNAVITNGRVTVLTNEGTFLSHDLNLLESLEFKQRIKHIAEIIEEVQWQDIDPDVLTSKFVSDIVMSVSSAMALRDRSSESARFEILSAEHSAVIIENENSTVHIDAVVDPLSPVGQKVASLLRVLRQYIQPSMRIVLNPMSSLVDLPLKNFYRYVVPTMDDFSSTDYAVNGPKAFFANMPMSKTLTMNLDVPEPWLVEPIIAVHDLDNILLENLGDTRTLQAVFELEALVLTGHCSEKDHDPPRGLQLILGTKNMPHLVDTIVMANLGYWQMKVSPGLWYLQLASGRSSELYVLKENGGGSLDNLLSKRITINDLRGKVVHLEVAKKKGMEHEKLLVSNDDDNHSQGKKKGTHNNWNSNLLKWAAGFIGGSGQAKKDENTSMEHGKGGRRGKPINIFSIASGHLYERFLKIMILSVLKNTNRPVKFWFIKNYLSPQFKDVIPRMAQEYGFEYELITYKWPSWLHKQKEKQRIIWAYKILFLDVIFPLSLEKVIFVDADQVVRADMGELYDMDIKGRPLAYTPFCDNNKDMDGYRFWRQGFWKEHLRGKPYHISALYVVDLVKFRETAAGDNLRVFYETLSKDPNSLSNLDQDLPNYAQHNVPIFSLPQEWLWCESWCGNATKSKAKTIDLCNNPMTKEPKLQGAKRIVSEWVDLDSEARQFTAKILGDEVSPQEPASPNASQNSATDSSSGEDEDRAEL

SEQ ID NO: 4109 - protein, 1466 aa, Syncephalastrum racemosum
MTRAFASIVFGLAVTLQYVGKPILAASASSTPVDVTLVAPWSAPDLLVEIAETVAGKNDTRYFDIVGRLATLTTKSTPQALYKTALDTLALTERELETAKLALSIHAAAPRVESHMQYFESHIQKDEQPCDIWIETAAGYTCDIDAMAATAPLNLLPFDRVLRTRVDAPTAILYTPNLSHPEFLRFHRYLSAQALEGQLAYIIRYAPSKSASPSPPLTLAGYGVELALKNTDYLVIDDREKEDQQEQDSTVKSKLAGLGKKISQTLFDTGAPATIEPLASKEIKDLGLKAAKFIRKSKKPLNTLVQLSQDFPKYAHRVSELHLDESDQNTFNSIIAQGENSMWINGLPLDSTEVEAFSLVRILRQEADRIAGYERLGLNSRQAIDVMTHPALAGDHTDESVKDIYDVRSELVEWWNDLEKDKRYKGWSSNIFEILKPVYPGQLRAIRRNIYSLVMVEDLTSLKSLERVATQIQAMIKHNTPIRFGILPLVSSSTESKGMALALHHILQNGGKADGMTFLNKVLEGTMAAKHEHTTMEIVEQSFQSVVQGLKSPREEDIESRSVKDLLPTGADYIASLVSFLNQFGIASPTMFMNGKLVEIEDDATWTRSIMAALQEQTQLIQRKVYFNEIEHDADFYQELLSASYVAKSRNPYIIESDQSPLRMVRMQDISYELLNGIRYFSNSEEAKYNVWIITDLNTAHGLELARNGLLFSETAGDARVAIFHCPDNMESNSVSPPAISNLLNTRSKTEDALNIIDKLLAAKEVGDDDTQIKISKSSDTEKSTDKPFLDGLESVGLERGFQGIIFNGRVIGPLNSAVVFSVHDFSNLAQYETDKRIEPVREALAAANVKDMTADKVMQVTAITNTPVGDEEINVPRAKKMLEHQVTGRERPYKDSNVDIQLGDKEKAYVEIGVFLDPVSETAQKWSAILETLSSLQGVYICIHLNPVSHLDEIPLKRFYRYVFDAEPHYDPTDGTAQTPTAYFSDLPVDALYTLGVDTIKSWHVTVKEANDVDLDNIVLKDGHVSAVYELERILIEGHCLDSVTLSPPRGLQFVLSNTTDTIVMANLGYFQLKSRPGLWELTLREGRSREIYTIDTLGTGNNEDDLLALTSFEGLTLYPEVRKKPGKEKEDVLVEMQQQKGHDEGILSSLKHKLFGDKSEEPKPAVAKQADINVFSVASGLLYERFMSIMIASVMENTNHTVKFWFIENFLSPSFKDFVPSLAQELGFDYEMVTYKWPSWLRAQKEKQRTIWGYKILFLDVLFPLDLEKVIFVDADQIVRTDLKELVDMDLHGAPYGYTPFCTDRTEMDGFRFWTQGYWKEHLRDKPYHISALYVIDLVRFRQLAAGDRLRAQYQQLSADPHSLANLDQDLPNNMQHIVPIYSLPQEWLWCETWCSDESLKSAKTIDLCNNPMTKEPKLDRARRQVPEWEVYDRRVAALRKGLPYAKAKELEKEHKTLHIVDEL

SEQ ID NO: 4110 - protein, 1288 aa, Oikopleura dioica
MVSFIPELDQKSDVEIYDTVNTLVNGMKFSKADIRMMNFALSLHIFSPRIEASRTKWLEGPADCAQVFFSSGGTSFCELKPEEIAEPAPVETDIVLIPGSKKIIFHGIVEAADFNDRLQAAKVFSARNNIGLSLRWQFSDDLCATPSLTGYGVELRLKSTEYKASDDSQDKSDDEDLVQKAAGFDFEILSKRFPDLQKEIKKFSRYVSDSSQEIQPMKKWQMGDLSYQAGLAAIEAFSKDGPEAGLESLQKISGNFPQMAMRLARTTVPSAFKSEVKKISESLSQSVGVRQGDSFFAINGMPVDLTSQWGDPFQLYETVKGELNVMEKLAGLGITGDLAQSVLQAPEPQGSSSEAVLKIPGDDEGLIWLNNIENDKKYAQFGQSLQEFLRPTFPGVIRRLRYNYLNLMIFVDPLSKDVHAIHDVIDTLSQNNLPVRVGVVLTGTSEKSLAASAVFHFLLKHNKEKNKSKMYTWNKWIALLTEKLDSASIKKLTGVDKDTITAEESEAYKNAFKMMNFGRAIGVGEDSSILINGAALKNLAFEDGMEEIVYQELLDAVPDIQRAIYYGTYRGETSFVEYFNSRGGVVTRFNQEILKAPVVNIDLTNIQYDGEYHGDGNICTFLVTTNSENSPVAQEALAYLKTSTSSRTAIIDCSQSSKICETLEKNAIYVNGRAYTKNTDNFTAADFALLETLAIQFGANKIAHLLKSFDDDVIMKTINVLSSQVEIKSRKTITFPVAKYSLIDFEPLRKDEASFDVVAVLDPASEDAQKMIPIISTLRKVVNMRLKIFLNCQENLSELPVKSFYRFVISDEFRESDKTHAVFTGLPHHSLLTAAVIPPESWMVAAVDAVHDLDNIKLVDQGDVHAVFELQHLLLEGQAFDVSNGSPPRGTQFELVKTGVALDTLVMANLGYFQFKASPGFWNLNLREGLSRDIYEIKEISSESGGEEQREIMMTSFTPKSLRVGVNKKSGMEDMDVLSKPDDRPQVNDEGSIWDRVGEAVGLKAKKVLAKEEVETINIFSLASGHMYERLMRIMMLSEITRVPRLENHFRIVSKEFGFEYEFVQYKWPRWLNSQKEKQRTMWGYKILFLDVLFPLSVDKIIFVDADQIIRADLKELVELDLEGNPYGYTPFCDDRKEMDGFRFWNGGYWKQHLAGRKYHISAIYVVDLKRFRQLAAGDRLRGQYQGLSQDPNSLANLDQDLPNNMIHQVGIKSLPQEWLWCATWCSDESKERAKTIDLCNNPLTKEPKLVAAARIVPEWTGYDDEIKQVLQGEKQTVKDNSNVKTEL

SEQ ID NO: 4111 - protein, 1536 aa, Sipha flava
MANYNDFDDGNDYIQSKYKHRNKTNCAKQSRKKSKRKSSNDSSNFFMIICLVLFVLLFTHKSENKNLKKGKYVTTMIDTKWNVVPLVLEIAEYMAEESQHTLWSFVDSISELNPALSELDNDQTKYQIAISKAELLLSNSKLRLLKFSLSMHIYSPRIEMYAQMAADRGVQCLTSVEIDGELVCSIEKLKNILKRIRAKGSKESCEIYHIDHHHPSSKNKSNSAILYGELGTAEFAAFHQILKQSAQDGYIDYVLRHFVKEKSEQKVRLSGYGVELHMKSTEYKAEDDSIVKDKNDININEVEEDISEIEGFDFKRLVELYPDKKQDLIKFRTHLSESSGELAPLKAWQFQELSLQAAQRIMSGPPQDAIQTFIHIAQNFPTQARSLANIKVSKELRDEVSKNQESFSMGLNLQTSDTVLLLNGMYFDIDITDMSTILDSVTEELSVMEGLFSLGITDKKAISSMLALDLGNIKGKSYAVDIRDSAIQWINDLETDTAYKRWPSSVDDLLRPTFPGMLRSIRRNLYNLVIVCDPASKSSWPLLKLTDSFLNHQSPLRVGIVFNVSPKPAIGLDNASVALLNAFNYIVEQTSKPLSAFNFITNIYTSISEDRDVNVEDVLHGFMKQYPKASIDDIFGEDSDYDTARILAKEYVTRTGFRKLPQVLLNGVPLQEKSLVEEDFEEAVLVELVSQTQTLQKAVYKRELTDGDNVVDWLMKQPNVMPRLNSRVLNTDSKKNLKLNNKHESIFKSMHYTTYTKQSSINPITHWIVGDFSKLSTFKLIKNTFEHLKSNSESRVSIIPNPSSNDEHVIKLNKIVFEAFKQKDKLNILVKHLSQAIEADKNHIEVISSLPEEINFDVSSIDIKSYSNYAIEILNFESGQCGVITNGRILGPFDENEDFLTDDFALLEQHTLKNSVNKILSILKDSDVEEITSDMIMKASALISSRSQTKNRHSIPDVSTKHSVIKLTAKNEDEPIFEINVIVDPVSRGAQKVGPIISVLSHVLNANINIYLNCVDKNSDMPVKSFYRFVLEPEVIFDKSGHLSPDPIAKFTNMPTSPLLTQILHVPDNWLVESVASPYDLDNIRLEDVEMGVYSRYELEYLLLEGHCYDSVNMNPPRGLQMTLGTKSNPVVVDTIVMANLGYFQMKANPGAWMLRLRQGPSADIYDIISHEGSDRSPNSMDIKVLISSFRSHIIKVKVAKKPGKQNLNVLGDDDAENKGLWNSITSSFSSGSPDKASDETINIFSVASGHLYERFLRIMMLSVLKNTKSPVKFWFLKNYLSPTLKDFLPIMAQEYKFQYELVEYKWPRWLHQQTEKQRVIWGYKILFLDVLFPLDVKKIIFVDADQVVRADMKELVDLDLGGAPYGYTPFCESRKEMDGFRFWKQGYWKTHLQGRRYHISALYVVDLKRFRKVAAGDRLRGQYQALSQDPNSLSNLDQDLPNNMIHQVAIKSLPQEWLWCETWCDDASKKSAKTIDLCNNPLTKEAKLTAAMRIVDEWKDYDNEIKKLQIKQSEHEDQVFNEKIQLKESQDHIEL

SEQ ID NO: 4112 - protein, 1538 aa, Astyanax mexicanus
MAPRSETGIMKILWLLLILTQFHHAHSASKGVTASLKAKWPQTPLLLETSEFICESGEEKFWPFVDTVRELAVYKHGESVRSYYNLIVKKAGQFLTDLQVSLLKLSLSLRAYSPTVHTFLQIASDEPPPEACSAFVSVHGQLTCSTKDMKKLLKTATGRPKPYLYKNDHKYPGANGTDLPVVILYAEIGTKKFNTFHKVLSERAEEGKLIYVLRHYVAEPKKQNILLSGYGVELAIKSTEYKAVDDTQVKDSKSSTTDEEDDTDEVQGFLFGKLKKSYPDLQGQLGDLRRHLLESTNDMAPLKVWELQDLSFQAAARIMSVPKFDSLKLMRDLSQNFPSRARSLTRVAVNQEMRKEIEENQKRLSESMGIHPGDSSLFINGIHIDLDFHNAFSILDIIRGEAKLLEGLHNLGIRGTSMSKFLRMPVTTVEESYALDIRHSAIMWINDIESDSTYRTWPSSLQELLRATFPGVIRQIRRNFFNLVLFLDPAQEESIELVKLAELFYKHKIPLRIGFVFVVNTEDKVNGFEDAGVAFFRLWNYIAEEYDVTQAFLSMVTMYNRVDVGDSLSVETVTAYLKKKFPKANTAKILGVESSYDDKRKAGAVFYRKSGLGALPVALFNGIPLSSEEMDPDELETILLQRIMDTTNFFQRAVFMGQISEGLDVVDFLMEQSNVVPRINPVILSPERRYLDFTASPVADDWDDSTMFSFLDSKDKTAVVSKRMKYLTKHEEEMVYGVTIWIIADIEQAPGRQMLLNALKHMKSSSSNSRVGVINNPGGTPSEDNSSLYKAIWASFLTQTSKNTLDFTLKLLKEDTVQLITHDTKIKDLLLQGMDQDAFEKKFNTLEVDFLRSQQRFCQEVLKLKAGQRAVVSNGRILGPFTEDEEFSADDFHLLEKITLSTSAEKIKAKVKQMNLAPRKSSDLIMKVDALLSAAPKGEARKDIKFVKDKHSVLHLAAREDEVFYDVVAIVDPLTRDAQKLAPLLSVLGQVVNMRVQVFMNCRAKLSEMPLKSFYRFVMEAEVSFLGNDTMSTGPVARFTEIPESPLLTLNMITPESWMVEAVRSPHDLDNIHLQEVSGVVNAEYELEYLLLEGHCFDMSSGQPPRGLQFTLGMKQDPLMQDTIVMANLGYFQLKANPGAWILRLRKGRSEDIYQIQAHDGTDSPADAEDVIVVLNSFHSKIIKVRVQKKPDKLNEDLLSEATESKGLWDSITSVWSTLEKSLTGSSSVEEGDKKKEDVLNIFSVASGHLYERFLRIMMLSVLRHTKTPVKFWFLKNYLSPSFKETIPHMAEAYGFQYELVQYKWPRWLHQQTEKQRIIWGHKILFLDVLFPLAVDKIIFVDADQIVRADLKELRELDLEGAPYGYTPFCDSRREMEGYRFWKTGYWASHLAHRKYHISALYVVDLKKFRKIAAGDRLRGQYQALSQDPNSLSNLDQDLPNNMIHQVAIKSLPQEWLWCETWCDDSSKPTAKTIDLCNNPKTKEPKLSAAVRIVPEWTSYDSEIKQLLKRVQEQKPEESNTGPSQTQTKHTGNQRDEL

SEQ ID NO: 4113 - protein, 1549 aa, Acidomyces richmondensis
MRSRSSRLALGFCVIGCLFYTAHAQSSVNVALRTSFSAPAYLIELLETAAEENETSYFPLLDRIAEGYFDSAKTDEELYVSFRGLLQQDGHLSQPEDLSSFDLALSLHSAAPRIEAHYQYYETSVKPLLEQREDDDCETWVYIPFNGDRYCSPQMSEASQQKVWKPTETVHQLPFDRILGDVDNKRPVVLYADILSASFRRFHTTISQTAKAGTTSYRLRYVPNKNRFNVPLTVNGYGVELALKRTDYIVIDDRNNKVEGEESTAPAVEATLSEEELSDLRPLSSSELLRLDQKAATFVMSSNDPFETLLRLSQDFPKHSSAIAAVNVSNDFLQEHRSNREIILPSGFNILWINGVQIMARDVDAYALLEHLRRERKMINSVRGLGLTAPLAIDLLSHEAVTAASVDQEVQRYDWRDDNEGGNIIIWLNDIEKDKRYAEWSNSIAALLQRTYPGQLPSVRRDIHNLVMMIDFADYGDVATVVDNLQNFVKRKVPIRFGLVPRIRSSAGIEQAKIIYYLLDRYGLSAAIDYLGKSIIGAGRKFAMPQEKYFVQAITDRKLRRDKAAQSFDEVLKSKEFDVQIIGAQSYVSRFSDGDTASPMLVNGVPVPHTEEWLQAMSQRVSIDFRMIQQAVFHGEVTEESWLPEIFLNNAWLRRNPLIVPEDDDDIRHINLGDLPDFATLKSVPADSDTIERELVHLTVATDLSSEQGLAQAMEAFLFKRDHDNVELALIHVPNKPDSNHICSLELARLTAEALQSLGRRYDALANEQFGDTALDYSQRRSIYQKLCEISSGAKTNYDQKSTADGATVKHIITAAGLEPGKQAFIVNGRIVGPMSTSKVLVVDDLDTLLSYERKKRLLPAALAIEDLQLQSMASTPLAFARISNLIALSQVSDVPEGIFEAAPTVRTSVFKQWNSTYTAIKVGDMENANIQIFSVIDPASELAQRWVPIIKKLSELDGVATTVFLNPRDRLEELPVKRFYRYVLDSKPTFDSEGSVRGLTAHFSGLPADALLNMGMDLPPSWLVAPEESVHDLDNIKLSALRSGTDIEAIYKLEHILIEGHSRDVTLGPPPRGAQLVLGTKHDPHFADTIIMANLGYFQFKANPGVYNLALQRGRSEEIFHIDSAGTRGYIPMPGDNSTEIVLMSFRGATLFPRLSRKPGMEEEDVLETSKTTLENLADGADKFLAKIGLHSSGASKYLSKAAKIVSAWTSGKVIPADLSAEPHADINIFSVASGHLYERMLNIMMLSVMKNTKHSVKFWFIEQFLSPSFKRFLPIFAKEYGFAYEMVTYKWPHWLRGQKEKQREIWGYKILFLDVLFPLDLDKVIFVDADQIVRTDMYELVQHDLKGAPYGFTPMCDSRIEMEGFRFWKQGYWKNFLRGLPYHISALYVVDLKKFRQIAAGDRLRQQYHQLSADPASLSNLDQDLPNHMQMVLPIHSLPQEWLWCETWCSDESLKDAKTIDLCNNPLTKEPKLDRARRQVPEWTLYDEEIASLARRHKAVEGTGMPSAGESGIVGVESANEESIQERLQREDAEKELKKQGRLRDEL

SEQ ID NO: 4114 - protein, 1532 aa, Varroa destructor
MSSAIFIWKSSGPRQSTVRNVFSCLLLTSLAYAVLGKLNQKPLTVSLDARWNHTPLHLEAAEFFAEDGADSFWKFVTDLQTLDLESFIKASEKLQYESIVELASRQLSEGRLALFKLSLALRAHSPAVETFQQIARDKKLPDCEFVLEFPGNEFTCSLDEIDRFIDKKIEGKVDIYGVDHEFGALSNGMPVVLYGDMVSTGFQKYHNALLKRYSQRKIRYILRHYVHKPVRRQVRLSGYGVEMALKSMEYKSQDDTNYKEKEVAEDETVETSEGHNDDRDIIHIMDAELTNLKESEVEELSLQLAAKILKVPPERQLKMFRDLAHNFPSIARSLTSQKIDPDLKSAVERNKKYFQAYLNLETTDTALFINGLYYDLEVSDMFVLLDSIKQETHLLEDLRDVGVETEAIPKLMKLDLNIKNSVYGVDIRDSAVQYINDIELDSDYRNWPRSLQEMLRPTYPGMLRSVRRNIFHLVIVADPAAPECRDMFKFAESFYIHRAPLRIGFVFAVNPSKDATGISNGGVALLNAFNFISQEKKPFDGLAFITEVYASQNEGYIEAERVISMFKLKFPSEDIEMVFGADSDYDTGRMLAWDFINRAGVGTPPLAMLNGISLKKENLKGDMFEEAVLTEIMKQTPKIQRAIYKGELTDRDFVIDYLMTRDNIMPRLNERVLNPPSREDTVFVDFTGRTVTDINADMMENLSAADLGASFAQTLQHLGKGTASVPLTMWIVADFDTSSGRNLLGHALEHLGNSDHTRLGFIYNNKKAATAGELTTFVESALRSLSFMETRQFLTRLVRNWDKIGSGKVKATDLLPSGTNFKLLPDDELSTIVALHQAFARTLKLKPSLRAVIVNGRLLGPLTESEDFTAEDFNLLERLSMAIYGVKLMELLDGVSSNVMMKASSVLQRFAQRKVRHEVKFATEQYGVINVSRKDKDSAAHDITVIVDPASRGAQKVSQILLLLQQVVNADIRVFFSCSYGNKELPLKTYYRFVASSEPQFGPSGELSGPRAVFVGLPSKPILTLAMATPENWLIGAVSSIYDLDNIRMADVESRVVAEFELEHLLVEGHCFEQSSGSPPRGLEFTLGSPANPVMYDTIVMANLGYFQLKANPGTWFLRIRDGRSSELYDVASTENTEKSGDDIAVLVTNFRSKVLKVRVAKRPGKEHEELLVDDDSQDDGIWNSITSSLGGGKTGEGADKEKDAEDDVINIFSVATGHLYERLLRIMMLSVLKNTNSKVKFWFLKNYLSPSMKDVLPYYARRYGFEYQLVEYKWPRWLNQQTEKQRIIWGYKILFLDVLFPLSVKKIIFVDADQIVRTDMKELRDLDLGGAPYGYTPFCDSREDMEGFRFWKRGYWSQHLGNRKYHISALYVVDLKKFRRIAAGDRLRGQYQGLSQDPNSLSNLDQDLPNNMIHQVAIKSLPQEWLWCETWCSDESKPHAKTIDLCNNPKTKEPKLAAAARIVPEWTSYDEELKKMIEEYEKEKGSGYKESTTQDSGEATLVYDGRQQQQQQPANLNGKPDLIDSQQHTEL

SEQ ID NO: 4115 - protein, 920 aa, Aphanomyces astaci
MAAEDPLKRLQLLSQNFPKYASSLVLASKPIPQQTIDDINHARSQRLYNRIVVNGLPVDFNEYGFNAFDFLKSLNGELRLADTLAKLDPTGSIKAAMGSLSSAPSDVRISLRGPVDGDAPLYLNSIETDEETAEWPTDLGSLRGPSWSLIYLRKTMYELILVVDPTTKQGINAMNEERATYAPSVEDKDVATVFHVSKMFLAARANGKSARDKYLREVLSLNDLTVKEVLQIYSQAVGERYTNDDWLQTAKAILTDGDNDGVWAMTNLVAEKNLPINSQVFNGVVRKHVNVQEDIMTHFARDQPLYQTLVRANQITDDSDMLSELLGNDETYAVFCPWFDPEYKPPTTVVQLDWNDPVRCFLPDQHVIYVNGRPLELVAPVTPSLFDGLVTYESATRSKAVSKAYVSQFKHNVLTAEDAADKTLQLNVVLSMVDSYLKTPRVAAVLPDDVQRPTYSYVTPSGSSSLDVVAYLDPLSDTAQRASGILRMLHSVLHAKITLVLVPPPSYDEFPLKRFYRFLWGGTSSSLVEFDRLPRHPVLTLNIETPELWNVQMVQSDVDIDNIQQNASATFTIKDVLVYGQCVDKTNAQYPTLPNGLQLVLERSVAKLHSHKDTVVMKNLGYFQLQAAPVPVIVYDFLSKTLQLEVKKQPGQEGVRLLDDGPEAPKAPAQPEETSVWTSLVQWGAGSSKLEARKGDTIHVFSLATGHLYERMLKLMMLSVLKRTNNPVTFWLLENFLSPDFKNSVAALQAEFGMDIRLVTYKWPNWLRRQTDKQRIIWGYKILYWKDHLRGKPYHISALYVVDLVKFKRMAAGDSLRAIYDQLSADPNSLSNLDQDLPNYAQHQIPIFSLPQEWLWCESWCSDESKAEAKTIDLCNNPKHKEPKLDMAKRVISGDLFPESWLQLDAEVKAAEAAYELASD

SEQ ID NO: 4116 - protein, 1587 aa, Heterostelium album
MSKTTMQTTIAQDGDSSKAVHVSLVSNWENTPLYLESFMFFKERVDNVVYNKYIEQLAKSVAKRSYSELSDKQKYDIVIDAATTVLGDDTQFYIGALRADLTMRTFSPKVELLRQLYLSAMTSNNIAIGKSSVPLIQIGSQTIHQNLNINAIDQALKSIVVTEKNSNNNNNNTQVYSFDTIIGNDITFDSQLLVDNGRPIVIYYGNVFSVEFLDVHSHLVKLATGSDAKITYVLRFTVESSEQPAKLQGYGYGLTIKNLEYKVMDDSVIAQDEKNQDASGNQLHEDVAGFNFKVLQDRHPQLLSTFKTFRKFLLAHQQTTDLKVWEIKDIGLQSAQKIISSSDPMRSMKFITSTFPSLARSLSRISLNDSLKQHVEQNHKFLTAGANQLFLNDLNIDLEEEFALNPIGLNEIIYNEIKSKLETKKLDLQSSLITKATNTMSKMNPVRFDIVPEDDTIFYINNVEKDYTYQRWDKSFSAIENGIDQNSVYIAKNIFTGIFMIDMDSDDAYQTLGQINMMINNNLPMRIGIIFATDRAQASGVKPNPAQVPNEAIIKVFASFWRYMGQRAAFYFMNALNYYRQQYDINYVTHSLMQGAFQTVTSQMHNRIPGGLHMAMENPQMDAQLVAGNQYIASKGIANFPQLFVNGMIVDLKKGNPLETLMSLVQEEMAEVKKLVDQRIIDDSTQDIYKTIMSHYRETTGLMSNFNPIIIPSESSPLKYVSLAYSSDAAIQQLANQVLNTDIIWFESTTEIKALSTFVVGDFDESSSSIKLALNALDRFSTDAKPNNQVRYALLSTGNGVVSKVLSHPQITIQGAIDLLTKQAQILEDKSTPLTLDQALAAAKLSNNPLLNQRNQNQLTFIKEYIGLPMTGSQTTIIVNGRVLTVEENDVFNEFYFLECYELSKARKVLSDILENPSADDKPLTNSQYSTILMRLMSSLGKRNEDTTIAKKQPPSGITPSFTYETNNNIISGLLRFTMIVNPLSKQAQKIIPIVAEFAQHYGIPCDVYLNVQLALSEMPLKNYYTYVVQLDNAFDSATGKVVSEPGGTLVNLPESRVLTLAMDAPVDWIVSPIVAKYDLDNIRLKDLGSDKVMRAVYALEHLLVQGSALDISNYQPPGGLELQLSSLNSKVSTDTIVMGNGYFQLQGNPGIWTLDTIGRGVDIFDTLNLVDRKASSLKNAHSVPHLLVYIESFRGSNAFLGLKRKQGQEATPVLPPVEDNQDQQQPEEEIEESYFFNWMKGNNNKKEKAPAKVSSTNETIHVFSVASGHLYERFLKIMMLSVKKNTNNPVKFWFLKNYLSPKFVDFIPFFAKKYGFDYELVTYQWPPWLRAQTEKQRIIWAYKILFLDVLFPLDVKKVIFVDADQVVRTDLKELWDMNLQGAALGYTPFCDSNKDTEGFRFWKSGFWRDHLRGKPYHISALYVIDLQRFRRIIAGDNLRMTYDQLSRDPNSLANLDQDLPNYLQHSVKIFSLPQEWLWCETWCSQASKSKAKTIDLCNNPMTKTPKLENAVRIIDEWTTLDNEAKGVEKEYEQLKSTKSQNKTPTSSTVIDVGSASQTVATTKYEETLPNQDVINQALIDAANEFI

SEQ ID NO: 4117 - protein, 556 aa, Dendrobium catenatum
MRIVLNPMSSLVDLPLKNYYRFVIPSMDDFSSIDHSVNGPKAFFANMPLSKTLTMNLDVPEPWLVEPIIAIHDLDNILLENLGDTRTLLAVFELEALLLTGHCSEKDHDPPRGLQLILGTRQMPHLVDTLVMGNLGYWQMKVSPGVWYLQLAPGRSADLYVMKKNEGEKSSLSKDIIINDLRGKLVRLEVEKQRGKEHVELLSGSDDPLKNKKDDHTGWNANLLKWASGFIAGNGLSRKRNENSSDNKKIIRHGETINIFSVASGHLYERFLKIMILSVLKNTRRPVKFWFIKNYLSPQFKDVIPHMAQEYGFEYELITYKWPTWLHKQKEKQRIIWAYKILFLDVIFPISLKKVIFVDADQIVRTDMGILYDMDLKGKPLAYTPFCDNNKDMDGYRFWRQGFWKDHLRGRPYHISALYVVDLVKFRQMAAGDTLRVYYETLSKDPNSLSNLDQDLPNYAQHTVPIFSLPQEWLWCESWCGNSTKFKAKTIDLCNNPMTKEPKLQSAKRIVPEWVDLDAEARLLTSRVLGEELEIQQIPSSTDTDKKDDLESKAEL

SEQ ID NO: 4118 - protein, 1331 aa, Pomacea canaliculata
  MOD_RES (286)..(286): Any amino acid
MLNFHRVLVTKAQERDIQYVLRHFVQEPAESNVRLSGYGVELSLKSTEYKAKDDTKFEGGTDGESIDFEDEEEDLQGFVFSKLRQLHPDLQKELKEFHSHLRESATELAPLKAWELQDLSLQAAQRVLSSSPADALQILTDISQNFPTLAQSLVKTVVPVELKEEIRQNQEFFERNHNLFAGESAFFLNGRAMDMEIYDVFTLLDIMLAEAKLVEGLHTLGFKGEWLQKILQLDLSSGEDTGNALDIRHSAVQYLNDLEKDSKYRGWPASVQDILRPTFPGMLRHXAKNIFHLTFIINPAEDASRELLKMAEAFYVHSAPIRLGIVLQASADASAKEDAGVAFARAFDFIKIDQSPAKALSFITDVYEKVGSEKITAESIIAEFNVQYPGEDLELVFGSSSEYDDTRKAGIDYIQRSGLLGFPQVLVNGVPLDKKYLSQEDFEEGVVGEILKQTQVIQKAVYHGKLTDSDVVLDWLMEQDNVMPRLNSRVLSSAAAQLDLTENVDGSVLDDPALFEMLNVREMSGAVAARLKYLTRRDEPAVRPVTMWVVCDLQTPEGRDLLYNAIKQVKASNELRVTWVPSSAAADNVDLVSRAAWVALRDLPGMLSKSFLTKLVKEENYAEISAGTKTLRDLEVNGMDMDSYLAAVEAETGGVLKSLSMFTRRVLGFTVGQRGVVANGKIYGPLGAQEDFTQDDFGLLEKVISVQAGAKLREQVKAVGIDGDRGSEMVMKVSALLSSRSRSESRSKVVFREDKYSVVKIPAADDLPAFTVEAIVDPASRAAQKMAPILQILHAVANVDIRIYMNSRQHLSEMPLTRFYRYVLEPELMFRSDGSAAEGPVARFIALPHKSLLTLGIDAPESWLVESVSSVYDLDNILLEEVDKGINAGFELEHLLLEGHCSDATTMHPPRGLQFILGTENKPDIVDTIVMANLGYFQLKASPGLWRLRLREGRSQELYTIQSHEFTDTPAGSSDVVVAMNSFKSKIIRIKVSKKPDKLHEKLLEDGQQESQGLWDSISSSFSGHKTEEDEDKTLNIFSVASGHLYERFLRIMMLSVLKHTKSKVKFWFLKNYLSPTFKDFIPHMAKHYGFEYELVQYKWPRWLNQQKEKQRVIWGYKILFLDVLFPLDVKKIIFVDADQIVRTDLQELHDLDLGGAPYGYTPFCDSRKEMDGFRFWKSGYWHSHLSGRKYHISALYVVDLKKFRQIAAGDRLRGQYQGLSQDPNSLANLDQDLPNNMIHQVAIKSLPQEWLYCETWCSETEKARAKTIDLCNNPLTKEPKLQAAMRIVPEWKNYDYEIKLLWDQIYGTNTKAQIEYEPPNIADFTTKTEL

SEQ ID NO: 4119 - protein, 1489 aa, Thielaviopsis punctulata
MWQLGVAAALLAALPASAVPAVDISMQAAFPSAPYLIELIETAAGENATAYYPILDKVANGYFSGISSDKGLYDAFFALLSDDGHIVRPDVLSTFKFALSMRTAAPRVEAHYQYYATGVEPGLGDTASAEGCDAWALIDGQKYCTPELTKGKGVVVKGLQSSTLPFDRVYGSGTPAVLYADIMDPSFGPMHKALMAAAAKGEVSYRLRHRRLGSVDGLEPLPVNGYGVEMALKRTDYIVIDDRDTGGEPAKIEKKSEAQVVLDAEEEIMDLKPLSKGEVLHLGMNAASYILESENPFDMLVKVSQDFPKYSTQLAARNASKAFVDEHMRNDANVPPGYNMMWINGAQQIERQIEPYTLLETLRRERKMIDGVRALGLNAQQVNDLLGHRAITTSKLSSDDTRYDWRDNIEENKVIMWMNNLEKDAAYSSFDSSLQALLQQTYGHLPSIAKNVFHLIVPIDFTNPEDISTAGQIWALANRALPVRFGIVPLLPSDTAIEISKLLYYLYDEFGFRAMMDYVSKAGMDGLNGVKEEAYTIATQKPPAEESEVDEGSEKESENETKTALPLSEVLSSESAAAQIALAESWIGRMDAAAEIPPILINGIMMPRINNWMPAMSQRLQGDLQEVQQAVYTKILTDESDPVSFLLKDASIRRNKYITPPDEKDPRMLDISKVYSEHRSLFEKIAAIEPTEDTTKEKWASLTLVADLNSDAGLQLLLNAFEFAEANPGVRLDIIHNPVETAGASQINEALIKNDPDAANIEQLRTILEADKFPIDEAFDAALENFLADTNIKAGTNLLILNGRVIGPIAPADAFSPSDFHQFLETERKKRIFPVYEAIDELKLGTVVSTPLDVAKLTSIVALSTISDLPQGIFEAAPTIRTSMWTEWNREHSSFDVGDPTESNVHIVVLLDPISEKGQRWAGILKVLSEIEGVYIKIYLNPSDNLTELPLKRFWRNVLSSRPTFNTETGKVETLHGIFKSLPTEVLFNVKLDVPPLWLVAPKSSVYDPDNMKLSSAKGDIEVVYELQNILIEGHSRESNRDGPAIAPRGAQLVLATEKHPHLDDTIVMLNLGYFQFKANPGFYNIQLLPGRSTEIFEIESVGAKGTTTPVPGDEGNDVCVMSFAGTTLYPRLARKPGMEKADVLDVEEEDSLLSKGKKLATGFGLFGGKQKTSDEEHAEINIFSVASGHLYERMLNIMMVSVMKNTKHTVKFWFIEQFLSPSFKEFIPFLAEEYGFKYEMVTYKWPHWLRGQKEKQREIWGYKILFLDVLFPLSLDKVIFVDADQVVRTDMIDLVNVDLEGAPYGFTPMCDSRVEMEGFRFWKQGYWENYLRGKPYHISALYVVDLKQFRRLAAGDRLRQTYHALSADANSLSNLDQDLPNHMQFQLKIHSLPQEWLWCETWCSDESLKEARTIDLCNNPQTKEPKLDRARRQVPEWTQYDDEIAAIDRKRRGVGNETKEKGEVAEEKNTKSRAWEEPPAVPTEKDEL

SEQ ID NO: 4120 - protein, 1238 aa, Tupaia chinensis
MIGENDPIDEVQGFLFGKLRDLHPDLKGQLKELRKHLVESTNEMAPLKVWQLQDLSFQTAARILAAPAELALVVMKDLSQNFPTKASLFDVLRNEARVMEGLHRLGIEGLSLHNVLKLNIQPSETDYAVDIRSPAISWVNNLEVDSRYASWPSSLQELLRPTFPGVIRQIRKNLHNMVFIVDPTHETTAELINTAEMFLSNHIPLRIGFIFVVNDSEDIDGMQDAGVAVLRAYNYVGQEVDDYHAFQTLIHIYNKVRTGEKVKVEHVVSVLEKKYPYVEVNSILGIDSAYDRNRKEARGYYEQTGVGPLPVVLFNGMPFEKEQLDPDELETITMHKILETTTFFQRAVYLGELSHDQDVVEYIMNQPNVVPRINSRILTAEREYLDLTASNNFYVDDYARFTALDSQGKTAAIANSMNYLTKKDDSFIRPVTFWIVGDFDIPSGRQLLYDAIKHQASLLDLSLYFRLRLHLALGLSLKSSNNVRISMVNNPSVEISYENTKISRAIWAALQTQTSNSAKNFVTKMVKEETAEALAAGADIGEFSVGGMDFNLFKEVFESSKMDFVLSHAVYCRDVLKLKKGQRAVISNGRIIGPLGENELFNQDDFHLLENIILKTSGQKIKSHIQQLRVEEDVASDLVMKVDALLSAQPKGDARIEYQFFEDRHSAVKLKPKEGETYFDVVAVVDPVTREAQRLAPLLLVLTHLINMNLRIFMNCQSKLSDMPLKSFYRYVLEPEISFTSENSFAKGPIAKFLDMPQSPLFTLNLNTPESWMVESVRTPYDLDNIYLEEVDSIVAAEYELEYLLLEGHCYDITTGQPPRGLQFTLGTSANPVIVDTIVMANLGYFQLKANPGAWILRLRKGRSEDIYRIYSHDGTDSPPDANEVVVVLNNFKSKIIKVKVQKKADMVNEDLLSDGTNENESGFWDSFKWGFTGGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQCNNPMTKEPKLEAAVRIVPEWQDYDQEIKQLQIRFQKEKEMGTLYKEETKESSKEDAHPAVGQAGKALSKVHLPKGHADVLLMPALRSLPGR

SEQ ID NO: 4121 - protein, 1526 aa, Ornithorhynchus anatinus
MEILVVFAGLWLYSSSVKADSKAVTTSLTTKWFSTPLLLEASEFLAEDGPEKFWNFVEASENIRSSDHEGTDYSFYHSLLNAASQNLSPLQKNLLKFSLSLRSYSATIQAFQQIAADEPPPDGCNSFFSVHGAKTCDFDTLGALLKSAPERPKPNLFKGDHRYPTSHPERPVVIFYSEIGSKDFSSFHHRLVSKSNAGEITYVLRHFIANLSKERVYLSGYGVELAIKSTEYKAKDDTQVKGTDVNATVIDENDPIDEVQGFLFGKLRQLHPDLKDQLKELRKHLVESTNEMAPLKVWQLQDLSFQTAARILTAPPELALVVLKDLSQNFPTKARAITKTAVNSELRFEVEENQKYFKGTLGLQPGDSALFINGLHIDLDTQDIFSLFDVLRNEARVMEGLHRLGIEGLSLHNVLKLNIQPSDSDYAVDIRSPAISWINNLEVDSRYSSWPSSLQELLRPTFPGVIRQIRKNLHNFVLLVDPAHESTTELINVAEMFLSNHIPLRIGLIFVVNDSEDVDGMQDAGVAILRAYNYVAQEVDDYHAFQTLISVYNKVKTGEKVKVEHVISVLEKKYPYVEVNSILGLDSAYDRNRKEGRAYYEQTGVGPLPIVLFNGMPYLKEQLDPDELETVTMHKILETTSFFQRAVYLGELFHDQDVVEYIMNQPNVVPRINSRILNTEREYLDLTATNNFFVDDFGRFTFLDSQDKTAAVANSMNYLTKKDDSFIRPVTFWIVGDFDKPSGRQLLYDAIKHQKSSNNVRISMINNPSEDPSFESTHIARAIWAALQTQTSNYAKNFITKMAKEETAQALKAGADITEFAVGGMDVNLFKDAYESLKVDFILSHAMYCRDVLKLKKGQRAVISNGRIIGPLEDGELFNQDDFHLLENIILKTSGQKIKSHIQQLRVEEDVASDLVMKVDALLSAQPKGEARIEYQFFEDNYSAIKLRPKEGDTYFDVVAIIDPVTREAQRLAPLLTVLTQLINMNLRVFMNCQSKLSDMPLKSFYRYVLEPEITFMADNSFAPGPIAKFLDMPQSPLFTLNLNTPEGWMVESVRTPYDLDNIYLEEVDNIIAAEYELEYLLLEGHCYDITTGQPPRGLQFTLGTSANPVTVDTIVMANLGYFQLKANPGAWVLRLRKGRSEDIYRIYSHDGTDSPPDADEVVVVLNNFKSKIIKVKVQKKADMMNEDLLSDGNPENESGFWESLKWGFTGGQKTEEVKPDRDDVINIFSVASGHLYERFLRIMMLSVLKNTKTPVKFWFLKNYLSPTFKEFIPYMAKKYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAVRIVPEWQDYDQEIKQLQSLFQEEKETGTVHSDREVKKPNREGLETHVEL

SEQ ID NO: 4122 - protein, 1288 aa, Entamoeba invadens
MFLLVCAALFLGTIAKVEVSVRTPWKDVPVIYEVISYVHKTTPTHFKDFFDQIIASQVFSQSGQTAYDTIISIASKYVNKNILERSLALHSEMLFVVSSDNMNVTLDGLLVGDKHFAAKSPLESKLLYLIKSDESLPNAVIVIPDSKIKNTVEEAYSKVSKKEVGSVAIYLSPSKIHTIDRMNTSEVIKDGIVTPLDNMNFTGFTAEMMHRSFKREFGIVQDKEDYIYLKEWDQDKLRAAVVKLLKSNTTLVGENLRKIIANFPLEIVDLLKTNADGIANDFAEMRMMQDQSLSINNIDFELSTKSVYDLLELLRTEDAAIRDLALLKLPQEMYTKSVQYYNNKGVMRFKIPSDIITFVNSFENRIYERNPKNLESFFQYNPYRIFRFTAKDLYTFVATLDFSGDDGMEKALKQLNIVNTIMLRYMIPFHFGVVPVSLPETQGAQLLFTAFYDVNRKWGTDGLMRFVEILGDQNIKTAQDMENVIKNFYRGRVATFTEKFENILKDEKVENKVSYMNKNGFDSSAFFINGMFITPKNIYMEMGKVYQKDLRQLENLISSKQLDENRSIYLQLLYHFDWINTFDKKLLVLEESSLGDSTETTLTLSQEELKMMKHVISVCKAKTETDQINLIKKLSDLNLNNEYLIQANLVDEKDEQKFIELFKNKRYEEAAHLVHSSASKVRNENCDFVYDGIKVVGKEHLNEQIKIIQKLYNSLHDYLLREVGIKKLELATTLVLKDSLKNKRTTNNMYSMVVTSKMARERKLSVTLFIDPIMREAQKAAEYLSIIEDLFPNQVSIDINFIKTPGRGGDFPSEFYISKTLTKPIIRNGVRVDENLEIKGLPSGRNYQLKIETPQCVDTILELATCDIDNIKFLRNTTEHVEYKIRGIVAEGFFSNSIYDGNEKKYFYLTAKGDYGNSVQGAVSKEGYFQLLTPPGSYSLHLENSDVSKFVIKQSKFDTTSFLFAPLRLEVFKEPLLPSERVAQPTQNSVNSKFSSFSSFFGGKNDEQIEIFTIAGGADYERTVKILMYSVKHKTSHPLRFWLVEDFLSPSGRKTLPEYAEKIGVKLNYVRFHWPYFMFKQVSKTRLIWAYKMFFNDLMFPQNIHRIIFMDSDQVTRADAFELWSYDMKNYAIAMTPFCVGEWLNKETESYRFWYQESWKNALNGRPYHISALFIIDFDNFRRDDVGTVYREIYNNLTPDPNNLANLDQDLPNYVQGRVPILSLPQEWLWCESWCNKGVKSRAKTIDLCNNPIHPMSKIQSALMNIEEWKDIDETISGMMKNSEKKEL

SEQ ID NO: 4123 - protein, 1339 aa, Vanderwaltozyma polyspora
MVVKKWSLNWVSTIVLTFLALVAHSNGLGDRNGFGVPEVARVWTVLTRILSLEDDLSVLQGLFPVVFQLDDSLILEDMEQLPETVSELLVKEFQKPNEAALLIEYCYLYPMGFPSELTDGEETNSNYFILNDKHYYEPDDVFYLKSGDLKKQSLKQDADILLVNDVVIGENSKAPIVLLYGCPVGDGVFDSFNRNLFAEAKAEKLRYIWRSTCSLDYQDDPIELSVSLTKRKNSGLTKWNYDFPGDLPAEFRKRKYTMQLPTTEELKDMDLKVASLIGSFYEKTKNFSKTLDYAKSIVNNYLLLVPQLLKAKVNERIIETQKLLSKKGIDYNMLGLYINGNNLRFSMLNEYTLLNAIKMELQDVNRFEKLLSNIGAKNTLPLAKKLLSRFSQFSLNNLKELQPFKLDLHRIPAFEGSVIYFNDIEKDTQYNELSTDVEAFFEKSKYGEIPEFRQNWNEIIFVIDFNTLHDSETQEALSGLIRALNIISQGYPQRIGLLPLHTGNDKNIIRSIYELKESGIKHLIEFLNALLKNENDEINDKDLLFSDYEDVPSIDKFLEDMEIYENSVIINGEIYPFKSNTWNYLIAKIIKKDVTLLKRELSRQKGQKDVKVRGLLHLKSGVNRNSRYLPDYFADSVYTYMNNGILENIRENLIEYIPNKEFNVLHTITLADDFNQLEALNRLESLINISYGGIKIRLINLFDDKSGNWGKLKDAFLKSKDLISVVESLQRKKPLKKGSEKSVGIDILHKWLPDVPLKYIDDRNFMIFNGKVISFEGDEILDTKLFESILQREAKRTLDTMYSFEEIYPDFFIDGVDPNNVEVASSLLTKMFYHSSDIYHNGIEYKTESELPRMDLNKFLENDDFTIFDKTSKPKPVDILLILDPLEERSQKILSLVSKIEQLPFINIKLVILPTKDLSFYSIERVYLPNTDIDDLLSSDLRKYFDIEIDSNPEMVMNENFEITDLVLEVHAFDETRPVSEGTVDGQGGVCLELLDSSDNLVGKAFTMETFGYGQFNIPKLGKCFKIQSCDPRFEVVSFSDAAYSDYISVKSFSILDFNPKKVYVKLRKLSDDKFVKTIEDNKINIFSTLNGSPEEEGNYKEMVLSILASSKNDGKRIKFWILDIPQLSTSFREFCSRITLEESVNSEIEFIKYNWPSWLRPQRFIDRRLDISKFIFIDVLFPQEVDKIVYMDPTREPIDIFDILEGSSKFSSPFVMFPISGKGYWSEGYWSKMLKEKKLRFHSIHPGFVINLQELRKLSGGDKLRIHYQRLSADVRSLTNIGQDLVNDVQADVSIAPLKKSLKKRLEISEEKLSALRQLISNGSANSKGSGEPLHDEL

SEQ ID NO: 4124 - protein, 1306 aa, Tetraodon nigroviridis
NPNPRKVYLSGYGVELAIKSQEYKAKDDTQVQGAEVNATVIGENDPVDEVQGFLFGKLKNMYPELKEQLQELRKHLVESTNEMAPLKVWQMQDLSFQTAARILAASPDDALYVMRDLSQNFPTKAMSITKTVVKPEIHKEITDNQKIFKGSLGLHPGESALFINGLHIDLDTQDIFSVFETLRSEARVMEGLRSLQIETHFIHDILKLNVQPSDSDYAVDIRNPAINWINNLETDHRYSSWPYNVQELLRPTFPGVIRQIRKNFHNLVIILDPVQEYAAELLSVAEMFYANNIPLRIGLVFVVSDEDEVDGMQDAGVALVRAYNYISNEVDSQSAFDAVISMFNQIPLGGLLSPAHVVKVLEKRFPYVEVSSILGADSSYDTNRKEGGAYYRQTGVGPLPVVMYNGIPYQREQLDPDELETVTMQKILETTSFYQRAVYLGELATDHDVVEFIMNQPSVVPRINPRVLSTSRSYLDLSDTNNYFVDDYARFSTLSVKERNTAVANSMNYLTKKEALSYFISLSDDAFIRPVTFWVVGDFDSPSGRQLLYDAIRHMKTSYNVRLGMINNPSDASSSETSRVARAIWAAMQTQSANNAKNFITKMAKEETAAALGQGADVGQFAVGGMDVALFKEAYEGLKLDFLHSHAAYCRDVLKLKRGQRAVISNGRIIGPLDEEEVFNQDDFLLLENIILKTSGERIKSKVQQFETEEDRASDLVMKVDALLSSQPKSEARVEYDFANERYSAVKIRPKEGDMYFDVVAVVDPVTREAQKLAPLLLVLKKLVDVNLRVFMNCQSKLSEMPLKSFYRYVLEPEVLFQADGSFSAGPMAKFLDMPQSPLFTLNLNTPESWMVESVNTRYDLDNIYLNEVDSVVAAEYELEHLLLEGHCFDVSSGQPPRGLQFTLGTASEPVIVDTIVMANLGYFQLKANPGAWILKMRKGRSDEIYKIYSHDGTDSPADSDDIIVVLNNFKSRIIKVKVQKKQDKLDEELLSDGTEENDAGFWKSLTRGFTGGGATEELKQEKDSVINIFSVASGHLYERFLRIMMLSVLKNTRTPVKFWFLKNYLSPTFKEFIPYMAKEYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDHSKRSAKTIDLCNNPMTKEPKLQAAVRIVAEWSDYDQEIKRLQSRVQESSDRGG

SEQ ID NO: 4125 - protein, 351 aa, Cervus elaphus
IEKAVTAEYELEYLLLEGHCFDLTTDQPPRGLQFTLGTKNKPVVVDTIVMANLVRKKPDKIKEDILSDKGEKKRGMWDSIKRIMMLSVLRNTKTPVKFWFLKNYLSPTFKEVIPHMAKEYGFQYELVQYRWPRWLHQQTEKQRIIWGYKILFLDVLFPLAVDKIIFVDADQIVRHDLKELRDFDLDGAPYGYTPFCDSRTEMDGYRFWKTGYWASHLLKRKYHISALYVVDLKKFRRIAAGDRLRGQYQTLSQDPNSLSNLDQDLPNNMIYQVAIKSLPQEWLWCETWCDDESKQRAKTIDLCNNPKTKEPKLKAAARIVPEWVEYDTEIRQLLDHLENKKKSAVLTHDEL

SEQ ID NO: 4126 - protein, 586 aa, Elephantulus edwardii
VIKLEPKEGETYFDVVAIIDPVTREAQRLAPLLLVMSQLINMNLRIFMNCQSKLSDMPLKSFYRYVLEPEISFTSDNSFAKGPIAKFLDMPQSPLFTLNLNTPEGWMVESVRTPYDLDNIYLEEVDSIVSAEYELEYLLLEGHCYDITTGQPPRGLQFTLGTSANPVIVDTIVMANLGYFQLKANPGAWILRLRKGRSENIYRIYSHDGTDSPADADEVVVVLNNFKSKIIKVKVQKKADMVNEDLLSDGTNENESGFWDSFKWGFSGQKNEEVKQDKDDIINIFSVASGHLYERFLRIMMLSVLKNTKTPVKFWFLKNYLSPTFKEFIPYMAIEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAMRIVPEWQDYDQEIKHLQTRFQKEKEARTLPEENKTKEPRLEVKYTVLSLPTSM

SEQ ID NO: 4127 - protein, 1933 aa, Hericium alpestre
  MOD_RES (1175)..(1179): Any amino acid
  MOD_RES (1182)..(1182): Any amino acid
  MOD_RES (1193)..(1194): Any amino acid
  MOD_RES (1207)..(1207): Any amino acid
  MOD_RES (1220)..(1220): Any amino acid
  MOD_RES (1231)..(1231): Any amino acid
  MOD_RES (1242)..(1242): Any amino acid
  MOD_RES (1249)..(1249): Any amino acid
  MOD_RES (1267)..(1267): Any amino acid
  MOD_RES (1308)..(1308): Any amino acid
  MOD_RES (1314)..(1314): Any amino acid
  MOD_RES (1324)..(1324): Any amino acid
  MOD_RES (1328)..(1328): Any amino acid
MQLALHAGTPKIEAFYQHYIDTSKAQLAPNDTDACGSWVEWYGEAVCDIDRLRDLVGPEEIDASEQEVHHSESSSRPQILPFDHIYPPPSQTLDIPPRTAIFHASMASSNFRELHYYLMRVSGRVAPRVEYVYRPIPSPDRGAEHSHLSGYGVVLDLKKMDYLALDDRRAGRKGSTSSSQALHISNADLGSSSGDSQVDEGTLSEPEVDQIVTLLSHYELNETMAASEPLTAEEIAPRRVVVNSGLEEEVHRNSFKVQPGTSIVWLNGGIVSEADMNPFGLLRVVRKERNIIQSLTSLGLEPPVARKLISHPAIADAATNSEFLDGIFDASDRPEQGDLIVWWNDIEKDSRYARWPSSLYTLMRPTYPGQINLVRLNFFNTVLVVDLSRFASLDYITGMVSNMIEHSFPMRFGIVPVVETDEGTRMAKVFWHLIETYGRGRTMRYFRSILESPQSYDVLPTYIDWAKARSVYDDFVVLQELPEGKRRLDWETVIGDSDEETETRLAKARSYTQRLGAGLSSASNGHVFANGKYFELNDMIAHQLQNAMTQTLQHIQEQIYVGKLSDEDSGKLSTYFYDLPGVQKRRNKYIFPAGGAKNTRIFNVPDLFDRTGFPASSESFVYPETEKVPLTIYVLADLDSEAGLSLVQAALTFVRPSEARISFIHNPSPSNIGVGEHRRPSTLLSRLQVHGLLAKRDPDRLSQALNLEVPLDIVKAGQTVLSPEAALQEISEGIAFDKDVDLHADYIKVGRLVARELGLSPGESALMVNGRVVGPIGEGGFTAEDFQVLQQHELFRRVEPVLRALEDLHPVISDYDKATFAQVVSMASSVVSDVLTPDPSEVGLFNSPPASRNPTYGLLQSEHTKIELGDNSTSHLHFAVLIDPLSEYAQRYVSLLEWLTSIPHVSAELHFHPVVNTELPLKRFYRYNLLPRLNFDENGKEIPSNAVFEDLPVEPIYTLALDIPSSWLVRPREALYDLDNIQLGVLSNEEARRGVEAVYELDYLVIGGHAGDAAANGAPRGVQLQLTTSNGAPIDDTLVLANLGYFQFKAKPGVYRLEIREGRGREIFELESVGNEGWDSPPIDKTGNVITLTSFEGWTLYPRLARKPGMLLADVLEVPQEKEETNGLASVLSSISSFFKPKETANEQTEESVSTRRHADINIFTVASGLLYELXXXXXQEXLPHFAEEYGFXXELVTYKWPAWLRXQKEKQRIIWAYKXLFLDTLFPMDXDKVIFVDADQXVRADLKXLVDLDLHGAPYGYTPMGXDNTDMEGFRFWKQGYWQQALHGKPYHISALYVIDLNRFRQXAAGDIXRTQYQALSAXPHSXANLDQVIRVTSSTRDHVRNTKRSSTKTLVVPSSANGEVVITSSQDVSPEVVASTISPSGNLTAILRETGQGEKKRFVEIWAKDRLIVATEVTKLHGVFYTDDHLRSLSFSPSETKLVYTAEANTPENQKDPYTRFRFVPDFGESLTERKRPQLALFHWQSESTTSFGQGPGQADIISFPPHLQLGGPHASCTTLHFLDLDTRESKTLLGTIDKPSPSIMDDFAGLYTVFALPAKPFLRLGKNLKTYIVTQSAEGSRTTIVLIDAESPSNVKRVTSAKNGSVEDTLRSWSFLGTDGHAQFLCARSSPTRPNELLLGTVDDHLTVTWKVLDTPALPSAAEQALKSLQASIIQIPDRHPVETILVKESKGSSAEPKPLATFIHGGPHSTSFTAFTPSVAALALQGYNVSLPNYTGSLGFGEYYVQKLLGKCGSLDVEDTVASVQHLIKLGIAEDKPEKLFLLGGSHGGFLSAHLVGQYPDKFGAAVLRNPVITGASPASTDIPDWYFWEFGVPYTPGADITPELYEKLWKMSPIAHVDKVKAPVLLHLGTSDRRVVNVQGRDYYHALKGRGKTVEMMEFKGEGHPLDGVEAARVTWESTVDWFKKVRS

SEQ ID NO: 4128 - protein, 699 aa, Fukomys damarensis
MMEKKDYYKKKTETKNSQFIPHSSSWSLPSSSQLSRVPARNMLSPVLWHFLWAQVPPSQLVFLSQEPFISLRLTLQQENRIGFVFILNTDDEVDGRNDAGVALWRAFNYISEERSVSEAFISIVHGMDKNAFEKKYNTVGVNIFRTHQLFCQDVLKLRPGEMSIVSNGKVLGKIINMRVTLFMNCKSQLSEAPLESFYRFVLEPELMSGDNDRPFLGPVAKFLDIPESPLLTLNLITPEGWLVDTVHSSCDLDNIHLKDIERSVTAEYELEYLLLEGHCLDPMTKQSPRGLQFTLGTKNKPVMVDTIVMANFGYFQLKANPGAWILKLRQGKCEDIYQIIGHEGTDSPSDIEDVIVVLNSFNSKIIEVEVQKKPDKMNEDILTDSDGKKGMWESIKSFTRKLHKDDDKKEKEVLNIFSVASGHLYERFLRIMMLSVLRNTKTPVKFWFLKNYLSPSFKEVIPHMAKEYGFQYELVQYKWPHWLHQQTEKQRIIWGYKILFLDVLFPLAVDKIIFVDADQIVRHDLKELRDFDLGGAPYGFTPFCDSRTEMDGYRFWKKGYWASHLAGRKYHISALYVVDFKKFRRIAAGDRLRGRYQALSQDPNSLSNLDQDLPNDMIYQVAIKSLPQDWLWCETWCDDESKQRAKTIDLCNNPKTKEPKLEAAARIIPEWVEYDAEIRQLLDHLENEKKSTSKLLSLP

SEQ ID NO: 4129 - protein, 1493 aa, Sclerotinia sclerotiorum
MGAFKFPWGLSGALLASTYLHSIGVTASPSINVGLQTSFPSAPYLLELLETAATENVSSYFPLLDRIADGYFTKASTDRDLYDQFIQILKEDGHMDAESLSSYQLALSMRVAAPRIEAQFQYYHTAVEASIKREKDSSCPTWVLFDGNQYCSPTLNEPHGKVNGPSQTKELPFDYVLGNPDGPHSILYVDITSPTFGHFHKTLVKTAREGKTSYRLRHRRAIDSGSNKPLMIPGYGVELALKRTDYIVIDDRKDDDEEVPKSKTETKVKFEDEEVADLKPLSTSELSSLGLKASSFIMQSENPFDTLIKLSQDFPKHSSAIASYNVSSDFLAEHNYNRGKLVPAGFNVWWVNGVQMIERQIDAITMLDIMRKERKLINGVSELGLTGPEAVQLLSHPDISDAKSDGDVQRFDWRDEIEGGRVIMWLNDIEKDKRYAEFPAALGALLQRTYPGQLPSVRKEIFNLVVPVDFSTPEDIALVSETLASFVKRKLVLHIGLVPITTSPAAIEQARVLYHLLDVYGLSGAIAYLEASVLNGVASPTEKAFEAAIEGREVRAEKVAIPLKDLLESDYYSDRIDASNRWSTRLSANGEFPPIFVDGVALPRDDNWLQGMVQRLTVDLQVIQQGVFNEIFTQDSYIPDFFLSEATARRNALIIPESDKNLKIIDITILSKHHGDVLSKLPKIGADSAWSKEDWAHMVLVADLSSVTGMDLLLSAAKFRESTSPLEITIIHNPSSDKETSDFSTRLFSHIQKRSDETFVDAQDLPTLANQDELELDYTTKDSAKTYWKLAGPLIRSAGLLPGESGLLLNGRLVGPIPAGSELKQEDFEQLISYERAKRIIPVFAAMKALGLSEKITDPLTGAKISSMVALASVSDTPDGIFEQAPTTRVSAFDIWNSSYTSIEAGDSSTATIHMTVAIDPASEQGQKWVPIVKAISELEGVYLKMFLNPKELLQELPVKRFYRYVLDSKPTFNDDGALITPGASFTGVPQEALLTVKLDIPPAWLVAPKASIHDPDNIKLSSIKSDVDALYELEHILIEGHSREMPSGSPPRGAQLILGTEKDPHFADTIIMSNLGYFQFKANPGFYKIDLQNGRSSEIFKIDSIGSKGWAPVPGDESTEVVLMSFQGATLYPRLSRKPGMEGEDVLEAKVESAMDFVSRGLNFAQGLLGSKNKATAAVEEHAEINIFSVASGHLYERMLNIMMVSVMKNTKHTVKFWFIEQFLSPSFKDFIPHLAAEYGFKYEMVTYKWPHWLRGQTEKQREIWGYKILFLDVLFPLSLDKVIFVDADQIVRTDMIELVNHDLQGAPYGFTPMCDSRTEMEGFRFWKQGYWKKFLRGLPYHISALYVVDLRRFRQIAAGDRLRQQYQSLSADPNSLSNLDQDLPNHMQQVLPIHSLPQEWLWCETWCSDESLKEARTIDLCNNPLTKEPKLDRAKRQVPEWTMYDDEIAAVDRKRKGINGSGSGNEVGDGKNTKSRTLEEVVDTKTKKDEL

SEQ ID NO: 4130 - protein, 1545 aa, Gouania willdenowi
MAAGQHQQPGEKRGSCSSAIMRRTIVLSLLLLNIHQVISAPKGVTASLKAKWSMTPLLLETSEFIAEDGNEKFWQFVDTVQELTVYKHGESVRSYYNLIIKKAGQFLTDLQVNLLRFALSLRSYSPAVHASQQIASDEPPPEACPAFVSVHGQHGCSTKDIKKLLKAATDRPKPYLSQNDHTYPGLNKSEVPVVILYAEIGTKKFTTFHKVLSEKAEQGKLTYVLRHFVADPKPRDMLLSGYGVELAIKSTEYKAVDDTKVKDANTTMNAEEEEQDEVHGFYFGILKKSHPELKEQLLDLHKHLLESRNDMAPLKVWEMQDLSFQAAARIMSVPKFDSLKHMRDLSQNFPSKARSLTRVAVKQEMRKEIEENQKHLSDTVGVHPGDGELFINGLHIDLDVHNPFSILDILRGEARVLEGLHNLGIKGEQQGLLLRLPVNTVDDSYSLDIRHPAIMWLNDIENDPLYRSWPSGVQELLRATFPGVIRQIRRNFFNLVLFLDPLQEESVELVKLAELFYKHKIPLRIGFVFVVNTKDEIDGFSDAGVGFYRLLNYISDEYDLSQALMSMVSLFNDVDVGEALSSDTISKYMKRKFPKANSDRILGAESEYDGNRKDGAFYYKQSGLGALPLALFNGVPLSPDEMNPEELETILLQRIMDTTTTFQRAVFMGQLTEGSDIVDYLMEQANVVPRMNPLILSTNRKYLDFTANPVADDWSDTTMFSFLDSRDKTGVIAKRMKYFANNDVDGMASVTLWIVGDFQKVPGRKLLLNALKHVRASPGVRVGVIDNPNEKAWEDNTVLYRAIWASLLTQKNKAAAEFVQKLLKEESSRLLQQGTKMKDLLMQGMDADAFEKKFNTMEVDFIRSQRLFCRDVLKLGPGQRAVISNGRILGPLEDNEEFTVQDFHLLEKITLSGSAEKVKARVNQIGLKSKHASELVMKIDALLSAAHKEEVRRDVHFAKETHSVLRLSPRENEVFYDVVAIVDPLTREAQKISSLLIVLSQVVNVRLQVFMNCRAKLSEMPLKSFYRFVLESDVTFLANETVSPGPVARFSELPESLLLTLNMITPDSWMVQAVHSPYDLDNIHLQKVSGVVAAEFELEHLLLEGHCFDLSTGQPPRGLQFTLGMSQDPLMYDTIVMANLGYFQLKANPGAWTLRLRKGRSEDIYEILTHDGTDSPSNAGDVIVVLNSFHSKIIKVRVQKKADKISEDLLSESSESKSIWDSIASLWSTFEKSIAGGSSNKEQGEKQKEDILNIFSVASGHLYERFLRIMMLSVLRHTKTPVKFWFLKNYLSPSFKETVSHMAESYSFQYELVQYKWPRWLHQQTEKQRIIWGYKILFLDVLFPLAVDKIIFVDADQIVRADLKELRDFDLDGAPYGYTPFCDSRKNMDGYRFWKSGYWASHLGQRKYHISALYVVDLKKFRKIAAGDRLRGQYQALSQDPNSLSNLDQDLPNNMIHQVAIKSLPQEWLWCETWCDDVSKVTAKTIDLCNNPKTKEPKLMAAARIVPEWVVYDNEIKQLLRRVQKEEKQTSEERTQKAENQRDEL

SEQ ID NO: 4131 - protein, 614 aa, Laodelphax striatellus
MTQTPTLQKAVYKGDLTDGMSVLDFIMDQPNVMPRLNDRVLNLGKSRYVDLVGTSKPSELSKSVMLSLKYASASKKEEKSAHLLTHWVVSDLATEKGRTLLLNALDQMRSSGRIRVGFIANPSAGASDTKLEKLVVGAAETLSPDQAAIKIKRIFYRYVLEPEVQFTADGNLAAGPYAKFTNMPGAPLLTQNMHVPENWLVESIVSPYDLDNIRLEEVQSVVHSQFELEHLLLEGHCFEATMGNPPRGLQITLGTESEPVVVDTIVMANLGYFQLKANPGAWILRLRQGRSSEIFDITSHEGSDTPVNSTDIKVLISSFRSHVLKLRVTKKPDKIGMDLLGEDDDSQPGLWNSITSTFGSSKEEQAEAETINIFSVASGHLYERFLRIMMLSVLKNTKSPVKFWFLKNYLSPTFKDFLPRMAKEYGFQYELVQYKWPRWLHQQTEKQRIIWGYKILFLDVLFPLDVKKIIFVDADQVVRADMKELVDLDLGGAPYDDLQIVFWKHGYWRNHLQGRRYHISALYVVDLRRFRKIAAGDRLRGQYQALSQDPNSLSNLDQDLPNNMIHQVAIKSLPQEWLWCETWCDDDSKKYAKTIDLTRPPDMLILNYDKSTHV

SEQ ID NO: 4132 - protein, 1771 aa, Sporidiobolus salmonicolor
MKAVAWLLLALAGPPGLAAAHSSPPVSARIETAWPAPDLVTQYLCAPLLSLRPRRQLTHRLRNRETLALEVPAHLFPFISFLASHPTSHRSLDPPLRAASLSASEPYSSQGISAAFVPEGTLQHNETLAVLEAAAARSLLFRGKGVRQSMGLALANREASVAIEAMRGLWEEREREVTAGTTNGGGEGETTGAGATRAGCESWIDVAEKKACSVDEFWKVVGEEQKDGKLPIILPETLRPSERPRLYPFDHVSPPGNNPHLPRVVLYGSPTSPSFQSLFAFLYQLSEPKPLPVIDPKSSTPSAATPGAAAPHPPRLQFALRWKPSSGTIKSNEKLVLSGYGAALDVKKSDYLAIDDRMSAASAGEEGESSSALDRDAPLEIEGDMPLKMEPVKKSDIAELSVRATDFIMSSDAPFQAFTALTSSFPLMASHLSTVVRNVSSHLLSEVAANQMSFPALTMRPFFSLNGMALTDAQVDPFALLRLMRKERKYVTDLEALDKHLSSKAAREILINGQAKSGEQGKTQQRVEAEVLGELFDATDRDEGEHVILWWNDLEKDRRYKSWSTSVRDLLRPVYPGSMNLIAKNLNNVIFVLDLSQPAALALLAENVKQFVSRGIPVRFGLVPVVGESGDAESVETMLAQVVWYLVDALGRAPTMSFLTDLYTASPEAPITPDLLLRAYMRLAAQSTHVEGGPLASFHAIQDGVYTKSESLTSRLSKTREYLKRLGIPLAKGENEGEKSAIGAFFMNGAYFPIDDEFSQNLQRTLGLHTQFLQQEVYIGALTNDMDAKSFFADLPTTHKRRNPYIFPSAETNPLRIVNLVDAFKGVDPAVMESFYIEGVTGMVDNETGFDIEDPPAAATMFIIADLNEPAGIQLAKAALQLAVRPSSSLSFLMLTNVDPLEQDKNTSVRISFIHNPVEHYEAHPWTFSNLLYLLHSYQALEDVLPIEFINWIDLTLDVGGPLPRHGMTWTEENPLRSVLLKGVEGKQAGEASLFWEELQWLSHQLGFQPGQNGIVINGRVVGPFPDGAFGLADVRALLSYELEKRIYPVVAAIQGTDFDTSLLERSHQSHLFNLASSIVQEAYLPDSAASIFGTGAVERRRDYVALHGNHSAFTNGNLRSALYEIVVVVDPATELAQRWAPIIQTLASLDTVHLDVYLNPNFHLTELPIKRFYQYTFSSALEFDELTGKELQPSVRFDGIPEDVLLTFGIDAQQSWLAFPKTSVHDLDNIRLVDLPEWSRKKGVAAVLELESIIVEGHARDMPSSKPPRGLQLELRSGGKASPNEKRVDTIVMANLGYFQFKANPGPWRLTIRPGKSSDVFDMESIGANGWKSGDVSETGDSLVVSTLEGLTLYPRFRRKPGHELTELLDELADVAAKRESASLLNRLKSMIPFLAPQSGSTDLITTSKRADINVFTVASGLLYERMAFIMIVSVLRHTKSTVKFWFIQNFLSPSFKAFIPHMAREYGFDYELVTYKWPHWLRAQKEKQRTIWGRILFLDVLFPLELDRVIFVDSDQWVAVLCPLSHRALTFTSCRIVRADLKELIDLDLQGAPYAYAPMGNDREETKGFRFWETGYWKQHLAGKPYHISALYVVDLDRFRQIAAGDRLRQQYQGLSADPNSLANLDQDLPNNMQTSIPIVRPFSRLTCSQALIGASAIQYTLDRSWLWCQTWCSDESLEQAKTIDLCNNPLTKEPKLVRAKRLIPEWITYDEEVAALARRIAESSASSPGEVAAFGTKADELEQAVQQQKEREEVLGEMKGADLVKDEL

SEQ ID NO: 4133 - protein, 914 aa, Trifolium pratense
SSIIGVNILTIFCRPKVKSPPQEILLKLEKEPELKELSQESSKHVFNLGLSKLQCSLLMNGLVIDPNEEALQNALNDETQRIQEQVYFGQIKSHTDVLDKFLSEAGIQRYNPRIISDNKPRFISLSMSTFGEASILNDINYLHSPGTTNDLKPVTHLLAVDITSGSGIKLLRQGLNYLIEGSKDARVGLLFSGNQTTNLFSLLFVKVFEITTSSYSHKKNALDFLDQLSSVYQQKYILTSAVEVDGTQEFIDEICKLAESNGLPSKGYRSSLSEFSAGEVRRHLSEVEKFLYIALGSESGVNAVFTNGRVRLSLSPAVTCPIDESTFLSADLHLLESIELKKRTNHIVDIIEEVTWQDVDPDMLTSKFISDIIMSVSSSMSMRERSSESARFEVLSDQHSAIILNNENSSIHIDAVLDPLSPTSQKLSGILRVLWKYIQPSMRIVLNPLELRSSLALLRIEASCHEVSSLADLPLKNYYRYVVPSMDDLSNIDSSINGPKAFFANMPLSKTLTMNLDVPESWLVEPVLTVHDLDNILLENLGDTRTLQAVFELEALVLTGHCSEKDHDPPRGLQLILGTKTSPHLVDTLVMANLGYWQMKVSPGVWFLQLAPGRSSELYIFKEDDDGSKNKQSSKLITINSLRGKVVHMEVVKRKGKEHEKLLIPDDDDNLQDKKKGSGWNSNLLKWASGFISSSEQSKNAESNSLVIFVDADQIVRTDMGELYDMNLKGRPLAYTPFCDNNREMDGYRFWRQGFWKDHLRGRPYHISALYVVDLKKFRETAAGDNLRVFYETLSKDPNSLANLDQDLPNYAQHTVPIFSLPQEWLWCESWCGNATKSKAKTIDLCNNPMTKEPKLQGARRIVAEWPDLDLEARKFTARILGDDLEPIQSPDQSKDSTNDDSLKEEDLESKAEL

SEQ ID NO: 4134 - protein, 1487 aa, Hypocrella siamensis
MDVLRLSWPLATCLAFAVQTWAAPAVRVDMTAAFDAGPYLLELVETAAGENSSSYFPLLDRIANGHFAAASSDAELHQRILHTLRDDGHITTPEALATFDLALGLRSSAPRIEAHYQYYATTVEPFVAHQHCDAWVLLEGKQYCTPELDIMTRDNLSSLATQTLPFDRVLGSLIGTGKEAILYADPTSNEFAKYHQALSEAARSQRLNYRLRYRRSRTNTNKTLYVSGYGVELALKKTDYIVIDDRAAVQSTGKPHQSSRRVLTGAEEEGLFDLEPLSTTQLASIGIKAASFILESDTPFETLVQITGDFPRYASSIASHNASDEFVTEHQQMRAHMVRDGINFLWINGAQLIDRQIEPFALIDMLRRERRLVDGIRDLGFDGDQAITLLGHDAISSASSEEDPQRYDWTDAAEGGNIIIWLNDLEMDKRYESYPKRLSSLLQRTFPGQIPPIRKNIFHLVFPADLSIDEDLEFIAEVISIIDRGVPIQFGLVPLQTTDESKIQAKVAYYLAANYNLDAFLSYMGSLARVQDRSAADSVLSAITEAYPLLPQGQPLSAGEVAAAEDYVEKLGMARDWIARLQADTSARSLFVDGVAIPRDRKWLQTVSTIIVGDLQTIQQGVYHGILDEQASVADIFLDGAASRRSHYMVSNDDKSLRILNIAKLHDENTHFLDALPVLDAGAGAAKQDWVAITVLADVSSAIGLTLMQTVLSFKQQNPAVRVDVIDTQEDERLSFQVISALKANRDELAGSESLDDLKAILNEAASYSANEQYAQGRQKFLSEAGFPVGSQFLLINGRVVGPMMPAAPFVAEDLQVLVEFEQTQRIRPVFAALEDLELGEKISSPIAAAKVTSIIAVSAISGLPEGIFESAPTTRSTIYNTWNTSHTALQTGDPRTCSLHIVGLLDPASEKAQRWAPILRTIAGLDGAHVRLILNPVDKVDELPVKRFYRHVFEPKPNYNDDGSIKPPKASFKRLPSEALMTAGMDVPPAWLVASKLSMKDLDNIKLSVVEHDVEATYQLQHILIEGHSRDEKGSPPRGAQLVLGTAAQPLLTDTIIMANLGFFQFKANPGVYQIQLKEGRSSEIYAIESIGANGWEPTAGDEGTQLALMDFQGATLYPRLKRKPGMEESEVLDDSAKPSDANLMSKGLKLAEGLFGAKSKSPAEQKHAEINIFSVASGHLYERMLYIMMVSVMRHTKHSVKFWFIEQFLSPSFKEFIPSLADEYGFKYEMVTYKWPHWLRQQKEKQREIWGYKILFLDVLFPLSLNKVIFVDADQIVRTDMIDLVNFDLHGAPYGFTPMCDSRTEMEGFRFWKQGYWANYLRGKPYHISALYVVDLRRFRDLAAGDRLRQQYHALSADPASLSNLDQDLPNHMQFQIPIRSLPQEWLWCETWCSDESLVKARTIDLCNNPMTKEPKLDRARRQVPEWTTYDDEVAALSAKRGLGLRSNVAETPSDEQMDQDQDEDKDEDERSKKSPEHQHQKDEL

SEQ ID NO: 4135 - protein, 1615 aa, Jaapia argillacea
MLLRRIIVLPWLFIATRAATSPPLKVSLRTSWSAPPFLLEVIETIALENPASFFPLVDALTDPSLPPPSSPEATYHLALQTALKDGWLTDPSAKEMVEINLALHSATPKLEAMFEWYRDTQSQRGEGEDVDVDKECGSWVDWYGERLCEVEELVRLAGHETIDAPSSGSQISGTSSSKLKPKILPFDHIHPKTLARPPHTAILYASPSSSNFRALHSYLYSLSSGVNPRVEYILRWAPPPSKDGVGAEERSYLSGYGVSLDLKKTDYLALDDRRSGSKSSGAESGGRTIDESSEELVDSILELIESYPVPENYTRDSSHPLTEDELLAIGIQATQLITSSTNPLTTLTKLTQNFPSYASLLARRVVVDEELDQEIRNNQVGKVQGGIGAMWLNGGVVGEGEVNPFGLLRLLHRERPLVLSLTSEPLSLTPRQAITLLTHPTIAAAQGEEVGVLEGLFDASDRQEGGGVVVWWNDLRKDSRYKKWSESLEVLLRPSYPGTFPQTKHNLFNIVAVLDLSKTSSINFLSQAVSGIIQRGFGFRWGVVPVLSNDEGRKMGRLFYYMIENFGRAKTMGFFKKVSQIQTLTDPTATSINWPIIRSEYDTLVLAESESEIFVPRDLDSVVGDGEKEEELAKASAYAKRLAVDGSGNGELGHVFVNGKPFDMDDDFLRNMQAEIGQQLQFLQAMVYTGTITDADDDAIDNYFYDRPTTAPKRNKHIYPSNKPGRGLKIMDLAKVFGRDGGMQGPFIYPEKSDFVPVTVWVVADLDSDDGLLLVKEALESLTPESRTRVGFIHNPRDAPPPPHHVDQMHSSLKSHVLSNPFLYKLSSSRLLRVLGLSSQIATPNSGPQTVIMSEDELEGGGALDADVYDEFLKMSRVVVDRLGLNPGAGALVINGRVVGPVLPGEFEAADFKLLEDYEMKRRVEPVHEALKDVLPDIDANDKAGLAHLVSLASSIISSIQIPGPSEIGLFNTPQRPRTRNYQLLDGDYTSFRVGNNETALYHFGVILDPLSEAGQKWPSLLEWLSSIPEVFIEVYLNPAQYREIPLKRFYRYNVLPRLSFDENGQEIPARAEFQNLPIDPIYTLGMDVPQSWLPRPREAPYDLDNIQLSTLTDKEQQQGIEAVYDLDYLVIEGHARDTLTNSPPRGLQLQLTTSNSTAIADTQVVANLGYLQFRAKPGVFQLEIREGRGREIYKMESVGSEGWESPTVEKAGNEIALTSFEGLTLYPRLVRLPGMEMEDVLTIAVAPEAPVSKSLFEQMWDQMLSLFGSSPEPTTDLIVSSTKQADINIFTVASGLLYERFASIMILSVLRNTNSTVKFWFIENFLSPSFLEFIPHFAEVYGFQYELVTYKWPSWLRAQKEKQRIIWAYKILFLDVLFPMDLDKVIFVDADQIVRADLKELVDLDLHGAPYGYTPMGDDNTDMEGFRFWKTGYWKDFLQGRPYHISALYVVDLIRFRQIAAGDILRGHYQQLSADPNSLSNLDQDLPNNLQREVPIFSLNEDWLWCETWCSKDRLHRAKTIDLCQNPLTKEPKLARARQIPEWEEYDSEIARFARKLAEEGLIRSDVTATDVNALANAAAGKTSAEPSSEQTPPNSDVESESARLAEGHERDEL

SEQ ID NO: 4136 - protein, 1625 aa, Mucuna pruriens
MGCLCRSECWVFIVLVLFNIGSAFADAPPRPKNVQTALRAKWSGTPLLLEAGELLSKEQKDLFWDFIEIWLNTEKDAVRSQTAKDCLKKILECVRPLLREPLTSLFEFCLMLRSASPRLVLYRQLAEDSITSFPLGDENYSDDETEEKKKIERRKLDPLQVGVNLKIHGGKCCWVDTGEHLFLDVFELLAWLQGSAELVGDSFQRPEIFDFDHVYYESSIGSPVAILYGALGTHCFKEFHVALVKAAKEGKVKYVVRPVLPAECESKLAHCGSVGAGESVNLGGYGVELALKNMEYKAMDDSTVKKGVTLEDPRTEDLSQEVRGFIFSKILERKPELTYEVMAFRDYLLSLTVSDTLDVWELKDLGHQTVQRIVRASDPLQSMQEINQNFPTIVSSLSRMKLDDSVRDEITENQRMIPPGKSLMALNGALVNVEDVDLHLLIDLIHQDLLLANQFSKLKIPQGILRKLLSALPPSGSSIFRVDFRSTHVHYLNNLEEDAQYKQWRNNLNEIFMPVFPGQLRYIRKNLFHAVFVVDPTTRCGLEASFYFLKLNIFTLFIGYSIDMIISLYENNFPVRFGIVPYSSKFVTQLENHAMKEHNNKFDEDISTMIICLFSYINENHGGQMAFQFLSNVNKLHIESDGNADDALELHHVEGVFVDTILSKVKSPPQEILLKLYKDQKLKEMSQESSKFVFKLGLSKLQCSLLMNGLVIDPTEEALVNALNDETQRIQEQVYFGQIKSDTDVLANFLSEAGIQRYNPKIISDSKPRFISLSMFTFGEESVLNDIVYLHSPGTMDDLKAVTHLLAVDITSRNGMKLLQQGIYYLIEGSKNARIGLLFNVKQSPNLFSLLFVKLCSLYEQNYILTSPMEAESTQTFIDMVCELGEANGLPSKGYRSSLPEFPPDEVRKHLTKVQNSLYRVLGLESGANAVFTNGRVTYPIDESKFWSADLHLLESIEFKQRTKHIVKIIEEVEWHDVDPDMLTSKFISDIVMTLSSSMAKRERNSESARFEILNDQHSAIILKNVNSSIHIDAVLDPLSPTSQKLSGILRVLWKYIQPSLRIVLNPMSSLADLPLKSYYRYVVPTMDDFSNTDSAINGPKAFFANMPLSKTLTMNLDVPGSWLIEPVIAFHDLDNILLENLGDTRTLQAVFELEALVLTGHCSEKDHDPPRGLQLILGTNTTPHLVDTLVMANLGYWQMKVSPGVWYLELAPGRSSELYILKEDGEGSSAKQSSKLVTINDLRGKVVHMEVVKKNGKESEKLLLPDNADNAQDKKKGSGLNSNFLKWASGFICGNKLSKPAEKSSPEKGKGRRHGKTINIFSIASGHLYERFMKIMILSVLKNTHRPVKFWFIKNYLSPPFKDLIPHMALEYGFEYELVTYKWPTWLHKQKEKQRIIWAYKILFLDVIFPLSLEKVIFVDADQVVRTDMGELYDMDLRGKPLAYTPFCDNNKEMDGYRFWRQGFWKDHLRGKPYHISALYVVDLKKFRETAAGDNLRVFYETLSKDPNSLANLDQDLPNYAQHTVPIFSLPQEWLWCESWCGNATKYKAKTIDLCNNPMTKEPKLQGARRIVSEWPDLDLEARRFTARTLGDDQEAESTQSSNQSNDLSSKDSSNEDKESRAEL

SEQ ID NO: 4137 - protein, 1608 aa, Piloderma croceum
MRLTSLTSKWFSLAVAILGTSARSPPVRVALRSSWPAPPLLLEIIETAALENPGAFFPLVDVLTNPEILPSPYPSTPEAIHAFALSAAEGYLSKQGHPTFLTANLALHASTPKIEAFYQYYIDHDLDARRATVAKGAECGSWVDWYGEVVCDIETLVRLAGKETIDSAENSTSSPSPKVKTLAFDHIQPSPSHAQEHPRYTAVLYASLSSKNFRDLHSYLLFLSTGTTPRVSYIMRHIPPSDRGLSERNILSGYGVSLDLKKMDYLALDDRYSHGGSSENDIAEDSTHALSEETDHILQLLQKYPVNDTAAEANVPLTEDELLLIGFQSAQLIRDSSTPLETLRELSQNFPKYATTISRRVKIDQALEEEVKANHEKASPGINMVWLNGAVVDEKHMDPYALLRLLRKERSIVLSLTSLGLTPSQAIELLSHPTVSAAQNNKGVMDALFDASDRPEEGGAIVWWNDIEKDKRYSGWTTSLQTLLRPMYPGQFPNVRHNLFNIVLVVDLSQSSTLRFVAGSLSSIISRGFPFRFGVVPITENEEGTQMARIFRYLVEYYGRARTMRFLQNVAQSYLPHLVTVDWALVRSEFEVLAASPPDEHVPPDFDALLRGTSNYSIELDKGRAYAERLEATLASAPRGHAFINGKHFDMDDAFLRNMQAEMGLQLQYLQEALYTGKLSAETAGDISNYFYDLPTTAMRRNRHIYPSSSVDALRIVSLQQLYSRVGILSHEHFIYPRRRSGSDVVAESESVVSNRVPFTVYVVADLDSEAGLALVKEALDSLKEDSLARISFIHNPANQKSTESHTSLLISHLVHKDLLSKLSPNKLLQALGLASVVDGDDVQTALSQERILREISGGVALVDLDVEIFNDYVRSSRRLVRELRLDSGDHAVVVNGRVVGPIEPRELVAADFEALLSYELRKRTGPVVEALVSIKPSVDSLDQDNFAHLVSMASSIISASQIPDPSETGLFDVPPRARVRNYRFMDSAHTAFEFGDNATTLFQLGVLLDPLSEAAQKWSSLMDWLRTLPGVFVDLHINPSQYTELPLKRFYRYNIIDSLSFNTDGSEHGSQAVFSGLPVDPIYTLGMDVPPSWLVRPREAMYDLDNLQMGALSADDRVRGMEAVFDLDFLVVEGHARDPQSNAPPRGVQVQLTNGNGTSVDDTQIVATLGYLQFKITPGVFQLEIREGRGQDIFKLESVGNEGWDSLTVEEAGNEITLTSFEGLTLYPRLTRQPGMETEDVLIDVPATVEEPPSLMADVVSRISSIFTPKETDLVPSGNAQADINIFTVASGLLYERFVSIMILSVLRNTKSSVKFWFIENFLSPSFLEFIPHLAEAYGFQYELVTYKWPSWLRPQKEKQRIIWAYKILFLDVLFPMDLKKVIFVDADQIVRADLQELVDLDLHGAPYGYTPMGDDNPDMEGFRFWKTGYWKEFLLGRPYHISALYVIDLVKFRQIAAGDILRQQYHALSADPNSLANLDQDLPNNLQREVPIYSLHEDWLWCETWCSKDRLHRAKTIDLCQNPLTKEPKLARARAIPEWEEYDSEISRFARKLADDGLIRSNIVAVDVNVLANAGASSVVDTKDEVESESKETRPSDSDSQVRDEL

SEQ ID NO: 4138 - protein, 1536 aa, Scedosporium apiospermum
MKFQGLSLSLTAVLLAAVPVSAVPSISVSMRAAFQAGPYLLELIETAAAENSTSYFPLLDRVASGYFSGAATEKELYDRFLKLLVQDGHISEPEVLSTFKLALSMRSAAPRIEAHYQYYSTGVQPRFLEPLPSACDTWVLFNGSQYCDYGFGEPRRLVADAIHTSTSLPFDRVLGHGPHAILYADVVSSPSFAPFHNSLVEKARRGEISYTVRYRRTNGPDENDTPLPVSGYGVELALKKTDYIVIDDRDAASDGGGRGHDANHGSGSQVVLDEQEEVADLRPLSKAEVSSLGLNAASLIMKGENPFETLIRFTQDFPAYSARIAAHNASLEFIEEQRDNLGTVVPQGVNVLWMNGVQLIERQIEPFSLVDMLRRERKLITEAKSIGLTGREAVALLGHPNVTSAKVDGSPQRFDWRDNQEGGEVIMWLNDLEADSQYDDFPTSITALLQRTYPGQVPRIRRNIFNAVIPVDVANVDDLKVALQVLAYVNRLLPVRFGIVPFSSSEDSRNLRKVLYYLHDNYGLEGLFTYVELAIHGGQTVADSAIFEEAIAAGSPAEGFKPSTFEEVLASKPLTERLQHVDMWVSRLNANSPTLPVFVNGMVVPRVDNWLQGMGMKINSDLQMLRKGLQLGDINEDTRILGLFLDEAVKRRHPLIYADDEKALNMIDLGKVYREHAALLQSVPVLDAYSDSSKETWAALTVIADMTTEDGLNLLYSALKFKANNPGVRMDILHNPKASSNAAAAAINAALATNLDKLLEAGSIEEIRSLLPAQDPVPDTQYGARLSAYIASTGLEPGTKGLVLNGRVVGPISQDEAFAETEFQQLLDFEQKNRILPVYAAVADLGLGAVLSGPLAAARLTCLAARSTISDLPEGIFESAPTLRTSIFNTWKSKHTTIEVGEAESATVHIIGILNPASEQGQRWTPILKVLSQVDGVYIKLFLNPEERLEELPIKRFYRYVLDSEPTFDESGRVKPLDATFRGLPSEALLTVGMDVPPAWLVAAKSSVHDPDNIKLSLVKGNVDAVYELRNILIEGHSRMVTKDAAPPSGAQLVLGTEKDPHSSDTIIMANLGYFQFKANPGFYNIQLQEGRSSQIFEIESVGAHGYDASPGDEGTEVALMDFKGTTLYPRLERKPGMETADVLSYGAEEAKPESDSLLSRGFRAAAELLGGSDSKHALEKKDKSSDDQAEINIFSVASGHLYERMLNIMMLSVMKHTNHTVKFWFIEQFLSPSFKDSIPHLAKEYGFKYEMVTYKWPHWLRQQKEKQREIWGYKILFLDVLFPLSLDKVIFVDADQIVRADMMELVNLDLKGAPYGFTPMCDSRTEMEGFRFWKQGYWANYLRGLPYHISALYVVDLRRFRELAAGDRLRQQYHTLSADPNSLANLDQDLPNHMQFVIPIHSLPQEWLWCETWCSDESLRDAKTIDLCNNPMTKEPKLDRARRQVPEWTVYDDEIANFERRRKGLPAVGDQKETPSVQEQEQIKEKEKEEEEARGKEEKDGSDNDQPKPDEEPTFERNTKSRNWEEPLTRIKDEL

SEQ ID NO: 4139 - protein, 1330 aa, Pythium insidiosum
  MOD_RES (55)..(55): Any amino acid
  MOD_RES (106)..(107): Any amino acid
  MOD_RES (275)..(275): Any amino acid
  MOD_RES (300)..(300): Any amino acid
  MOD_RES (597)..(597): Any amino acid
  MOD_RES (608)..(609): Any amino acid
  MOD_RES (641)..(641): Any amino acid
  MOD_RES (932)..(932): Any amino acid
  MOD_RES (945)..(945): Any amino acid
  MOD_RES (1060)..(1060): Any amino acid
MPLLLICPLGVILRCEFMALATRGLLKMTATTASWRLLAGATALLAALGGQQHAXVEARGLAVNLTASWPSSRFYPLLETSEFLAEENPLWFWRYVDALESHMQEXXSKRDDVSALSTLAVDVAQEIAPHTKNILELSLSTRTYSVKVEMFRQLALDSGVRPCGPDVDAWAVFYREKQCAVAVACRAEDIKRSVELLTDLDDGNSAETCVATGLHDVELDRVDHKYPQPLRLKDTVILYGLVGSKSFYSFHNELKSLATARRLEYIVRHYPKDAXLETLLQGYGKVGDDEVDGDLDAADXSRDDDDDDDDLTSDEDVDGVFFSTLMRENDVIAAELKGFRDQLVKQHDQHEEIKAWQLKDLGLSATREILDAKNPLKRLRVLSQDFPRHAKKLALSRKSISDDLRSEAAARRSEVQTNGLLNRFLLNGILVDPMQRSFNIFDFMKTLKAEWSIAKKLAQLPLSEQDRETMLENVREAKQARASVRIRVRGPVDGTAPLYINNIETDLTSMDWPSSVAQLRRPAWNLIFLRKNMYEYVVAFDPVSPQGRQALSHIAFMRMRGAPIQWGLLASTKELVAAKGRDERDAIVKQYKDYSLXEKATGWHFAKXXFMARAKDAADDEGRGRAVSGFIEGVADESGDXTVQALLTCYVDATGGAFTRSKSEKEAVETLKSSEHDDSVMSMTEYLAKKHLPFECSLFNGELTDDMDLIDELLTNQGAYPSYFSLFGGDEDSEEDAKVTYMHQDGTITSPKKQTLLFWLDLGDRVHAAHVYEAVKAVQEDMGSLMRVGVVHRLSTASGGDGIGELVAGVIATVGDSDNEKHIGLVIEALRCVVKGKTVEATKSKMRGLVEKIDAWDADEVLASLMQVFDASADVACRDKTFEMYSPPNGLQLVLERDVGSVRLHRDTLVMKNLGYFQLQATPGVWDLHLAXGRAVELYEILDAXTERVLSSRNVIVSDFGSHVEQLLVRKRQGMEHEELLAPSKAGTKSKSDVEPISEDAGLIGSYWNSMLSLFGKKKDKAQKDDAKAVATATGSDSERTGETIHVFSLATGHLYERFXKIMMSSVLKRTKNPVTFWLLENFLSPDFKDSIPALRQKFGMDIRLVTYKWPNWLRQQTQKQRIIWGYKILFLDVLFPLGVQKIIYVDADQVVRADLKELWEMDLKGSPYGYTPFCDSRNVGYQFWRQGYWKDHLRGRPYHISALYVVDLALFRQMAAGDILRAIYDQLSADPKSLANLDQDLPNYAQHQISIFSLPQEWLWCESWCSDESKANAKTIDLCNNPKHKEPKLDMAKRVISGELFQESWLELDQEIREAEQEYVRVATTTSTS

SEQ ID NO: 4140 - protein, 1689 aa, Klebsormidium nitens
MARQLCIQFLLAAFLLLGLRHVHAAPASKVPKGVNVVLRSKWEGTPLLLEAGELLAEHDSPSFWHFLDAWTAQTPTPNLESNDSWCAEQILSQATQNFTQPQASLFHLSLSLRLASPKLVVYRQLASESLERLGLASLATTAKSKDDERWKVTRNPASPGGAMCCWVEAPGKSVLRTARELEEELAEESGATAEEVPRYAFDHVHPASKRGARLFVLYGALGTPCFAEMHRVLSEAVQSGKGVAYIYRPVLPSGCESAASPCARIGTQKPVDLAGFGAELALKNMEYKAADDSEVKKDGSVTSDGPAAEDLTQEVNGFIFSKLVERRPDKEAELLTFRDVLLSSGAADDSDKISVWELKEIGLQAVQRIVQAREPLRLMQDINQNFPNVASSLSRTPLNASVRAEIEANQKMVAPGRTLLAINRALVPDVDSLDLFSLIDRVSADVTLGAALARLGLPADVSGELLALPEPPDDVGGVRVDFQGDGVHWLNDIESDSQYRMWRSSLQELLMPTYPGQLRQIRRNLFSAVFVLDPASTAALKIFPTVMLFYQRSIPVRFGVMLVSPTHLAGIEREEEGQAVAAPAKLAEDLSELVTQVFLYLEEELGREHGFRFLAELARAWGGDADEFDDFTDDVSNDSPLTLAHVEAAYAALVRQTRGSVKRKNLGDFLAGIHGETYREGSLAGTEFAHKKGLAAAAPVMLMNGKVHPAGDVQATLVQAIQEETQYIQQEYYYGRLKERMNILEYVLHSGSQPRYSPLILKRNAQPSDASERYVSLAGSVADQTRFISYLHHPGTADDVKPVTHWVVANLGGKRGLGVLKQAVGHVAGADSAQARLAVLLNGEGEPGALERVVLAALQVPSRRQKIVPFLQRLLSSGALVESLRSATGPVSTETTDFVLRLAAEAGLREADLRSSLTEPASLSQMLEDHRRFCEDVLGLPRGTSAVVTNGRVTALPDSAPALHADDFSLLESLELRARAEKVLLIIEDAEFSDVEPDDLTSDFLSDVILGVTSALAARKRAAGGTANFGLLKTRHSAIVLEGDPSSSISIEAVVDPLSPSAQKLTSLLVLLHEWLNPSIRIILNPVSGLSDIPLKNFYRYAAPSRLDAPSPAPPAVSFSHLPPSRTLTFNLDVPEPWLVEAVQAPYDLDNLRLEQLGESRSMHAVYELEALMLTGHCFDSKTREPPRGLQLALGSGQKLGEGEKSPFMVDTIVMANLGYFQLKAAPGVWNLSLVPGRSTELYALGGGRAGGIRRGGEHGGGGERFQGKVVAHGGDKARREREGEAVGGGRGGWQGGGFETGGCVGSRGGVQVGDGAGAGQEVAAIEGRGACIKKGRPCAVKRDSSSGEELASTVVAPAASNETIHVFAVASGHLYERLMKIMVLSVIKQTQRPVKFWFIKNYLSPRFKDFIPHMAREYGFEYALVTYKWPSWLHKQTEKQRIIWAYKILFLDVLFPLDLKKVIFVDADQVVRTDMAELYDMDLKGAPLAYTPFCDNNKDMDGFRFWKQGFWKDHLQGKPYHISALYVVDLARFRRMAAGDHLRVFYESLSKDPNSLANLDQDLPNYAQHMVPIYSLPREWLWCESWCGNATKAQAKTIDLCNNPMTKEPKLEAARRIVAEWPALDEEQRRLTDRVEAGEFDDVAGSEDPPTTARDKKLDSGSVEEIQSDNLEEKGNQRQEDTETAAEL

SEQ ID NO: 4141 - protein, 1440 aa, Wickerhamomyces ciferrii
MLKQFTGVFLLLSLVFAQIDIQLQANWENPPFALRLLETVATENESYYLSSLSKIAGLNLNEDDDDDEGEGPASNDEELYHSIFNLLTPKEQSLYDIPLANKYHSPRIISHYNYYNNTVLPKFQSKLIKKCGGRVPKTWLKFNDVVYCKPDDVFALMTDSSNEIDKEILEFDRIIGDQGPLLILYGDVNDPSFKEFINNLYDNAKYGKLRFIWRYVPQNIDEREILSGYGVDLTLKRTDYLVIDDRDVNNKNVKRDQIKQDAQQVLKNQESSNSFLDIYNDDIPGVNQQDLKDLDLKIASFISSSQNQSENFQNLIHIVQDLPKFTSYLSELEINDELLESTEFNEKLGLTSDSSAIFLNGLPIDESDLNVFGLYKAIKKELSLVENFSDLKLDPKITKDLIGKFALLSMVKNRKTLKTRYNIETNEHNPIIFINNIESDPTYENIPKDLNIFKQKHQFGQIPPYKENIHNVVFVMNFSDEEQLLTLQRIFQAVVQRGITQRIGFIPLISNEEDRIHANNIYYLLENKGFKKAARYVFQIGTTPNHSVENLTDEDYISKYLTPFVKKFDVYEPSIIVNNIFYPFDSNWPYALTRQVSEDVNLITSAVFAGAIKEGDSIKKLLYEDATDFRNTLIIPENKRQLDYKYISPQFQEIIKASSNYIFEFTNTNEDSDKSATLTFGGNLGSRFELEQFLEILKFTQNADFSLKIRIIETSKEATFIGKIRQSLNKSIDHAIEVVQGIIEDNQFTELDFDPTIKSLLQSIDIDSSKFLLFNGRYIELNEKIIDDVSLNHLADYEFENRLYLASKVLKKHESIANSVSQDWFESFASLITKSFYVETDLFTPAPLPRFDFSALNLNNAISFGDKDKSDINVLLVIDPVEEISQKLISLIQSIKDLSFISLDILIQPKKELKELPVKRFYRSNFQSSIKFNKNGKLDESSFVSFNKVPEKTLFTLDIDVLPSWVVVTKDSISDLDNVLLEQSGPVTGIYELKNIAVEGNAFDVDTLEPPTGLSVQIEGSDTNVMTNYGYLQLKGNPGIWNFEIKQGKSSDIYSLLTTDDFYSTEREKTNEKIKFSLLNLDGVKLFPRVIKKEGKENESLISLTGESIDVVQDEEEESKPKLGFFQKLFPQKKKKQADINIFTIASGHLYERFLSIMTASVMRHTKHTVKFWLIENYMSPSFRKFLPHLAEKYGFEYELITYNWPSWLRGQREKQRTFWGYKILFLDVLFPQDLEKVIFVDSDQIVRTDLKELVDLDLEGAAYGYTPMGDSREEMEGFRFWKQGYWAKMLGDEYKYHISALYVIDLKRFREIAAGDTLRQHYQALSKDPGSLSNLDQDLPNNLQPKLKIFSLPQDWLWCETWCDDESLKTAKTIDLCNNPLTKEPKLDRARRQIPEWTEYDDEITALREEVFPKVELSVGEEIKPGESNSNDDLDHDEL

SEQ ID NO: 4142 - protein, 1303 aa, Glarea lozoyensis
MLTDLDVFEEAYALCMNLEDPQQIPSRDSMVRIGSQDGNLKLSTRETAADENSTSYFPLLDRIADGYFSKSSTDKELYEKFLEILKEDGHMPDTESLSSYQFALSMRSAAPRIEAHYQYYYTAAEPSLAGARTESCPSWVLLNNKQYCSPALDTANADIEGNQQVQELQFDRIIGNISAPASILYADITSPTFGHYHKTLVKTAREGKTSYRIRHKKALSQNSDSHIFPGYGVELALKRTDYIVIDDREGEQETVEIDSEKKEVKFEDEEFADLKPLSSSELLGLGLKASSFILESEKPFDTLVKLSQDFPKYSSAIASHNPTKEFVAEHEYNRAQLVPAGYNVWWMNGIQMDKRYEDWPTSLQALLQRTYPGQLPTVRRDCFNLVLLVDFTSPEDVHLIVEQLRGFVQRKLNIRIGLVPIVQSVHSLEQARVVYYLVDSYGLSTAILYLEKSLAAGKLSAPSKSVFEAAIEGRNPKPEKVTRAAIQTAIFQDFFEHDSWVPSLFMASAAKRRNSLIVPEDEKNLKIFDVNELLVDNQDLFHVMPHIDVGTESAKEDWAHMTVVADLESEGGVKLLATAAIFREANPSIELAIMHNPSDGIVDTGFSYDLFARMEEQPAKIQTVNGITDMLSSEKSVEVEPIEQAAKAYWHQAAPFIKSLNLLAGENAILLNGRLVGPIPSSVDISNEDMIQLLSYEKSKRGVPVYSSMEALGLAEKISSPQDAAKVISMVAISTISDTPDGMFEQASTRAVSEMDSDTENTFRTRRGELPVKRFYRYVIDSKPSFNEDGSLKALKASFTGVPQEALLTLKMDVPPAWLVAPKVSIHDLDNIKLSSVKSDVEALYELEHILIEGHSREVPGGAAPRGAQLVLGTERDPHFADTIIMANLGYFQFKANPGYYKIKLQEGRSEEIFNIDSIGAKGWSPAPGDENSEVVLMSFQGTTLYPRLSRKPGMGDEDVLESKTDSPMDFVSRGLNFAQGILGKGKSIETKTSENAEINIFSVASGHLYERMLNIMMVSVMKHTKHTVKFWFIEQFLSPSFKDFIPYMAEEYGFQYEMVTFKWPHWLRGQTEKQREIWGYKILFLDVLFPLSLDKVIFVDADQIVRTDMIELVNHDLKGAPYGFTPMCDSRTEMEGFRFWKQGYWKNFLRGLPYHISALYVVDLHKFRQIAAGDRLRQQYHQLSADPASLSNLDQDLPNHMQAMLPIHSLPQEWLWCETWCSDEALKEAKTIDLCNNPLTKEPKLERARRQVPEWTVYDDEIAAVDRKRKGLPVEGKNEKSRTMEVMIETPETKKKGDKDEL

SEQ ID NO: 4143 - protein, 1736 aa, Amanita thiersii
MRRTGVAFLATAALAGATSPPINVSLRSSWNSPPFLVELLESFSLEFPNTFFHLLDIVSTPSSRLLHGQQSPRDIHQETFRLAAQSGILTDLSDLSAVDSTLALHAATPAIEALYNYYHDRHGKEKNARCIKEGKGASWVDWYGRVVCDVKELVELANAQTHDSSSTNEGGDNTHPSHSRPKLLAFDHVHPSPSRVITAPERTAILYADLGSSNFRSLHEYLYAQSQGSEPKIEYVLRHVPPNSYFSNQKEEGKAEDSRSSLTGYGVALDLKKTDYLVLDDRHSSGSGTADSQRKTSESTTEESDPLLNLLKSLPALEPKPIPRPPPLGKSAEVEEVVVDEAEEETIPPKDPNAPLIEAEILELGYKASQLIISTSLQRDNSGSLNDTIYQLTSAPTDFPFSLPFQQAHLSPLDMLTLLSQNFPKYAQTLARRIEVASEVEEELRMNSLIAQTGSSVVWVNGGMVITHGGEVVPSQLGGRGGGSAVDLLTLKRVLRRERGWVKSLEAIGMSRKEAVQVISDSGGVVPEQGKENGDAGKNKRKESQKKKGRNANMSDQVLDGRIDASDRSEGGDVILWWNDMDKDERYQMWSPRLMTLMRPMYPGSFPAVRRNLFNIILIMDFTKTQSLQFISGTMVNIVDRGLPLRFGLVPSIDTPEGHSIAKLLYYMMKETDNATTLEFLRRMMQSVEQSTENVSLDQIKAAFDAVIREYQAEADDELGGATFMSVTAGQSLPEGINAYIERVDARIGPDPSAPLGHAFFNGKYLEFSDMNDFIRDMQMEISYQLQYLQQQIYTGTMKDDDDITNWFYDQPGVSKRRNKYIIPATGNSASGDGNVLRIVSLPDTFDKTGVEWQKVKSGFLYPPGNGPTPNSVYVVADFDSEEGLDLVKEALSSLNEESRTRLTFIHNPSINGEDQKQTADHRPPSQLIAQLVMSGKLSGSGVNPQNFGKTLGIEVVPIEGVETMEEEQAQKPLGTSDSTSSLESLLNSSGGEAEQQEYLKVSRLLAREFGFTPGQSGLIVNGRIIGPIERRGFIAADFKALEEYEYSKRVEAAVETVERVCPWSLDADRAEYAELVSLTSSVLAAIQTPDPSEVGLFDAPPRPRQRTYHALARNLTMFTYGDSSTAMYHVVFVLNPLSETAQKWSSMITWLTAVPDVYIEVHLSPHKQQEIPLKRFYRYNAKPVLSFDNNGNEIPSQTIFDGLPTDPLYTLAMDVPSSWLVRPREALYDLDNIQLTQLSPSDTSVDAIFELDYLVIEGHARETVTQAAPRGLQLQLVNSRGHPIADTQVVANLGYLQFRAKPGVFRLEIREGKGREIYNVNSAGNEGWDSPTVESGGTEITLTSFDGLTLYPRFARNKGQEKADVLESDDLDGDSSGSLFEGVASRVKSLFQGAKQSKPSTSMVESNGQSEINIFTVASGLLYERFVGIMILSVLRNTNSTVKFWFIENFLSPSFLQVIPHMAKEYGFQYELVTYKWPSWLRAQREKQRIIWAYKILFLDVLFPMDLKKVIFVDADQIVRTDLKELVDLNLHGAPYAYTPMGDDNHDMEGFRFWKTGYWAETLQGKPYHISALYVVDLVRFRQDILRGQYQQLSIDPNSLANLDQDLPNNLQRLVPIHSLHEDWLWVSSKNRLDRAKTIDLCQNPLTKEPKLARARQIPEWEEYDAEIARFTRRLAEEGKVRSGIAAADANVLANAGNTQASPQSNDNADGKIKPDVNSPEENDKAASDHAHDEL

SEQ ID NO: 4144 - protein, 1509 aa, Bipolaris oryzae
MRASASVLGAKALFVLTAFRHMGTLASPSINVALRAAFNPAPYLVELLETAAEENATAYYPILDRVAEGYFDDKTTDQELYTAFVDLLYADGHITQPEALASFEFALSVRSAAPRIEAHYQFYNTSVEPSLSAKQTEACDLWVSFHGKQYCSVHLDEPFGDIASERTYQLPFDRILGNSSALPAILYADITAPRFKKWHKTLSTTAKQGKTSYRIRHKPSPKAPTSPLVVNGYGVALQLKRTDYIVIDDRQATESDKNAAQKTMETGLNDEEDVADLKPLSKDEVSDLGLKTASFVLQSEDSMNTLLKLVQDFPKYSSIIAAHNASDEFLQGLEKNHDQWLMGGVDFIKVNGLNIPTRDVNPYSLLAHLRRERKLMNGFRSQGLSVSEVVSLLSHSAIAKNNAGDSPQRYDFRDTAEGGNVIIWLNDIEKDPAYEDWPTSLQALLQRTFPGQLPSCRRDIHNAIVFVDLTSTQDVTTLLDSTFNLIRRGIPLRWGVVPQSGSSDAIEQAKIIYHLLDAYGVSAVEVYLQASLDGKKLAQPDQAIFDATVKTSTLIDERTALSFQDVLASEELDQRIANSKQYVSRLAGDGPQSPIIINGVAIPGNEEWLSSLSKRITFDLREIQKAIFEGNFNEDSWVPQHFLAQAASRRNPYIIPEDEKNITLIDMAEFENTHSHVYNKMPRVRASESSSKSDWVHITLTADFDSENGLSLLKSLADFREANPNAEIVLIHNPVAKAEKSGVSQDILESFSKTGDKFTADTLLELLAREPSSVSFPEESRLFWKAADPIYEALGLKPGQNSIIVNGRHLGPIPEEIEFTKDDLEGLVSYEMSKRAEPLSKALDDLGLLNKIESPFNIAKIQSLAALSTISDVPEGMFEQISTIRRNDDEKWNTEHTAIVKGDKDKAVFHIVAAIDPATEVAQKWVPILKTLGDMEGVHLTLYLNPKNNLQELPIKRFYRYVLEARPHFNPDGSVGSLKASFSGIPKEALLNLGMDVPPSWLVAPEESIYDLDNIKLSTIPAGSNVDAIYGLESILIEGHSRDTTNGGQPPRGAEVVLATEKDPHFADTIIMANLGYLQFKANPGFYNIQLKSGRSQQVFNLDSAGPISWAPQPGDETTEIALMSFQGATIFPRLSRKPGQETADVLAPEESLASELVGKGAQKVNQFLGKIGLNFDSEKVLQKGADLLSGKAVKKGTQADINIFSVASGHLYERMLNIMMLSVMKHTKHTVKFWFIEQFLSPSFKSFLPHMAAEYGFEYEMVTYKWPHWLRQQSEKQREIWGYKILFLDVLFPLDLEKVIFVDADQIVRTDMYELVQHDLEGAPYGFTPMGDSRTEMEGFRFWKTGYWANFLRGRPYHISALYVVDLVRFRQLAAGDRLRQQYHALSADPNSLSNLDQDLPNNMQFNLPIHSLPQEWLWCETWCSDEDLAKAKTIDLCNNPQTKEPKLDRARRQIPEWNVYDEEIAALAKRVKGEREIAAGLVDVQELEQVREKKEKDAERVVEHSEL

SEQ ID NO: 4145 - protein, 1656 aa, Salvia splendens
MGEARFRSRCFLCVIVVLVLCGLFSPLSAQSRSPKNVQVALRAKWSGTPLLLEAGYSLSLSLILELLSKEWKDLFWDFVESWIHAVDLDSDLRTAKDCLKKIAEHGKSLLSEPLASVFEFSLTLRSASPRLVLYRQLAEESLSSFPLADDGGTSEPSETAKLDISEALLLGKNVKSPGNKCCWVDTGGSLFFDVKDLHKWLENPIDTKDSAFQYPEIFDFDHVHPDSTAGCPTAILYGALGTECFKEFHMALSEAAKNGKVKYVVRSVLPSGCEQKTSPCGAIGTGDSVNLGGYGVELALKNMEYKAMDDSAIKKGVTLEDPHTEDLSLEVRGFIFSHILERKPELTSEVMAFRDYLLSSTISDTLDVWELKDLGHQTAQRIVHASDPLQSMQEINQNFPSVVSSLSRMKLNDSIKDEIIANQRMLPPGKSLMALNGALLNVEDIDLHLTKFRVLRLFNMAHQELTLAEQYRKLKIPPSTVRKFLSVLPPSETHAFRVDFRSDHVHYINNLEVDAMYKRWRSNLNEILMPVFPGQLRYIRKNLFHAVFVLDPASPCGLEASFPFCTIDTIIALFENNLPMRFGVILYSAKLVEGIEANDGELPVARLKDDEDISSLIIRLFNYIKENHGAPTAFQFLSNVNKLRMDSGAEDSPEVHHVEGAFVETVLPRVKTLPQETLLKLEKDQTLNELSVESTMFAFKLGFAKLECSLLMNGLVYEPNEEALMNAMNEELPRIQEQVYYGQINSHTDVLDKFLSESGVQRYNPKIIADGKVVKPKFVSLCESILVKESVLNDLHYLHSSETFDDVKPVTHILGVDATSKKGMKLLHEGIRYLIGGTKYARIGVLFNVNDDATLPSLLFMEVFKTAVSSYGHKKGVLQFIDQLCSFYEKEYMSSSGATENHQALIDKVVQLADANGLPSKGFVSACSGFSAENFRGYLKKVTQFLYRTIGLEFGVNAVITNGRVVRLFDGSTFLSHDLHLLESLEFKQRIKHIAEIIEEIKWEGIDPDVLTSKFISDIVMAISSSTSTRDRSSEGARFEILNADYSAVILQNENSSIHIDAVIDPLSPSGQKLAALLRILSKYVQPSMRLVLNPMSSLVDLPLKNYYRYVVPTIDDFSATDHVVQGPRAFFANMPLSKTLTMNLDVPEPWLVQPVVAVHDLDNILLENLGDTRTLQAVFELEALVLTGHCSEKDHEPPRGLQLILGTKHAPHLVDTLVMANLGYWQMKVLPGVWYLQMAPGRSSELYVMKEDGEGAGDTTLSKRITIDDLRGKLVHMEVIKKKGMEREKLLLPADDDSHSSKKKGSQNGWNSNILKWASGFIGGKEQSKKDVSSSLKPGSGGRHGEKINIFSVASGHLYERFLKIMILSVLKNTDRPVKFWFIKNYLSPQFKDVIPHMANEYGFEYELITYKWPTWLHKQKEKQRIIWAYKILFLDVIFPLALEKVIFVDADQIVRADMGELYDMDLKGRPLAYTPFCDNNKDMDGYRFWKQGFWRDHLQGRPYHISALYVVDLVKFRETAAGDQLRVVYETLSKDPNSLSNLDQDLPNYAQHMVPIFSLPQEWLWCESWCGNATKTKAKTIDLCNNPMTKEPKLQGARRIVAEWPDLDLEARRFTAKFLGEDIEPQEQVALPTPEIQKPAADYSAEDAESKAEL

SEQ ID NO: 4146 - protein, 1504 aa, Protobothrops mucrosquamatus
MLFLSVGPRGAQSAPRKAVTARLAAKWPATPLLLEASEFIAEESNEKFWQFLETVKELTIYQKGVSEHSYYDLLLKKAGQFLSNLQINLLKFSLSLRAFSPTIQMFQQIAAIEPPPKGCNAFVVIHGKSTCKTNEIKKLLMTAASRPKPYLFKGDHKFPVLKEPALVVILYAEVGTKDFATFHNVLSEKAQKSEFVYILRHFVKKRSTEKMYLSGYGVELAIKSTEYKAVDESQAGATRNRTEEEDNKNSEVQGFLFDTLTENHPDLKDNLKELKKYLIESSDNTEPLKLWELQDISLQAASQILSTPVYNALKVMKDIAQNFPVKARSLTRVLVNQQMRKEIEENQKHLHESLELKPGEARLFLNGLPIDLDLRDPFSILETLKIEGKAMHVLHSLGIKEDFPSKFMRLASQSQDASYALDIRHSAIVWVNNLERDAMYNKWPSSFQELLKPAYAGMMRQIRRNLYNMVLFIDPLQEEAAGFIKLIELIYTQKVPLRLGFVFILNTDEVVDGNDDAGVALWRAFNFIADEVDIPQAFVSILYMYRQVDEGEILSVHNVKRILHRQFPQADVEEILGLDSEYDDKRKAGAMFYKKTGLGPLPQALFNGVPFNRKEMNIAELETSLLKIIDATEAFQRAVSMGLLNDHKDAVDFIMEQQNVVSHINDIILGDEKRYLNFESPSVPIDVNDYSTFFFLDSQDKTFVISENMNYVTKQDDALIYPVTIWIVADYDKPDGRQLLSTALKHLKTSSHIRLGIVNNPTSKITEDSTIIARAIMAAFLTQKNVHLKNFLGRILKEETAKALAEGTKIKKFFFPAMDADALEKKYNTLGVDMIQTHQAFCQEVLKLLPGEMAVISNGRILGPLKEDELNAKDFDLLETITLNTAAAKIKSLVKEMGIDHKRGSNLVMKVNALLSSLPITDDRQDVEFFKDQHSILKINPEQSEPYFDIVGVVDPLTREAQKLSHLLIVLGQIVNMKLRLFMNCRSNLSETPLKSFYRLVMEPELSVGSNNFFPLSSGATFLEIPESLLLTLNMAIPESWLVEAVNSSYDLDNIHLKDVEGVVSAEYELEYLLLEGHCYDVSNRKPPRGLQFTLGRRNNPFKVDTIVMANLGYFQLKANPGSWILRLREGRSEEIYEIFQHEGTDSSGSQEEIIVVLNSFRSKIIRIQVQKKPDSENEDLLSEVTTEEEEDSMTSFTGRTWKANLEKKIDVLNIFSVASGHLYERFLRIMMLSVLRHTKTPVKFWFLKNYLSPTFKALIPHMAKEYGFDYELVQYKWPHWLHQETEKQRIIWGYKILFLDVLFPLAVDKIIFVDADQIVRSDLKELRDLNLRGAPYGYTPFCDSRREMDGYRFWKSGYWASHLGKKKYHISALYVVDLKIFRRIAAGDRLRGQYQALSQDPNSLSNLDQDLPNNMIHQVPIKSLPQEWLWCETWCSDESKEKAKTIDLCNNPKTKEPKLEAAVRIVPEWTDYDSEIQKLLNRIRNEKTNGTPFHPKDSKHDEL

SEQ ID NO: 4147 - protein, 1324 aa, Ophiophagus hannah
MMTGPMPLFVAGMLFLSIGRRGAESAPRKAVTARLGRFTGRWGDEEEARWVRLGAWRGVTAPAMRTVLFPRNASSGILYISFIFLFFFNIVSEHSYYDLLLKKAGQFLSNLQINLLKFSLSLRAFSPTIQMFQQIAALEPPPKGCNAFVVIHGKSTCKINEIKKLLMTAPSRPKPYLFKGDHKFPVLKEPAIVAILYAEVGTKDFATFHNVLSEKAQKGEFVYILRHFVKKRSTEKMYLSGYGVELAIKSTEYKAMDESQVEGTRNRTEEEDNKDSEVQGFLFDTLTENHPDLKDNLKELKKYLIESSDNTEPLKLWELKDISLQAASQILSAPVYNALRVMKDIAQNFPVKARSLTRVLVNQQMRKEIEENQKRLHESLELKPGEARLFLNGLPIDLDLRDPFSILETLKIEGKAMHILHSLGIKGDLPSKFMRLASQSQDASYALDIRHSAIVWVNNIETDAMYNKWPSSFQELLKPAYAGMMRQIRRNLYNMILFIDPLQEEAAGFIKLIELIYTQKVPLSRLGFVFILNTDEVIDGNKNAGVALWRAFNFIADEVDIPHAFVSLFYMYRQVEDGRILSVDNVKRILYRQFPQADMEEILGPDSYYDDRRKGLLNDHKDAVDFIMEQQNVVSHINDRILDDERRYLNFESPSVEILTFFFSDDALTYPVTMWIVADYDKSDGRQLLSTALKHVKSSSHIRLGIVNNPTSKVTEDSTIIARAIMAAFVTQKNFHLKNFLGRILKEETAMALSAGTKIKKFFSPGMDTDALEKKYNTMGVDLIQTHQIFCQEVLKLLPGEMAVISNGRLYFCLAYSFYRLVMEPELSVGPNNFFPLSSGATFLEIPESLLLTLNMATPESWLVEAVNSSYDLDNIHLKDVEGVVSAEYELEYLLLEGHCYDVSTRKPPRGLQFTLGRRNNPFKVDTIVMANLGYFQLKANPGSWILRLREGRSEEIYEIFQHEGTDSSGSQEEVIVVLNSFRSKTIRIQVQKKPDSENEDLLNEVTTEEDDSMGSFTGRTWKTDLEKKTDVLNIFSVASGHLYERFLRVMMLSVLRHTKTPVKFWFLKNYLSPMFKALIPHMAKEYGFDYELVQYKWPHWLHKEIEKQRIIWGYKILFLDVLFPLAVEKIIFVDADQVVRSDLKELRDLNLRGAPYGYTPFCDSRREMDGYRFWKSGYWASHLGKKKYHISALYVVDLKIFRKIAAGDRLRGQYQALSQDPNSLSNLDQDLPNNMIHQVPIKSLPQEWLWCETWCSIESKAKAKTIDLCNNPKTKEPKLEAAIRIVPEWTDYDSEIQKLINHIRKEKTDRNPSHPKESKHDEL

SEQ ID NO: 4148 - protein, 1603 aa, Rickenella mellea
MKRLWGLGGALVASINIGVRASSSPQVKVGLRSSWPEVPLILEVLESVAVENSDAFFPLLEALTAQNTPTTQQAIHEFALETAVSLGYLKEPGALASAELHIALHAATPKIQAFYQYYADQHFAEISNCTSWVDWYGERICDLDTLMRLVGHESIESTARNSSESYVCSQPKILTFDHINPPRSRNLQIPPRTAIFYASPTSTNFRDFHTYLLKLSSSPMPRVEYVFRHVPPEGRNVVERSYLSGYGVSLDLKKTDYLALDDRRSKQPGQNEETSDDTVTSNNDYIFSLLEQLYPENKTMDMNAPLTKEELKGKANIGIKATQLLHDSKDELGLLTILSQNFPKYATSIARRVVINESLHNEIQDNQPKAQGGISMAWLNGLAIPETDMTPLGLLRLMRKERSIILSLTSLGLSPSQAVELLTHPLVGEAHSDSGVLDGLVDASDRPEGGSAIVWWNDFTKDSRYVRWDSSLLGLLRGLYPGQFHQIRLNLFNVVLVMDLSQTSSLNFIAGAVKTIISRAFPFRFGIVPSVETLDGQKMARIFYYLIDNLGRAKTMTYLSQLTQLSSPMENLSPGIDWEIARAEFDALIAEHPPQDGDVPTDFDSIVEDGDSQPTFIRLERARAYAIRLDAKLASSPTGHAFVNGKHFDLGDDFLRHMQLEQQAQVQHLIEKVYSSQLTEGDAERMDTYFYDLPETTKKRSPYIFQTTETGDLRIHNLPDLFHRMGVQPTSGQFIYPTESDQHTLTTYVVADLDSEAGIALMREAVDSLENGSPSRLSFVHNPAPVNSPEDSPPHTRISQLVAHLIAKDQLARISHSTFKAILDWRMEDDATNPTSDTPVSQIPLGSDVDYDGSIDAEMYKRFCHTSLLVARELGLSPSDQAVVVNGRIVGPLTAGSFMVDDFKTLEEYELRKRVRPVAEALRNMTITPDDLDRATYSTLISMASSVIAAVQIPDPSEQGLFNTHHRVRHRQYRLLSGTYSAFDFGEASKSAFNFGFLIDPLSESAQKWSGLLMWLATIDSVYAEVHLNPATYREMPLKRFYRYNLRTRLSFNEDGSENKAQTLFNDLPSEPIYTLGLDVPPAWLVRPREADHDLDNIQLSALSSSERLRGVEAIFDLDFIVIEGHARDALTNSPPRGLQLQLTSLDSKPIDDTQVVANLGYLQFKAKPGVFQLEIREGRGRDVYAMESVGNEGWNSANVDQVGIDVTLTSFEGLTLYPRLRRRPGMEKADVLDEFVIGSSEPKGLFDNLASRVASLFNSKKEEAVPVKPQADINIFTVASGLLYERFASIMILSVLRNTNSTVKFWFIENFLSPSFLEFIPHFAEAYGFDYELVTYKWPSWLRAQTEKQRIIWAYKILFLDVLFPMDLKKVIFVDADQIVRADLKELVDLDLKGAPYGYTPMGDDNYEMEGFRFWKTGYWKDFLRGKPYHISALYVVDLVRFRQLAAGDILRGSYHQLSADPNSLANLDQDLPNNLQREVPIFSLDEDWLWCETWCSKDRLHRAKTIDLCQNPLTKEPKLSRARQIPEWEEYDSEIARFAGSLADKGVIRSHIAAVDVNALASAGAAAAAPPTEDSGPSGSQILDEAQPTEQAPEPTIRDEL

SEQ ID NO: 4149 - protein, 1591 aa, Coccomyxa subellipsoidea
MLIAPQVLQVVLSIRQLSPRLEFFRTQAAAADIQPGSCCFVDIGGASVSAEEELIKKLAEVGEGDYAVPDQAQLQPFDHVLAPAGAAVATVNTELRRATAVVLYGAIGTKCFRRMHALILSAAEKGAGKLVYVYRPVLAEGCLAGESCVGLGSGGGLPLPGFGVELAIKNMEYSALDDSKVEAEKEAAKEAGEEDEGPLEVEGFLFKRLIERRPEAHQALLSFRDHLLASSSDNEALKAGHSLAPADRAVYCRRKPGHENVLVWDMKELGLQAAARIAASSEPLRALTQMAQNFPNLAAALSRVSVPKALRSELKKLHRVLQGGSSFMLVNGIPTDIGTFDLYTLMEQIRKEVRLMDKLKETGLQPADITALVQLRSEMKEVAAEDLRIDLRSSEAIRWLNDIESGRQYWHWGQQLASLLQPMFPGQLHRVQRNLYSAVGLIDPGSAQGLQVAGVLLELFSATWPVRCGAILLPPDTIQRVKQSGAEVAASAAWEDLSASERAALAYIYLENAAGAPAAFKFLSRARAEHLMGEDAGDALSWTSVEEAFLAAWGDLPDTRNRDLTPAAALQELSEGPKEVMEELVKGVAFTISKGVAGVGTAVWVNGLLVTSSEGVPWEQMIPYQLQVEQQRLQEQIYFGRIQDSDEDILEAILRVFNAAPKYNPTLLQSDSDGAAKSPKQVALVGPDLSPMQEPWSQLGYLHHASTQDEVKGITHWLAGHKLVLGALGHLEAESSQGARVALVHNPADVTADISVLARAVTAASRLQSRRPKILPFLKSLLESHAGVGSVEEVVALAKDAGLNEKALEADLTASEAAAARLAEACRKALGLQAGAAAVVTNGRVVPLANADSLVTEDFGLLTLYADAAQVAKQVAAAVMTAQAEGRTVSAESAGADGDGADEAEEWTSDQLSNAAAVASSVLAQHGAVQQGAGKTAKLIAALRGLSPQVSNITVEGAGVAVEIWAVLDPLSKTAQRVAPVLQFLADTLQPSIKASLVFLNPQAELSDLPLKSFYRYSLPDISASGEGRLSQPGLPAAVFTGLPSGRILTLNMDVPEAWLVEPVRADLDLDNLRLADLGAAPSLQAEFELEALLLTGSCVDIAARSREQMTPRGVQLVLGTPQQPALVDTIVMSNLGYFQLKAAPGAFDLQLAPGRSRSLYLVDNSTAGVLAQEAGEEGAISTGVSIDSLGGRTMRLNLRKRPGFEGEDVLGTGSEGETGSVWGKVSSWLAPGSKGSPGRAGGLSAEEDPDCIHIFTVSSGHMYERLQKIMVLSVLRTTKARVKFWFIKNYMSPQMKRFLPRMAAHYSFDYEFVTYKWPSWLHKQTEKQRIIWAYKILFLDVLFPLSLRKVIFVDSDQIVRADFAELWNMDLKARLFSAFHGAPLAYTPFCDNNREMEGFRFWKQGFWKDHLRGRPYHISALYVVDLVRFRQSAAGDQLRVVYDQLSRDPASLSNLDQDLPNYAQHQVPIFSLPQEWLWCETWCGNATKKYAKTIDLCNNPLTKEPKLDSARRIVAEWPGLDEEVATFTAEVEADLAAEAVAGGEAADSPEQPAKVGGDIIQHHDEEDHGREAGGEKGSGSASEGHDASEL

SEQ ID NO: 4150 - protein, 1491 aa, Schizosaccharomyces octosporus
MMISNKSRRYIISTTFIQNTLILSHYLKSIFLDTLKNLFGKMRWNKWLTFVPFLSLCFAAKPIDVKVSTAFSKPSFVALLAESLHEENRDSFLWFLDNLPSIRKDDLITDEQLYNLTVESLKADKILSQEELTTFSYSVALLSGAPKLAAFSSIVSSHAEDCNTFLVLNEQTNLCFSDLPEESLIFSENYQPSPLDYKVIGDNLSEGLPVAVIVSDFGVDLDKFHKLYSSLAKNKKCNYILRYAPSQDTELEKLYVSSFGAHASLKRTDYLVMDDREIPMSSNENNTSRIDKSKKKKEVLFDLDSDELETVTQNEIASLDLLASEAIINSRNPLMTFKLLSQDFPMYAQHLVSKVSISDDLIEDVNHLQSQAIPEGKNAIWLNGISIDLEETDAFSILSWLRKERRILSGFQKLGIEPSKASKVLSSEQFDVTEAQFKFFRFHSQDDLEDNKAIFWMNEVETDTRYSKWPKSNMQLLTPIYPGQLHLLRKQLHTVIYPIFPSSDSSISLLSELVQFSRRPSPVQTGLVCVAPEEDEFGKTICRAFHYVARTNSKPSALKFLFKCLAGDPSAGAWALVEEHMPVEDYDEETFHKIKTSLNSNIYDTILSKSFQWSSRLGLDPESQEVIVNGRIIAHDENYDSNMYSIFIEDIPEIQLAVAQEMVSEEENLLDYLLKDAPHTRNPLIYPSSKSKIKQVDMLNLLDDTGYTHSDLLTIGDKKAKYSIWLVTDFASEEGLELTTTLAEAVSKFESSNLVLVQSDLENELPALITQLSSSSHHTTEHLLKVLNKNTKKKQSKLTCKVKSKLAKYSEASKAVVAKINNPSQSVLILNGRLINSISVDKLGVQDLEMLLSHEKSNYIDKLDNALVNATELKKKGILPFVSSYLKKLEFDYVRGSVPGHEKAMFPRDNFHSQLPPSSLTIGTDNFDSCTYHFVAILDPLSKASQKWSAILESISHLDGVGVRIYLNPSKGLSDFPLSRFYRYSIEHEPVFRYDGKFKDSGVEFDKLPAETLLTMDIESRDTWVVMQEEVDIDLYNIKLEHTSSEVLVEPISAVYELKNILIQGFSQEENVKSPPRGMQLALETTKHEHFTDTIILANLGYFQLKANPGIWNLKPLPGRSSQFYTITTLNRLDSGKEKQVVLDSFEGATLYPVMRRNPGFESSDILDEDMSPQRFFDKMKKKLNFFKNKNKDPTINIFSVASGHLYERFMYIMTKSVMQHTNKKVKFWFIENFLSPSFKHSIPVLANEYGFEYEYVTYNWPEWLRKQDEKQREIWGYKILFLDVLFPLDLHKVIFVDADQIVRADLQELMDMDLQGAPYGYTPMCDSREEMEGFRFWKQGYWKKFLRGLKYHISALYVVDLDRFRKMSAGDLLRRQYQLLSADPNSLSNLDQDLPNNLQHLIPIHSLPQEWLWCETWCDDQSLKKAKTIDLCQNPLTKEKKLDRARRQVSEWTTYDNEISAMLRNAEESRLAFTSPVQDLPDNNKETDEL

SEQ ID NO: 4151 - protein, 1485 aa, Capronia epimyces
MRLSGLSWSAAVVALWPLSLLIPSALSSHSVNVALETSFAAGPYLVELLETAALENSSSYFPLLDRIANGAFLELQTEQELYSKFIEVLQHDGHLSSPESLSSFKFALALHAAAPRVEAHFQYYNTSVQPHLMAAQDAVCPVWVYLDGQQYCSPELDRAQQAVSLPAVTEELPFDRVLGSNADGLASILYADITHPLFGQFHNVVSQTARDGRSTYRVRYRPASVTERKSLFVSGYGVELVLKRTDYIVIDDRDAASSDTPDEDRTSLDNVKDDELSDLKPLTTSEVVNLGLNAASFIASSSDPLQSLLQITSDFPRYSSLLASANASKEFLVEHRSNRERFLPSGYSVFWINGVQIEPRQINAYSLLDHLRRERRIIGDIRDIGLTSSEAINLLSSEVIAEAQANEVPQRFDWRDDIEADKVLIWLNDLEQDKRYASWPSALRNLFQRVYPGQLPQLRRDVHNLVVPIDMGSIKDIELVATSLQGLVRRQVPIRVALVPIGSGAIADDYTRVSYHILDTYGLAPLVAFFSDVAASKKLLPSPEKSFQKAILGRSVREGKRALPYDDVLISEDLLQRLQARNDYVSRLALSSSDPPFIINGVVLPRTDNWFELMSSRLFADLQLLQQAVYQGIIPEDSWVPQFFLLQASARRNEIVFPHDPKDIKIVDISRLAAEFPDALNILPRVPGAAATLLSDRAHLLVVTDVDSEDGRGLLMEVLAFRQQFPEIDVLLLHNPASDTQSSKLACAIYALAQDNGRDLTPEELRLILETESNLADAVHGAETCAAFWSAGVGLTRSLGFSHGQSGLWLNGRVIGPLNREFTAHDLESLLELERRERITPVTTAITSLGLEERFSNALDLAKVTSLVARALKSDLPEGLRESVPLIRMDRFKIWNGTHTSIKVSNTDDPSIQVVAVVDPASEIVQQWVPILQALSQLHGVSVQIFLNPKERLSELPVKRFFRQVISSEPSFNEDGSLVTPTASFSGVPKDTLFNLGMAVPPSWLVAPKKSIHDLDNIKLGNLAEGENIDAWYELEHILIEGHARDVTVGPPPRGVQLLLGTEEEPRFTDTIVMANLGYFQFKANPGYWQISLKPGRSSKIFNIDSVGPNGYSAQPGDETTSVALLSFQGLTLFPRLSRKLGMEAEDVLESSGSGGPMDYISKGASFASSALSSLGLKKTSTTNAEINIFSVASGHLYERMLNIMMVSVMKHTKHSVKFWFIEQFLSPSFKSTVPELAKHYGFDYEMVTYKWPHWLRGQKEKQREIWGYKILFLDVLFPLDLDKVIFVDADQIVRTDMMELVQVDLKGAPYGFTPMCDSRTEMEGFRFWKQGYWETYLKGKPYHISALYVVDLKRFRQLAAGDRLRQQYQALSADPNSLSNLDQDLPNHLQHTLPIYSLSQDWLWCETWCSDASLTTAKTIDLCNNPLTKEPKLDRARRQVPEWTEYDEEITSVIKAAKSQEDESTFGQDVEQKGVEAERKRDEL

SEQ ID NO: 4152 - protein, 494 aa, Galeopterus variegatus
MSGTNDISSLGPVAKFLDIPESPLLTLNMITPEGWLVETVYSNCDLDNIRLKDTEKTVTAEYELEYLLLEGHCFDTMTEQPPRGLQFTLGTKNKPVMVDTIVMANLGYFQLKANPGAWILKLRQGKSEDIYQIVGHEGTDSEPDLEDVIVVLDSFKSKILKVQVQKKPDKIKEDILTDKDEKTQGMWDSIKSFTISLRREEDKKEQDVLNIFSVASGHLYERFLRIMMLSVLRNTKTTVKFWFLKNYLSPTFKEVIPHMAKEYGFQYELVQYKWPHWLHQQTEKQRIIWGYKILFLDVLFPLAVDKIIFVDADQVVRHDLRELRDFDLDGAPYGYTPFCDSRTEMDGYRFWKTGYWASHLLRRKYHISALYVVDLKKFRRIAAGDRLRGQYQVLSKDPNSLSNLDQDLPNNMIYQVAIKSLPQDWLWCETWCDDESKQRAKTIDLCNNPKTKEPKLKAAARIVPEWVEYDTEIQQLLNHLENKKKNKILTHDEL

SEQ ID NO: 4153 - protein, 1628 aa, Aquilegia coerulea
MDRHNMRNSIHCLFLIIFIVFLSLVGSSVSAENRRPKNVQVSLRAKWPGTSLLLEAGELLSKEWKDIFWEFIDAWLNMESDSEPLTAKHCFQNIVKYGHSVLVEPLASLFEFSLSLRTSSPRLVLYRQLAEDSLASFPLEDETNSEYVPGDSAGVISTSPKSNVGKCCWVDTGSSLFFEVSDLLSWIRMPSDLAVDSFGMPELFDFDHVHFDSMDASPVVILYGALGTGCFRDFHVHLADAAKRGRVKYVVRPVLPYGCEEITSPCGAVGTNDSLHLGGYGVELALKNMEYKAMDDSMIKKGITLEDPHTEDLSQEVRGFIFSKILQRKPEMTAEVMAFRDYLLSSTISDTLDVWELKDLGHQTAQRIVHASDPLQSMQEINQNFPTVVSSLSRMKLNDSIKDEIIANQRMIPPGKSLMALNGALINIEDIDLFLLVDMVHQELSLADQYSKLKLPHSTIRQLLSTLPPSEANSVRVDFRSTHVHYLNNLEEDVMYRRWRSNLNDLLMPVYPGQLRYIRKNLFHAVYVLDPASICGLESIDTMISMYESNFPIRFGAILYSSKLIKKIEENGGEIPLLSVGEDNFHIEDDISSLIIRFFGYIEENHGTQAAFEFLSKVNRLRSASEEPLEETLEVSNVEGAFVETLLSRVKSPPQDILLKLEKGTEFKEMADASSLFVYNLGLSKLKCCLLMNGLVFEPTEDAVINAMNDELPRIQEQVYYGHINSRTDVLEKFLSESGYHRYNLQIIGDGNIKKRFVSLSASVLGSESVLNDINYLHSPGTVDDLKPVTHLLSINVSSKEGMKLLREGIRYLVGGSKRARVGVLFNTEYDAGSPTSIFVKAFEFSAASFSHKRKMLDFMDKLCSIFEREYMFKLDIESASSFVRDVCELAGSFSLPVEEYKAALSDFPVDLKKHFDKVSHFLYRQLGLDYGGNAILTNGRVMVPVEGSSFLSHDLVLLESVEFEQRIKHIMKIVEEVDWQDVDPDVLTSKFISDIIMFVSSSMAVRERNSDTARFEVLNSKYSAVTLNNENSSIHIDAVIDPLSPSGQKLSPLLRVLWKWIQPSMRIVLNPLSSLVDLPLKNYYRYVLPTMDDFSSVDYSVYGPKAFFSNMPLSKTLTMNLDVPEPWLVEPVVAVHDLDNILLENLGDTRTLQAVYELEALVLTGHCSEKGHDPPRGLQLILGTRSMPHLVDTLVMANLGYWQMKVSPGVWYLQLAPGRSSDLYAMKENEKEGQELTFSKRITINDLRGKVVHMEVVKKKGKEHEQLLPSDEVLEEKNKENLNTWNSNLLKWASDLIGGNEHSKKRKGALQENRAGGRHGITINIFSIASGHLYERFLKIMILSVLKNTPRPVKFWFIKNYLSPQFKDVIPHMAREYGFEYELITYKWPTWLHKQKEKQRIIWAYKILFLDVIFPLSLEKVIFVDADQIVRADMGELYDMDIKGRPLAYTPFCDNNKEMDGYRFWRQGFWKEHLRGRPYHISALYVVDLVKFRQTAAGDNLRVFYETLSKDPNSLSNLDQDLPNYAQHMVPIFSLPQEWLWCESWCGNATKSRAKTIDLCNNPMTKEPKLQGAKRIVSEWPDLDTEARRVTAKILGDDADTHEAITFSEKASGVSDTPEDMESKSEL

SEQ ID NO: 4154 - protein, 1622 aa, Leucoagaricus sp.
MKHALRLLGPALAALASKAAGPPVKVSLTSSWPAPPVVPEILETVALVNPDGFFPLLDQLTDPQMYIFAQSAAPEALYQSGITSAIGTGILQGASDVSEVQLNLALHAATPKLEAFYQHYEDKHNNSRGAACGSWVDWYGEVVCDIESLVQLVGHETIDSSEKANAELTYPRPKILTFDHIYPPPSQTLDRPYRTAILYATLDSKNFRELHTYLYAQANKPVPHIEYVLRYVPPQVPREAKNYLSSYGVALDLKKTDYLAVDDRLSSSKTSGKQEEQITDEAVEREVDPIIALIQAHPEDGSAPDAKTPLTEEEIGRLGHKVIQLITESESPLSALTRIAQDFPKYSTSLARRVQVSPQITGELASNAQKVQPGMNLFWINGARVEEKDVSVFSLLGLFRKEKSLMRNVVGLGLERSEALQVLTHSAVASAQKDGGVTDGLFDASDRTEGGGVVVWWNDFEKDKRYARWSPSLYNLLQPMYPGMYPNVKHNLFNTILVMDLTQTSNVHLLATTVANIVNRGLPFRFGLVPMIDDEDSLKIAKLFYYMINTYGRRKTLAFLGELVDIQLSVEEQPKHIPFSTVETAYESFILNLNQDDEADSQTDAESEKPTTHATLNAILESVNEEEQGAAPVEKLRKYIERLGGSKKESTSGRGHAFLNGRYLTLDEDFLRALQTEAGQQMQWLQEKIYTGAISDEADKRPNMATYFYDLPTTSKRRNRYIVPSTHGGLRIFNVPGVLASSGLGAVGLVKSGAWIYPDLDSVTSSLLVVADFDTEAGEGIFKQALESLTKGSQTRITFLHNPSSTPSSSDLEKNLLSSVIAHLISTHALSKLTPEKLAIALGYSLSFIAAGQTSKQTPLSTKNAFSTLGVDLSEIQSGAYARYVKASRLAARSFGLKGGETGVVINGRVIVPLEKDQLVAADFAALEDYEYRKRAVPVVQALTSVKENARQLDKASYANLVSMLASIISSSQQPDPSEIGLFDAPLRPRSRSYRLLDSEHTSFEVGDNTTALYHVAAVLDPLSSTAQRWSSLLNWLSTIPEVFIEVHLNPNWYTDIPLKRFYRYNVLSSLSFDEAGSEVPAQVAFEDLPIDPIYTLAMDVPTSWLVRPREALYDLDNILLSQLSSDDTSVDATFSLDYLVVEGHAREVKSHAPPRGVQLELVKTSNKSPIDDTLIVANLGYLQFKAKPGVFQLQIREEGRGRKIFKMESVGNEGWDSPSVEEGGDEITLVSFEGLTLYPRLARLPGMEKEDVLEDELEHEPTVLESLTSKLMSMFKTNHVDESAGKELSVVKQQADINIFTVASGLLYERFVGIMILSVLRNTNSTVKFWFIENFLSPSFLEFIPHMAEKYNFQYELVTYKWPSWLRAQTEKQRIIWAYKILFLDVLFPMDLKKVIFVDADQIVRADLQELVDLDLHGAPYGYTPMGDDNTEMEGFRFWKTGYWNDFLKGLPYHISALYVIDLVKFRQMAAGDLLRSQYQHLSADPHSLSNLDQDLPNNLQREVPIFSLHEDWLWCETWCSKDRLHRAKTIDLCQNPLTKEPKLSRARQIPEWEEYDSEIARFSRELAKEGKIHSRLATAGADVLASAGAAPPKDSGTTERPEEYTKKPMANDEVPSRDEL

SEQ ID NO: 4155 - protein, 1727 aa, Phytophthora megakarya
MRPTNSVLYASCVLRGSSAFGSHLTRSSCILVSTAAIFSTRRRSRRSLGVSCTSRGGGVSFSKTSAKAASPEYGGILRFTRRGRWSSGALGSNRTLRCMMAGPMPLELICPLGVILRVPLFHFHVDTLSAMWSTWLSAGLTALVAAAQPSLTAARGVHVNLTASWPSSPFFPLMETSEFLAEENPLYFWQFLEQLETRTAYVEFMGSDVDALGGLAVTVAESIAPGSKNILELMLATRTYSVKVEMFRQLALDSGVRPCGADADTWAVFYNNPHCVEAVVHADTWAVFYQESHCVEAVACSGDELDTILRNKKLQNKDQSCVAAGVNDVELQVDHKYPHIASDSNETAPSAILYGLVGTEKFHAFHSKLVKQAQKNKIQYMVRHYPRDSPLDTLLQGYGVALDIKNMEYKTIDDSKKTEEEEDATAGNESDEDEDEDEEEIDDEEVEGFLFKPLMISKKTEEEEDATAGNESDEDEDEDEEEIDDEEVEGFLFKPLMARHGAIADDLKEFYDLLIKKADGEQDQVLKAWHLKDLGASATRAIVDAKNPLKRLESLSQDFPMQAKKLAFSRKSISTELREGIASTRMQAANRRLKNKFIMNGIAVDPMERSFNVFDFMKTLKEEWSVAKQLGRLPMNQSELEDMLEHVRETNREQPAVRVHMRGTMGGSTPLYLNNIETDPNTANWSPDVNALRRPAWNLIFVRKNMYECVLALDPLSGAGRAALSHIGFMRMRGAPVQWALLVSSKELMASNTADERLALVEKYKSFQGADKATPWHFAKLLMLAQSKDTALAAAKDEENKKAQSGDEESNEEEETDRVVPIRIASAFLQRVGDEGSSDVLVERLVEAYAEAAEEVGTTEDNEDEALTCLKSDQFDKEVLAMTEFIHLKHLPLDSFVFNGVVQTNLDIQRSMMANFGRDQPLYVNMAHRDLLNDDMDLVDELMTAQDAYPAYLSIFETPEDTPGDVEVHTPKHLYADDVDGRLEAAAQHAVSYLHAPGSRALPKKQTVVFPADLNDPRDADHAYRVIKAVLEDSEESLRVGVVHQLNGEIKNKKDDNNVGDLAAAIFSGIGDSDNEVYMKFALETLSCIVKKKTITVMKDKLRGIWKKTEKEGGNKKVYKKVLKLLSSKSGKWLTSKQRSRLTEFNTLLRSRFPPAFAEVSEEESSKVALPHLFINGRQVTLPPQSLSDEDVTTIVNFDLKYRTQPVAKALIKRSVTLKVKEADNLSFEVMKTTGIVDKYVKTDRASRLDVDENSLNTVRLSGDPSLRVAAYVDPLSEAAQVMSSMLRMLHSQLNATIELVLVPADEYTEFPLQRFYRYLFDKKSSLAATSVEFRKLPVQPILTMKIDTPEAWNVQTLLAGDDLDNLRVDPDSPTAVKSTTSAVFRLESLLVYGQCRDATFNMYSPPNGLQLVLERDVGAQLLHRDTLVMKNLGYFQLQATPGVWSLHLAKGRADDIFDIIDPDTEVPLENYPIVVYDFGSHISQLFVRKKEGKEHEELLQSVEDAASEDKSKSESESTGKDLRSYWNSMLNMMGKHDDELEKKTVESSDEAEKDNALVQQKQRTGETIHVFSVASGYLYERFVKIMMSSVLKRTNNPVTFWLLENFLSPDFKKSIPVLREQFGMDIRLVTYKWPNWLRQQTEKQRIIWGYKILFLDVLFPLGVQKIIYVDADQVVRADLKELWELDLEGKPYGYTPFCDSRNVGFQFWRQGYWKDHLRGKPYHISA

SEQ ID NO: 4156 - protein, 1481 aa, Aspergillus campestris
MRPVSGLAASCRLAAVGAALLTPLVHASPSVNVALQASFDSPQYLVELLETAAEENSTAYFPLLDRIADGAFDDTITDKELYDRFLQIVSDDGHLRTPESLSSFKVSLAIRSASPRIAAHYQYYNASVQQTLMAAQDAACPVWVHTDGKQYCSSAMERAQQDVSGELDPRELPFDRVLGDLALPPAVLYADVSSPMFKDFHLALSALAKEGQISYRIRYRPSQHRSPRPLYVSGYGVELALKRTDYIVIDDRDAEQRDGKPSNAEGDAPDDLKPLSSSEVSRLGVNTVSYVMDSDSPLDTLIKLSQDFPKYSANVAAHDASPELLQDIRSSRLQLLPPGTNVMWINGVQVDPREIDAFSLLDTLRRERKLIEKFRDLGISATEAVDLLSHEYLGKALAQDAPPRYNYRDEIEGGRIIIWMNDVEKDARYEQWPSSVRAYLQRSYPGQLPAVRRNANNIVIPVDLSTMEGVQVVINNIKIFVQNNIPVRFGLVPVASSPGSSAQLKVAHYLQETFGLASLLQFLEETAAKKSAASPDQACFEAATQDQTARADRQVLSFEEVLKDKDLDALVARTADYQKRLGIEGKKPPILVNGAPVSSGESWMQEMSVAISKDIQTIQRGVAEGVIDDDTVIYEYLLSDAFDRRTSWVVPEDPKDIQVVDIATVSDSREEVLRELPHIASQSDDALDSLHLLVVGDFDSGNGQALLTAALESREKHPEVEVLFLHNPTTHGSSTGASAALYRSLKGDKKGDATQVLADVASYDGAEAPEIAQFWEAQQPLVKDLGFAPGARGVVINGRTVGPIRDDIAVVLDDMDQLFAYEQKKRIGPVAKAVKELGFGSKLSGPLAFAKLTSLTTLSTISDVPEGISQPMSEVRLNLFGKWEDSRSTITVSGSEDPAITIVASIDPTSEVAQRWLPILKVLSELASVRLRLFLNPREQINELPTKRFYRYVLDSEPSFDDDGALSRPTASFSGVPVDALLTLGMDVPSPWLVAPKESIHDLDNIKLSSVRDGADVDAIYALEHILIEGHSRDTTIRSPPSGVQLVLGTDDNPHFADTIIMANLGYFQFKAQPGLWKIDLKPGRSERIYNIDSVGSLGYSPQPGDENTEVALLSFQGKTLFPRLSRKKGQENEDVLETGPQPGTAMDYVSKGLNFASGILSSVGVGSKGEEKHADINIFSVASGHLYERMLNIMMVSVMRNTNHSVKFWFIEQFLSPSFKSFLPHLAKEYGFSYEMVTYKWPHWLRAQSEKQRQIWGYKILFLDVLFPLSLDKVIFVDADQIVRTDMYDLVTMDLEGAPYGFTPMCDSREEMEGFRFWKQGYWKNFLRGQPYHISALYVVDLNRFRALAAGDRLRGQYQMLSADKNSLSNLDQDLPNHMQHQIPIKSLPQEWLWCETWCSDASLTQARTIDLCNNPQTKEPKLDRARRQVPEWTEYDEEIAALTKKFALEQEVLQKEQEQIHGEEEDEDGDDSGWDKDEL

SEQ ID NO: 4157 - protein, 1956 aa, Nylanderia fulva
  MOD_RES (1529)..(1529): Any amino acid
MGVLIFFYTLLLCSTQLGADKKINKYVTTLINAKWNETPLILEAAEYLSDENPSYFWKFIDAYSRKISDLVIATEKENYDIILELVKKYLSEAEIAVFKLGLSLRIYSARVEMFSQMAVNKNVSLYGCNNVVNVGGTFTCSLQDIDTLLEQDTWETADTYDVDHRYLSASESDKVIILYGQIGTPTFIDFHQKLKNIAETKEINYILRHYVKNRADKKLRLSGYGVELQMKSTEYKATDDSDIKDNTGKSSEVANDGMEEIEGINFMILKKLYPDQQAELDKIQMHLLETSHEIGAFKVWQFQELSHQAAERIMKSPSVDALNVLTDISQNFPMQAKSLIRTKVNSDMKKEMKLNQEIFMAGLNIQPTDTALFINGLFFDLEAIDVLTLLESLRSELRVMEALHKIGFSNKKMSKLLALDLSGSTDNQNFAMDIRDSAINWINDIENDSRYSKWSRSLTELLRPTFPGMLRNIRRNLYNLVLIIDPLSEDSMSLIALAQSLYAHSAPLRVGLVFVTNFNTSVTGLMDASVAINNAYHYFADTKSSKEALHFLSELGNYIGPYGADIDDIKKVIRSKDSSASIIYILGEESEYDVGRHLASDFIKRCSFKKFPQALLNGIPLTPSQINSESYEEAVLSTIMSQTPALQKAVYRGELTEGDDVVDFLMNQPNVMPRLNERILKVDKNAWLNLIGTIPDDDDYTKWSSPDLSTYLMTKMQYFFVPRRNNVRHLYSFWIVVDLRSSSGRQLLREALEYVESNTDARISIIVNAEDNLKNSKSDINKIVLAALNALSPEKAILYIRKIIREENAALITDGSFEIEDESVAALLENQNPILLLHQHYSKNVLNLETGAKAVLCNGRIIGPLDSGEEFTSEDFSLLERFSQSTYGEKLFMKLMKDQFYNEDDYEEENNITDDMIMKISSLLVPRPQTRNRYDVPFHGDDNSVIKIPAADPDKVAFNFIAIVDPVSRGAQKLGPILKTVQQALNCNIKVFLNCLDKNSDMPLKSFYRFVLEPELQFTPEGDISGSIAKFTKLPTSSLLTQYIHAPENWLVEVVRSVYDLDNIKLDNVAIGVHSEFELEYLLLEGHCFEAIVGNPPRGLQFTLGTEKQPVMVDTIVMANLGYFQLKANPGEWVLRLRQGRSAEIYDFSTVEGQDVIQNGNDVKVLISSLRSHVLKVKVSKKPDKAGLDLLSDNEKDSGLWNSISRTFTATDESEDQDEKLNIFSLASGHLYERFLKIMMLSVIKHTKTPVKFWFLKNYLSPTVKDFLPHMAKEYGFEYELVQYKWPRWLHQQTEKQRTIWGYKILFLDVLFPLNVKKIIFVDADQVVRADLKELATLDLGGAPYAYTPFCDSRTEMDGFRFWKQGYWRNHLQGRAYHISALYVVDLKRFRRIAAGDRLRGQYQALSQDPNSLSNLDQDLPNNMIHQVAIKTLPQEWLWCETWCDDASKRYAKTIDLCNNPMTKEAKLQAAMRILPEWVGYDEEIKALQQKLENANRQTEKDSAWPLSIVRAPTSFAFLLVDELPRNFXGDMENNSVINGNSSVNLQTVQQNTKANEFKDKAIYGYGTSIPPNNNEDEESEISTRKVIFCVHGKLSGCCTVVKSSVDENAAVDYRQNPITPEDHCHRERNEEIDKKARKKLLIASVLCVIFMIAEIIGGVLSNSLAIATDAAHLLTDFASFMISLFSIWVAGRPATRKMPFGWYRAEVIGALTSVLLIWVVTGILLYLAVERIVHKNFELDAMVMLITSAVGVAVNLVMGLSLHQHGHSHGGGHDHGGNNDVENVLDDDFKGEDSKKNINVRAAFIHVLGDFIQSVGVFIAALIIYFKPTWIIVDPICTFLFSILVILTTVAIIKDVVNVLMEGIPKGFEYSQVESTFMQIDGVVKVHNLRIWALSLDKTALSAHLAIKPGTSPQNILRTATRNIHDKYKFFEMTLQIEEFNERMENCKQCKALSQ

SEQ ID NO: 4158 - protein, 1084 aa, Miniopterus natalensis
MTVSFIQYLGSPIDIKWINDLENDYLYVAWPASCQELLKSLFPGKIPSIRRNFHNLVLFIDPAQEYTLNFIKLAEVLYYRKIPVRIGFVFIVNTDDEVDGTNDAGVALWRAFNYVAEEYDVSQAFVFITQMYQKVKSQNIITVDNVKSVLQDKFPQADILDILGINSRYDDKRKAGASFYKVTGLGPLPQALYNGESLNHEDLNIQKLERALLQKMMDVTIYLQREVFMGTLNDRTNAIDFLMDKNNVVPRINHLILYSEQQYLNLISTSVTADVEDFSTFFFLDSQDKSAVIAENMYYLTQEDEDVISSVTLWIIADFDKPSGRNMLLNALKHMKTTFRSRLGVIYNPTSKINEENTAISRGILAAFLTLKNNFLGNFLRKLAREETATAIYSGDKIKTFLTEGMDKDAFEKKYNTVGVNIFRTHQLFCQDVLKLRPGERGIVSNGKFLGPLNENFCEEDFFLLEKITFTNLAEKIKGIVENMAINSKNKSDLVMKVDALVSSLPTPESRYNVAFLKENHSIMKVNPQENDMFFDVIAIVDPLTREAQMMAQLLIVLGKIINMKLKLFMNCRSKLSEAPLKSFYRFVLEPELTLVSNNVIEPVAKFLDIPESPLLTLNMITPGGWLVETVHSNCDLDNIHLKDIERTVIAEYELEYLLLEGHCFDTTTEQSPRGLQFTLGTKNQPVAVDTIVMANLGYFQLKANPGAWILKLRQGKSEDIYQIIGHEGTDSQVDLGDVIVVLNSFKSKILAIQVQKKPDKIKEDILTDKKEKKGMWDSIKSFTRSLHKEKDKKETDVLNIFSVASGHLYERFLRIMMLSVLRNTKTPVKFWFLKNYLSPTFKEVIPYMAKEYGFQYELVQYKWPRWLHQQTEKQRIIWGYKILFLDVLFPLAVDKIIFVDADQIVRHDLKELRDFDLGGAPYGYTPFCDSRTDMDGYRFWKKGYWASHLLRRKYHISALYVVDLKRFRRIAAGDRLRGQYQALSQDPNSLSNLDQDLPNNMIYRVAIKSLPQDWLWCETWCDDESKQRAKTIDLCNNPKTKEPKLKAAVRIVPEWVEYDTEIRQLLDHLENKKKNAILTHDEL

SEQ ID NO: 4159 - protein, 1563 aa, Ciona intestinalis
MCSNLIFFITTLVCLSSIIEISKADPKSIVTSLKSKWKSTPLIIEASEFMASESTDAFWKYVETIMGFDIAHQTDISARTLYQTALKAAHITFDDDKMDSLNMQLLKFALSLRTYSPRVEMFHQLAVINGLTGCDIFFDVHGQKTCEYSEVHQLLKSAKMQDLQPSTVFKQDHVFPESKSSDSTIILYANIASTEFKQAHDLLKRLAKAGEAKYVLRHFIRSRPDKGVQLSGYGVELAMKSTEYKAIDDSVVKDDGSSASLLDDGEVEVEGFNFSTLARVHPQLTKQLAELRGHLMESTNEMQPMKIWQLQDLSFQAATRVLNAPKNDQLKILKDISQNFPTRVRTLVKQQVPDELRHEIKQNQRSFEQFDIDQGQAMFLLNGIQIDVDETDMFKLLDMLRSEGKLISGLKKLNLNSNQIQKAMKLNVHPEASGKHILDIRESAIIWANDIETDERYKRWPANVHELLRPAFPGTLRRVRKNMFHLVFVIDPTHADAKYLVEAAEIFWANDVPLRIGFSFLVDDSAEIDGNDDAGVALVRAYNYARDEMDDNEKSFSFLTNVYKSLKEGSIITVEHIIQRLKQKFKSADIDDILGSSSEFDSNRKLGKSFQSRTALVGPVNVLMNGALLSDDDISDDMFEQVVLDKIMEETPVLQRAAYMGELSNNGDPLEYLMSRNGVVPRFNDRVLSAEANFFDLLGNAKKESVYLNPKQFAKLSNSDKTATISEQLSTLYLSKTDSSKHIRPITMWVIADVETSAGRSFVYSALKHVKTSSNTRLAIIHNPKNTDHLTSSSKYMRAVEAAILTQQNNHARNFILKLLKPENAAKIASSDSLSEFYVGGMAESAFEKAMTSDPKVSLAHITAHSDWSTTVLNLEPGQNAVLANGKLIGPLDQNEVFVADDFLLIEILMYSSSGEKIQEVVKSMQLQLTPPEKSDIIMKLTSHLSSQPKVEAERRDLSPPFAEHSVVDLPSSDPERSSYDILAVLDPASNIAQQIIPVIEVLREVLDANVKIYMNCKEKLSDLPVKRFYRFVLEPELSFKVDNKLSDGPLAKFSDMPNKSLLTLTMHPPEGWMVEAVSAVHDLDNIKLSEIRNKLVSADYELEYLVLEGHARDVTTGQPPRGLQFTLGATKDKVTVDTIVMANLGYFQLKASPGVWYLNLRHGKSSDIYDIVSHENTDSSTGDVIVLMDSFKSKVIVVKVSKKSDKSDSSLLEDDESEGKKEEGGGGGIWNSIKSSLGGGGGESESKEWEEGASNSSDVINVFSLASGHLYERLMRIMMLSVMRHTTSNVKFWVLKNYLSPQFKDFIPHMAEEYGFEYELVQYKWPRWLRQQTEKQRTMWGYKILFLDVLFPLNVEKIIFVDADQIVRANLKELRDLDLEGNPYGYTPFCSDRTEMDGFRFWKGGYWAQHLAGRKYHISAIYVVDLKKFRQIAAGDRLRGQYQGLSQDPNSLANLDQDLPNNMIHQVGIKSLPQEWLWCSTWCSDDSLSRAKTIDLCNNPLTKEPKLEAAVRLVKEWPDYDEEIKTLQSKFSPEGNQSSKSKDKETGFASTLDKSAGKHEEL

SEQ ID NO: 4160 - protein, 1200 aa, Neotoma lepida
  MOD_RES (163)..(163): Any amino acid
  MOD_RES (538)..(538): Any amino acid
  MOD_RES (783)..(783): Any amino acid
  MOD_RES (1143)..(1143): Any amino acid
MTLGIVADLSFQTAARILAAPVELALVVMKDISQNFPTKARAITKTAVSPQLRTEVEENQKYFKGTIGLQPGDSAFFINGLHIDLDTQDIFSYTSFLPADSSFLKLWVNNLEVDSRYNSWPSSLQELLRPTFPGVIRQIRKNLHNMVFIVDPVHETTAELMSXAEMFLSSHIPLRIGFIFVVNDSEDVDGMQDAGVAVLRAYNYVVQEVDGYHAFQTLTHIYNKVRTGEKVKVEHVVSVLQKKYPYVEVNSILGIDSAYDQNRKEARGYYEQTGVGPLPVVLFNGMPFEKEQLDPDELETITMHKILETTSFFQRAVYLGELPHDQDVVEYIMNQPNVVPRINSRILTAKREYLDLTASNNFFVDDFARFSSLDSRGKTAAIANSMNYLTKKGMSSKEIYDDSFIRPVTFWIVGDFDSPSGRQLLYDAIKHQASFSDFILGGELWSVLFVSEAPIGFKTSNNVRISMINNPSQEISYANTPIFRAIWAALQTQTSNSAKNFITKMAKEETAEALAAGVDIGEFSVGGMDVSLFKEAFXSSKMDFILSHALYCRDVLKLKKGQRVVISNGRIIGPLEESELFNQDDFHLLENIILKTSGQKIKSHIQQLRVEEDVASDLVMKVDALLSAQPKGEARIDYQFFEDKHSAIKLKPNEGETYYDVVAVVDPVTREAQRLAPLLLVGLLFYRYVLEPEISFTADNSFAKGPIAKFLDMPQSPLFTLNLNTPESWMVESVRTPYDLDNIYLEEVDSVVAAEYELEYLLLEGHCYDITTGQPPRGLQFTXGTSANPTIVDTIVMANLGYFQLKANPGAWILRLRKGRSDDIYRIYSHDGTDSPPDANDVVVILNNFKSKIIKVKVQKKADMVNEDLLSDGTSENEAGFWDSFKWGFSGQKTEEVKQEKDDIINIFSVASGHLYERFLRIMMLSVLKNTKTPVKFWFLKNYLSPTFKEFIPYMASKYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCXNPMTKEPKLEAAVRIVPEWQDYDQEIKQLQILFQEEKEMGTLREEKTQDGSQKHEEL

SEQ ID NO: 4161 - protein, 2267 aa, Trichuris suis
MFRKRTVRNLRRKTANSDSSEGERENAESGPTANVPPPVDTIPAPSHVTGSAASLLSFAEDVEEEGCTVKFEKKSKVRRTPKSLLKQESGEMVFTKSYKSKPTKPLESESKEKVETTITQSSNRTEVLVVESDEAVVEVLSEVPSDDDDEEFQDVLIGGRIPDANLIHKARKKRERAREGTALPEVITFKDPDKNRSTRRLVREEDDSESDEERYKFYSRLESKAEEERREVQANFVSVEQDSDEERDDELERWEQEQMRKGVSFQKLAYYKKEISACAGLDSHREDGSKPSGPYSEINEPLPMDLEVDLEQTEAAGSFVSGSRRTKQFPAEFYDDASAIASADDAYHKCMKKVKESLKECEENHQSRLNTLTGLHERLEENEQMETQLSNAKPSLIMQYNFFQRLNVYVNSLLDCLNEKVPKIDILEKEAIDYLQRRSDYFIQRQKVDINDQYDDCMASASGLKAKSTDPEKVMRIAEREARRTRRRLKREKCDSSESHCEGMSSDDEDTSARISEFCSKKDSWAKSAEELFVDVADEYGKFESVCQRFSEWYDKYPVFYREAFVTLCLPKLLSPFIRLEMLGWTPLEVNYKPLDSFHWYQSLLLFGCGSGLPEEHCIVVLIPTVVEKVVCPLLTELVKKVWRPASSSQTELLCSFLRHLFSTYPTLTGESKRTTQLLDAVYNRFEKMLNDEIFLPMFPKDILDVRSTGAFNFSERQFWFSVKCLKNALLLRGVLSDHSVKKLVFDGLLNRHIIARLQSTPAVDMSVWTKTEALCDLIPLEWTNCPINEWSQSRFEPISGLLKKLSKNLNGTKTTGARATQKNVIAYVQSKWADTPLVVEASEFMAHEGDGYFWKFIEVLGKNETDLGSATDEGIYERLIGIAKSVLDSKSRVKLFQFALAIRCHSPSVEMYRQLSLSLSGRPAGHVFVDVHGQLSSNINSLDELLSQAKQRSPAIFSFDHIYATRSNKAKKWTILYANLESNEFIAWHDLLKSRAIKGELNYVFRHLPRVGKGKVPLSGYSVELAIKSTEYKAQDDTKIRSKPTAGANLTDDGDEEEADLDGFNIRLLKLLHPELRDRLDEFKLHLLEADELAPLKVWQLQDLSFQAGQRVLLAAKEDVLHTLQELSQNFPLMARSISLTAVKPEFRSEVETNQEAFSEIGIEPGNSAMFINGLRIDLDEIDIFSLLDKLKKEERLLAGFFDMGFRKETQSLLYRISSETSWSKFALDYTQWLPDFVNDLENDPQYRQWGNSVQLLLQPYFPGMIRPIARNFFTLIFAVQLGDDNARSLLQIAKSLYEHVAPVGLILATNPDKKISGYSDGGVALLNAYNFIKGDTSIERALKFVLHVYNRVPSGNVTPSDVIDVFKQKYPDEDLSNVFDVDSDYNSGRQRWAQFAQNSGLSKLPSVLLNGFPMADNDVTSDQFEEAVVLEVSQVTSELQKDVLEGKLTDGVDVQKFILNKPFVLPKLNPKVLATDNEALILTDVMEYKVRTVDELKELGRKQQNQYIVQSRRYLTKNDESVLRPVTLWVVANVATKDGRDLYLAAIRSLKQLPNERVGLIHNVAPNDRVGYAIASLIQACLKLPLHQAKVIITKMLEKQLKTIDELEKLDIHGVDWSFLRNELTKKGEDIVAIDSYYSTHILNIPSGKVGLIINGIILSDVTSKDFSSTEDFALIEKYLLSSGCKVIASQIRKWNVPHDDGRSSDLVMRVFSLLKAYGPDTKRQWVTPLMQNNSCVDILSKDMTSATFEVVAIVDPLSASAQQISHLLSTIGHVVNADIRLCMNCKPKLSDIPLKRFLRVAIPTQLEFNQDGSLKRQPVARFSILPQKQLFTLNVIAPHSWLVEATEAAYDLDNIKMSDAFTDVVGIFELEHLLLEGHCFDEVTGSPPRGLQFTLGTAEQPVMFDTIVMANLGYFQLKANPGAWLLRLREGRSKEIYKVNSLDGSQVANDEDMVVILDSFGGRTVKIKVAKKPDKYEEELLPTSGEEDEESSLWQSISKKFTSPKDDYDVLNIFSLASGHLYERFLRIMMLSVLKHAKSPVKFWLLKNYLSPHFKAFLPFMAKRYNFSYELVQYKWPRWLHQQTVKQRVMWGYKILFLDVLFPLDVKKIIFVDADQVVRTNLMDLMRLDLEGAPYGYTPFCDSRKEMEGYRFWKSGYWKQHLGDRKYHISALYVVDLKRFRQIAAGDRLRGQYHGLSKDPNSLSNLDQSAMRIIEEWRDYDAEIKKLLDEYDRQRGIDRSASNEEEEEEEPQQPSGPIPHGEEL

SEQ ID NO: 4162 - protein, 1551 aa, Cryptotermes secundus
MQFLVIALLVHVFCGAAGGASKQKTKSVTTLIEAKWEVTSLVLELAEYLRDENENFLWEFVDGVCALDPPIADLENERAKYDTALDVAGLLMTPAQISVLKLALSLHIYSPKVEMYSQMAIERGVSALSCPVVADVAGKLTCYVKEMKKFISEKEGGDQSHVETFGLDHHYPGSQNNTLTVVLYGELGTQEFAEFHQVLKTYAVKGDIDYVLRHYIKERPNRRVRLSGYGVELQIKSTEYKVQDDTEVKGDKSQDSYEQDDEDDEIEGFNFSRLKHLYPDKKENLAKLRQHLLESSNEMAPLKVWQVQELSLQAAERIMSSPKEEALKVLTNIAQNFPLQARSLVRTVVKDELKQEIKRNQELFASSLNLQPADTALFVNGMFFDLDVVDVISLLEVVRQELRVMEGLHKIGISDSHMSSLLALDFSSSGSSSSPEYAIDIRDSAVMWVNDIENDKQYRRWSDSLMELLRPTFPGMLRSVRRNLYNLVILANPAKKETRPLLKLAESFYVHVAPLRIGLVFTVDPDQSVSGNMDAGVALLNAFNYVSDVKDAYHGLAFITDVYATLKEDRDVVVEDVISLLSSKFRSADVDEIFGEDSEYDTGRRLARDFVERSGFRKIPQALLNGIPISEKHLNADDFEEAVLSEIMNQTPVFQKAVYKGDFTDGDNALDYIMNQPNVMPRLNDRVLNQDKNQYLDLMGLPLAGEIPLTLESFSGLSPRDKTATIISRGVQYFLKKQHVDTTVTALHIITHWIVTDLGTADGRQLLIHALDQMRSSGGISVGVLLNPPTVEQFQQVDRIVLAAPRVLQPGHASQFIIKILSDDSLVEALNNGQKDLSDISVPGVDLMELSEALKEDSFELLKVQQLYCRQVLNVPAGARAIVTNGRILGPLEQTEKFTLDDFSLLERYSMNSYGDKILQTLKKTTEHNADDYDDVLRDSNVLMQAVALLVSRPQSRNRFEIPVHTDIHSVIKLPPHNVSEPAYDIAAIVDPVSRGAQKVGPILSVLQEVLNCHIKVYLNCVEKNSDMPLKSFYRFVLEPEIHFTSDGRQTSGPMARFANMPTSPLLTQNMQVPENWLVESVRSPYDLDNIRLEDVDSVVHSEFELEYLLLEGHCFETTMGNPPRGLQITLGTETQPVVVDTIVMANLGYFQLKANPGAWILRLRQGRSADIFDIVSHDGSDTPANSTDIKVLISSFRSHVLKLKVAKKPDKMHMDLLSDDSDPNSGIWNSITSTFGASKTTEEEGDERINIFSLASGHLYERFLRIMMLSVLKHTSTPVKFWFLKNYLSPTLKDFLPHMAKEYGFEYELVQYKWPRWLHQQAEKQRIIWGYKILFLDVLFPLDVRKIIFVDADQVVRADMTELRDLDLSGAPYGYTPFCDSRTEMDGFRFWKQGYWRNHLQGRRYHISALYVVDLRRFRRIAAGDRLRGQYQALSQDPNSLSNLDQDLPNNMIHQVAIKSLPQEWLWCETWCDDASKQYAKTIDLCNNPLTKEAKLTAAMRIISEWKDYDLEIKKLQNKINMNQTDEEREFMSGESTTWKADDHEQHSEL

SEQ ID NO: 4163 - protein, 1486 aa, Exophiala oligosperma
MQLPRLLQNSVAGGLLCAALFTPLTGASPSINVALETSFSAAPYLVELLETAALENSSSYFPLLDRIADGAFVDLQTEKELYNKFIEVLQQDGHLSNPESLSSFKFALALHAAAPRVEAHFQYYNHSVQPHLMAAQDAACPVWVYLDGQQYCSPALDRAQQPVSMPEAEGELPFDRVLGSDVDGPHSILYADITHPLFGQFHSIVSQTAREGRSTYRLRYRPSTLSARKPLYVSGYGVELVLKRTDYIVIDDRDAQKSEASKPEQISLQQAQDDDLTDLKPLTSSEVVSLSVNAASLIASSPDPLERLLQITCDFPRYSSVLASTNASKEFLAEHRANREQFLPSGYNVFWINGVQIEARHINAYSLLEHLRRERRIIGDLQKIGLAPSEAVSLMSSEVIAETQANESPQRFDWRDDLEENKVLMWLNDLEQDKRYAGWPSSLRALFARVYPGQLPQVARDIHNLVVPIDMTDVKDIELVTTALQNLVKRSVPIRVALVPTGTGAVADIYSKLSYHILDTYGLGTLMSFFTEIASSKKLPASPEKAFTTAIKGRSLREGKEVTPYEGILQAEPLDAKLKARDAYVKRLALGSANRPFVVNGVVLPRSENWFEVLSSRVFSDLQLLQQAIYEGAIEEEGWIPGILLFSAAARRNELVFPSDPKNVEIVDINRLTNDFANEFAALPRILGNAATLLSDRAHVFVIADLSTAAGRAFLQQALDFWEAHPEADLLILHNPLPDSELHSVASGLHALTQHGRDLTVEQVRTLLEQDTILPEGEEEAGRFWASYWGLLNQVGLEMGQNGLWLNGRVIAPVDDSFMATDFESLLEYERRERMAPVTTAITSLGLEERFGDALDLAKVTSLVARSLKSDLPEGLRESAPLIRMDRFKIWNDTHTSFKISNGDNPTIQVVAVVDPASEVVQQWVPILKTLSHLSGVSVKIFLNPKDRLAELPVKRFYRQVVSSEPTFDSEGSLQEPTASFQRIPRDILFNLGMTVPPSWLVAPKECTYDLDNIKLSSVADGDNIDAVYELEHILIEGHARDVTTGPPPRGVQLLLGTEQEPHFTDTIIMANLGYFQFKANPGFWHITLKPGRSSKIFSIDSVGPQGYAAQPDDETTSVALLSFQGATLFPRLSRKPGMEDEDVLEASGGAMDYLNKGASFASSALSSLGLKTKSSNNADINIFSVASGHLYERMLNIMMVSVMKHTKHTVKFWFIEQFLSPSFKSTLPDMAEHYGFDYEMVTYKWPHWLRGQKEKQREIWGYKILFLDVLFPLDLDKVIFVDADQIVRTDMMELNKVDLKGAPYGFTPMCDSRTEMEGFRFWKQGYWETYLRGKPYHISALYVVDLKRFRQLAAGDRLRQQYQALSSDPNSLSNLDQDLPNHMQHVLPIHSLSQEWLWCETWCSDESLGVAKTIDLCNNPLTKEPKLDRARRQVPEWTEYDEEIASVLKEAAGKRSSRQLPEVDEVAGKKEDIVAADDERKRDEL

SEQ ID NO: 4164 - protein, 1483 aa, Oidiodendron maius
MRAMSFPWGLTGALLASTYLHSLCVSASPSINVELRASFSSAPYLLELLETAGDENSTSYFPLLDRIADGHFSKASTDKELYDQFIQVLKEDGHMSDPHTLSSFQFALSMRSSAPRIEAHYQYYHTSAEPYLQADQEPSCSIWVLFNDKQYCSPLLEEANGDVSGHSQAQELQFDRVLGSRSAPATVLYADITSPSFGQFHKSLVKAALEGKTSYRIRHRNPTSEFKPLTIPGYGVELALKRTDYIVIDDREDNEAKTSNSDSETKVKFEDEEFADLKPLSSSELLNLSVKASSFIMQSEEPFDTLIKLSQDFPKYSSAIATHNATDGFVTEHEYNRAQLVPAGYNVWWINGVQLIERQINGLSLLEILRKERKLIKGVTNLGFTVREAIDLLAHTEISTVKVDNEPPRYDWRDDIEGGSTIIWMNNLEKDKRYAEWPESLSAMLQQTFPGQLPSVRRDCFTLVVPVDFTDMQDVYLVADTLLSFVKRKLALRIGIVPIAKTSNAAEQAAIVYHLLDTYGLAAATEYLGVSYNSKSVEHASKSNFESVIKGKGLRPDKTSHPFDDVLKSDEYKNQVQFSQKWIQRLGANSDVPPMFVNGVAIPRDENFLQAMSSRVSTDLRAIQAEIFKESIEPDAWLPSYFLTDAVLHRNTLVAPEDDKSLRIFDVNKLMDGSLDILQKLPRVEVDPSSAKAEWAYMTVVADLNSEAGGKLLSTAVSFRKANPSVELVVVHNPAPEATNNTVSNYLFSYMRGRSYNTVQNADELIAHSNAAAVDGTGLFQEEANRYWQTASSLVRSIAFQPGQNGLLLNGRLLGPVPDTLELELADFEQLLSYERSNRISPAYAAVDALGLLDKITEPLVAAKISSIVALSTISDTPDGIFEKAPTIRLSFNDVWNSSHTVIEIGDISTASIQMTLLVDPASEQGQRWLPIIQVVSELDGVYLKLFLNPKGRLQELPVKRFYRYVLGSKPTFDESGDLQSLGASFTGVPQEALLTVGMDTPPAWLVAPKTSIHDLDNIKLSSVKSDVKAIYELKNILIEGHSREIPGGAAPSGAQLVLGTEREPHFADTIIMANLGYFQFKANPGFYKINLQEGRSSEIFKIESIGSQGWAPVPGDESSEVVLMSFQGATLYPRLSRKTGMETEDVLEATADSPLGFVSRGLNFAQGILSGKTHEVQQETQAEINIFSVASGHLYERMLNIMMVSVMKHTKHTVKFWFIEQFLSPSFKDFIPYLAAEYGFQYEMVTFKWPHWLRKQTEKQREIWGYKILFLDVLFPLSLDKVIFVDADQIVRTDMIDLVNHDLKGAPYGFTPMCDSRTEMEGFRFWKQGYWEKFLRGLPYHISALYVVDLQRFRQMAAGDRLRQQYHSLSADPNSLSNLDQDLPNHMQTVLPIHSLPQEWLWCETWCSDESLKEARTIDLCNNPLTKEPKLDRARRQVPEWTVYDDEIAGVDRKRKGPKEPEDKTESKTVGAKEGTSSKDEL

SEQ ID NO: 4165 - protein, 1642 aa, Trichinella sp.
MEVLIFHLENSNPLNLIESEVICGNESCFITELSSMTVFCANFTVESLLDATVRSMWVFPLIVVCFVSPVLVSPRKAHKNVIVSVRSKWPSTSLIMEASEFMSKESNEKFWQFIEAVIDKHQNSLGNKTDREVYNGILQIGDQILKSKARLEFLKLALTVRVHSATVEMHRQIAATSLDVQNGKSVYAVVHGKQISDLQQLDTILKHAEALARPVTYEFDHIYPGSKQGSVCVLLYADIENPHFKPWHLQLKKLVQRDGISYILRHYPKMNDDMVALSGYAVELAIKSTEYKAVDDSDKQTGSESGVSSSEEEVTDLNGFNLHLLEADELTPLKVWQLQHLSFQAGQRVILAPKEEALRVLRDISQNFPIMARSLTRMSINPNFKNEVEENQADAFSKLNIEPGDSAFFIDGIVIDLEEKDIFNLIELLKNEEMLISGLLKLGIRRKDFTLLYAMKGNDPNAEYAVDYTQWSPHYINNLESDAAYRNWGNSIHAILQPYFPGMIRPIAKNFFTLIFVLRLGDRASQNLLSTAYQMYEHVLPIRIGFIFVVNNDKSVSGYDDAGVAMLNAFNFIKEDRSVSKAIMFLIKIYNTSMRETISVEDVHKLFKSSYRDENLKSVFNSEEYNQGRSSGVDFIKESGLSMVPMVLMNGYPFTAEEISPEHIEEAILSKVMRFTVDIQKDVYEGNLKENMDVQQHLLKKPTVLPKLNYNILQMENIFLDMTDTSKYGAMSVEKFSHLDSSGKTQFIIESILYLTKNDDDILRPVTLWIVADVESDDGQQFFLNAIKYLKYSVDMRIALIHNPKSEAQATKGTASLVQACIQFLPLYQSKAVIGKIFANKITTLEDLINLSPSGISWPEFKKAYNSMSDIWMQLHVHYAKFVLNLDPGVEAIVANGKVLAPLSASDFNSLKDFNFIERYLLTSGCNDIAQHLKIIPYLDKSPKALSDLVMRLYAFLRRYNANEKRHWPIIENYHHSCVQIEASDPTAAQFDIVAIVDPLSPAAQKMSHLLVILSSVLNVHMKVCMNCKSKLSEIPLKNFFRMVLPRELEFADDGSLKAQSSARFSALPQKQLFTLNIIAPQSWMVESVEAVYDLDNIKMEEVKGDVVAKFQLEYILLEGRCFDERSGSPPRGLQFTLGTFHEPFMFDTIVMANLGYFQLKANPGAWILALREGKSAEIYEVKSVDGVVQNQTTSVVILDGFSGRMIHVKVAKKNDQLENELLAESEDAESESLWQSISKTFQSGEKYDVINIFSLASGHLYERFLRIMMLSVLKHTKTAVKFWLLKNYLSPGFKEFLPYMAGHYNFSYELVQYKWPRWLHQQTEKQRIMWGYKILFLDVLFPLDVKKIIFVDADQVVRTDMLNLMELDLEGAPYAYTPFCDSRKEMDGYRFWKQGYWENHLAGRKYHISALYVVDLKKFRQVAAGDRLRGQYHFLSRDPNSLSNLDQDLPNNMIHQVKIKSLPQEWLWCETWCDDKSKKFAKTIDLCNNPMTKEPKLQSAMRIIEEWKDYDSEIKDLLDQRTKDKWNITEQKIVDIGFQFTAYFLVFLEESWNRAMNKENQVQDNRKAEITRDDLPPATGSINNATEMKARQRGMIEKMLRKYVVGIKNQNSLIKLRIMPANSLGTLRLSNRRLSKQMIVI

SEQ ID NO: 4166 - protein, 1506 aa, Paxillus involutus
MALALPCVLFALTGGVLSAFNVHGASPPVAVSLRSSFSGSDPLLEAFETVAMEEPSVLFPLLSAFSLPEKPLTPQNVHEAVFDIASTHLDGPALASARVLLALHAASPRLAASAEYYDSHIANLTDSHKLRSPECASWVDWYGHIVCDADTLLQLASSENNTLATTRPKRLPLDHVHQVTASLEEPRYTALHFADPTAPSFSSLHGALLSLEPKVEYVLRWAKGTVEKGETELSSYLSGYGVALDLKKMDYLVLDDRDQHQGDSAAHDTSSGDNVEDADKRPSSEEIISCVFDSLPYIDEEAEARARTGEPLSSEEIANLGLKAIQFMMSFSSRPQAGPLYIHQCWDNHHQVPFPAVDLFSTLSTSFPLYATSLARKIKVLDELRDEVHENWAKAAPGVNMVWVNGRVINENEGSAGSIFGLLRTLQRERGLVKSLVDLGLTSSQAIELLMYPAHSATQNPSIPLETPRKGTTRGSAKAFVVQDDGVEIAEKKTFAISPKFTEFLDGLIDASDRQEGGGVVLYWNDLEEDQRYAAFSPSLQGLLRVHTMSLFSPMLRIRLNLVNVIFVLDLSETRSLSLLGSLSETFVARGFPVRWGFIPDFQGDSLKMARLVYYLKQKYGRDRMMAFIQGISHTHAERRLSSLSWQIVHETFNTLSAGDDFAAIARGDVPIIHEATGEDVLVRAQRYARRLGVGLQGATGKGHAFVNGRYFPVDDNLFRQMSTEVMAQLQILQEMVYTGEIMDTDASLMSTFFYDLPSTFSRRNPYIFVKSAPGGGHLLDAMGLRMFNLPELFSKAGFEEKDGSFILPSDSDALPITMYVIADFDSPEGLELAKEALRFVTNSVRTRVTFIHGPGEMTTGVVSTFISTLVHSGRLSEVPPSRMLEVLADRLDEQLGAFKDELMAGKQLTNAKLFRILQTNRLVARELGLKPGQRCILVNGRLVGPFESGSDFDAEDFEMLEGFEIKQRVGRVMEAIDAVLDGGDALDVFRRAHLVSMASSIIYADQQPDPSEAGLFDSAPKPRTQNYRSLSAGYTWVSHSVTLQRVHASRLAHPFSPCQVSERAEGIKWVGCLQFTSVSFDNEVVECKDRLNATRPFFGGKLTKLDVVEIIEGFTRAHKPRWWDVHAQVRYDFEPKRGHQSQVYCKWHLSNGPDHCSDMESFVSKMSSLFKSRDEDKDVEVIKKQADGQADINIFTVASGLLYERFASIMIQSVLRNTKSSVKFWFIENFLSPSFLEFIPHMAEEYGFQYELVTYKWPSWLRAQKEKQRIIWAYKILFLDVLFPMDLKKVIFVDADQIVRADLKELVDLDLHGAPYGYTPMGDDNHEMEGFRFWKTGYWHDFLAGKPYHISALYVVDLVRFRQMAAGDILRGSYQMLSADPNSLANLDQDLPNNLQRDVPIHSLHEDWLWCETWCSKDRLHRAKTIDLCQNPLTKEPKLSRARQIPEWEEYDNEIAQFARKLAAEGKIHSSVATADSNILAGSNSNVQPGASGEAKDSSLSHDEL

SEQ ID NO: 4167 - protein, 1418 aa, Schizosaccharomyces cryophilus
MKWSIWLGFFPFISLCFAAKPIDVRVSTTFNKPSFVALLAESLYEENRNSFLWFLDNLPLIRTDGLSTDEHLYNRTVQYLKADNVLSQEELTTFTYSVALLSGVPKLAAFSSVVSSHPEGCNTFLIFNDQTNLCFSDLPQGSFLYTGNYQPTPLDYSVAYFSEALPVAVIVTDFGTDFDRFHELYSSLAKNKECNYVIRYAPAPNATMEKLYVIGSSDEKNEVLFDLASDQLETVTQDQIATLDMLAAEAIVTSKTPLKTLKLLVQDFPMYAQHLVSKVRLSEDLIEDVNNLQSYSIPEGQNAVWLNGIPIDLQEADAFTILSWLRKERQILSGFQKLGIEPSKASKVLSNEQFDISEAEFKFARFHCQDDLEDNKAIFWMNEVETDTRYSKWPRSNMQLLTPIYPGQLHLIRKQLHTVIYPIFPSSDSSFSLLSELIQFSRRPSPVQTGLVCVATEDDEFGKTICRAFHYVAKTSSKPNALKFLFKCLASDPSAGAWALVEEHMPVEDYDEETFPEIKKSLNSNIYDTILLKSLQWSSRLGLDPESQDVIVNGRIIAHDKHYDSNMYGIFIEDIPEIQLAVAQQMVLEEENLLDYLLKDAAHIRNPLIHPSSKSKVKQIDLLSLLDNIGFTYSDLLTVGNKNAKFSLLLVTDFASQEGLGLTSMLAEVLSKFESSNLILVQSDFDNELPTLISDLSSYTNPTNEDLRKLLKNNEKKKPAKLTSKIKSKLAKYTEVSKAIVGNIDEPSQSMLILNGRLINSFSIEKLGLEDLEMLLSQEKGNYIDKLDNMLDNASQLQNQGILPLLSSYLKKLEFDYVRGSVPGREKAMFPRDNFYNQLPVSRLTIETENFSSCMYQFVAILDPLSKISQKWSSILESISHLDGVGVRIYLNPSKSLSDFPLSRFYRYSIEYEPVFDNGGQFKDSLIRFDTLPADTLLTMDIESRDTWVVMQNEVDIDLYNIKLDHTSPEENVEPVSAVYEIKNILIQGYSQEEGLKTPPRGMQLALETPKQEHFADTIVLANLGYFQLKANPGIWNLKPLSGRSSQFYNIKALDKLDPSEEKQVVVDSFEGVTLYPVMRRNPGFESSDILDEDMSPQRFFDKMKQKLNIFKIGKKEPTINIFSVASGHLYERFMYIMTKSVMQHTNKKVKFWFIENFLSPSFKHSIPVLSRHYGFEYEYVTYNWPEWLRKQDEKQREIWGYKILFLDVLFPLNLHKVIFVDADQIVRTDLQELMDLDLHGAPYGYTPMCDSREEMEGFRFWKQGYWKKFLRGLKYHISALYVVDLDRFRKMSAGDLLRRQYQLLSADPNSLSNLDQDLPNNLQHLIPIYSLPQEWLWCETWCSDQSLKKAKTIDLCQNPLTKEKKLDRARRQVREWTTYDNEIATLLRTAEEESSHLTSSPSVQDQPQNMEKDMDEL

SEQ ID NO: 4168 - protein, 1520 aa, Scheffersomyces stipitis
MFSRWYFSLLVVLSVQFVVAENQKTGPDQNTLSVQLQAPWKETDFELNLLESIAAANESLYVSSVLKLAGISNIEEEVEDLEDFEDEDLELSRKSHKDKYELLMKNIDNEETRATINFTLVNKYYSPRIESHYDHYASDVEAELSERLKTECAVDSFGNKLDTLDVWLLYNNKLYCSKDELYALQTDSRSDVQPLLFDRVIGTNEKAPLVVLYGDHKSDQFRDFFENLYESANIGKLRFVWRYLPPKTVRKNDILTGYGVDLTLKRTDYVVIDDRDVSSKISNSKKKSSKPKLDIRKDLHKIAALQELFPIDKSSLQSLGLKLTSFVKSNKQKSSYDTLVQILEDFPKYVSFLADLPRDNNEILVGDIVDSNEKLGLSKESFGLYVNGSPIHRLELDLLKLFEKIKDELDFINKLQELGFTIEQAKFLLTKFALLSAVKQTQFRNGNTIMGKNENRFKVYDYAFTKTSKRGVVFLNDLENDNSYSHFTTNSREAYLGPESYRLRPNQIPPSRENIHDLIFAVNFGNREQLRVLFTLSKVILDNGIPQQVGIIPVQGEDPLDLILAEKFYHIVATSSPQEALAFLYKYLESKSVDETQNLIDTITIPIGQEIGPEAFQDVLLRFSIDQASVIFNGVIYELTSPNWQIAMSKQLSQDIALLKSHLRNGNAEGKSLKSLLYENAGTERNLRIIPIEPSDTLYKAVDEDLIKYSTLIRKDTTEGIAGTFWLVGDLNKKICQTQLLNLLISFKKSKYDYQIRVINSGTTSAVLNKVKKSFKLDKLSSPKIDKVIELFKSEFREVSASSNNTIIKFLESKQLPSHHDFLLFNSRYFRLDIPLSKKEIELLLEYEYSQRLSLFDDILKAYPEVFHGQQIDNFSLPASVGSREDWMDLVTSVVTKSFHFDDRSFITDVSRFDFSKLNYGNCIDVNTYEVTKKIDILLIVDPLDEYSQKLATIVKSVADIPFVNTRILLQPSTEEVEDITIKRFYRGVYESSSPMFVDGKWSSNSSASFESLPGSELFTTDLDIPTRWLTTLKESPIGVDMDNIKFDNYNNKNAYGVYELRNILIEGYARNVANGNAPSGISMKLAKSGSITDTIVMSTMGYLQLSALPGIWKLFLDSGKSSKHYSLLSASSNKFEANTASLEYVDIGIFNLNGQLIFPRLRKNPGYEGVEFSNDAEADKNEGIKNAGIIQSVFKMDKPAKEADINIFTIASGHLYERFVGIMTASLRKHSHRSIKIWIIENYISSHFKRLLPYLSEKYDVEFELISYKWPNFLRKQREKQRSIWGYKILFLDVIFPQDLHKVIFVDADQVVRTDMQDLVDMNLEGAAYGFTPMCDSREEMDGFRFWKQGYWTQVLKDDLKYHISALYVVDLDKFRQIRAGDRLRSHYQKLSADPNSLSNLDQDLPNNMQRSIKIFSLPQEWLWCEAWCSDESMKTAKTIDLCNNPLTKESKLERAKRLIPEWTVYDEEVQELVVKATEEYYEKKEKESEEFKKLEEQERSREEEEEEEEDNDIDHDEL

SEQ ID NO: 4169 - protein, 1047 aa, Ectocarpus siliculosus
MNINTEEGGESAEPPLYGGGRGLDWLHPSGTSDYAKGVSVVSVVDPSSRKGLRALEQALSLLVSENGGSGGGGPEEKADGPSGASLNDNDNDDGAEDGGAGDGVTLPRSGLRLAVVFDAASSSPERSGGGGGGGGGGGVPAAGGGRWWLPAVFEAVGSRSPDKSPRFLLSVTRAAMSSPGPDGEAKNAADTVETLAREAGLSPSLRAAVAKAAAGGEASSSARRRRMARLARSVAGTARGESCALVNGRRVMSSGPALRPTESIHRVLVDWRASGPRWFHILGAELQSTVISQLASFLLRFHQERRQMIPDAVALGEILVQTVAEVAAARGGGRGDSTNKKKRKKRKKNAAGGGGGGAVNDDGVVSVLRLGPDGHLRRGTVGGAAAAAAAAASGEQEQDADGPGDAAAGDAVADAVVDAAPSDAVGDSAGDAAGGGAAGGDIAGGDATGDGAGDANGAGDGQAAAEAEGAGGEGVVEEDEGGEELGMGQVAVELVAVLDPLSVAAQRASTLLSLAQEVLGLPVTLLLLPSLDVSELPLKNFYRLVLGPASGSVAAFDRLPARDILTQRLDTPEPWNVQASAALQDLDNLRCDDSAGCGDNGTFTTSAEYTVKGLLLTGRCYDVTSSPPSPPQGLQLVLRPSPSTPSSHTTGGGGGGGGVTADTVVMENLGYFQLQASPGVWDLELADGRASEVYEIIDGGGRGGSGSGGVVNSAAHAAALEVQRRLETERAAEGASPAAESQAIVVRNFYSRYEPVLVRKRPGMEDVGLLEADDGFAASASGDNAAAGAPAPAGIWSRVSAATENVRGLVGLAGEGEGVGMGEVKGGEAERLHVFSLATGHLYERFLKVMMMSVVKRASMPVTFWLLENFLSSSFKESAQALAEEFGFRVEFVTYKWPEWLRRQSEKQRIIWGYKILFLDVLFPLSVDKVIYVDADQVVRADLKELWDLDLQGAPYGYTPFCSSREETLGYQFWRGGFWQAHLAGRPYHISALYVVDLKAFRRMAVGDSLRSIYNSLSQDPNSLSNLDQDLPNYAQIRRGTGKVPYM

SEQ ID NO: 4170 - protein, 1510 aa, Tuber magnatum
MRLPNFGGRLSVGLLLLSPCVRLVSCGPAVNVALKASWNGAPFLLELLETAAEEVGPSYFPLLDRIAAGDFADIGSDRALYHAFLRVAQGEGFLVDQEELASFNFALSIHAAAPRIEAHYHYYGNSLEPMMGRLYEATCEVWLQWSHKQVCSTGGDFKDMLNDRRKLQFDRVLGTHEDKPAAILYADIEAPTFKQFHEVLRDYAKQGILTYRVRYKPRTNKKGRPVILSGYGVELALKKTDYIVMDDRDVSGGGDVNKGEYTQTPIGELDDQEIQDIKPLHPKDMSFLGMRAASFVMDSEDPLTTLLKLLQDFPKHASSVAAIDVKPDVMDALQGNWDSFLGSGQNALWVNGVQLESSDINAFALLEHLRRERRFVNSFRTLGVNSSEAVQLLSHQILANSRQDEAPQRFDYRDSIEGGKSIIWLNDLEEDLRYREWSAAVGMLLRRVYPGQLHPLRRNIHHLVVPVNLASRDDLALITEQLRLFVDRKIALRFGIVPLTGTPEAVAQAKVFYYLNGSYGLPVALRYLELALGSGQFSKPNAKVLDQVIKEAELIEGRTALSLEEVLSSETVGEHIRASKSWAGRLGANSLIPPVFINGLSLPRDEQWMQTMSARLQADVQLTQRAVYEEIANDETDFATLLLGNAATRRNSYIFPEGEESIRSINVEKLLQEYAHIFEKLPTIISDKPDKLVESTIWVIGDFDEEDGYELLRGASELQKLAPGVNLVFINNPQLVSENPALSTLLHQLHQVGFFKGPEQLRQLLEEMPDVKSSSWRFPDHIESGNFWRESQVMLEVAGFKPGQRGVIINGRVVGPVPIDEEFGAEDFVQLLEYEHSRRILPVLKAANEIGVLEKLKGSQSSARLTNLVALSNVPEVPTSMFQGPSLARTDAFDRLWKKEHVAIESGDRGEAIFQVVASIDPASELAQKWVPILKVLSEMKGVYMEIYLNPQRVVAELPVKRFYRHVLNSAPIFDEHGDLTDPQARFENVPELPLLSLSMDVPPSWLVTPKESPYDLDNLRIQSLKDRLKGTDIEALYELRSILIEGHSTDIINGGPPKGAQLVLGTEKEPHFADTIIMANLGYFQFKANPGYYKMELKEGRSKEIFRIDSTGTKGFQQGKHGVTVEDSEIALLSFQGATLFPRLSRNPGMEVEDVLKQSTGVPKNVGDFATKFLRMAENVLVNIGFLAPVADSKPQADINIFSVASGHLYERFLYIMMLSVMKHTDKSVKFWFIENFLSPSFKDFIPVMAREYGFGYELVTYKWPHWLRGQKEKQREIWGYKILFLDVLFPLDLDKVIFVDADQIVRTDMRELVDLDLQGAPYGFTPMCDSREEIEGFRFWKQGYWKNFLKGLPYHISALYVVDLKRFRQIAAGDRLRQQYHQLSADPNSLSNLDQDLPNHMQSVLPIHSLPQEWLWCETWCSDESLKTAKTIDLCNNPMTKEPKLDRARRQVPEWTAYDEEIAALARRSLKKERGEESEAPRRVEKEEETVEAPGGREGEQPVIREEL

SEQ ID NO: 4171 - protein, 1604 aa, Coleophoma crateriformis
MAIFKLPWGLAGTLLASTYLHSLCASASPSVNVGLKASFSSAPYLLELLETAADENATSYFPLLDRIAEGYFSKASTDQELYNQFVEVLKEDGHMANAETLSSYKFALYLRSSAPRIEAHYQFYQTAVEPFLDVEESTSCPAWVLFNSKQYCSPTMDVAQGNVKGNLQLQELPFDRILGNADAPASILYADITSPTFGLFHQVLTKTAREGKTSYRLRHKASSNAEPKPLIIPGYGVQLALKRTDYIVIDDREGATEPEMTSSETEVKFEDEEFADLKPLSTSELVGLSLKACSYIMQSEKPFETLLKLSQDFPKYSSPVAAHNASEAFLQEHAYNRAELVPAGMNVWWINGVQMIEREIESLSLLGKLRKERKLINGVRELGLTGPEAIELLGHEVVAGVKARDEPQRFDWRDDLEGGQVIIWMNDIEKDKRYEDWPKTLHSLLQRTYPGQLPPVRKEIFDVVIPLDLSNLDDVKVIVETLQSFVKRKISVRFGFVPLSETSAAAEQAKVVYHLLETYGLSAVVAYLEAAASAKKLSSASDTILKTVVEGRKIRTDKTAHSVEKILSIGTYDERVEAAQKWASRLAMDSKAPAFFADGVALPRDENWLQAMSARASTDLQAVQNAVYQEILTEEWIPAWFLSGAASRRNPYVIPEDEKTLRIFDVKKLLDEHSSIYNVLPRLPAEGTSTSADWTNIVLIADLVTEGGWKLLLNAVKWRELNPSAELVILHNPAQPGHGFSVTDNLFTHVRDAQGEAFESLNQLKSTLRWDGMVEDSDIREVAGQFWKAATPLVQALSLTPGQNGVLVNGRLAGPLPEIAAAEFTTDDFDQLVSYELTKRIRPAYAAMEALGISEKITNPLVGAMISSIVAISTISDVPEGMFEQASTLRMNQFSIFKAEHTVIETGDNTTASIHLEILVDPASEQGQRWIPILKAISELEGVYMKLFLNPRERLQELPVKKFFRYVIDSKPSFDESGALKAPGASFTGVPQEALLTLGLDIPPAWLVAPKVSAHDLDNIKLSSIKTNVDALYELEHILIEGHSREVVSGSAPRGAQLVLATERDPHFADTIIMSNLGYFQFKANPGLYKINLKEGRSSEIFEIASLGSKGWSPRPNDNTQEVVLMSFQGTTLYPRLARKAGMEAEDVLEAKVDSTMDFVSRGLNFAQGILSGKGKDLEEKHADINIFSVASGHLYERMLNIMMVSVMKHTNHTVKFWFIEQFLSPSFKDFIPYLAAQYGFKYEMVTYKWPHWLRSQTEKQREIWGYKILFLDVLFPLSLDKVIFVDADQIVRTDMIELVNHDLKGAPYGFTPMCDSRTEMEGFRFWKQGYWKNFLRGLPYHISALYVVDLRRFRQIAAGDRLRQQYHQLSADPNSLSNLDQDLPNHMQSVLPIHSLPQEWLWCETWCSDESQAVAKTIDLCNNPQTKEPKLDRARRQVPEWTVYDDEIAAVDRKRKGIKDEVVLEKNTKSRAWEEPITKKDEFTYGNVEIDVQVIDVQVNNAGINSSSNKNATFRENYQAGFDTNVSGIAVMNDTCLPLIGTSKYPQRRIVTLASGLGFNSDKDACEGGALMARAAVEGEKKELFLKIIDDEGKHAEFRLVIR

SEQ ID NO: 4172 - protein, 1529 aa, Trichosporon asahii
MKWLAGAAAFAAVAAAAPQSSVPFSVGVETAWSAPPLLLEILETAYDESASSYFPLLRLITSHIVGLRKTPESQYEHALQLMGSHHICSGDESTFNLALSLHTTAPRIEAAFAQYAKLDEAALGVTDCAAWVEFQGKAYCDAEKLRAAVERGIDGNSTEVPIRTLPFDHVSGAEPKAVFYYSPSPDALPLLNYLDKHTKSVPEFAYVVRYRPTGERTRKTPLSGYGVEMALKKTDYLVVDDRARAKGGVGVNAITVIKNAKNPLKAFTDLSQNLPKYTAALARKVSAPDSIKKRARITGHEYPVSPLFLLNGKLTGRLLNAIRSERPYINTLLDIGFTPKEAVELMSDEVIGTAQASTSPSEGLVDASDREEGGNVIGWMNDIENDAHSVTNSQYMRPVYPGQLHLVRRNALNAILAVDLSKKIGLGTVANEALGFVRRGVPVRFGVVPVGDNTAGKIFFYINEKLGREAANDYIKTLDTITEGGKVTDVAVETAYESITESAVGEWPPFDAVLKSKLVTKRSQRAQDWLERVGITPSEATGGTLMVNGKPIAIGVGWTRALQNELISMTQMLQQLIVGGAVGEDSDLSTVFYDLPSTLKRKAKYIVPKQGEKLVVYNLADVFNGTADVLAENFVYPAEGCRSRLGFVNVQPPGGSGLFSSLLYELISTGQLNTIKPSQLIEFIDELNSRETNIDQLTLDEIQAGQAPQELDTEGKDEPLNAFTGAGWTVGVTAEAGKFWSVGNTVAHRLGVNGTQPYVLVNGRLIGPIDEPDVLRPKAFGLLEDFEGKKRVDPVAQLVASMSIGDGKDIPRSIQIGDFENALYHFGVIVDPISETAQRWSGLLELLSSLDRVAISVHFDVDPRPKEIKVKRFYRESLRAQLSFDVDGNEVSPDVRFVDLPSSPIYTLGMSVPQAWIISPTDSPLDLDNLMLGQLGEPTHVLFDLKQLVMDGHAREGVSTPPTGLQLQLRAQGEDEVVSDTQVMTNLGYLQFKAPPGVYDLAIRPGRGEEVYELQSAGNEGWESPSVQDAGNIVTLTSLEGNTIYPRFTRKEGMETADVLEVDEPAGWLSKIKSAVGLAPVKKSRHADINIFTVASGLLYERFASIMMLSVMKHTKSSVKFWFIENFLSPTFLKFLPQMAEHYGFEYELVTYKWPAWLRAQSEKQRIIWAYKILFLDVLFPMDLDKVIFVDADQIVRTDMKELVDLDLEGHVYAYPPMGDDREEMEGFRFWKQGYWKNELRGNPYHISALYVVDLQRFRAQTAGDRLRGMYHALSADPNSLANLDQDLPNSMQQQIPIFTLDKDWLWCQTWCSDESLKTAKTIDLCQNPLTKEPKLSRARQIPEWDSYDREIAEFAASLGASELGGSVDELAGTLEKAQGLKDSDAPSSSDDATMDSAEEEGLKEEIAHEKQVQAEQDEALEEILADADAPVSFESDRPESKRKTGPADSQKGGVKADIKADAKDPRQHPADGRAAVRDSVNEEEVEVLVTYSDEPGAVWEPALKRDNTEPDAEKEEGEQTEEVVHDEL

SEQ ID NO: 4173 - protein, 1742 aa, Oesophagostomum dentatum
MLSKVHFSEFISKESNQLFWKFVNDIAGRCSKLDWSKASDEQKYELGLEVASGMLSDSSLDLLKLSLSFRVFSPSVQLFEQLGSDYSLDCAAFFEVHGTVGCTAKELENAVNSAKGVFSEELELLSTDHVYGKETSPKIVAVIYGDVGSKEWLELHQKAFKLASEHKVQYVLRHYLKRTGRSQQLSLSGYGVELAIKNTEYKAVDDSNVKKEVDEGNLHGFNFKLLNCFARELHPDASDSLDAFRIHLKEIEELAPLKQWQVQDLSFQASQRIVNDGAYHAIDTLKELSQNFPTHARSIARETVTRELRQEIELNQKEHLSDAGLSPGESMVFLNGIGLDVDSLDMFQLMDFIKQEERVSSGFFNMGFRREYLSLLAEMDFTEEKTKYAVDYRDAYPVYLNNLDTDKRYQHWRNSVKLLLEPYYPGMIRPIARNLFNLIFVVDPAERNSRNLMRIAYSFFKHEIPLRIGLIFAVNNEKGVSGLNDSSVAILNLFNFLAIDSSEHEALRMVNEMLDTYRTQDEINPADIKTWFEKNYKDADYQDVFGPNTDYDRGRNTGAEFLVKSAIGKAPKVLLNGYVLDDDGITGDKFEETVMMEVMRITPKLQSAVINGNLKDRVNVANWIMEQKDVMPRHNERIQNAAAKKNVLDIAVTSECKAKTLLDFVPLTNSEKTQCILTNIDYFKKSEEDYTAPLTVWVVADVEDAKGREIVHSALKYLDKSHKMRLSVILNPKDEELACKENSVSSLLHAATRLLPHDQAKKFVSKLIKLENMEDLRNGAHSIEDLFGKEMNLQHFNKERRNIGCDRIKMESHFAREVLGVPAGERAFIANGLIVGPFDETEEVVDADVELLEKIIHSQGAAVIATSIDNWEVDKKNGYSSDVVMRSFAMILKNAVARKRTWILSVILNPKDEELACKENSVSSLLHAATRLLPHDQAKKFVSKLIKLENIEDLRNGARSIEDLFGKEMNLQHFNKERKITLKIFAIVLLSVILNPKDEELACKENSVSSLLHAATRLLPHDQAKKFVSKLIKLENMEDLRNGAHSIEDLFGKEMNLQHFNKERRNIGCDRIKMESHFAREVLGVPAGERAFIANGLIVGPFDETEEVVDADVELLEKIIHSQGAAVIATSIDNWEVDKKNGYSSDVVMRSFAMILKNAVARKRTWIVLGEDEHSTVTLPAEDSNRPVMDVVAVVDPLSGSAQKLAPILDLLRKAVNCDLKIVLNPKAKLSELPLKRFYRYVAAPELQFDKAGNVAANQAKFTGLPSKQLLTLSLHSPSAWMVENIFAEVDLDNIRMELAPSDVTALFSLEHILLEGHCFDEVSGSPPRGLQFVLGTANNPTQFDTIVMANLGYFQLKANPGAWILQLREGKSKDIYELLDHPTTKVNKNGSIRVLIDSFSGKTIRVRVTKKKGMEQRTLLANDDEENSGIWSAISSTFVFFVLTNENHDSINVFSLASGHLYERFMNIMMLSVMKHTTKPVKFWLLKNYLSPQFKKNLPLLSAEYGFEYALVEYKWPRWLHQQKRSIGLCGVTRLTLMRILFLDVLFPLDLQKIIFVDADQVVRADLMELMNYDLGGAPYGYVPFCDSRKEMDGFRFWKQGYWANHLAGRRYHISALYVIDLQKFRQIAAGDRLRGQYQGLSSDPNSLSNLDQDLPNNMIHQVKIKSLPQEWLWCETWCDDSSKAKAKTIDLCNNPMTKEPKLESAIRIIPEWTEYDNEVKRVLKKAQEQNTSTSSEHTEL

SEQ ID NO: 4174 - protein, 1525 aa, Aureobasidium namibiae
MVRYQHLAVKTALFLGLQVFGTTAAPSVNVGLKTSFNSAPYLVELLETAADENATAYFPLLDHIAEGRFDHASTDRDLYYLFKKTLQEEGHLSKAEDISSFEYALSIHAAAPRIEAHYQFYNTTIEPTLKSRLDLNCETLLHFNGQQYCDADLSSSTANSVDQERILDLPFDRIMGDKQSKTPAILYADLMSPSFRQFHKTVRQTAKSGKTSYRVRYRPSLSIPGFPLAVSGYGIALDLKRTDYIVIDDRKADESDDTNNDASSAKLTDEDVADLKPLSSKELLRLDMKASSFVMDSADPFNTLLKLIQDFPKHSAAMSNHEVSEAFRKEHLANREVFLPSGYNVIWINGLQILARDFDAYAMLEHLRRERKLVNSAGELGLSGKEAVRLLSHSSISEAASAQEPQRYDWRDELEGGKVIIWMNDIENDRRYAEWPTQVRALLQRTYPGQLPPVRKEIHNLILPIDFANYKDVELVVESLQSFVKRKVPIRFGLVPKVSGPASTEQAKAVYHLLDTYGLGVALEYLQKLSSSQGRKLAGPVQSIFETATKGRKLRKDRVSAPLQELLKDTVIDARVTSAHTYLARLGASGPTPPFFVNGIPLPMSDEWLQEMSQRVSTDLRTVQKAIFEEQLDDESYIPEVFLSRASARRNPWIIPEDENSIRQVNLASLSDLAEGAIGSIPSLPANKDTVSNDLVHLVVIADFDSGVSQQMLSELVTLRKEEYDQVEILLVHNSAKPLSTSSFAVQLFKTMMLGPVVSLEALEALLSRDNSNTKIADEDVVAAQTFWSSADRFLDDVGFGSGEQGILLAGRVVGPMPSFAQFGRDDFETLLSYERMKRLMPAAAAIKGVNIADKANTALSFSKLSNLIALSSKSDVPEGMFDSVPPARADVFSGWAGSHTLIERGDAETAAIQIVAAVDPASETAQRWVPILRVLSELSGVHLRLYLNPKERLDELPVKRFYRHVLESKPRFDEQGSLEGTLAHFEGLPADALLTMAMDMPPAWLVAPKDSVHDLDNIKLSSTQGKDIEATYELESILIEGHSRDVTLGTAPRGAQLVLGTNKEHFADTIIMANLGYFQFKAKPGFYNLTLQKGRSEEIFKIDSAGTLGYSPQTGDETTEIALTSFQGATIFPRLSRRAGTEDEDVLESAKTTADHITDKADKILAKVGLGSVKSSEVLSKAQKFGSGLLSGTTGSTTDISTLPHADINIFSVASGHLYERMLNIMMLSVTKHTTHTVKFWFIEQFLSPSFKAFLPIMAEEYNFRYEMVTYKWPHWLRGQKEKQREIWGYKILFLDVLFPLDLDKVIFVDADQIVRTDMYDLVTYDLQGAPYGFTPMCDSRTSMEGFRFWKQGYWKNFLRGLPYHISALYVVDLVRFRQMAAGDRLRQQYHQLSADPNSLSNLDQDLPNHMQHVLPIHSLPQEWLWCETWCSDETLGVARTIDLCNNPQTKEPKLERARRQVPEWTIYDDEIAALAQRKVGEGKSPIAGSAGGVGIQAEMQEQDAKKQKEENEKKEKGKGHDEL

SEQ ID NO: 4175 - protein, 1586 aa, Gracilariopsis chorda
MGATRRLLLPLALLLTLLIGAGARSLHVALHAAWRRTAVSAEALAWLSAQRSSSSSTPLFLSRLCAQIDADPSPSTSVQSEHDRVIAAVSPLLANQSLITHTFNWLLHSAQLSPLVALHFSTAQLVLSRFNASVSDTPPVFALRADAQLRSAQLITSVDHIHASCPSCPSISADTSLSFLRPLTREVILSTSSSRSSPFIFIFADVSTAQFCRWYTALTAPIQARSHRIVLRFWRPPQQQPTRSFNPSLQSFGVHVTLKSTEYKVVDDRVFDTKLFPECGYTDAACASTHPSNRSVAWLHRPDNVTFTPLQALQFITRHNAPQQPQNLTDVLTSLSSFVEDMPSVTRSQPFLSTDDYVNTTLEKQLARSVYRVRESIGERQYLFINSRPFHLSSLTRATEKLFRCLSSVSIASAHLPQLFADHVASDRVYASLHATPVRKSASLRVHLPLQHLVHRSLVPLNDLFSDSRYKKWDPLQLNSSEDIENFVAAVDKQRKKASSSDDESSSATTPSASQQYSNIVKVRAHHLSLQLIVDPGDVQQFAYLSIPQSVIQANLPIQVSVLLVPNGKTSSLIAAAFHYLLKLKGRKTAVRFLTMILEILEYLGAFSPVPLSPQLVDMAFSRVAAKEGSPYSSAAQVLEREADINVKLEEALRFAQDMNLFGGDSTSQEVSNEEDDQVNSLNDEDKRKRKMSMLCVLNGVVVKDAVSDVIPLAIAEQERIANLLKNHQVMDALLKANTTFDRWVAADPDLIVVQRLGKKMKTRERASTVTTSEDVLPPMTAAALFDLRTHLEEIRYIAPLSLTEPDTPVEHTTTVWLAGIDQVSDEFKTVEKILREVAQSDVAEKIRTRFAVLDPTSVINQEVLGCTTSISCLDEAVVVVNGKRLPASLFASVDDVVVELSSYFDGVDRSDLRNDDMRLVHRLHVNEISSACEVSEGETESEVTFSTVRDVVLEHAHSSMLYPEALGDGLLVSKPLSVLAVVDPTSPDAYVLTSLLEQLEKAFDSDKLALGLVVLPKSRTLRKKLELPKTYRRFVLQSVAAFQEESGNRLPPRASFFGLPQDRVLTVSVEAPRAWFVSSYATNYDMDNVVLETLPEGSTELHSEYELSNLIVEGSCIDEDESPPQGLKLYLENENGVSVDTIVMANLGYFQLKVPGPGLWNLRLADGRSSELYSLVGMEMYKELTKTVYRADEAGQVGIVIESFDGGGGILLRVARKGGTEGKSLLKSENEGSEKDKMSTRSAGGMLGKVKSGIANIYDRWMQQSVADMGNGDGSVRAKDNRIHVFSVASGHLYERFLKIMMTSATKHASRAVKFWLLENYLSPSFKKVLPLFAKEHGAEVGMVTYKWPGWLRAQTEKQRIIWAYKILFLDVLFPLDVERIIFVDSDQVLRGDLAELMDIDLRGAPYGYVPFCDSRKEVEGYRFWKSGFWKDTLRGAKYRISALYVVDLKRFRESAAGDTLRFIYQSLSADPNSLSNLDQDLPNYASSAASMGGRVRMFDLPQEWLWCESWCDDESKQEAKAIDLCNNPMTKEPKLQSAKRIISEWVGYDEAASALTEKLYGELSGGGGARDGEESIRREEKEEL

SEQ ID NO: 4176 - protein, 1470 aa, Diuraphis noxia
  MOD_RES (413)..(413): Any amino acid
  MOD_RES (1323)..(1323): Any amino acid
  MOD_RES (1374)..(1374): Any amino acid
MGKINHYSRYTSSEYDYGRQYQPKKQNRKKKRIYTKNDPSNLFFIVCLFFVFFIFTNQSVNKNSKKGKYVTTMIDTKWSMVPLVLEMAEYMAEENPYSLWSFVDSISQLNPALSELDNDQIKYQTALSKAGLLLSNSKLRLLKFSLSMHTYSPRIEMYAQMAADRGVQCSTSVEIDGELVCSIEGLKKVLQRINAEGSKHLCETYHIDHHHPSSKNRSNIAILYGELGTAEFASYHTVLKQYAQEGTIDYVLRHFVKEKSEQKVRLSGYGVELHMKSTEYKAEDDSVVKDKNDINRNEDEEDISEIEGFDFKRLVELYPDKKQDLLKFRTHLSEVSGELAPLKAWQFQELSLQAAQRIMSGPPQDAIQTFIHIAQNFPTQARSLANVKVSKELRDEVSKNQDSFSMGLNLQPXDTVLLLNGMYFDIDITDMSTILDSVTQELSIMEGLYSIGITDKKAVSSMLALDFGNVKGKSYAVDIRDSAIQWINDLETDAIYKRWPSSVDDLLRPTFPGMLRSIRRNLYNLVIVCDPASKSSWPLLKLTDSFLNHQSPLRVGIVFNVSPKPAIGLNDASVAILNAYNYIVEQTSKPLSAFNFIINIYTSISEDRDIIVDDVLNKFKKQYPKAIIDEIFGEDSDYDTARVLAKEYVAKTGFRKLPQVLLNGVPLQEKSLVEEDFEEAVLVELVTQTQTLQKAVYKRELTDTDNVVDWLMTQPNVMPRLNSRVLNTDSSKNLQLSDKHEFVLKSMNYITFAKKSSINSITHWIVGDFSKLSTFKLIKNTFEHLEEIHFDVSKIDIQLYRNFAFEALNFESGQCGVITNGRILGPFDEDEDFLTDDFALLEQHTLKGSVNKILNILEDSDLTNITSDMIMKASALINSRSQTKNRHSIPDVSTKHSVIKLSANNEDEPVFEINVIVDPVSRGAQKVGSIISVLSTVLNANINVYLNCVDKNSDMPVKSFYRFVLEPEVIFDKSGHLSPDPIAKFSNMPTSPLLTQILHVPDNWLVESIESPYDLDNIRLEDVEMGVYSRYELEYLLLEGHCYDSVNMNPPRGLQMTLGTKSNPVVVDTIVMANLGYFQMKANPGAWMLRLRQGPSADIYDIISHEGSDRSPNSMDIKVLISSFRSHIIKVKVAKKPGKQNLNVLGDDDAENKGLWNSITSSFSSGSPDKSTDETINIFSVASGHLYERFLRIMMLSVLKNTKSPVKFWFLKNYLSPTFKNFLPIMAQEYKFQYELVEYKWPRWLHQQTEKQRTIWGYKILFLDVLFPLDVKKIIFVDADQVVRADMKELVDLDLGGAPYAYTPFCESRKEMDGFRFWKQGYXKTHLQGRRYHISALYVVDLKRFRKVAAGDRLRGQYQALSQDPNSLSNLDQXLPNNMIHQVSIKSLPQEWLWCETWCDDASKKSAKTIDLCNNPLTKEAKLTAAMRIVSEWKDYDNEIKRLQIKQSEHEDKVFNIETQSKGPESHTEL

SEQ ID NO: 4177 - protein, 1519 aa, Rhizoctonia solani
MRSLSALGTLGAASLVAAQTAFSPPVKVSLTTSWAAPPILLEILETTAAEHPGRYFEILDALIDRSSDGLLGPITEPVHKPKYVYSTALAHLITRGFLTEPNALSAFEKNMALHSATPKIQAFYQLFGDPSKAPECQSWIEWSGKQACTSEEADALLAGASNGGYTQIFPFDHVQESTSGECTSHAIFYASLSSPNFYDLYSHLRSKSETPGFCYILRYSPPKDTLITGEQSRNILSGYGVALDLKKMDYLALDDRGPRGKDEDSDSTTNESIVWEDYVSSLLSEHPHEDLDLTAPLTEEEISSLPLRATHLVMSSEDPLKALSHLSQNFPKHVVSVARRWDPARTEDLKAKHGSVEAEVQANMHMVSGAGNMFWLNGVALPEADINPFRCAYTSLWLPNSSLICAFICSLLRLLRREHQTVNSLMNANLTPEQAIHVLTNPEIGKASVASGPTDGVFDASDREEGGGAIIWLNDIEKDKRYTRWPSSLTVLFRPMYPGQFPTLRRNCFNVIAALDLSRTSSISFVVQLANNLISRMLPFRFGYVPLIETAESRQIARLMKWMMDEYGFEKTAQYFSVAITPSDTVDLKLLETAYVQYTTQMPPQSGNVPEFSSFSADPLQIQVVGHQFVPDEELQPAAAYAKRLRLGAQDGSGKGHVFINGKHFAYDDVSRVNFFQEQLYAGTLVDAPETDVSVFMYDLPTTAKRRNKFIYPSGNLRVYALDNLFHSVGATKLLKDSFVYPAGGHPVPLTISVVGDMDNEETLNLAIEGLRGMSDDAKYRLGFIHTPTVNPSDLPSTQQPLVSPMLARLAATGNYAEFPPSELAQILEEAKQLVVNAAELNVQDNPVLLNLNNRLTGITNEGVDYEELKRTNAAGNALAKAIGLKNGERALVINGRVIGPLAGSDFVAEDFGSLANYEAAKRVTPVVTALNAVREDLTELDRPAYADLIARVSSIISSVSVPDPSEEGLFQSKSLARQRPYNELIGKDCSSTFEIGDNSTALFHVGLLLDPLSEPAQKWSSIVEWLATVPQTHIHVRLNPAAALTEIPLKRFYRYNIQPRLTFDQDGFEMRNLVEFHGLPVEPIYTLAMDVNPAWLVRPYISEADLDNIHLASLSDPKAGVEAIFHLDHLVIEGHAREENNAPPRGVQLQLTSLDGNPTADTQVVANLGYFQFRTGPGAFRLEIRPGRGRDVYTIESAGNEGWNSGHVNATGTEITLTSFEGHTIYPRLNRKPGMESADVLAEPEKEESIWSRSLWGSKPTDVVSESKQADINIFTVASGLLYEEFIPHLAEKYGFQYELVTYKWPSWLRAQKEKQRVIWAYKILFLDVLFPMDLKKVIFVDADQIVRTDLKELVDLDLQGAPYGYTPMGDDNEAMEGFRFWKQGYWKDALRGKPYHIRLRGQYQALSADPNSLANLDQGDSARFDRAKTIDLCQNPLTKEPKLARARQIPEWTSYDNEIAEFARSLVDSGKIRSRAISGSVDALASVGKKVTTSTTEESPVPTQNEEAESHREHEEL

SEQ ID NO: 4178 - protein, 1583 aa, Piromyces finnis
MKYWNIFSIFIYTLIVLNVKCEDIKKDSPPVKISLQTPWDNTPLILEALEFISKEKPSLYFPLLSKISKEKDFPKTAYDQYQYAMNLPEVSELEIESLLKLSLSLRSEAPLIQSHYHYYNASVIPSHKANSKFDNTCQNWLDWYGSQICEMESFKKIAQISLVDGKYTMNKSDKKSPIPLPTDHVKGSSSGKENGFVIFYGDILSENFGEYLDELLRINEEAGLSFVIRYKKSSDEQYNNNPITISGYGVEMAIKNTEYKVIDDRKLKKDDKENIKKSHEKIPNIPSKEFGLNRLIETYPKLEEEFNKFNDLLQKQEIPVLKKLLKNETEDLGTKLIQYITTSSNPLYVLNQLSSNYPKISHIINQMPLIEEYSSEIKYLQKLFYVPDYNSLYVNGLEIDTKNLNPFSILRIFASENKSIKQLNSLGYSNKDSVNLLNSANDEKEDKRSSDIEYYDVRDDIVSWWNNLESDSRYEKWPKSLREILQPLYYQGQMHRIARNLYNALFVVDISKNNVLEIFTEIFVFIERGVPIRFGVVPIVGLEKKTEINSAAGVIFEVFMREYSKKSAKNFIVKLLEESKGSDINEAILKKVTEKILDDNKLKLLDDDISLRNYDDILEYGIKKYYKELKNFSEKFGISSESPALFVNGAYSEFSMDWKQVMMASVMNEMDSILRKVYYQEYTNKDNIYNKILDAPNVRKRKNIYIYPSDENPIKFIDLLSIKNIDNLKYFSNSGKLGSHASIWTISDLSSHKGIKLALEAIKYIQDKSGKSSRVSIIDSASVDNKRASVIRNIINQASMVSIPKNVDYTEVDFIKELLEARLNLDDDASEELILKKAQELNSKYGNLILQKDVDYINQKPAVDVSKIVELTLGDKKDMQAIVINGRLIGPWKNTVTFTDEDIKLSYEFEYKHRIRILIGKVRAYGKTLDWGDVTIKEWYSSLIMKTTSIVASCDTADKVKTDFNDSGSDRIGSGYIKKFKSKYSNFNTGNDETAKYHLTAVIDPASKTGQKIASFLMIISKMKEVFIEVQLYSPKPNEDVQELDRYYRYAFDTEMTFDDDNNQILPTAEFENIPIDPLFTVGIDAPQAWLVTPVVSVHDLDNICLKSVEDNGVNAIFELKNILIEGHARDMRLNTPPRGVQLILGTKSYPSMVDTIVMANLGYFQLKANPGVWELQLRSGRSAELYQIINVGDSINSWLDDRNDELVKLYEDYGITTALTSFEGSTVFLRVDKKKGMEREDVLSEEGTNTNSDNKDDDKIWGKLKKKLGINNNNNKNNSTETKKSAEKINIFSVASGHLYERLLSVMTLGVMKHTQTPVKFWLIENFLSPSFKNFIPHLAKEYGFEYELVTYKWPHWLRAQSEKQRTIWGYKILFLDVLFPLDLEKVIFVDADQIVRADLKELVEMDLHGSPYGYTPFCDSRKETEGFRFWKTGYWEKHLRGKPYHISALYVIDLVKFRQMAAGDRLRGEYQMLSADKNSLANLDQDLPNNMQDTIPIFSLPQEWLWCETWCDDDSLKTAKTIDLCNNPLTKEPKLDRARRLLPEWSVYDNEVAEFEKKVEMMLNNNEEIKSEEKAKGKDEL

SEQ ID NO: 4179 - protein, 1480 aa, Aspergillus ruber
MVSTKSLVASWRLYAIVATGLTGLVRTSPSVNVALQASFDSAPYLLELLETAAEENTTAYFPILDRIADGTFDDLSTDQDLYERFLKIVHDDGHLRTPESLSSFKLSLAVRSAAPRISAHYQFYNTSVQHSLMAAQDAACPMWVHYDGSQYCSSAMERAQQDVEGESNLRVLPFDRVFGDESLPPAVLYADIASPMFKEFHQTMTALSKEGQLSYRVRYRPPQHWASRPLYVSGYGVELALKRTDYIVVDDRDAKQRGEKDIAPGTEGKEDSPDDLKPLSSSEVDRLGKNTVSYVMDSDTPLDTLVKLSQDFPKYSAHVASHNATGELLEDIREKRGRMLPPGANLMWINGVQMHPSKIDAFTLLDHLRRERRLIDKFRDLGIPAQEAVDLLSHPLLGEALVQDTAQRFNYNDEIEGGSVIIWMNDIEKDARYEQWPDEIHAYLQRSYPGQLPAVRRNLHHAVFSVDLTDAQDIQLVIEPMQMFVKRKIPVRFGLVPTVSSPGAIAQAKVAHYLQDKFGLSSLLQYLEESLKKKKTASPDASCFESTTKDRNIRPGRQPLSLEEVLATDEYETIVSQTASYQSRLGINPGKRDFFVNGIPLTREESWTQELSMQVNRDLQMVQQSIFEGTIDDDASFAKFLLSDAVDRRNPLIIPQDPKDVRILDVGKIADAHKDALNELPRLASSAENVLGSAHVLVVGDFDSESGVQLLTVALNSQKDHGQAEVLFLHNPDGQKVAKESARLYKSLKEGKKIDATQILVDVQRSAISDAEAERICQTWAALQPLARDLGFAPGKTGVVVNGRAVHIPDGSALDSEDVNLLLAYERTRRIMPVAKAVDDLAFGAKFSEPLEFAKLTSLAALSTISDVPEGMFESSSDIRLNLFGKWTASPSVLTVSNSEDPTINIVVSIDPTSELAQKWLPILKVVSELAGVQLKIFLNPQDKINELPIKRFYRFVLDPKPSFAADGSLAQPTASFSGVPLEALLTLGMDVPSSWLVAPKDSVYDLDNIKLSAVKNGNVDAIYALEHILIEGHSRDLTDRSPPRGVQLNLGTEENLEYADTIIMANLGYFQFKTQPGLWKISLKPGRSQQIFNLDSVGSLGYSPKVGDDNTEVALLSFQGKTLFPRLSRKKGQEQEDVLETGPKPGSAMDYVSKGLSFASGILSNVGVSTGARANEHADINIFSVASGHLYERMLNIMMVSVMKNTNHSVKFWFIEQFLSPSFKSFLPHLAAEYGFTYEMVTFKWPHWLRAQREKQREIWGYKILFLDVLFPLSLDKVIFVDADQIVRTDMHDLVTLDLDNAPYAFTPMCDSRTEMEGFRFWNQGYWKTFLRGKPYHISALYVVDLNRFRALAAGDRLRGQYQMLSADPNSLSNLDQDLPNHMQHNLPIKSLPQEWLWCETWCSDEALGVARTIDLCNNPQTKEPKLERARRQVPEWGVYDGEIAALGERVRQQYVSEEQGGQVDAESREGSGWDKDEL

SEQ ID NO: 4180 - protein, 1488 aa, Thermothelomyces thermophilus
MLRLRQHSRPPLIWWSCCRSILPSNADHSSRTFRETAASENATAYFPLLNRIAQGHFLEATTDKALYEKFIEVLRRDGHMDGEALSTFRLGLSMRTAAPRVEAHYQYYTTAVEPSLPDDQDKCGQWFLVGGKQYCTPALDVAHGDVRGDAQERVLPFDRKIGTGPREIILYADITSPDFGNFHQAALKLAQNGEGTYRVRYKRNPAQRREALSVNGYGVELALKRTDYIVIDDRDTGSGEAPPDQTPNPIGSSQVVLNEEEEITDIKPLEKSELAPLGMKAASFIMQSDAPFETLLKLTQDFPKYSTFLAAHNVSADFKAEHAGNRRVLLPEGVNILWMNGLQLIERQIQPFGLVELLQRERKLINGVLDLGLSGQQAISLLGHPEIAQARSGDEEPRRFDWRDEIEDGRVIIWLNNLEKDKRYREFSPSIYAVIQPMGHGLPQIRKDIFNLVVPVDFTKPEDVEMVTTQLLGFVRRLIPIRFGLVPLTPTGEAIEQAKVVYYLLENHGLSAVVSYLEKSLEQRKTARPDQNILLEAIKDRPLRPEASPLPFNDIFTSETHEKQIHLAKHWVERLRAGGEIPSVFLNGFAIPRDEHWVKVMNQKLMVDLQALQHAAYFGQINDNVWVPGMFLENAVARRNSLIFPEDATDLKVLNVKKIYTEHHDVLSKVPIIEADDQSIKADWAALTVITDLDSLDGQKLLYFALQFRRDQPGVRVDIVHNPKDVTRSASQLNQRIKARESELSAVSRLLDLETILQSGEAQADPGYDAALAAFLATAKLQAGDNALILNGRVVGPIQSAEDFSKEDFDQLLSAERASRILPVHKAVEDLGLDDKISGPLDAAKVTSVTALSGISDLPQGIFGSAPSLRTTAFNKLNSTHTSFEVGDPSRATIFLVAIINPASEVGQKWAPVLKVLSELEGVHLKIFLNPIEELGELPVKRFYRYVLESAPSFDEHGKVKALSANFAGVPLDTLLVAGMDVPPAWLVAPKVSVDDLDNLRIKDIKTRRGTEHIEAVYELESILIEGHSREMPAGRPPRGVQLVLGTERDPHFADTIIMANLGYFQFKASPGVYNLRLKEGRSSDIFSMESAGAQGWTPVPGDNTTEIVLMDFQGTTLYPRLKRKPGMEAEDVLEESSANAGTGSAMEYVSKGLKFAEGLFGRAKSTPETKSLSATQHADINIFSVASGHLYERMLNIMMVSVMRHTNHTVKFWFIEQFLSPSFKNSIPHLAAHYNFTYEMVTYKWPHWLRQQKEKQREIWGYKILFLDVLFPLSLDKVIFVDADQIVRTDMYDLVTHDLHGAPYGFTPMCDSRTEMEGFRFWKTGYWANYLRGLPYHISALYVVDLRRFRELAAGDRLRQQYHTLSADPHSLANLDQDLPNHMQFQIPIHSLPQEWLWCETWCSDETLEEARTIDLCNNPQTKEPKLDRARRQVPEWTEYDEEIAALLKRRREEQQEQQAGEVEKNTKSRKFEEDRATETTSVKDEL

SEQ ID NO: 4181 - protein, 1443 aa, Ceratocystis platani
MISHSSETAAGENATAYYPILDKVANGYFNGISSDKDLYDAFLRLLSEDGYVTSPDMLSTFNFALSMRTAAPRVEAHYQYYATGIEPHLGSHASDKDCNVWALIDGQRYCSPDLVLAKDKGTTIKGLQATNLPFDRILGAGVPAVLYADISDPAFAPFHKAMVAAARKGEVSYRLRHRRTASHGTPEPLPVNGYGVELSLKRTDYIVIDDRETGDQPAVKDTTDDLQVVLNDDEEVADLKPLSKAELLNLGLSTTSYIMQSPNPFDTLVKVSQDFPKYSAKLAAHEIASEILEKRPKRDVNTPAGRNMMWINGVQQIERQIEPFNLLEALRRERKLIQGVRSLGLNARQANALLGHNAITGSKISEDSIRYDWRDNLEGNRVIMWMNDLEKDPGYAQFDRSVKALLRQNFGQIPPIARNVFNLIVPIDFTNAADVSLAGQLWGLSQRGLPIRFGIVPLLPSNTATEIGKALYHLYHKYGFEVMLQYVSEAGVVGTLEIQKKVFDAVISGVSKAAEGGDTPISLADILTADSSNDQIEKTRNWIKRMEASSDVPPFLVNGVMMARTERWMQSMSQRLQIDLHLIQNAIREKALTDDGEPLEFFLQDAVLRRNKYINPSGEKDPRVLDVGKLYVDHKNLFDKIATIEPLEDTTKEKWAAMTLVVDLTSDAGLQMLLDAFAFVEANDGVRLDIIHNPVETRGSSRVNKALLVNDPDAQNVNQLRDLLKPDGHAADESFDISLESFLLATNIQPGSSMVILNGRMIGPIADEDAFTQDDFQQFLLNERRVRIFPVYTAIDDLELGDIISNPLEVAKLTSITALSTISDLPQGIFDSVPTIRSNIWDKWDDSYASFEVGDAEESNVHIVVLLNPVSEQGQRWAGILKVLSELDGVYIKVFLNPSEKLTELPLKRFWRHVLASQPTFDAETGKVEKLHGLFKGLPSEALLNAKLDVPPLWLVAPKVSVHDPDNIKLSTAKGNVEAVYELQSILIEGHSRDGATTPPRGAQLVLATEKNPHQEDTIIMANIGYFQFKANPGFYSIQLLPGRSSDIFEIESVGAKGFRPVAGDKGTEVCVMSFQGKTLFPRLVRKPGMETADVLEVGDEGDSLLAKGKKLASGLGLFSSKNKGQEEQAEINIFSVASGHLYERMLSIMMVSVMKNTKHTVKFWFIEQFLSPSFKDFIPFLAEEYGFKYEMVAYKWPHWLRGQKEKQREIWGYKILFLDVLFPLSLDKVIFVDADQVVRTDMIDLVNVDLEGAPYGFTPMCDSRVEMEGFRFWKQGYWANYLRGKPYHISALYVVDLKQFRRLAAGDRLRQTYHSLSADPNSLSNLDQDLPNHMQFQLPIHSLSQDWLWCETWCSDESLKEARTIDLCNNPETKEPKLDRARRQVPEWTQYDDEIAAVDRRRRGPATEEKRGAKTEEEPEAKNTKSRSWEEPPAVVTEKDEL

SEQ ID NO: 4182 - protein, 694 aa, Rhincodon typus
IQGMDNDAFEKKYNTIGVNFLRTHRMFCHDVLKLLPGQEAVVSNGRILGAFNENETFHPEDFSLLEKITLSTSEGIKAHIKQMGVDSKSGSDLLMKVDALLSSMPKMESRKDVKFHQNQLSVVKIKPQDGVFYEVVAIVDPLSREAQRIAPLLLVFNLVINMKLKVFMNCRPKLSELPLKSFYRYVLEPELVFTADNNLSAGPIAKFLEMPEVSLFTLNMFTPESWLVESLHSPYDLDNIHLEEVEGIVSAEYELEYILLEGHCFDVTTGQPPRGLQFTLGMKHNPVMVDTTVMANLGYFQLKANPGTWLLRLRKGRSSNIYQIFIHEGTDSPDDADDVVVVLDSFKSKILKVQVNKKPDKINEDLLSGVDTEDKGIWESITSFTGLRSDQTENKKDDVLNIFSVASGHLYERFLRIMMLSVLKHTKSTVKFWFLKNYLSPTFKEFIPEMANEYRFQYELVQYKWPRWLHQQTEKQRTIWGYKILFLDVLFPLAVNKIIFVDADQIVRTDLKELLELDLEGAPYGYTPFCDSRKEMDGYRFWNSGYWASHLGGRKYHISALYVVDLKRFRKIAAGDRLRGQYQALSQDPNSLSNLDQDLPNNMIHQVAIKSLPQEWLWCETWCSEESKKMAKTIDLCNNPRTKEPKLKAAVRIVPEWNDYDNEIKVLLKRLEGHGNNRYTKSKCQSPASGRDEL

SEQ ID NO: 4183 - protein, 356 aa, Piromyces sp.
PQAWLVTPVVSVYDLDNICLKSVEDSGVNAIFELKNILIEGHARDMRLNTPPRGVQLILGTKSYPSMVDTIVMANLGYFQLKANPGVWELQLRSGRSAELYQIINVGNNIHSWLDDRNDELVKLYEEYGITTALTSFEGSTVFLRVDKKKGMEKEDVLAEEGSSNNNDSDDKIWGKLKKKLGMNNGGSDTKKPAEKINIFSVASGHLYERLLSVMTLGVMKHTKTPVKFWLIENFLSPSFKNFIPHLAKEYGFEYELVTYKWPHWLRAQSEKQRTIWGYKILFLDVLFPLNLDKVIFVDADQIVRADLKELVEMDLHGAPYGYTPFCDSRKETEGYRFWKTGYWEKHLRGKPYHIR

SEQ ID NO: 4184 - protein, 462 aa, Rattus norvegicus
MITPEGWLVEPVHSNCDLDNINLKDIERSVTAEYELEHLLLEGHCFDMTTEQPPQGLQFTLGTRSNPDVVDTIVMANLGYFQLKANPGAWILKLREGKSEDIYEIIGHEGADSETDVGNVIVVLNTFKSKILKVQVKKKSGKIKEDVLADKHEDRGMWDSIKSFTESLQKDGRKDNNILNIFSVASGHLYERFLRIMMLSVLRNTKTPVKFWFLKNYLSPTFKEVIPHMAKEYGFQYELVQYKWPRWLHQQSEKQRIIWGYKILFLDVLFPLAVDKVIFVDADQIVRHDLTELRDFDLDGAPYGYTPFCDSRTEMDGYRFWKTGYWASHLVKRKYHISALYVVDLKKFRRISAGDRLRGQYQALSQDPNSLSNLDQDLPNNMIYQVAIKSLPQDWLWCETWCDDESKQRAKTIDLCNNPKTKEPKLEAAARIVPEWVEYDTEIRKLLDHLENKKKSTIHDEL

SEQ ID NO: 4185 - protein, 1516 aa, Strongyloides ratti
MKWQYTLLLLFFILKSTYSSNNDGKLVITSLVAQWNHTSFIAEIAEFIGKEDPTLFFKYIDLLTEKNDINIDNLEKEYEVGIKLAGEILSESRLDLLKLSLSLRVASPAIELFQKLGKEKIDGKNCIAFVEIGDKFICSANELEEIFTNGNNLNAETYSIDHIFYSKKIRNNEIIGTIILYGNYASKEFGQLYNICKKASKNGKINFAVRFYDSQEKPDAMPVSLSGYGVELSIKNTEYKAIDDSNEKKDNFEDDLPELNDVQGFNFNILKKKHVDLVEQLKQLKVFLAESDELTPLKQWEVQDISFQAAQKVFNEPNAEAAIETLVDISQNFPIRARSISQVAVDPKLRKEVQENQERLNDEFEISPGENSIFINGINIDADSLDIYSLLDTLKQEETLANSFYEMGFRREYLSLLFSLDFSESKESFAVDFREAFPEYINNLDKDPEYKRMGNSVKLMLQPYFPGMIRPIARNFFNLIFVVDPGKVDQIVLLKIAHSFYSHQIPLRIGIIFDVSNEDDVNGMNDIGVAVVNFYNYAKSEKNAAKALNLCMKMFDSLMDDLTIENIHKFFKKNFKDVEIDEVFGKDSDYNQGRATGRSWIIRSGLGKSPKVLLNGVVFDQSSLSADKIEEAVMNEVSKQTPYIQKAVMNGKLTDKDNVMNWIMSRPTVLSRLNNRILNNGGEYLKMTNVMPCKVKNVNEFNKLSDVEKTQCIITKMKYFTRSDVESTKPLTIWLVGDMEQFESREMLRNALKFLKKSKFSRIGLINNPKDGMKNFGKVTKIINSIIRLLPQNIIKQILPKILAESVIKKIENDQFSIDEFAVNGMSTDNFNKEAKLLSNEQLKFEVSYAKSVLNLNHGDRKYIVNGKSYGTLEEKEIVEVDDFDLLEKMAISKGANKVASQIDRWGVEKDNGKSSDVVMRSISVIGNSNTKKTRHWVVLANDQKSVVHSISQDDKKAVLDIIVVTDPLTKGAQKLSAILKLILRSCNADLKIVLNPQDKLSELPLKRFYRFVADQEISFTTDGKVISPVAVFENLPKKQLLTLNVISPDSWMIQPIFAEYDLDNIKMESVEKNIVAKFELRNILLEGHCFDDITGSPPRGLQFELSNYNRKIKYDTIVMANLGYFQLKANPGIWNLELRQGRSEEVYNIVEHKNTESQNGSIVKVMVDSLPGRVIKIKVSKKADKLEENLLSDDKDSYEDDDDEENSIWSSVTKYVSGEKYDEINIFSLASGHMYERLMRIMMVSVMKHTKHPVKFWLLNNYVSPQFRNSLEPMAKKYGFSYELVEYKWPRWLHKQTEKQRIMWGYKILFLDVLFPLHVKKIIFVDADQIVRTDLMELMNFDLNGAPYGYTPFCDNKKEMDGFRFWKTGYWANHLAGRRYHISALYVVDLVKFRKIAAGDRLRGQYQGLSADPNSLANLDQDLPNNMIHQVKIKSLPQEWLWCETWCDEKSKKNAKTIDLCNNPLTKEPKLDAARRIVPEWIEYDEEIRELLEKNKISNLVKENEDKNKNTHSEL

SEQ ID NO: 4186 - protein, 407 aa, Nestor notabilis
MANLGYFQLKANPGAWTLRLRKGRSEDIYRIYSHDGTDSPPEASDVSVVLNNFKSKIIKVKVQKKLDMMNEDLLSDGTSENESGFWESLKWGFTGGQKNEDVKQDKDDVLNIFSVASGHLYERFLRIMMLSVLKHTKTPLKFWFLKNYLSPTFKEFIPYMAKKYNFQYELVQYKWPRWLHQQTEKQRIIWGYKILFLDVLFPLAVDKILFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAMRIVPEWQDYDQEIKQLQSLFQKEKETGIPAEMPGHHTHDPAAHVEL

SEQ ID NO: 4187 - protein, 1774 aa, Gregarina niphandrodes
MKIIIPWLAVVGGLKVRVQAPWESPSLAGQIFQGIRFLEESANWGDSLVAKWIGGVTAPSSDGRSRAQREEDLVCGTFNIPDPDGGLPLESGCPLGTGSFVLHSKLMGTVLDGLVANGMFVPPLQQQQAISKEEFQLLFQLNNIHASKEDHNIREHHGSEPLVYSSKILNHSSKNVEREDMPRHGWYSVYRITDGRVIAGGWTEDPQQFASSLVHVEHEPTSSRLLQFLEPASLWTQRRNKGVTELPDGEYHIFHSDLMLADELVSLAQFVNNDRHNAYRYYHYPTLENFAVRNWAASLVLKNPEYKTSNEAETSDKIHLKNVDDEELNDHHAHKDMLSGKTISNLHDLISDKANLSSLGVATMTFMRTEVEKYLRHEKSVCDDYVVDAETVKMSCIKGISSNLLSHAPDVFGKFNSTVAKLIMKGSHSLDRVVQTRLNGVFVDGKRAHIIPSTHQSLRSMTTGFISDFLLKWLWPMALHDEIIRSTFVKHIKDCDIIARKIGSPERWKGSEKNEKVTSSLIGLVRQASRILGDFNLDESRARWNPTLFLERMGIGETQWLHTQNDEVRQLGVVEYAKALQYGLMSDITIIDWGSVEPNFHFADIIIYVDRKRLELIPRLIGELQANGLRWLVVLNDPDQPELTSRLLKSHDDYETIIQAIRELSSSKDEGDNSQGDDNSQKDPQDGDLTSRANSFTPPINTIWVNGRGIKIDDTVDNPFMDEMAIELVKAMLETDAVLLQNGLLGFSKPNGVLTHIRSLRDLAALLEGKWYRNELVDGDTSKLDTELNHESFNLGNFWMEASNMVMVDEKLVHLYSPSEINKVLKVEENGDSISPIRTLTKTMGTSFLTHSVNILVYEGSSLAKQSRIEAPFVVWIVLNADDESRPIPNVYKLRATDQLDDQLDDQLDDQEYIISPFPVNVRVSFVKDGRLCYPATSGSIDLEDLICLGSIIDGELDHKVGTIILGNMYMHLDEAAIVMNDRSKNVRQRSRTFLRHVKSRIQALVNAQIGIYRRSLTTNNISRLSETGRLPYLSPITFHTMVPDLQEKNIILEAVSHLYHSLLNKNTQDYNDWMEDQQLEKELFSKPSLRGLRMASIIDDNDDARIKLLIDPLSSMGQIYSNLAEYVNVYLGLNTQVILTSHWSYKDLPINKWFDFVQQPPLMFQLQKSRKISGPDSKSTGSKSTGILRSSFIGAKFLNNLTDEIVTFKIDIAPQLHIRSDESEVDMDNIKLDILKDDVIVNYRLDGFRIEGSIHEVGGSVTGGVPIRLVDIETNHTFDETISLSQPNYFQLVAPDIGQYKIMIDNTTITHANYTEGRGARKYNFDVNQIMGNHNMSDHNMITINSWNYDLWPRADSIIKIMSTFTGSEVLFDNIPIRYQLPIIGTLLQRVEGVFAGSLFGRCTQLIYAIGEHILEPYEPYVARVYSSIWRWYYGPDDDVQKGDDRVHIFSLASGHMYERLLRIMMLSVSHNTDRKLTFWILEDFLSSKFKEYANKLQYSLNTEKDLIEIRYVSFGWPQWLRSQVDKQRQIWANKILFLDLLFPRNLNSIIYIDADQVVRGDIGDLWDLDMKGHVYGFTPFCNDRDETSQFRFWEHGFWYDYLKGRPYHISALFKVDLKLFRERRVGDVLRTMYNKLSADPNSLANLDQDLPNAIQDFVPIFPLPKEWLWCETWCSDKTKSKAKTIDLCNNPKTHEHKLKQATRIIPEWTDYDNRLKILIGDEGIPNTHPQQNLNTIAHTINTIAHTTNNKHVPNNHVPNNHATIKDDAPDEL

SEQ ID NO: 4188 - protein, 749 aa, Equus przewalskii
ETSVHSRLGVIYNPTSKINEENTAISRGILAAFLTQKNSFLRNFLRKLAKEETAAAIYSGDKIKTFLTEGMEKNAFEKKYNTVGVNIFRTHQLFCQDVLKLRPGELGVVSNGKFLGPIDENFHAEDFYLLEKITFTNLVEKIKGIVENMEIKSKNMNDLIMKVDALVSSLPTHASRYDVTFLKESHSIIKINPQENDMFFDVIAIVDPLTREAQKMSQLLIVLGKIINMKVKLFMNCRGKLSEAPLKSFYRFVLEPELMLMANDNIGPVAKFLDIPESPLLTLNMITPEGWLVETVHSNCDLDNIHLKDIERTVTAEYELEYLLLEGHCFDVITDQPPRGLQFTLGTKNKPVVVDTIVMANLGYFQLKANPGAWILKLREGKSGDIYQIVGHEGTDSQPDLGDVIVVLNSFKSKILEVQVQKKPDKIKENVLTDKDEKKGMWDSIKSFTRSLHKEKDKKETDVLNIFSVASGHLYERFLRIMMLSVLRNTKTPVKFWFLKNYLSPTFKEVIPHMAEKYGFQYELVQYKWPRWLHQQTEKQRIIWGYKILFLDVLFPLAVDKIIFVDADQIVRHDLKELRDFNLDGAPYGYTPFCDSRTEMDGYRFWKTGYWASHLLRRKYHISALYVVDLKKFRRIAAGDRLRGQYQALSQDPNSLSNLDQDLPNNMIYQVAIKSLPQDWLWCETWCDDDSKQRAKTIDLCNNPKTKEPKLKAAARIVPEWVEYDAEIRQLLEHLENKKKNAILTHDEL

SEQ ID NO: 4189 - protein, 1512 aa, Corynespora cassiicola
MRVLASLLSVKALFILSAFKHIGAHAGPSINVALRASFASAPYLVELLETAAEENADAYFPLLDRIADGYFDGAKTDQELFVAFVELLEQDGHITEPETLASFQFALSVRSAAPRIEAQYQFYNTSVEPSLEAEQGEGCDTWVAFGGKQFCSPQLEESHGAVKSERMYALPFDRVLGNASSPLSSILYADITAPSFSKFHKTLSKTAKEGKTSYRVRHKPSANAPKTPLIVNGYGVELQLKRTDYIVIDDRSAEQGENAAQKPLETELNDDEEVSDLKPLSKDEVSDLGLKAASFVMKSDQPMDTLLKLVQDFPKYSSAIVGHEASEEFVAEHSQNREQLLPSGYNVLWINGVQIPAREVNPFTLLEHLRKERRLVNGIRSQGLSGSDAIALLSHSAITETQAEDEPQRYDFRDEIEGGKVIIRMNTIEKDSRYESWPSALTSLLQRTFPGQLPAVRRDIHNVILPVDLTSEDEVFVIAETLLGLVKRGVPIQWGLVPQTRTEGQMAQAKVVYHLLDTYGLSALIKYLNAAKEAKKLASPDKSIFDATVKDAKLRKEREPLELANVLKSEDLEERVAAASKYLARLAADGPKAPLFVNGVPVPNDESWLQLASQRISMDLRQVQKAVFENVIKEDNWVPQQFLASAAPKRNPLVIPENEKDITIINMAEFEDKHSEVFEKMPRVDVATKSSEGTWAHLTLVGDFDSESGLALLRSVAQYRQDNPNVEVVLIHNPQAGAEQSNASADIFEAWVKSSKKLTSQKLLDTVTEEPSFSPTSANSTAFWKVAEPIYEALGLKQGENAILVNGRKVGPISANYAFSKDDVETLISYETTKRIEPISKALQALEIQTGNPLELAKIQSLVALSGISDVPEGIYESTSTQRIDIFNKWSDEHTAIVKGDNNTAVIQIVASIDPATELAQRWIPILKTLSEMDGVYLKLFLNPKQMLSELPVKRFYRYLLDSKPTFNEDGSVDNLEAHFSGIPKEALLNLGMDVPPSWLVAPEESIHDLDNIKLSSLSSGTNIDAIYGLESILIEGHSRDVTNGQPPRGAEVVLATEKDPHFADTIIMANLGYLQFKANPGFYNIQLKAGRSQEIFNLDSAGTKGYAPQAGDETSEIVLMSFQGTTLFPRLSRKPGQENADVLGADEPESFASEIVEKGTQKVNQFLSKVGLGFNTEKVLAKGAELLSGGKSASKGVQADINIFSVASGHLYERMLNIMMLSVMKNTEHTVKFWFIEQFLSPSFKSFLPHMAAEYGFSYEMVTYKWPHWLRGQTEKQREIWGYKILFLDVLFPLDLDKVIFVDADQVVRTDMYELVSLDLEGAPYAFTPMCDSRTEMEGFRFWKTGYWANFLRGRPYHISALYVVDLQRFRKLAAGDRLRQQYHSLSADPNSLSNLDQDLPNNMQFNLPIKSLPQEWLWCETWCSDESQKEAKTIDLCNNPQTKEPKLERARRQVPEWSVYDEEVARLARRVRGEGAVVEGGSVQERLQEEERERKEREEEERVKGFKQEL

SEQ ID NO: 4190 - protein, 1731 aa, Raphidocelis subcapitata
MIARAAILLLALGALFAAPLGVRAAQKGASITVRARWQGTPYLLEAAEFLADESPQTYWRFVEGLGELKREPSSPAECWRATLSQAGPLVLPPVAKLLPVALGLRQYSAKLELFRQLAAQLHPNATASSCCFADVEERLIPGDDLAALEAALKAAASAKPAAGAPSAVELHAFDHVYNPQQQGAPGAAHAVVYGPPGTRCFAHMHRIARDAATASAAAGARPIVYAHRPLLGEACRSGEAPDCLFVGAEEQLVLPGYGVEAVLKNMEYSAMDDKKQKEKAAAGQQPPGAASDAAAADGDGAGDGAPLGEVKGFRLDALAARRPELRQELLTFRDALMAGEDDEAIKVWDLADAGLQATSRISQSSDPLALLQEISQGFPSIVSSLTRQQVPPSLRTAVAANQRLVSPGANILMLNGMLVEVNNFELYAFLDRLRIELRMVGQLQQAGLKPQHALQVLEERSEDVSAAAASDLRLDLAPYSKLPWLNNPEKDKRGGGQVRGGIMALMQMYPGRLRPLAANAFSLLYAGDAVSPQGLAVGRILAGMHERRLPVRIAMLPLAPDAIHRAAAARAGVGAFADPPPWKEMSPQERFARALLTLRDTFGGPAALQFWEGLAKGAEQREPASSLKSLKAAFVAAWEGAAKGPLTKKGQVAAKKAAAVAWSDLESGSGYSSEAGMALADLSAFALRKGLAQADKSVLWVNGGLHVLPEGVSDWLELEREVTYIVAGEHQFLQEQIYFGRIGEGEPLLPSIMELSTTVRRWNPAVLGGGDDDGAEEGAKKIVVAEALASPDAAALTYLHPAVEEGQVVGKGTAWGESQVYPVTHWVVADLSSQRGRALAAAALDRLLSIDDDDEVADARAALLMAPAADAATPSLLDALVARGLRAYRAAGASAADGALLRLLRALLRSPDAAALAAEPLGGAAAGKRDLPALLLPLARAAGAVPDGAAAAAAASALGGVDAAALAEAAADVDALSRLARGPLGLEPGAAAVITNGRVILDWSPRGAAGGGEAGAGGAEGLTAEDFGLMQMYAQEMQPGAAIAAAVRAAAKPYLPPRNMSDAALLAASAIGAQIYPDSRFGSLQAKQISGILGSLKGKAVRAGAPQGPDTLLQLVAITNPLTREAQRMSQVLRFVSEVLGPAASIQLHLNPKLDLSDMPLKSFYRYALPEFPRDEDGSLGLPGAPSAYLPRLPPKRVLTLNLEVPEAWMVEATKSVYDLDNLRLADVPEAVAYAEYELEALMLTGSCTEALPGGRRGAPPRGLELRLGTKAEPRRVDTLVMSNMGYFQLKASPGLWQLSVAPGRSSDIFGIVPPASGGSAAAAALASSTATYIDSFSGHHISLRVRKRPGMEEEQLLPAADGADADADAAAGGGAKGKGKAGKKGKGKASPAAVPSNDVINVITVASGHMYERLQKIMFLSVIKNTKSRVKFWIIKNYMSPHHRRVVPEMAKAYGFDYEFITYKWPHWLHKQTDKQRIIWAYKILFLDVLFPLDTGRVIFVDSDQVVRTDLAQLMTMDMKGAALAYTPFCDNNKEMDEFRFWKGGFWANHLQGKPYHISALYVIDLPRFRQAAAGDNYRIIYENLSKDPNSLANLDQDLPNYAQHKIPIHSLPQEWLWCESWCGEATKAKAKTIDLCNNPRTKEPKLQAARRIIAEWPALDEEQANFTAAVDARYAQEQAAATGEDAAVAGAGAGEQGQAAAAAAGEQGGGGGGGGGDGDDDGGSDKTEL

SEQ ID NO: 4191 - protein, 1454 aa, Aspergillus tanneri
MATLCTTCCRTIFFKLLESAAEENSTSYFPLLDRIADGAFDDAVTDKEIYDRFLHVVEEDGHLKTPESLSSFKLSLAIRSASPRITAHYQYYNASVQHSLMAAQDAACPVWVHSDGKQYCSSTMERAQQEVSGGMDARELPFDRVLGDTSLPPAILYADVASPMFKDFHQTLSALAKEGQVSYRVRYRPPQRWSPRPLFVSGYGVELALKRTDYIVIDDRAAEQRESDNAGPSTYSDAPDDLRPLSSSEVARLGVNAVSYVLDRDDPLDALVKLSQDFPKYSSRVAAHNVTMELLHDIRSSRLQMLPSGMNVMWINGVQIDSRQMDAFSLLDLLRRERKLIEKFRDIGVSAQEAVNLLSHQFIGEALAQDAPQRYNYLDDIEGGRVLIWINDLEKDARYASWPSDLEAFIHRTFPGQLPPVRRNANNIVVPVDLARSEDVGFVVRNIQGFVIKGIPARFAIVPVASTPGSSAQLKIAHYLQETFGLASLMHYLEESSSQQKVASPDKGCFEAATKERKIRPEKQILSFEEVLKSEDLEDLVSKTLSYQNRLGITGDASQSFVNGAQVIRKDSWMQEVSVRVSKDLQVIQQGIVGGEIEDGTSLSGLFLSQAFDRRSLWAIPEDPKDIRVVDLVKVSDSQKETLGETPSIVSMKDDALDSAYLIVVGDFDSEQGHQLLTATLEHREKHEEVEVLFIHNPGEHTSKMDASIKLYRSLKGGKQVDAAQVLADIKSSDYSAPSAGDAEEISKFWADKRPLIQEFGLPHGANGLVINGRTVGPIDADVTSGDLDQLLAYEQTKRIGPVTRACKDLGFGSNLSGALAFAKLTSLTTLSTISDVPEDIFESTSDIRVNIFDKWNDSRSVITVSNSEDPAITIVASIDPSSETAQKWLPILKVLSRLASVRLRLFLNPREEIKELPTKRFYRYVLDSEPSFNDDGSISRHTASFSGVPVEALLTLGMDVPSSWLVAPKDSVHDLDNIMLSSLNSGSDVEAVYALEHIMIEGHSRDLTTKSPPRGVQLDLGTDNNPSFADTIIMANLGYFQFKTQPGLWKINLKPGRSERIFNLESVGGLGYSPQPGDENNEVALLSFQGKTLFPRLSRKKGYEMEDVLETSSKSGTAMDYVSKGLNFASGVLSSVGVGSKGMSEKQADINIFSVASGHLYERMLNIMMVSVMKNTKHSVKFWFIEQFLSPSFKSFLPHLADEYGFSYEMVTYKWPHWLRTQREKQREIWGYKILFLDVLFPLSLEKVIFVDADQIVRTDMYDLVTLDLEDAPYGFTPMCDSREEIEGFRFWKQGYWKKFLRGKPYHISALYVVDLSRFRALAAGDRLRGQYQMLSADPGSLSNLDQDLPNHMQHHIPIKSLPQEWLWCETWCSDESLTQARTIDLCNNPQTKEPKLDRARRQVPEWTEYDDEIAALSKRVALGHQQKEEEMQPNLVDEEDDEGSPEWDKDEL

SEQ ID NO: 4192 - protein, 1534 aa, Orussus abietinus
MLFINNRTQSNIKMWIFIFLYSLLITSSHTLADKKINKYVTTLINAKWNDTPLVLEVAEYLNDENSNYFWSFIDKVSNRTDDLANSATERERYNILMEIVSDFLSPAELAVLKLGLSLRIYSARIEMFSQMAQNRNASGLGCNNVFDVGGKFTCSLDELEKLIEEDEWPQAVTYSVDHYYLGKQNSNRLVVLYGELGTPEFVEYHERLKTLVKTKNIGYILRHYVKDRLDRKLRLSGYGVELQMKSTEYKATDDTDIKDNSGKDAESVNDGVDELDGINFAILKNLYPDKRTELDQLQTHLLETSHEIGALKVWQFQELSHQAAERIMNSPVDEAIKALIDISQNFPMQAKSLIKTKVSGDMKKEMKLNQELFSASLSIQPTDTALFINGLFFDLDAIDILTLLEALRSELRIMEALHKIGFNSKKMGKLLALDLSSGADGQDFAIDIRDSAIIWINDIENDARYSRWSPYLNELLRPTFPGTLRNIRRNMYNLVLIIDPLSETSTALVSLMESLYLHTTPLRLGFMFITNYDPSVTGLSDPSVAVNNAFHYFLETRGPKDALNFLIDVGGFIGKDGLGVSDVKKAIKTRDPSANVNYILGEESEYDVGRHLASDFVKRTGFKTFPQALLNGMPLPPDQLNAESFEEAVLSTIMSQIPMMHKAVIRGEITEGDDIIDFIMNQPNVMPRLNERVLRVEKSTWLNLIGKAPKDEDFTKWGAQDAFTWLMDKMHYLYVPRRSSLHHLYSFWIAVDLNKPSGRELLLEALEFLKSNTDVRVTILVNNEPHQDFGQDINKIAIAALSALPVEKSVDYVNQLIIEDNVKLIQQGSFVIQDEAVQNQMKEQDLVLAVHRHYARNVLNLESGARAIVCNGRVIGPLDEDEIFTTEDFSLLERFSQSTYGDKLFKNLIKSRLFNDIEDDDDDEYEKSDVTDDMIMKISSLLVPRPQTRRRFDVPFHGDEHSAIKIPASDSDGVAFNLVAIVDPVSRGAQKLGPILNTLQQSLNCEIKVFLNCLEKNSDMPLKSFYRFVIEPELQFSPEGDLAEAIVRFTKLPTSSLLTQYIHAPENWLVEVVKSVYDLDNIKLDNVAMGVHSEFELEYLLLEGHCFEAVMGNPPRGLQITLGTEIQPVMVDTIVMVNLGYFQLKANPGEWILRLRQGRSAEIYDISSVDGQDVIQQENEVKVLISSLRSHVLKLKVSKKPDKIGMDLLSDDDQNSGIWNSISRTFTATDEPKDQDDKLNIFSLASGHLYERFLKIMMLSVIKHTKTPVKFWFLKNYLSPTLKGFLPHMAKEYGFEYELVQYKWPRWLHQQSEKQRTIWGYKILFLDVLFPLDVKKIIFVDADQVVRADLKELATLDLEGAPYAYTPFCDSRKEMDGFRFWKQGYWRNHLQGRSYHISALYVVDLKRFRRIAAGDRLRGQYQALSQDPNSLSNLDQDLPNNMIHQVAIKTLPQEWLWCETWCNDESKEYAKTIDLCNNPMTKEAKLQAAMRILPEWVGYDEEIKALQQKIENDNRQAEKEVEELVNDSAKHEEL

SEQ ID NO: 4193 - protein, 1637 aa, Eucalyptus grandis
MKACCRSGFWIVVVLAVCLGVASVHGENRRPKNVQVALRAKWSGTPLLLEAGELLSKEWKDLFWEFIEVWLHSEGNDAKPSTARDCLKIILGHGNSLIGHSLAPLFEFSLLLRSASPRLVLYRQLAEESLSSFPLADDFSSSNVNPGFPSETEELKRKLDSLPVGGNPDSPNGRCCWVDTGGELFFDIAELNLWLQNPERSGDVFHQPELFDFDHVYLDSSIESPIAILYGALGSNCFKEFHGTLVEAAKKGKVIYVVRPVLPSGCESKVGVCGALGTEDYVNLGGYGVELALKNMEYKAMDDSAVKKGVTLEDPRTEDLTQDVRGFIFSKILERKPELTSEIMAFRDYLLSATVSDSLDVWELKDLGHQTAQRIVHASDPLQSMLEINQNFPSVVSSLSRMKLNDSVKEEILANQRMIPPGKSLVALNGALINIEDVDLFLLMDLVHQEMSLADQFAKMKIPQSAIVKLLRTLPPPESSMFRIDFRSSHVHYLNNLEEDPMYRRWRSNLNEILMPVFPGQLRYIRKNLYHAVYVIDPGSVCGLESIDMVISLYENNFPVRFGVILYSSNFIEKSEINGVSRHAEDNGGQTEDLSSLIIGLFFHVKENHGTHLAFQFLSSINRVRSESVDSEDDTLERHHVEAAFVDTLLPKAKSPPQDILLKLEKDHSVQLLSEESSLFVFKLGLHKRGCCLLMNGLVLDANEEALMNAMNDELPKIQEQVYFGHINSHTDVLDKFLSESGVSRYNPLIIADSKARPRFVSLSSLVLQGKSVLNEINYLHSPETMDDLKPVSHLLAIDVTSEKGMKLLREGIRYLMGGSKIARLGVLFNANQSADSSSLLFMRVFEFTLSSYSHKERVLYFLDQLSLFYENKYILVSSLATETTQEFKDKVYELADENGLSSDAFKSMLLEFSVNKMRGDLNKVAQCLYKLLGSGSNVNAVITNGRVLFPIEDTFLSDDLRLLESLEFKQRIKYIKEIIEEVEWQDIDPDLLTSKFFSDVIMFASSAMAVRERSSESARFEVLNAQNSAVLLGNANASVHVDAVVDPLSSSGQKLASLLRILSKYVQPSMRIVLNPLSSLVDLPLKNYYRYVVPTMEDYSTIDYSINGPRAFFANMPLSKTLTMNLDVPEPWLVEPVIAIHDLDNILLENLGETRTLQAVFELEALVLTGHCSEKDHEPPRGLQLILGTKSKPHLVDTLVMANLGYWQMKVSPGVWYLQLAPGRSSEIYILKEDGEGSQNEPSLKRIMINDLRGKVVHLEVVKKKGREGEKLLVSSDDEQQSQEKRGAQNWNSNILKWASSILGGSEESRSRSAAQEHGKGGRHGKPINIFSIASGHLYERFLKIMILSVLKNTQRPVKFWFIKNYLSPQFKDVIPHMAHQYGFDYELITYKWPTWLHKQKEKQRIIWAYKILFLDVIFPLSLEKVIFVDADQVVRADMGELYDMDLKGRPLAYTPFCDNNKEMDGYRFWRQGFWKEHLRGRPYHISALYVVDLVKFRETAAGDNLRVFYESLSKDPNSLSNLDQDLPNYAQHTVPIFSLPQEWLWCESWCGTATKSKAKTIDLCNNPMTKEPKLQGAKRIVSEWPDLDLEARTFTAKILRDEFELQEAVASDKSQGSQSDESSVEELDLESKSEL

SEQ ID NO: 4194 - protein, 1523 aa, Callorhinchus milii
MWVLVAVTLGSICLSTVTADSKAVTTSLTTKWPSTPLLLEASEFLAEQSKAKFWEFVDSSQEFYEENHAGTDLLHYQFIQRQAATFLSHVQVNLMKFALSLRAYSATVQMFQQIAAEEPPPKNCVAFVNVHGEKTCSPDNLEMLLKGSLERSKPYIFKGDHIEFPLKPELPVVILYGEIGTKEFSKFHGLLRSKSMMGTINYVLRHYVATPSQERVFLSGYAVELVMKSTEYKAKDDTQVTGSEMNATAINENDPVDEVQGFLFGKLKTLYPKLQEELKELRKHLIESTNEMSPLKVWQLQDLSFQTAARILAAPSADALMVMRDLSQNFPTKARSITRTVVNSDMRNEVEENQRYFKETLGLHPGDSALFINGLNIDMEVQDLFSVLDLLRNEAHIMEGLHDLGIQGEDLHELLKLNVHPGDNDYGVDIRNPAVYWINNLEIDSKYNSWPSNVKELLRPTFPGVIRQIRKNFHNFVLIVDPTDDSTPELFKVAEMFYSNNIPLRIGLVFVVDDSEEANGLKDAGVALLRTFNFISDEVDNTKAFQTIISIYNKVKQGERLKIEHVIGTLEKAYPYIEVTSVLGADSVYDTNRKEGKAYYKQTGLGPLPVALYNGMPYQKEQLDPDELETVTMHKILDNTGYFQKVVYMGELNNDQDVIDFIMSQPTIVPRINSRILNSERQFLDLSSKVVYGVDDYSQFAFLKSDEKAAAVANSISYLTKRDNNYIRPVTFWIVGDFDEPSGRQLLYESLKHLKSSNNLRVGLINNPSKEPTEENSVNARAIWATLKTQNINNAKNFITKMAKEETAKALSEGADIMEFAVGGMDNEAFKAMFNSPDLSVILSHGSFCTDVLKLKKGQRAVISNGRVVGPLEESEIFNQNDFHLLESIATETAEKIKSKIQMLVIEEDHASDLVMKVDALLSAQSRGEPRIDLQFFAERLSVVKLRPKEEQVYFEVVAIADPVTRDTQQLAPLLLVLNQLVNMNLRVFMNCQPKLSEMPLKSFYRYVLEPEIAFMADGSFAPGPVAKFLDMPQSPLFTLILNTPESWMVESVRTSYDLDNIYLEEIDGGVAAEYELEYLLLEGHCYDVTTGQPPRGLQFVLGTSANPAVVDTIVMANLGYFQLKANPGAWALRLRKGRSEDIYKIYSHEGADSPPGTEEVIVVLNSFKSKIIKMKVQKKPDHVQEELLSDGNAENEGFWESIKRGFTGGPKPEEIKPDKEDVINIFSVASGHLYERFLRIMMLSVLKQTKTPVKFWFLKNYLSPTFKEFIPYMAKQYGFQYELVQYKWPRWLHQQTDKQRIIWGYKILFLDVLFPLAIDKILFVDADQIVRTDLKELRDLDLDGAPYGYTPFCESRREMDGYRFWKSGYWANHLQGRKYHISALYVVDLKKFRKIAAGDRLRGQYQGLSQDPNSLSNLDQDLPNNMIHQVPIKSLPQEWLWCETWCDESSKKKAKTIDLCNNPMTKEPKLEAAVRIVPEWQDYDQEIKQFQKQFQEGKLNAFAHVGTENVTSIEDHVPHSEL

SEQ ID NO: 4195 - protein, 1510 aa, Hydra vulgaris
MTKFLIILQLLVLCSCSEKFVRIELDAKWRQTPLPIEASEFIARQSNIKFWKYIESFQSAFNASAKELYNEALAKAGLMLSSTELDALKFSLSIRVQSPKVQFYQQMADSFQQKCNIFFQTSDRNIACNLDDALRVKKNIPDNSLVHEFDHIYPGSEHNSHLLIVYANFYIPEFKEAHQKIVSMLSSSNIKYILRHFYQIHQKELKVALSGYGVELAVKSTEYKAIDDQKVEDLKMKESVVDGAEDDEVEGFLFKKLREIHPDLQEQLLKFKQHLKDKNKELTPLHQWELQDLSFQAAQRVMSASSQDQLKLLKDISQNVPMIARSLVKTAVNENLRNEIKENQQEFESSQILPGDAALYINGIKQSVDDLDIFNVNELLESEAIGLSVLNQLSLDLSKTSQLLALNLVPEHESLILDTRSDAVQWMNDLEKDSQYHYWPSHLQEMLRPTFPGMLRYVAKNIFHVVAFVDPLTHEGIKLLEEFNKLISQSMPARFGVVFVTKAGLSDKAEDDASAGLLRAFSFIKSDKNVKDAFKWLSTLYRNSGNEPPKPSGVISLLQSWYGKSEASDALDPKSDYDDLRKISNKFFKKIGLKTLPSILVNGETLSKEEMQDLESSVTEKILSQTADVQQAIYNGNHHNYPTIYDYLMSQPNVVVRLNSLIQNTKGSYLEMLSTRKEFTTDISLLSKEDASSFFAESAQYFIQDSGATTIWVIADATTSHGKSLVINALKYVQKQKNARLALFLNGKESDEITLNDALLIIFRLRKTLISGIAKFAVKFLEENDFKKIIENEDELEKIATGITGINKKRLFELFSSKDDLEKVKQDIKRNTVVINNVFGGYESLVIANGRIIGPLSQEDGFVVDDFQLLQNFENNRGGYKILEIIESMNLPSLPSEGHARYKSDLVMKISAALSKRKDQKRSTFTFKKDQHSVIKLKPRRNDVSFDIDVILDPLSKSAQKLVPIVMTLYDAFNVNLKIFLNCKGQHSELPVNRFYQYVLQPELLFNKDGEIINDQAATFLSLPHSALLTLIMDTPQSWLIEAVGSNQDLDNINLGEASTYVYGDFELENIIVEGHCSDSNTHQPPRGLQFILGTEKEPDQFDTIVMANFGYFQLKAFPGSFVLQLREGRSSQVYEMDSLTGGEELSPGQNYTVFIDSFSGKFLKVKVKRREGQAKTDLLSDDSGDSSSENDFGIWHSFTSYVKSEAKSSKNTDGKIHIFSVATGLLYERFLRIMMLSVLKHTKTPVKFWFLKNYLSSSFTTFLPHYAEKYGFEYELVQYQWPRWLNAQTEKQRIIWGYKILFLDVLFPLNLERIIFVDADQIVRADLKELMDMDLEGAPYAYTPFCNDRPEVEGFRFWNHGYWRNHLGGRPYHISALYVVDLKRFRKVAAGDRLRGQYQGLSQDPNSLANLDQDLPNNMIHQVEIKSLPQEWLWCETWCSDESKKYAKTIDMCNNPQTKEPKLQRAIRIAPEWTEYDDIIRMLQEQVFKNSSNLEKTSSNPTQDSKEEL

SEQ ID NO: 4196 - protein, 1363 aa, Saccharomyces eubayanus
MRLLALACIFFYAPFCALAHSLRYGIPESAQVWSILVHLLGDLDEQLLAELYPLVTGLDDETDTQGCLIASTSDALRKQHGKEDVADLLELYGSLYPMGLLQEDVSSITDQDEINGNYFIMNGKRYDKPDDVFYLKSKDLTSQQKIPDINVIQPYDVVIGANPNAPVLVFYGCPTVDNLDFEEFNRNLYMEAMNEEAKIRFIWRSTCSLDGESVEYPLNFPLGITLQNGSNLNSIPQLKKILSTIPNDVSVETNHELYDLDPEELHELDLKVTSLISKFYQEKNDTLATLHFTKNIINNFPLVSKQLTEIVLDNEDIKASNEKLNSKGFDYNMLGLYVNGQNWKITSLDPYNLLNALKIEYQNLLKITNLLQTHEASKGMLDSKFLLNRFSQFSLGKLQNLQPIKMDLHTIPGFSDSVIYFNDIEADPQYNELIDSVQAFFEKSKFGELPEIRQNWSEIIFVIDFAHLEDNDVKEALSGLVRAINVIFQGYPQRVGLLPYNSGSDDSVVNKIYELKNSTNGLAELKTFLETMLLADGLTANTDASKYSPVPDVHGLLDELQIGETSIIINGEAYPFKKNTWNYLIAKVIKKDTEFIRKELSVSSPKNKQVKVRDLLHYKSANLRHNKYTPNYFADSLYSTVNNTALENIGKDRVTTYTKDKRYNILHTITLVDDFNSIHALERLQNLLGSSFVGVRVRVIHLGDLSNAWTQLQHSFSDSDSKSSINKLINNLKVKNGKSKTSRKNALNQLGLHKWLPDIPLFELEKGTFIVLNGRFIHLDPKEVPETKHFEAIIKREAVRTIDSVFSLDLLFPGFSQERMDPDFIEMTSSILTKLFYQSTNIYGNGIDYTTESSLPRMDLNQFFEPNNLTIFDDGKSSPIDLLLILDPLEERSQLILSLVDQVKHLKFINVQVILMPTVDLNIVPIRRLYVDDREVIKLVTSETSLVDSEVDMEMDAPKSFVIDSEFQLKELLIELHAFSNKTALSAGNIDGIGGVCLELVDHLGNIIDKTITMDTFGYGQFRTDRFLKGCSIRSCDPRYTVHSFSTDGHPGFIPSNSLDILSYNPHRIAVKITEEPSYGEEHKEGGSDDATINIFSVLEPGLDEEEKYKQMVLSILSKCSKLQQVNFFILEQQSISDSLKKFCEYVNASGEMRGTITFLKYEWPQWLRPQRFSSRRRDVSKFLFLDVIFPQNISQVLYMTPNETPFDPFDLFQFQGLKRAPLGLFRMSGNGYWKEGYWEKMLRENNLEFYSTEPGFLVNLERFRQLDVGNKYRIHYQRVSSDARSLVNIGQDLVNNLQLEVPIRFLKASYKSKLITDDEHVSEWKERIDAFVSSSSDGKASEEGKSRNNQGYEDSIPLHDEL

SEQ ID NO: 4197 - protein, 1398 aa, Phaeoacremonium minimum
MDQESLSTFKLALATRSAAPRIEAHYQYYRTAVEPILRKTEDDCLDWVLIEGQQYCSASLDQPQGSVDGRQDRQLPFDIILGSGSGSVLYTDITSSQFGQFHKILSEKARKGEGSYRIRHRVTSSAGLEALPVSGYGVELALKRTDYIVIDDREAGDDATQKPTSEVNLDGEEEVADLKPLSTSELSELGLKAASFVMHSESPFDTLLKLTQDFPKYSTSIAAHNVSADFVKEHQANRQALVPSGMNVLWMNGVQLIERQIDAFTLVDMLRRERKLIHGAMDLGLTGKEAVSLLGHSSVASSKADNEPQRFDWRDEIEEGQVIIWLNDLEKDKRYAEYPKTLMALLQPAMPGQLPPIQRDIFNLIFPVDLTKAEDILLVVDQLQGFVKRKLPVRFGLVPLVSTPESLDQAKVVYHLLENYGLAAMVTYLQSIGDGKKTPAADKTVFDKVIKDRKPRAEATPLPFNDVLRSEHHERQTELALHWAERLKANGPVTTLFANGIAIPRDDNWLQPMSQRLGLDLRAVQEGVYYGMIGEDTWLPGYFIEKAASRRNVILFPEDDKSLTILDVNKLYTEHKDLFHQLPVIEANPDSTKENWAALSLVADLSSEEGRKLAVSALQFRANNPGVRFDIIHNPADAAGAHVINNVLKSKVDDLVSIETVESFATVLNAAKKSSDDGFGVALARFLKTAAILPATNVLILNGRVVGPIPTAADFTTEDFQTLLEFEQANRILPVYEAIEELGLTEKMSGPLAAAKVTSITALSTMSDVPEGIFESAPTLRISAFNTWNSSYTAFEVGDASTATIHFVATLNPASEQGQRWVPILKVLSELDGVHLKVFLNPRDRLDELPIKRFYRYVLESAPSFDDSGKVKSLSATFKGLPSEALLTAGMDVPPAWLVSSKDSVQDLDNIKMSSVKGDVNAIYELKHILIEGHSREPGGGPPRGVQLVLATETDPHFADTIIMANLGFFQFKANPGFYNIQLKEGRSSDIFSIESVGALGYSPAPGDEGTEVALMDFMGTTLYPRLVRKPGMENEDVLEDIKPAEPAGGAMDFVSKGLKLAEGILGGSKDKPKTKSVSDQEHAEINIFSVASGHLYERMLNIMMVSVMQHTNHTVKFWFIEQFLSPSFKDFIPHMAAEYGFKYEMVTYKWPHWLRQQKEKQREIWGYKILFLDVLFPLSLDKVIFVDADQIVRTDMYDLVQHDLDGAPYGFAPMCDSRTEMEGFRFWKQGYWANYLRGLPYHISALYVVDLRRFRELAAGDRLRQQYHTLSADPASLSNLDQDLPNHMQFQIPIHSLPQEWLWCETWCSDESLTKARTIDLCNNPQTKEPKLDRARRQVPEWTVYDDEIAALDRRRKGLAADGNLLPEDEAQKVVAGEPNTKSRRLDEPETRKRDEL

SEQ ID NO: 4198 - protein, 1528 aa, Culex quinquefasciatus
MEKYHYLLLAVACWFTTGAYGESKSHPITTQLSAKWGRTPVQLEIAEFIEEENAHLFWDYIDLLNKIPGGLYSIDTEEGRYRKAVELAETLLGVGQTNLLKLALSLHSFSPKVQAHLQIGQEVLKQGDCDTSAFVNVGGKVACDQTELRSILKSSNKDQANVETYSLDHIYSGSENNSLTAILYAQIGTTQFKDFHDVLKAEADTGKVKYVFRHFVKKMSSKKMRLSGYGVELHLKSQEYKSQDDSPRQQEQEAIVNDDSLESEVEGFDFIKLKGRFPHLSHSLDRFRNALLEKHEEIAPLKAWEFQELGLQAAQRIAQIQGEEALQILQFTAQNFPTQAKSLLGQTVSEDFKKEMKHNIEILGRNLNLQPPDSALFLNGLFFDADTIDTITLLDTLRTEMRVLEGLNKINIRGKTATPLLGLDLASTAKEFAIDIRDSAITWINDLENDAQYKRWPGSVMDLLRPTFPGMLRNIRKNLFNLVLVIDPTADESTGRDIVKLAESFVVHSAPVRVGLVFDTRGSAEEKDYRAITCAFNYAHQKKGSTDALGFLTDLFSTTQKRQIKHEDVRKQLKKSFSKLKMEEIDEIIGEDSDFDYGRQLSQEFVGRLGLKATPQALLNGVLLPQNTLNSDDFEETILTEIMQQTPTIQKAVYKGDLNDGEPVIDFLMKQPHVMPRLNQRILSTDEPTFLDVSGNPHPDLEDVSALAQLSNSDLTATLMKNLKYMGGKSTYEKFLGHRLHFHTVWVVADLKQPSGRKLLKNAVRFMKSTSGTRVAFIPNSDGADASRSEAKKHLNALAWAAINTLQPDEATELILNLLKLADEEKRYDVPESVSGFLPATQVHLKMLRVYCQRVLKMKASKNGLVANGRVLGPFDEDEYFDSEDFGLLEKFINLQYTDKIRRALKEASSDEDNVEVTSDTIFKLVSILVPRQQSKSRFAIPSDIQDNHTVVKLPPKSNDLPFFEIVAVLDPASRGAQKLSSMLVLLRNVINCHVTLILCAVDRHSDMPVKTFYRFVVEPELQFTADGKLSPGPYAKFVGVPANPLLTQSLNVPENWLVEAVRSVYDLDNIKLSEINGPVHSEYELEYLLLEGHCFDTTTGSPPRGLQITLGTEEQPIVVDTIVMANLGYFQLKANPGAWILKLRHGKSADIYDITSADGPNTIHSAEDGTRVVISSLRSHVLKLRVTKKPGKANADLLSDDKDSHGGIWDSISSIVGTGESQDQEVLNIFSVASGHLYERLLRIMMLSLLKHTKTPVKFWFLKNYLSPQFIDFLPHMSEEYGFQYELVQYKWPRWLHQQTEKQRIIWGYKILFLDVLFPLDVKKIIFVDADQIVRADMKELNDFDLGGAPYGYTPFCDSRQEMEGFRFWKQGYWKNHLQGRRYHISALYVVDLKRFRRIAAGDRIRGQYQALSQDPNSLSNLDQDLPNNMIHQVAIKSLPQEWLWCETWCSSETLQHAKTIDLCNNPLTKEAKLTAAQRIVPEWKLYDQEIKRLQAKVDELEHEEGQNLHSEENSTKNDEAGQHTEL

SEQ ID NO: 4199 - protein, 1510 aa, Polistes canadensis
MWILVFFYSLLLCSKGLKADKKVNKYVTTLIDAKWMETPLFLEAAEYLNDENPNYFWKFIEAYSENVASIQNGTEKDNYELILKLAGKHLSPAEIAVLKLGLSLRIYSTRVEMFFQMAENKNVSTLDCYNVIDIGGKFTCSIFEVNELIAKDKWTKRDTYSIDHYYLGSQKTDKVIIMYGQIDSPMFMNYHTKLKSIADTHGINYILRYYVKDRLDRKLRLSGYGVELQMKSTEYKATDDSDIKDNTGKGSETNNDGIEEIDGINFVTLKTLYPDKKAELEELQTHLLETSHEIGALKVWQFQELSHQAAERIMNSPTDEALNVLTDIAQNFPMQAKSLIRTKVNNEMKKEMKLNQEIFSGSLSIQPTDTALFINGLFFDLEAIDVLTLLEALRGELRVMEALHKIGFNSKKMGKLLALDLSSNVDNQEFAMDIRDSAIIWINDIETDVRYSRWSPALTELLRPTFPGMLRNIRRNLYNLVLIIDPLNEDSMALISLASSLYTYVAPLRIGFVFITNYDTSVTGLLDASVAVNNAFHYFIESKSAKEALEFLLGLYIGSYPITVDIVKQAIRKIDSSANINYILSEESEYDVGRHLASDFVKRSGFKKFPQALLNGVPLPATRLNADLFEEAVLSTIVAQTPALQKAVYRGEVTQGDDVIDFIMNQPNVMPRLNERILKIDKNSWLNLIGTVPKDNDYTKWTPQDASSWLMEKMQYLFVSRRSSLHHLYSFWIVVDLKLKSSRKLLQEAVIYIESNPDARISLIINNNDVDFEYDLNRIALAALNSLPTDKVLQVMHKIVKEDFESLAEYESVNEHLKDQDKLLEFHTYYAKQVLGLEKGAATVVCNGRMIGPLDTNEEFTNEDFSLLERFSQSTYGDKLFKNLIKSPSEDDDDYERTDITDDMIMKITSLLVPRPQTRSRFEVRFHGDEHSVIKLPPVNPDEVTFDLIAIVDPVSRGAQKLGPILKTLQQTLNCQIKVFLNCLDKNSDMPLKSFYRFVLDPEPQFTADGHLNGAIAKFTKLPTSSLLTQYIHAPENWLVEVVRSVYDLDNIKLDNVAIGVHSEFELEHLLLEGHCFEAVMGNPPRGLQITLGTEKQPVMVDTIVMANLGYFQLKANPGEWHLRLRHGRSAEIYDITTVDGQDVIQDGNNVKVLISSLKSHVLKVKVSKKPDKANMDLLSDDDKNSGIWNSISSFSKFWTFTTGDESEDQDDKLNIFSLASGHLYERFLKIMMLSVIKHTKTPVKFWFLKNYLSPTVKDFLPHMAKEYGFEYELVQYKWPRWLHQQTEKQRTIWGYKILFLDVLFPLNVKKIIFVDADQVVRADLKELATLDLGGAPYAYTPFCDSRKEMDGFRFWKQGYWRNHLQGRSYHISALYVVDLKRFRRIAAGDRLRGQYQALSQDPNSLSNLDQDLPNNMIHQVAIKTLPQDWLWCETWCDDSSKKYAKTIDLCNNPMTKEAKLQAAMRILPEWVGYDEEIKTLQQKIENETRQMEKEDNESTTEDHTKHEEL

SEQ ID NO: 4200 - protein, 1690 aa, Moesziomyces aphidis
MRAISLLSTSYAWLALLFALSVTLPAQRVVAQAPSVKVQLRASWSRFSLPSRGSPFLLELLEAARSQRPSSFFPLIDALTSRHSPAELRAASDEFLANAVEDAIRSLALFGAIDSLANQELDAWRMALALQNSAPRVEAFAQLYKTMQLNEIWQTRTSDSPCDSWVHHQGQALCSAQELCEAFGVDASQAELRQSHGAAFGHHRATSKPNKGDRPSVILYADPYSNNFRELFSTLEEYASQSAAPFTYTLRWRPALDVAGTRSQDEAAPMLAGYGAILDLKKVDYLVIDDRKLKDDSEVGDVGSSTDSHGEEQVAARKASDNLRWLQEQIGTDTETEQNLGLSSLSEDQIADLGIKAARLIMSSADPLRAMKELSQNFPTHAAALASSTKWDDDDASASLVEAVLGLSSMRIQPGSSELWLNGQNTNARDFMPLALLDTLRSERRWSRALQHSLAGGGLNVTEAADLISSSLVGRAFLAQSEGSSAAATFDASDRIELKTAPEGTSMGAITWLNDLEKDEATSDWSDDLMDLLRPMWPGKFPRLSRNLFNVVLVLDLSQKESCRFLVETAIQSLGRVGLHWGLVPGGLEHDANTDSIRMARLFWFVLQEAGPQLLSDVLRKASASKSGSADKINVSVAVKEAKFALKNLDADGSLAARFDAVLSGDDSNYTQREALTKAYIKRLRATRAESSTGHVFVNGQHHPFHPQIVHILHQAIQEQIQVLAPQIYYGQISSSTPGLDTLFYDAVGALSYRSALVPGSSSASRAEKGSAADAKHESVDLFSALLDDTIPSAAATQVFQFFYPQAVAADSRTGGATGALLNSTVWVLADLDSHQGSTLLLQAFEALGRDNAPFRLGVLHTPTESSEKASNEHLLSTLLYRLIGEKRLDQLQAATMVEAIKHLQQLLEQKIPIRGMGELLDIVGLPTSDTQRHEERYDLAANQRAARQFWDSTGSIIASKYGLSSAAILVDGHLASNFDVESIEARDVTALVDYEAGQKLPYIEQALKLLRENIDEMSPRERQDLMFAALSVMNGVYEESRAGQGIFSAKGHSRSGLPDQLGTKDHIFEIGERATSDIRITLLVNPLSESAQRWSSILEMLSKLHGVYVRVILNPDIKLRELPLKRFYRFSAPHRPQFGPDARATAAELRFFDMPEEAVLTLGLDAPAPWLTMPVEAVYDLDNIRLADVPSTSRAKGVKAVYELKHILIEGHAREESAGTAVSVPRGLQLLLETPDASTSLDTIVMANLAYFQFKAQPGLWKLRIRPGRSDELYQMQSVGGNGWNSASVDVTGEDVTLDTLSGLTIYPRVVKRAGKQHEELLEELDAQGRPMKKARSDGAGAEEGIAASASALLSSAKHKVASWASKVSSTDNKVVAARKHADINIFTVASGHLYERMTYIMILSVLKHTSSSVKFWFIENFLSPSFKEFIPHLAREYGFEYELVTYAWPHWLRAQREKQRTIWGYKILFLDTLFPLDLSKVIFVDADQVVRTDMKELVDLDLQGHVYGYPPMGDDSEDMDGFRFWKQGYWKDYLRGRPYHISALYVVDLNRFRLFAAGDRLRGQYQALSADPNSLSNLDQDLPNNMQASLPIFTLDKEWLWCETWCSNDWLHRAKTIDLCSNPKTKEPKLERAKRQIPEWNVYDQEVAALAQRLVDQRIVGASVVAPDSQVAANEPVSQDSHHPHDEL

SEQ ID NO: 4201 - protein, 806 aa, Larimichthys crocea
MNQPNVVPRINPRVLSTSRTYLDLSDTNNHFIDDYARFSTLDTKEKSTAVANSMNYMTKKDDGYIRPVTFWVVGDFDKPSGRQLLYDAIRHMKTSNNVRLGMINNPSTAPSAETSRVARAIWAAMQTQSANNAKNFITKMAKEETAAALEKGIDIGEYAVGGMDVSLFKDSYEGPKYDFLLSHAAYCRDVLKLKKGQKAVISNGRIIGPLEEEEVFNQDDFLLLESIILKTSGERIKSKVQHFGTEEDRASDLVMKVDALLSSQPKGEARVEYDFADDRYSAVKIRPKEGDVYFDVVAVVDPVTRDAQKLAPLLLVLKQLVNVNLRVFMNCQSKLSEMPLKSFYRHVLEPEVVFQADGSFSPGPMAKFLDMPQSPLFTLNLNTPESWMVESVHTRYDLDNIYLEEVDNIVAAEYELEHLLLEGHCFDVSSGQPPRGLQFTLGTASDPVIVDTIVMANLGYFQLKANPGAWILKMRKGRSDEIYKIYSHDGTDSPADSDDIIVVLNNFKSRIIKVKVQKKPDKFNEELLSDVTEENDTGFWKSLTRGFTGGGKPEELKQEKDDVINIFSVASGHLYERFLRIMMLSVLKNTKTPVKFWFLKNYLSPTFKEFIPDMAKQYGFQYELVQYKWPRWLHQQTEKQRIIWGYKILFLDVLFPLAVDKILFVDADQIVRTDLKELRDFDLEGAPYGYTPFCESRREMDGYRFWNALYVVDLKKFRKIAAGDRLRGQYQGLSQDPNSLSNLDQDLPNNMIHQVPIKSLPQEWLWCETWCDDSSKRNAKTIDLCNNPMTKEPKLQAAVRIVAEWT

SEQ ID NO: 4202 - protein, 1493 aa, Aspergillus saccharolyticus
MVSGSAIVASWRLTSVVVASALSCLAHATPSVNVALQASFDSAPYLIELLETAAEENSTSYFPLLDRVAEGAFDDAVTDKELYDRFLEVVNTDGHLRTPEALSSFKLSLAVRSASPRIAAHYQYYNASVQHSLAAAQDAVCPVWVHAEGKQYCSSTLERAQQGVMGTSDPSELPFDRVFGDPSLPPAILYADLASPMFKDFHQSLTALAREGQFSYRVRYRPPQHWSSRPLFVSGYGVELALKRTDYIVIDDRAAEERGSDTSGSQIPMNTEEDDLDDLRPLSSSEVSRLGPGTVGYVLDSQSPLDTLVKLSQDFPKYSPRIAAYNVTRDLLQEIQSSRLRMLPPGLNALWINGVQIDARQVDAFTLLDHLRRERKLIEKFRNLGLTASESVDLLSHKFLAAAMVQDGPQRYNYRDEIEGGSVIMWLNDLEKDARYESWPSDLGGYMQRVFPGQLPSVRREANNVVIPVNLANADDVNLIVKSIQVFVKNKIPVRFGLVPIPSSTKSIAQLKVAHYLQETFGLGSLMSYLETSASKSKLSTPDKAAFQAATANRNVRPDKQPLSLDEVLENDALNTIVSKTSGYLKRLGVTDDASHSFVNGVPIPRKENWAQELSARVSRDIQAIQQSIADGELAEDTWLPGLFLSDAFDRRNPVIVPEDPKDVRIIDMAHVGETHGELLDSVPRIPSTQDDVLASNHVIVVGDFSDEPGFELLTAALGSLKDHAEAEVLLLHNSGPNATIWTGSYTIHRYLKKEDSVDAAQLLEKITGTDAWLREDRKEVDDFWAAHEPLVKGLGLAPGANAIIVNGRVIALPVDIKLTSEDLDQLLAYEKQKRVAPVAKAAKALGFDAKLRDPLALAKLTSLAALSTVSDVPEGIYESTPDVRVNLFERWDESRSVVTVSNSDDPAITIVASIDPTSDVAQKWLPILKVLSELANVRMRLVLNPRDELQELPTKRFYRYVLDSEPSFNQDGSVARPTASFSGVPVEALLTLGMDVPSSWLVAPKDSVYDLDNIKLSSVKEGTDVDAIYALEHILIEGHSRDLTTKTPPRGVQLILGTEENPQISDTIIMANLGYFQFKAQPGLWEINLKPGRSEQIFRLDSLGNEGYSLHSNDDTSNEVALLSFQGKILYPRLSRKKGQEMEDVLETGVKSGSARDYVSKGLNFASDILSSVGINGSPKDAASGKQADINIFSVASGHLYERMLNIMMVSVMRNTEHSVKFWFIEQFLSPSFKSFLPHLAAEYGFSYEMVTYKWPHWLRAQTEKQREIWGYKILFLDVLFPLSLDKVIFVDADQIVRTDMYDLVSLDLEGAPYGFTPMCDSRHEMEGFRFWKQGYWKNFLRGQPYHISALYVVDLSRFRALAAGDRLRGQYQMLSADPGSLSNLDQDLPNHMQHYIPIKSLPQEWLWCETWCSDESLAQARTIDLCNNPLTKEPKLERARRQVPEWTAYDEEIAALGRRLKLQQEAEGVKEEPAAAAAAADDDEGWNKDEL

SEQ ID NO: 4203 - protein, 1543 aa, Rhizopus microsporus
MLRISTAILGLVTLSGLLSKAYASSPTVDLTLVAPWSAPDFLLEVAETIAVHNEESYYRFIDIIRTQQESYNWTPRKVYEEAVKAAASLKEIDVDLLKLSLSLHEAAPRIEAYFQYYNQLVTANLTEYDHQCDVWVHIGDKQICDLELLTDTIKDLKDTAYVNLLPFDHITDDTLQKPTVVLYTDSFSAKFNMFYTWLKDAADQHKIAYIIRYRPPVSDSMKKSLYLSGYGVEMALKKTDYLVIDDRKTQDGKSQHVLKEKLLNFGKKLNHALFDTTEEANIQPLTPSEISQLGLKAAQYIAKSNNTLETMSLLAQDFPKYAKSISMIELDKEFENEVLENQYSSVQGGLNAVWINGKALELRQVDPFYLVRLLRDEKKLIQSIQAIGFSPKEAIEILSNPALSEGESMGNDIISGVYDVRDTPENPFVIWWNDIEKDTRYEDWPSNIMEILKPTYPGQLHPIRKNIYNLLLVEDLASTASLSRIVNEIQTMIKRTIPIRFGLIAFVEDDNSASTLMARALYYFIKNNGKADAIQFLETILELTSSNGLDRATTEMIERAFNGHMSISHENLNSEQVIDQSQAFITATRQFMKRMGISQLKPNEGIMFMNGKLLEFDEERPWIHSLMPHLTEQTRFIQTMAYNQEFDPDLDYYEYTLSQPNVVQKRNPYILVSHTNPLRMHTFDAITASKGLKYFQNDNESLVKTNLWVVSDFDTANGLKLLLEAILFAEANPKVRVAFIHKSIHKVSTKDTNDTKFSDLLCKLIYEQDTNLTTLKEILQNTNLFAGIDGYSSQNPGEVTIQINGDGLEPVPIIPGTPITEMVAKAQREKWSNLNTALVKDGLEPDFTGIIMNGRVIGPLSLSENIQFTNQDFEILYQYENTKRIMHVEKAIVESGKDLQNNTSDAVMKLTAIIENDKAQATQDAIESREPVHRIRQYQKIPRTQYTQFIAGGYSDDTFLEIGLIIDPLSEAAQKIAPIVHTLSEIEGVSVVTYLNPVSTLQELPLKRFYRYVFDKEPHFDTITGEKQVPTAYFANLPVKPLYTLGVETTNAWHVTVKEANMDLDNILLTSIPDNQHGVSAVYELQSILVEGHCLDSINKSPPRGLEFELISPSGLDKKDTLVMANLGYFQLKASPGIWKLALREGRSSSVYSIQDVGANGKWNWNTEFNGSKGIDDTLALISFEGLTITPLVHKNPGMEDEDVLEPAQPKSKKNAGGLWSSINQKIFGTKETENASSLANKATNAEINIFSVASGKLYERFLSIMMASVMKHTKSTVKFWFIENFLSPEFKDFVPHMAKEYGFDYEMVTYKWPAWLRAQHEKQRTIWGYKILFLDVLFPLSLDKVIFVDADQIVRTDLKELIDMDLHGAPYGYTPFCSDRTEMDGFRFWKEGYWKNHLRGKPYHISALYVVDLVRFRQLAAGDRLRAQYQQLSADPNSLANLDQDLPNNMQHIVPIYSLPQEWLWCETWCSDESLKKAKTIDLCNNPLTKEPKLDRARRQVPEWETYDKEIDELRKRITAGGSSSLPKQDEPSIKKHLKDEL

SEQ ID NO: 4204 - protein, 1520 aa, Thraustotheca clavata
MSLRCMPHMVLWLLMAIAAVCTGRHVEVNLTTTYLSSPVAPVLETSAFLAEINANWYFEYIDAVEIRMNAIQIKDNINYTAVALDAALDVLPVNATIAKLLPFVLATRAQSPKIEMFHQLAIESAYKGCGLEYVNATAWAVVYHESGCAAHVVCSIDDFNPTMLTPASDTKSCASSGEHDFELPVDNVYNKELGAPTVTVYGIIGDAKFQPFHKKFIALAKDKKIRYIVRHAPQDNTLPVNLHGYGVSLNIKNMEYKSFDDSRSPHSKLTPTDVDQDEFIVSVMMKKGGETISALKEYQLEFEDFSHINATDDEAPWQLTQLGYLAAQDILTAVEPLQRLQLLSQNFPKYASSLTLTTEPVPFDVMQAMNHARGLVATNQLLNKIVINGMDFDINDFTFNPFDFLKMLTDEVQQGDSLRALNLDDASLSSLHSAMTTLSTRSTDVRIRVRGPIDGTAPIYLNSIESDAITAEWPTDISILSEPAWSLIFLRKVMYEVIVILDPTTTEGAAAMNEINFLLMRGAPIQVGVLWTSNDVLSVSEDERASYLPSTQDKDQATAYHITKLYLSARDHGADTAKQFISGILELNGGVSVKEALMIYTQAVTHQFDDSDAIEEARQLLLKTKPGDPVWDMTDLVLQKQLPLNSHIFNGVVRQDLSIQDSLMSHFGRDQPLYQDMARNGKLAQDSDFVDELLSQESFYSVYTQWLDPSYKVPEVSLELSQEDVWNQVYYMHMAQTAHQPKKQNLLLVLFRCPLFVDLDTYFGAKSAYIALKTTLESPQARVSIIHTSSKPTLGNRVGYILQQLGHTDALPYYSVVLEILRLMSKSKPEVEVLLHVRVLLQVHIDNNPEDKILPQLIAWLESAPNFEHPLVALLNLQSQGLLVNGKLLELKQNQVMTPDLLAVVMQHEADNRSKAVAKALFLPYKHKTLDTNSAASVSHSLYKVLEIVDSYLKTPRVAPLFQTVDHATTYSTKSASLLDVVAYLDPLTEASQRASVFLRMLESVLDAKITLVLVPTPAYNDFPLKRFYRYRWGSSAIFKNLPLPPVLTMNIETPELFNVQMTESDCDVDNVQGDAKAVYAVKSLLVYGQCIDRTMPYHPTPPNGLQVVLERTAGTELWHRDTVVMKNLGYFQLQATPGVWQLELAKGRATELYHMIEADEPTQQTRIIVHDFLSAITQLKVKKRPGQEYSRLLDEPEGQKSNDKKEDEEDQSYWKSLLSWGSGTKQVKPVADTRQGETIHVFSVATGHLYERMLKLMMLSVMKRTQNPVTFWLLENFLSPDFKNSVPALQAKFGMDIRLVTYKWPNWLRRQTEKQRIIWGYKILFLDVLFPLGVQKIIYVDADQVVRADLNELWTMDLHGKPYAYTPFCDSRNVGFQFWRQGYWKDHLRGKPYHISALYVVDLIKFRRMAAGDTLRAIYDQLSADPNSLSNLDQDLPNYAQHQIPIHSLPQEWLWCESWCSDESKAQAKTIDLCNNPKHKEPKLDMAKRVISGEYFKESWLDLDEQVKAAEKAYAMEMN

SEQ ID NO: 4205 - protein, 1502 aa, Valsa mali
MIRLSQLPWGLVASLLAATVFQTQSVYAGPSVEISMKAAFPSPPYLIELLETAAQENASSYFPLLDHIADGYFAEVSTDKDLYESFLNLLQEDGHISSPESLATFNLALSTRSAAPRIEAHYQYYHTGVEPTLQGEQEGCDAWVVWQGQQHCLPSLDPGQARGQVSERQERDLPFDVSLGDGPSCILYADITSPRFGPFHMVLSEKARNRECTYKVRHRILSYESLEALPVSGYGVELQLKRTDYIVIDDRKAKEEKTQKSIESEVVLDGEEDVADLKPLSKSELTPLGLKAASFIMQNEKPFDTLLKLTQDFPKYSTSLTTQNVSEEFFLEHKANRVQLVPTGANVLWMNGVQIVERQMDAFTLVNLLRRERKLINGVTDLGLTGEEAIALLAHEAVAAAKTTDEIQRFIWHDEPEDGKVIIYLNNIEKDKRYEEFTKNLASLIQGGMPGALPQIRRDIFNLVIPVDLSKEEDISLVLQQLQEFIKRKLPVRFGIVPLAFTEASERQAKIVYHIVETYGLGTMMAYLQAAVDAKKHGDADKGLFDSTTVDRTLREDATALSFEDVLASDHHQEQTTLSNHWAERLKANGPIPVLFVNGLPMPRQGNWLPPMSQQIGADLQALRQAYFYGEIDESQWIPGFFLENAAKRRNTLIFPSDPKALTVLDVNKLHLEHPELFGMIPVIEASSDSTKENWAVLTLVVDLTDPEGFKLATSALQFRANNPGVRLDVIHNPADPAEAHQINTALKAGQSELATADPEELLQAIIDKAEGLPEDDLYDSALRQFLAAVGIRSGQNMLILNGRIIGPILSAAEIDTEDYQLFLDVEQRQRILPVYEAIEDLGLAEKVSGPLAAAKVTSITALSTMPDLPEGMFETASPLRISAFKVWNSSHTSFEIGDKSTATIQLAAVINPASEQGQRWVPILKVLSELNGVYLQVWLNPKDKLDELPVKRFYRYVLDSAPTFDESGKVKALGAEFKGVPSEALLNVGMDVPPAWLVASKQSIHDLDNLKLSSIKSNVEAVYELENILIEGHSREPTGALPRGAQLVLSTEKDPKVADTIVMFNLGYFQFKANPGFYNIQLKDGRSSDIYYIESVGAKGYKPVHGDEGTEVALMDFMGTTLYPRINRKPGMEKEDVLDMSAEGGALDFVKQGFKFGKDLLGLKTKSASDEEHAEINIFSVASGHLYERMLNIMMLSVMKNTNHSVKFWFIEQFLSPAFKDFLPSMAEEYGFKYEMVTYKWPHWLRQQKEKQRQIWGYKILFLDVLFPLSLDKVIFVDADQIVRTDMYDLVQHDLEGAPYGFTPMCDSRVEMEGFRFWKQGYWANYLRGLPYHISALYVVDLRRFREIAAGDRLRQTYHTLSADPNSLSNLDQDLPNHMQFHIPIHSLPQEWLWCETWCSDETFPVARTIDLCNNPQTKEPKLDRARRQVPEWTKYDDEIAALDQKRKGESSAALEDGEQKVIRGDGQELKEAEEGLERNTKSRAFEGEDPSATGHVKDEL

SEQ ID NO: 4206 - protein, 1302 aa, Valsa sordida
MVLSEKARNRECTYKLRHRRLSYESLEALPVSGYGVELQLKRTDYIVIDDRKAEAKSQENTASEVVLDGEEDVADLKPLSTSELTPLGLKAATFIMQNEKPFDTLLKLTQDFPKYSTSLATYNVSEDLYLEHRTNRAQLVPTGANVLWMNGVQIVERQMDAFTLVDLLRRERKLINGVTALGLTGEEAIDLLTHQAVAAAKTTDETQRFIWHDEPEDGKVIIYLNNIEKDKRYEEFTTNLASLVQGGMPGSMPQIRRDIFNLVLPVDFSKEEDIALVVEQLQAFIKRKLPVRFSIVPLAFTEASERQSKIIYHLVETYGLGPMMAYLQAGLDAKKIGDANKELFDSAIVDRTLREDATALSFEEVLASEQYEEQIRLSKHWAERLKANGPTPVLFINGLPMPRVGNWLPLMSQQIGADLQGLRQAYFYGEVKESQWIPDFFLENAAKRRNTLIFPSDPKALTVLDVNKLHLEHPDLFGMIPVLEPYPDSTKENWAVLTLVVDLVDPDGLKLAASALQFRANNPGVRLDIIHNPTDSTEAHKVNSVLKASESDLVAADSEELLKVIVDTAEGLTDDDDLYDSALRQFLSAVGIRPGQNMLVLNGRIIGPIESAADIDVEDYQLFLDVEQRLRILPVYEAIEDLGLADKVSGPLSAAKVTSITALSTMPDLPEGMFETASPLRISAFNIWESNYTAFEVGDKATATIQLAAVINPASEQGQRWVPILKVLSELDGVYLKVWLNPKDKLDELPVKRFYRYVLDSAPTFDESGKVNALGAEFKGVPSEALLNVGMDVPPAWLVASKQSVHDLDNLKLSSIKSNVEAVYELENILIEGHSREPTGALPRGAQLVLSTEKDPKVADTIIMFNLGYFQFKANPGFYNIQLKEGRSSDIYYIESVGAKGYKAVHGDEGTEVALMDFMGKTLYPRINRKPGMENEDVLETSAEGGALDFVKQGFKFGKDLFGVKTKSASDEEHAEINIFSVASGHLYERMLNIMMLSVMKNTKHSVKFWFIEQFLSPAFKDFLPSMAEEYGFKYEMVTYKWPHWLRQQKEKQRQIWGYKILFLDVLFPLSLDKVIFVDADQIVRTDMYDLVQHDLEGAPYGFTPMCDSRVEMEGFRFWKQGYWANYLRGLPYHISALYVVDLRRFREIAAGDRLRQTYHTLSADPNSLSNLDQDLPNHMQFHIPIHSLPQEWLWCETWCSDETFPVARTIDLCNNPQTKEPKLDRARRQVPEWTKYDDEIAALDQRRKDKGSAALEGDEQKVIRGDGQELKEADEGFERNTKSRALEGEDPLATGHVKDEL

SEQ ID NO: 4207 - protein, 1447 aa, Colletotrichum fructicola
MVRPYQLPMGIALTLLAASNVAAVPSVTVDMKAAFPSGPYLLELLETAAGENATSYFPLLDRVASGHFADSKTDKDVYDKFLQVLRDDGHITTPDALSTFKLALSLRTAAPRVEAHYQYYRTAVEPKLESDTQDGCEVWAELGGKQYCTPALDAPKDTKLTEAKALPFDRTLGSGSEAVLYADPTSPGFGAFHSALAQKARNGEVEYRLRYTKPAGSYEEALPKKITSEEVLDAAEEVTDLKPLAKSELEQLGLKAASFVMQNQNPFEALLKLTQDFPKFSTSIAAHNVSEKFLAEHQLNRQQLVPSGMNVLWINGVQLIERQIEAFTLVDILRRERKLIDGVRDLGFSGGQAVALLGHPKVAESKADDEPPRFDWTDDIEEGKVIIFLNDLEKDEQYANYPTELMSLLQRVYPGQLPPIRRDIFNLIVPVDFSKIEDLSVVSQLNTFVKRKLPLRFGLVPLTPTEESVGVAKILYYLLDSYGMEAFVDYLDAALQDSKTDKADAACFEKAIKDRELLPEATAVAFEDVLQSEGAQQVIKLAQQWAKRLNANTPIPPVFIDGVPVPREGNWLQAMSVKAANDLQTIQRAVYMGMVDEEMWIPDFFIEKALKRRNTYIYPENDKSLKILDVNKIYTDHDDLFSKVPVIEAYADSTKENWAVLTVVADLTTDAGADLLLSALAFRRNNPGVRLDVVHNPKNPASASSVNKALKSSDKLAEAETIADIKTISEAADSDSDAIYAAALNDFHSFAAIKPGSNLLILNGRIVGPFAAEEPFEADDFQYLLEFEQKARILPVYSAVDELGLTDKIAGPLAAAKITSVTALSSMSDLPEDIFETAPSVRVSAYDTWNSTYTAIEIGNPETSSIHLVGLLNPASEQAQRWAPILKVLSELEGVYLKLFLNPKDKIDELPVKRFFRYVLDSEPTFDETGKVRALEASFKGLPSEALLNAGMDVPPSWLVAPKVSVHDPDNIKLSSIKANVHASYELESILIEGHSREGKATQPPRGAQLVLGTEKEPHFADTIAMANLGYFQFKANPGFYNIQLKQGRSSEIYTIDSIGAKGWNPVPGDEGTEVVLMDFQGTTLYPRLSRKPGQEESDVLFVEEDNSLVGRGLKFAGGILGKKTKSISDEEHAEINIFSVASGHLYERMLNIMMVSVMKNTKHTVKFWFIEQFLSPSFKDFIPHLAEEYGFKYEMVTFKWPHWLRQQKEKQREIWGYKILFLDVLFPLSLDKVIFVDADQIVRTDMINLVNHDLEGKPYGFTPMCDSRTEMEGFRFWKQGYWANYLRGQPYHISALYVVDLRRFRELAAGDRLRQTYHSLSADPNSLANLDQDLPNHMQFQIPIHSLPQEWLWSDESQREAKTIDLCNNPQTKEPKLDRARRQVPEWTVYDDEIAALDRKRKGLPAEAPKKEDTKIECDKTVEEKNTKSRNWEEPPSEKTHVIDEL

SEQ ID NO: 4208 - protein, 1440 aa, Phoenix dactylifera
MLRSASPRLVLYRQLAEDSLSSYPSDDETNSEHVMGDLSEPISRVKAEPFLINRNPRSPGGSCCWVDTGSALLFNVTELLSWLDTSAKLDVGSAEQPELFDFDHIYFGSSIASPVAILYGALGTECFKKFHVTLVEASKKGKIKYIVRPVLPSGCQAASSYCSAVGSSDVVNLGGYGVELALKNMEYKAMDDSTVKKGVTLEDPRTEDLSQEVRGFIFSKLLERKPELTTEVMAFRDYLLSSTISDTLEVWELKDLGHQTAQRIVHASDPLQSMQEINQNFPSIVSSLSRMKLNDSVKDEILANQRMVPPGKSLMALNGALINIEDIDLYLLMDLVSEELSLADQFSELKLPQNAIRKLLTAPPPLEINAFRVDFRSAHVHYLNDLEKDVMYRRWRSNINEILMPVFPGQLRYIRKNLFYAVYVLDPATACGAETIDMILSLYQNSVPMRFGVILYSSKLIKSLKEKDSSLPMSSVDNDTKNGEDISSLIIQLFLYIEENYSPQLAFQFLSNVRRSGADDLSEETLEAHHIEGAFVDSILSKSKSPPQEVLLKLEKESKFKEAAWESSIFVFKLGLSNLRCSLLMNGLVYESSEETTINAMNAELPRIQEQVYYGHIHSNTDVLDKFLSESGYHRYNPQIIGDGKGKNKFTSLFTSYLGMESILRDISYLHSRGSVDDLKPVTHLLAVNATSRIVIKLLREGIHYLMEGSKRARVGILFYASGGASSPALLLAKIFERTASSFSNKEKVLDFLDELCSLYESQYMTSSLLDSESLHTFTEQVCELAGANDLPSDDYRALLSSFSVDMIKKQMDKVANFLYRQLGHDFGSNAVITNGRVFILNDENSFLSDDFSLLESLEYEMRIKHILEIIEGVEWQDVDPDDRTSKFYNDVIMLVTSSLSTRERSSDQAHFEILNAKYSAVILNNQNSSIHIDAVVDPLSPSGQKLAPLLRILWKCIQPSMRIVLNPISSLVDLPLKNYYRFVVPTMDDFSAVDYSVNGPKAFFSNMPLSKTLTMNLDVPEPWLVEPVVAIHDLDNILLEHLGDVKTLQAVFELEALLLTGHCSEKNHDPPRGLQLILGSRHIPHLVDTLVMANLGYWQMKVSPGVWYLQLAPGRSADLYVLKESEDGRPFHPSSKLITINDLRGKLVRLEVAKKRGKEHEDLLNASDDIQLQEKKKGNQNIWNTNILKWASGLISGNELSRKGDESPLGHEKGGRHGETINIFSIASGHLYERFLKIMILSVLKNTQRPAKFWFIKNYLSPQFKDVIPYMAQEYGFEYELITYKWPTWLHKQKEKQRIIWAYKILFLDVIFPLSLKKVIFVDADQVVRADMGELYDMDLKGRPLAYTPFCDNNKEMDGYRFWRQGFWKDHLRGKPYHISALYVVDLVKFRQTASGDTLRVFYETLSKDPNSLSNLDQVIFLRPHHYFCCCKRDLFNLF

SEQ ID NO: 4209 - protein, 1508 aa, Pyricularia pennisetigena
MIQLSRLPWGLRVSLLAALAQLQLFPLASGAPSVEVSMQASFQSPPYLLELLETAAQENGTAYFPLLDRIASGHFAKANTDRELYEKFLQVLQEDGHITSPDALSTFKLALSMRSAAPRIEAHYQHYRTAVEPKLQGKVDNCPEWILKSGEIFCSVDEAKGVANIVGDVLSRDILFDQQLGDSSEGVVLYADITSPSFGAFHDTLATAARNGGPSYRLRHRSIATASKQPLYLSGYGVELALKRTDYIVIDDRANEKTAQDDSAQKPLVGGSSEIVLNGDEEVADLKPLSASELEQLGLKAADFILRGEKPFETLLKLTQDFPKYSGSVSAHNVSAEFRTEHNANRMVLQIPSGSNILWMNGVQLIERQIQSFGLVDVLRRERQLINEVRDLGLSGREAVDLLSHSDVASSKANDEPPRFDWRDEKEDGKVIVWLNNLEKDKRYESYSPHIMTLLSGGMPGQLPPIRRNIFNIVLPVDFSKASDLALATSQLIGFVKQRIPIRFGLVPLAFTPEAEGQAKVVYHLLQTYGLSSLMAYLESCLDGSTAGANQEAFDAAIKDRAVRSDSTALSLKEVLESDAYTNQVTLAKQWSSRLGAHSAVPPLFVNGFALPRDLENRWMGMMSGRISSDLRSLQEGIYYGTINDETSVIDIFLEGASSRRNHYIFPENSNGLTILDINKVYTDHDDLFSKAVVIESSPDSTKEAWALLTVLVDLDSKNGREILLSALKFRRINPGVRLEIVHNAVQKTSHDINSNLKEQSDRLLAAESDEGLVAILDEIRHAPQTNIGLEYAQALERFQRAAHFEPGNSILMLNGRVVGPIESASEFGESDFQTFLEFEQNSRIIPVYKALEELGLGDRLSDPVAAAKLTSITALSTISDLPDGAFENPPTLRISSFKLWNSTHTGFEVGDPSKASIFFTAVIDPASELGQKWTPLLKVLSELEGVHLKVFMNPRDRLEELPVKRFYRFVMDSAPAFDEAGKLKVPSASFKGLPSEALLNLGMDVPPAWLVAPKVSVHDLDNIKLSSVTSDVTAIYELENILIEGHARSTDSGTPRGVQLVLGTDSNPRVADTIIMANLGYLQFKANPGIYDITLEKGRSSDIFYVESIGAHGFSPVPGDETTEVALLDFLGTTLYPRLRRNPGKEDMDVLEESGAAPSGTAGGAMDFVNKGLKFAESILGTARGKAKEKSPSELQHAEINIFSVASGHLYERMLDIMMVSVMRNTNHTVKFWFIEQFLSPSFKDFIPHMAAEYGFKYEMVTYKWPHWLRQQKEKQREIWGYKILFLDVLFPLTLDKVIFVDADQIVRTDMYELVQLDLQGAPYGFTPMCDSRTEMEGFRFWKHGYWERYLKGLPYHISALYVVDLRRFRELAAGDRLRQTYHSLSADPNSLSNLDQDLPNHMQFSIPIFSLPQEWLWCETWCSDETQPMAKTIDLCNNPMTKEPKLDRARRQVPEWNIYDAEIAALDRKRKGLPVSGDAVSEKAEKNPKSRTLAVEPENTHIVDEL

SEQ ID NO: 4210 - protein, 1266 aa, Friedmanniomyces simplex
LVRLGLKAASFVMASDAPFDMLLRLSQDFPKHSSAIAATNVSTDFVQEHRANRDLLLPPGFNVLWINGVQIMPRDLDAYSLLEYLRRERKMINSVRELGLSGPEAINLLSHEAITASAVDQEAQRYDWRDDNEGGNIIMWMNGIEKDKRYMEWPSSISALLQRTYPGQLPPVRRSIHNLVITVDFSNYADVLTVIESLQNFVKRKVPIQFGLVPRFASDAGRQQAKTVYYLLDRYGLGAALAYLTNSVAGAGRKFSAPQEKYFAQAIEGRKLRRDRTVVSFADVPSDATLDERLLSAQAYFRRLGAGQATPPILINGVAIPHTDDWLQTMSQRVSVDSRMVQEAVYTSTVSQDDYLPDLFLASASLRRNPLIVPEDDKDIRHINLGELPNLSAFPSLPANPDTIDRELVRLTVAADFDTREGFEQLMEALLFRQQHDNVELAVLYVPSGNATSGAFAGECVQRDPCVKHIQSALDKYETLRATRYTDEEASSSVELSSSQRFELYRTMWAERMVGGSANDQTLQNARAPATVTSAIGVQAGQMALVLNGRVVGPVSSSQIIEVEDLETLLTYERKKRLLPAALAIEGLGLQEKASTPLAFAFISNLIALSQVSDVPDGIFEAAPTVRTGVFKQWNSTHTAIKTGGMENANVQIFSALDPASELAQRWLPIIKALSELDGVATTLFLNPKERLEELPVKRFYRHVLESKPLFDADGSLKSLSAHFGGLPAEALLNIGMDLPPSWLVAPKDSVHDLDNIKLSAVKTGADVEAIYELEHILIEGHSRDVTLGPPPRGAQLVLGTEADPHAADTIIMANLGYFQFKANPGVYNLALQKGRSEEIFRIDSAGTKGYAPQPGDNVTETALMSFRGATLFPRLSRRVGMEEEDVLEAPQSALENVAEGAERLLSQVGLSGAKTRKYLSKAAKFGSALIQGKSKPTDIPTEAHAEINIFSVASGHLYERMLNIMMLSVMKHTKHTVKFWFIEQFLSPSFKTFLPLMAEEYGFKYEMVTYKWPHWLRGQKEKQREIWGYKILFLDVLFPLDLDKVIFVDADQIVRTDMYELVQHDLEGAPYGFTPMCDSRTEMEGFRFWKQGYWKNFLRGLPYHISALYVVDLKKFRQIAAGDRLRQQYHQLSADPASLSNLDQDLPNHMQMALPIHSLPQEWLWCETWCSDAALKDAKTIDLCNNPQTKEPKLDRARRQVPEWTLYDDEIAGVAKRHKAGEAEGRPVADDAADAGVQGEEESIQERLQREDAESERERKRHDEL

SEQ ID NO: 4211 - protein, 1510 aa, Helicocarpus griseus
MAFRFHFYPWRLGGLALLAASSLFTSTVSAGPSVNVALTASFNAAPYLVELLETAAEENSTSYYPLLDRIAEGAFAELTTEKELYEQFIQTLQDDGHLTSPESISSFNFALAIRSTAPRIEAHYQYYNTSVEPSLMVAQDAVCTVWAHYEGDQYCSPSLKYAQQSVSGDLDERVLPFDRVLGDPSLTPLVLYADIASPLFGGFHQELSQKSRDGQFSYRIRYRPSPAEPSRPLYVNGYGVELALKRTDYIVIDDRDAEQSILKDGGAAKPTLAPVEDLKDEPPADLKPLSASEVSTLGINAASFVMSSEDPFGTLLRLSQDFPRHSSAIASRNATPEFLQEFRENRAAMLPAGYNVMWINGVQMDPRNIDAFSLLDHLRHERKLISGLRGFGLSGQQAVDLLSDPVVAKIQVADDSQRYDYRDEIEGGGVIIWLNNLEKDHRYDGWPDDLHSLLKPTYPGQLPPVRRDIHNVVIPVDLASLADVEIIVGNLQMLVKRKIPVRFGLVPIIHKSHSLEQAKIAHYLLDTYGISTFVAYLRASLSANRIGSPDEASFTAALEDRKPREDRTPLAFKDVLNSEDYDSALANTSSYLKRLAIGGGPIPFFVNGVSFVRDEGYLQNTVATVGRDLEELQRAVIEGAIEEDTWVPSFFLSDAMQSRNPLLIPEDPSAIKTVDLNEKYEKHPILFNTLLRIAATSKSDHPLLEWTSIILATDLDSDTGAKQLHHILELHEKHPEIEILLLHNGKGTASSNSLSSRLYSFQTGRDLDPVAVAATLDAIAAGQDAPDLDSDHASAYWETVQVLSKELDMEAGETGMVVNSRMINVPSTTVFDTQDLERLLTYEQSKRIGVLAHTAFTLGLENKISGPLSLAKLLSLITLSAASDVPEGLYDSGPQLRTNLFERWNTTHSAISVSNSEDPSINIVAAVDPTTEPAQRWIPILKVLSELSGVSLKLFLSPREHIQELPIKRFYRHVLEAAPSFNDDGSIVKPQATFRGIPREALLNLGMDVPHSWLVAPKESIHDLDNLKLSLIKEGTDVDALYELEHILIEGHSRDITLSAPPRGVQLLLGTEKNPHFADTIIMANLGYFQFKAQPGYWKITLKPGQSERIFHLDSVGGQGYKPTPGDDNNDVALLSFQGKTLFPRLSRRPGHEEDDVLSPGPKPGTAKDYLTKGLNFASGILSSITTTNTHPQETHADINIFSVASGHLYERMLNIMMLSVMKHTTHTVKFWFIEQFLSPSFKSLLPHLAARYNFSYEMVTYKWPHWLRAQTEKQRIIWGYKILFLDVLFPLSLDKVIFVDADQIVRTDMYDLVTLDLEGAPYGFTPMCDSRTSMDGFRFWKQGYWHKFLRGLPYHISALYVVDLNRFRAIAAGDRLRGQYHQLSADPGSLANLDQDLPNNMQRVLPIKSLPQEWLWCETWCADEELGKARTIDLCNNPMTKEPKLERARRQVPEWTVYDEEVAKVQREVMEGKIGVEEGDGEVGDDVDVSADADADADEKRREHRKDEL

SEQ ID NO: 4212 - protein, 1453 aa, Candida parapsilosis
MACKWSVSFFKIMIPWQWTTKVLLIVSTFSIYSSANDTGLLTVDVKAPWKRIDFVSNFIESIAGFNASLYIPTLEAIFGLGDSDVSEGRTDKEIYDYTMKQLSLEPSAIDFVNFNLVYKKYSPRVASHYFHYETTLQQFGDRLKTECTKDSFGNQVETKNGLVPAWVLYNDKIYCSVNDLFALQTDKSNQETFLFDRVIGDSDDAPLLTFYGDPTVDQTREFLKVLYEEAQNGKLRFVWRYIPSVSKRVDSLPGFAVEVPTKNIEYYAHSKLDLNKDFDTIKSSRAISKIGNNVNELGIKLTSFILSNKIKLSKFELLQTILNNMPIFYSYLNKLPQSINYKKVQSKVVGNEQVGLSKESFGIYINGSPIHPLELDVYKLYDKISDELSTVKNLVELGFNSVQAKLLLAKFGLLSAVKQAQFRTGNTLMGNNENRFKVFQHAFNRNDATKGGVVFINDIESDRNYGEYSTDRQEAYLGVESRKLKPNQIPPLKENVHDLIFALNLASKKQLKAFFTFSKIILDSGIPQQVGVLPIIGEDPLDEQLAIRLYHITKLSDQKEALALLYKYMESTGPDEIQELLKKVDVPTNFRVDFDTVLNKFSIDQPSVVVNGVIHDLFSSNWQVAMSKQIEQDNSLIKTQLRQGDVNGNLKDIIYNNAKSERNLRIHPLDPSEIIYKKIDHDLMRSSIAFKKVDKELNNHATIWLVSDFRDSKMIDQLVTLLNLMKRKSIQVRVFNVGNTKLFSKLAGKMRLTVLTNADINAIISTLKEGGEVSTGLNEDLVHSLEQKHMPVRHSYLLVNSRYFRLDPVILNMEELSQLIEYELTQRLRLINEICVTYVDEFPQALYEYNSMGSGLDDMDWFDLVSSIVTKSFHVDDKTFVNDVNRYDFGSLDMSNSIDYKKHDESKQVDVLVIMDPLEDNSQKLINILDAVKDFSFVNVRALFQPKLEYAREELTERFYQGVFPPSIPYFEGSGKWDDTFLATFDALPVATCSINMDVPKRWVVVAKSAPSDIDLNSFKLDKNPISVSFEITNLLIEGNARDVNTGKAPNDLQLQISNGTHTDNTLVMTALNYFQLKALPGVHSLSVKSNHSLLSASDNKFDPNIVEIETAPMSLFSLNGLVLQIRVSSNRERIVEKSKHADINIFTIAGGHEYEKLVSIMIASVKSHNLKKSIKFWILSNFISPQFKVLIPHLIEKYSVEIELVTYKWPTFLRKQSNRQREIWAYKILFLDELFPQDLDRVIFVDADQVCRTDLTELVNMDLEGAPYAFTPMCESNKETEGFRFWKSGYWAEVLQDDLKYHISALYVVDLSKFKSVEAGNRLRAHYQKLSSDPNSLSNLDQDLPNNMQRQIKIKSLPQEWLWCETWCSSETFNEAKMIDLCNNPLTKENKIDTAKRLIPEWVNYEKEVLALIDQVTDTVEEEVEEDEENFTIDESHGEVDSDDDALYHDEL

SEQ ID NO: 4213 - protein, 1560 aa, Salvelinus alpinus
  MOD_RES (1314)..(1314): Any amino acid
  MOD_RES (1504)..(1504): Any amino acid
MADAGSYQAGFGPRMWQHCALLLSLTLLPVVSGGADSKGVTTSLTTKWASTPLLLEASEFLAEESQEMFWDFVEANQNIKGDHDDTDQAYYDLIMKRASALLSTVQLNMLKFALSLRAYSATVHSFQQIASKEPPPSGCSAFFNVHGEKSCDTEKLAALMETAAERPKPYLFKSDHRFPGSNPDIPVVILYAEIGSSEFTMFHQLMLSKANKGLATYVLRHYLASPSSRRVYLSGYGVELAIKNQEYKAKDDTQVQGAEVNATLMGENDPVDEVQGFLFGKLKTLYPELKEQLKELRKHLVESTNEMAPLKVWQMQDLSFQTAARILAAPSSDALNVMRDLSQNFPTKARSITKTVVSSEIRKEMEENQKFFKGTLGLQPGDSALFINGLHIDLDTQDIFSVFEVLRSEARVMEGLRSLLIETPFIHDILKLNVQPSDSDYAVDIRNPAINWINNLETDSRYGSWPYNVQELLRPTFPGVIRQIRKNFHNLVVILDPTHESSAELLNVAEMFYSNNIPLRIGLVFVVSDVDEVDGMEDAGVALLRAFNYITEELDAPAAFDTIISMFNRVPSGGKLSVGDVVKVLEKKFPYVEVGSILGPDSTYDDNRKEGRGYYLQTGVGPLPVVMYNGMPYQREQLDPEELETVTMHKILETTSFYQRAVYMGELATDQDVVDFIMTQPNVVPRINPRILSTARTYLDLSNTNNHFIDQYARFLFLDTREKSTAVANSMNYMTKKDSITIHSSVNPPYLTPHQHYHTILHLYDGYIRPVTFWVVGDFDQPSGRQLLYDAIRHMKTSNNVRLGLINNPSDSPSEENSRVARAIWAAIQTQTANNAKNYITKLAKEETAKALETGGDVTQFTVGGMDVALFKSAFEGPKFDFLLSHAVYCRDVLKLGKGQRAVISNGRLIGPLEDGEVFNQDDFLLLESIILKTSGERIKSKVQQFGVEEDRASDLVMKIDSLLSSQPKGEARIEHAFADDRYSAVKIRPAEGDVYFDMVAVIDPVTRDAQKLAPLLLVLKKLVNVNLRVFMNCQSKLSDLPLKSFYRYVLEPEVLFQTDGSFSPGPLAKFLDMPQTPLFTLNLNTPESWMVESIRTRYDLDNIYLEEVDSIVAAEYELEHLLLEGHCFDVSTGQPPRGLQFTLGTPSDPVIVDTIVMANLGYFQLKANPGAWILKLRKGRSDEIYKIYSHDGTDSPADADDLIVVLNNFKSRIIKVKVQKRPEKFSEELLSDGSQENDSGFWESLTRGFTGGVKTEESKQEKDDVINIFSVASGHLYERFLRIMMLSVLKNTKTPVKFWFLKNYLSPAFKEFXPYMAEQYGFQYELVQYKWPRWLHQQTEKQRIIWGYKILFLDVLFPLSVDKFLFVDADQIVRTDLKELRDFDLEGAPYGYTPFCESRREMDGFRFWKSGYWASHLAGRKYHISALYVVDLKKFRKIAAGDRLRGQYQGLSQDPNSLSNLDQDLPNNMIHQVPIKSLPQEWLWCETWCDDNSKKKAKTIDLXNNPQTKEPKLQAAVRIVAEWSDYDQEIKRLQNRVQERGAENHTTQKDKPDDTHTEL

SEQ ID NO: 4214 - protein, 1560 aa, Perkinsela sp.
MPCPHNLTLLLCVIQYVLGTTHVATPDVRVNMKSPWQETSLLHESIMYAEERNLFWPFVSESSRKTLNTGNDIASDHRSQYEHAQEVMSAILPNNESHLFETALSTRFFSPKVEGCRKAIKKRTRHVFEHTEIPWGSPFLEVQTNHTIWIAESPEKAEAFLKFRNFSALSEIPRKNDDAFQKLEAHTEKACFYQWKDSSRVKPSTSDKIHLTLFGVMGKLVTSLIHTSVIGELSRNPADIQYSYCEISNECIGEFEEVHDSDIGLSGYDVSFIVKSTEYIAHDEKRSPTPINTGGSDLLTTIGVDFDMLKRRYPSVSTRLEAIKASIATAHRTENTIDPTKILLEDSDISTFGQKASAFIIRSSNPFQNFEAVAQNLPRFIQEINSLKLSLNNRRVVQSISRSQMENDLLYQGEASLILHGRIISVIDTDIFALIRTLLTDLTFFQSTRAVIDLCIPSDALEVRNRLLQIFLNDKSDDRSEKYLPAHRLHISTNDIHWLNDLENDEIYASFPADPNRLYTSPFPIPIRKNLFNLVIAIDPSLKSSLKLLLDTFQKYRELVGIRVGVSFVTADGSASRGNSVEYTIAAMYQILTLEKGPVAGVVFLSRLFHYSIDERITASNVEDVLQDLFHIGSHTIMDRRSDVCQRVAAALDRSHRNQLGAIAPSCFLNGVRVSFTDDIQHAYLKEIEHIRPLVVSGRLTSATADCYTAVLEAFRGIERYHSMHWESSENLSGPDLMQLAHMMQELVWFTRGDKCDDLAQLSYVFLLDISTKSSLTDFFEALSYVKSDAIPSERVAFLVHSANFPLHQLMVNFLRVVIKLHDAEILSEAVEIAMEMYEKSHDDQADAIVSFFRKHNEDISVPSDSPCAYAFVGTDVHWPAGHSVVFLNGQIIRLTKYAQSGHPVTCMEYRTLSRLSREHMQWAMQAISTLDMTEIGGTCVSNAIAIATGLRYADMENNGERIGSMPHATEESLDGFPLPLRNNSVSQFPLFAETNYSLSAIIDPLSVHAPKALSLLQFLRDITGCEASVFLNPAQELTTRPVLHFTEHFLSQKLKFHPSGQVMQPSCHFPTLPGNLLLSLTLRTPESWVVYPQVAPIDLDNIRLAAESHNSPMEISYKLHGLILQGSCPEIAERVPPAQLTLRLDGLDEEKKTTGETHVMGNIGYFQLPLLPGFSTLRVSRNEDDYTMLGVQSTEREGLNVSKTDASGEFLLFHASFAATNVVVDVTQLSAEMDQTVSTLPATIHNSSAPKVKPSMLQRLLSHLWPQNTLAETNQTVHIFSIASGHLYERLLRLMMFRVTATTKAHVKFWFIEDFLSPRFKRLLPHFAEKFHCSYELVSYKWPKWLRRQINKQRTIWAYKVLFLDVLFPQSVDRIIFVDADQIVQSDIADLYNTDLRGKSVAYVPLCVTNSRNETNGYRFWNAGHWKEHLRGKPYHISAIFVVDLRKFRADGAGDIYRSAYESLSADPNNLANLDQDLPNYLQDIVPIHSLPEEWLWCETWCDDKSLRKARTIDLCNNPLTKESKLAVAKRVIPRWEEWDNELVRYEENILQNKIVSGE

SEQ ID NO: 4215 - protein, 1637 aa, Corchorus olitorius
METRFRSRFCTLILLACVIISGFTFVGAQNRRPKNVQVAVRAKWSGTPLLLEAGELLSKESKNLFWEFIDDWLHVPKTADDLHSAKDCLKKILKHGSSLVSESLASLFEFSLTLRSASPQLVLYRQLAVESLSSFPLADDSYSNDGNGVDANETITTKKLDPLLVGVNPKSPGGKCCWVDTGGALFFDVAELLLWLQRPNELGDSFQQPEVYDFDHIHSDSNTMSPVAILYGALGTDCFREFHVTLVQAAKEGKIKYVVRPVLPSGCEAEVGLCGAVGATDSLNLGGYGVELALKNMEYKAMDDSTIKKGVTLEDPRTEDLSQEVRGFIFSKILERKPEFTSEIMAFRDYLLSSTISDTLDVWELKDLGHQTAQRIVQASDPLQAMQEINQNFPSVVSSLSRMKLNDSIKEEIIANQRMMPPGKSLMALNGALINIEDVDLYLLIDLVHQELSLADQFSKLKIPHGTVRKLLSTVIAPESDTFRVDFRSTHVHYLNNLEEDAMYRRWRSNINDILMPVFPGQLRYIRKNLFHAVYVLDPATVCGLQAIDMITSFYESSFPMRFGVILYSTQFIKKIEMSGGELHSSASVHDGEIEDDKSSLIIRLFIYIKENHGTQTAFQFLSNVNRLRMESSESTDDALEMHHIEGAFVETVLPKAKSPPQELLLKLEKEQTYKDLSEESSMFVFKLGVSKLQCCLLMNGLVFDSSEEALVNAMNDELPRIQEQVYYGQINSRTDVLDKFLSENGVSRYNPQIVVDGKVKPTFVSLASSIFAGGSILNDINYLHSPETVDDVKPVTHLLSVDITSKRGINLLHEGIRYLIGGSKGARVGVLFSASQHADLPSLLLVKTFEITAASYSHKKKALEFLDQLCSFYELNYLRSPVAAESTQAFIEKVYELAEANELSSKEYKSSLPNASDQKLRENLNKVAQFLYRQFGIASGVNAVITNGRVTSVDAGVFLSHDLHLLESVEFKHRIKHIVEIIEEVDWQGVDPDMLTSKYVSDIVMFVSSSMATRDRSTESARFEVLNAEYSAVVLENENASIHIDAVVDPLSPSGQKLSSLLRLMAKYVHPSMRIVLNPLSSLVDLPLKNYYRYVVPTMDDFSGTDYTVNGPQAFFANMPLSKTLTMNLDVPEPWLVEPVIAVHDLDNILLENLGDTRTLQAVFELEALVLTGHCAEKDRDPPRGLQLILGTKNTPHLVDTIVMANLGYWQMKVSPGVWYLQLAPGRSSELYHFRDGGDDGSQEKSLSKRITINDLRGKVVHLEVAKKKGKEHEKLLISADDGKGSKENRGQSGWNSNFLKWASGFIGGSEQSKKSNETSVEQGKGGRRGKTINIFSIASGHLYERFLKIMILSVLKNTRHPVKFWFIKNYLSPQFKDVIPKMAEEYGFEYELITYKWPTWLHKQKEKQRIIWAYKILFLDVIFPLSLEKVIFVDADQVVRADMGELYDMDIKGRPLAYTPFCDNNKDMDGYRFWRQGFWKEHLRGRPYHISALYVVDLVKFRETAAGDNLRVFYETLSKDPNSLANLDQDLPNYAQHTVPIFSLPQEWLWCESWCGNATKSRAKTIDLCNNPMTKEPKLQGARRIVSEWTSLDYEARKFTAKILGDELENPEPVASPEVSSTDSSSEDTESKAEL

SEQ ID NO: 4216 - protein, 1637 aa, Actinidia chinensis
MEPQFRSGFWVFIVFVIFFGLSGDLVSVESRRPKNVQVALQAKWSGTSILLEAGELLSKEWEGLFWEFIEVWHHSEVDDSHTAKDCAKKIVKYGQSLLSEPLASLFEFSLTLRSASPKLVLYRQLAVESLSSFPLSDDTNSHSVDGGVSEASENMENKKAEPLLVGMNPRGIEGKCCWVDTGGALFFDVAELLMWLDNPKEPSGDSFQQPELYEFDHVHFDSSIGSPVAILYGALGTDCFREFHAKLVAAAKEGKVKYVVRPVLPSGCQSITGQCAAVGTSDPVNLGGYGVELALKNMEYKAMDDSAIKKGVTLEDPHTEDLSQEVRGFIFSKILERKPEVTSEIMAFRDYLLSSTISDTLDVWELKDLGHQTAQRIIHASDPLQSMQEINQNFPTVVSSLSRMKLNDSIKEEIIANQRMIPPGKSLMALNGALINIEDIDLYLLADMVHQELSLADQYLRLKIPPSIVRKLLSTLAPPESNAIRVDFRSAYVHYLNNLEVDAMYKRWRSNLNEILMPVFPGQLRHIRKNLFHAVFVLDPGSTCGLESIDMIISLYENNLPMRFGVILFSTKFIKTIEMNGRSAPMENDSHIGEDPSSLIIRLFIYIKEHHGTQMAFQFLSNINRLRIESADPAEDAPEMNHVEGAFVETLLPKATSPPQDTLLKLEKEQTFSELSQESSMFVFKLGLIKLRCCLLMNGLVIDANEDALMNAMNDELPRIQEQVYYGQINSHTDVLDKFLSESGVPRYNPQIIADGKVKPKYVSLSRAILGKDSVLNDVIYLHSPGTVDDLKPVTHLLAIDITSIRGIKLLREGIQYLIEGSKNARLGMLFNANTRVGFPSLLFMKVSEVTASLYGHKEKVLDFLNQLCTFYEHEYVLASSVDAESTQAFIDKVCDLADANGLPSKSLRIALSEFLVDKFGDHLNKVGQLLYSQLGFESGTNAVITNGRVIHIDDSTFLSHDLHLLESVELKNRIKNIVEVIEEVTWEDVDPDILTSKYISDIIMLVSSSIAMRERSSESARFDILNAKYSAVVLNNKNSSIHIDAVIDPLSPSGQKLSSLLRVLWKSIQPSMRLVLNPLSSLVDLPLKNYYRYVVPTMDDFSSTDYTVYGPKAFFANMPLSKTLTMNLDVPEPWLVEPVIAVHDLDNILLENLGEQRTLQAVFELEALALTGHCSEKDHEPPRGLQLVLGTKSTLHLVDTIVMANLGYWQMKVSPGVWYLQLAPGRSSDIYVFKEDGDGSQGMPSSKRITINDLRGKLVHLEVAKKKGKEREKLLVPSDDDNSSRGKKKGNQNGWNSNFLKWASGFIGGSEQSKKIESTSVERGNGVRHGKRINIFSIASGHLYERFLKIMILSVLKNTNRPVKFWFIKNYLSPQFKDVIPHMAQEYGFEYELITYKWPTWLNKQKEKQRIIWAYKILFLDVIFPLSLEKVIFVDADQVVRADMGELYDMDIKGRPLAYTPFCDNNKDMDGYRFWRQGFWSEHLRGRPYHISALYVVDLVKFRETAAGDNLRVFYENLSKDPNSLSNLDQDLPNYAQHTVPIFSLPQEWLWCESWCGNATKFKAKTIDLCNNPMTKEPKLQGARRIVSEWAGLDFEARRFTAKILGEDVDPLEQVASPSQTQNSEGTVASEDKAEL

SEQ ID NO: 4217 - protein, 1508 aa, Batrachochytrium dendrobatidis
MHAGISSVLIVTINLLYVAATSSSSSASPPIHVWLKTVDEWSAPPFALEVIEFAAEEVQDSVFPLLSLMAKNDLLDASKKPKQIYDALFSSQTASAPIIQRFLSSHASLGLAKLSLAIHSSAPRIQAHYRFYLQTIVPSLSKHKDFDPSCPVWVYWNGRQICDVGAIDTLFESSLNSSNSDYTVLPFDHTYQKHNSPSLVAIIYADVLSSEFKPMLSAFMNAAENHPLQLVLRYKPSTFAKQPLFLSGYGVELAIKNTEYKVEDDRTLNSDTIETFDGDLVSTSTSEDAFLFEAIPIIKSLTKEDIYDIGIRTASYIAQSATPLDTLVLVTQNFPKYAHILASYHIDDEVRETTKKVMQISTAPNQLYLNGHTVDLSRIDTFELFRMIRKESKIMGKLRQLGWTTAQAIELLSAPLLESLDRSWGECFDTRFESIIWLSDVEKDSRFSFLPASIRDIMRPTYPGQLKYVRKNLLTTVLMLDLTKSSHITVATTVFGFIEATTPLKFGIVPLVNDEHGEHPCNMIAMIFYRFKESGRKKHIKSMIEMLAKFAETEEGVTASVVKSIFSKITNKEYSEIFGEPSEKTKVLLKDLFAYSERLGVTRSDGAIFSNGKYIETNGLWQKTLVETYFSMVEYLTKAVYSGQVDDNTNLWGHFMTLDNVFRKRNALVFPSSKQAISLVNWLEYSASKVFDTLPWMYRSADAEFAEISLIVVGDFSTPPGLDFALAAVNSVAANDHPVRVAFLHNGSTDSKDTEVFIDEAAFHILQLSTSKEGSTPIEALKAAATNSDKFERTSESSEFNTLRHEGLAAVVAATKLLPGEYAVIANTRVISHIPVSRLFDQHDFESLLSFESQNRASQMTKLIASLRDKDLSPAELSNLHFKSQSLVIAANTATKTPQHEATSIKRVSSSKFAAIRNAPGTFSTSGFDEATIHFTAIIDPISNVGQKLASVLAGFSKVDGVAIEVFLNPQYHADLEKLPLFRFYRYVLRSEPEFDTQGNLAPVGASFDRIPAAPLLTLGMDVVGAWLVRPTKSIHDLDNIKLSSLPHFPRAVGIEADFVLQSILVEGHATDIHSGGSPRGLQFVLGSETDPNMVDTITMANLGYLQLKANPGVWHLRIREGRSRTIYNMDSLSYMSSNGTFVESSKLGDDGALVVVDTFEGVTVFPNVNVRPGMAGKDVLADSDQAKPGFWNTVKQGVKEVFGGGISTLETINVFSVASGHLYERFLSIMMLSVKRQTKNPVKFWLIENFLSPSFMEFLPYLAKMHKFDYELVTYKWPKWLREQTEKQRIIWGYKILFLDVLFPLKIDKVIFVDADQVVRADLKELVDLDLHGAVYGYTPFCSDRTEMDGFRFWNQGFWQGHLRGRPYHISALYVIDLVRFRGVAAGDRLRQQYHTLSADPDSLANLDQDLPNSMIHHIPMYSLPQEWLWCETWCSDESLKKAKTIDLCNNPMTKEPKLERARRILPEWEGLDQQVHATRAEFDAARQAAAKLTVVKANDGSDRDEL

SEQ ID NO: 4218 - protein, 1505 aa, Blastomyces dermatitidis
MTFRYHPFPWRLGGLALFGASLLFTSNAIAGPSVNVALTTSFNAAPYLVELLETAAEENSTCYFPLLDRIAEGTFAEITTDQGLYERFTQLLQEDGHLTHPEAISLFKFALSLRSTAPRIEAHYQYYNTSVEPSLMAAQDAVCTVWAHYDGDQYCSPSLEYAQQSVSGDQHDRILPFDRVLGDSSLPPLILYADITSPLFGGFHQELIEKARDGQFSYRIRYRPSGSEVPRPLFVNGYGVELALKRTDYIVIDDRDAKQRVLQDNDAEKPTLAPAEDLEEEPPADLKPLSASEVSTLGMNAASFVMSSDDPFATLLRLSQDFPTHSATIASGKASSKFTKELKQNRAALLPEGHNVMWVNGLQIDPRTIDAFSLLNHFRREGKLINGFRKFGLSGQQGVNLLSNPVLAKSHAAGDPLRYDYRDEFEGGGVIIWLNDLEKDHRYNGWPSDLKSLLRITLQGQLPPVRRDIHNVVIPVDLTSPEDVRIVAETLLILVKRMVPIRFGIVPLVHNKNTLGQAKIAHHLLDAYGIGALISYLQASLSADKVASPDRASFTSALENRKLREDRTPLAFEDALESDNYDPILSNTKSYLERLAVKGEVLPFFVNGVAFMRDESFLQYMLASLSKDLEDIQRRVYEGTIDEDVWVPSHFLQGALQGRNPLLIPENPTEILTVDLDEMYMNHKDIFDTTLRIPAAAESEHPLLDWSSIILVADLDSDAGAKQLTYLLELHKKHPGVEILLLHNGESSSTSQALSTRLYSIRNGRDLDPAVITAALGSENEEPSDSAAASAYWKTVQPLVKEIGFGTSEIGMVVNSRVIGPMPSSTTLDIQDLEQLHMYEQSKRVGVLSRAAFELGLEANISDPLGLARLQALASLSATSNVPEGIYGSGQTARTDIFEKWNGVHSAISVSNSDDPSIHIVAAIDPTTEIAQRWVPILKVLSELNGVSLKLFLNPREEIKELPIKRFYRQVLESAPSFNADGSIAKPQAIFRGIPGEALLNLGMDVPPSWLVAPKESIHDLDNLKLSTLKEGTNVDVIYELEHILIEGHSRDVTRGVPPKGVQLLLGTEKNPHFADTIVMANLGYFQFKARPGCWKITLKPGQSERIFRIDSVGGHGYIPTPGDENNDVALLSFQGKTLFPRLSRKPGHERDDVLDADHKPASAAKHFLSKGLNFASNILHSITGPAQETHADINIFSVASGHLYERMLNIMMVSVMKHTKHSVKFWFIEQFLSPSFKSFLPHLAAEYGFSYEMVTYKWPHWLRAQTEKQRIIWGYKILFLDVLFPLSLDKVIFVDADQIVRADMYELVTLDLEGAPYGFTPMCDSRTSMEGFRFWKQGYWEKFLRGLPYHISALYVVDLNRFRAIAAGDKLRGQYHTLSADPASLSNLDQDLPNNMQQVLPIKSLPQDWLWCETWCSDESLATAKTIDLCNNPLTKEPKLERARRQVPEWTVYDEEIAAVQRRVLEEEREAKGGTKGGDQNVPRDDGGDDGKGKSEKGTRKDEL

SEQ ID NO: 4219 - protein, 1608 aa, Tarenaya hassleriana
MGSRPRSRFCVVAFVLLLLVCGAWAQNRRPKNVQVAVRAKWEGTPLLLEAGELLSKESKHLFWEFTEVWLGSDDDDSDCNSARDCLLKISEHASSLLTPSLTSLFRFSLTLRSASPRLVLYRQLADDSLSSFPLSDDSSLCCWVDIGSSLFFDESDLLSWLASPPAAEDSVQGPELFDFDHVHLDSRARTPVGILYGAVGTSCFRKFHVLLSQAATKGKITYVVRPVLPSGCVGRTRRCGAIGAWDNVSLAGYGVELALKNMEYKAMDDSTIKKGVTLEDPRTEDLSQDVRGFIFSKIMDRKPELRSEIMAFRDYLLSSTISDTLDVWELKDLGHQTAQRIVHASDPLQSMQEINQNFPSVVSSLSRMKLNESIKDEILSNQRMIPAGKSLLALNGALLNIEDMDLYMLMDLAHQDLSLAHEFSKLKIPDEAIRKLLLASPLPEPDSYRIDFRSMHVHYLNNLEEDAIYRRWRSNINEILMPVFPGQLRYIRKNLFHAVYVMDPATVCGLESVDTIISLYENKFPVRFGVILYSENLIKKIEKNGGQILSSDTVNDAHVKEDLSTLIIRFFLYIKEHHGIQSAFQFLGNVNRLRTESADHAYDDIELQHVEGAFVETILPKVRSPPQDILLRLEKEQTLKEASEESSLFVFKLGLAKLRCCFLMNGLVFDSVEEDSLINAMNDELPRIQEQVYYGQIDSGTDVLDKLLAENAVHRYNPQITTNGKSKPRYVSLASSSGRGEFVLNDVTYLHPPETSDNVKYVTHLLVVDVATKKGIKMLHEGVRYLIEGSKAARLGVLFSSYQNAHPHSLLFIKVFKITASSFSRRGNVLAFLDQLCLLYEHESLFKIKSPTGVATSQMFIDKVIENAEAYGFSSKAYESCLLESSDEKLLEHLMKVNQFLSWDLGLESDMNAIITNGRVIFPVDERTFLSHDLQLLELVELSQRIKHVREIIEGVEWRTMDPDLLTSEFLSDVFMFVSSAMATRDRGSESARFEILNSQYSAVVMGNETATIHIDAVIDPLSPVGQKLASLLRVLGKHVETSMRIILNPVSSLADIPLKNYYRYVLPNMDDFSSTGFVVNGPRAFFANMPLSKTLTMNLDVPEPWLVEPVIAIHDLDNILLENMGESTTLQAVFELDALVLTGHCSEKDHEPPRGLQLILGTKSRPHLVDTLVMANLGYWQMKVSPGVWYLQLAPGRSSELYILNGDHDEGQDQFLSKRITIDDLRGKVVHLEVVKKKGKEQEKLLVSSDGENGVQQKERESWNSNFLKWASGFIGGGEQSTKGDNKKELGKGERQGKSINIFSIASGHLYERFLKIMILSVLKNTKRPVKFWFIKNYLSPQFKDVIPHMAQEYDFEYELITYKWPSWLHKQKEKQRIIWAYKILFLDVIFPLSLEKVIFVDADQVVRADMAELYDMDIKGKPLAYTPFCDNNKEMDGYRFWRQGFWKEHLRGKPYHISALYVVDLVKFRETAAGDNLRVFYETLSKDPNSLSNLDQDLPNYAQHTVPIFSLPQEWLWCESWCGNASKPKAKTIDLCNNPMTKEPKLQGARRIVSEWSGLDLEARRFTAKILGEDMELNELLATTDKRNHPSSDVSSKQDLESKAEL

SEQ ID NO: 4220 - protein, 1495 aa, Aspergillus steynii
MIFNSNSVASWRLTAIVAVVLACLVRASPSVNVALQASFDAAPYLIELLETAAEENSTSYFPLLDRVADGAFDDAVSDKQIYDRFLQIVDEDGHLKTPESLSSFKLSLAIRSASPRITAHYQYYNASVQHSLMVAQDAVCPVWVHSEGKQYCSSTLERAQQDVLGEMDSRELPFDRVLGDLSLPPAILYADVATPMFKDFHHTLSALAKEGQISYRVRYRPPQHWSPRPLFVSGYGVELALKRTDYIVIDDRAADQQGSNNAEPSDSEGDAPDDLRPLSSSEVARLGVNAVSYVMNSDDPLDTLVKLSQDFPKYSARVASRNASTELLEDIRSSRLQMLPAGMNVMWINGVQIDSRQIDAFSLLDHLRRERRLIEKFRDIGVSAQEAVSLLSHEFLGEALAQDAPQRYNYLDDIEGGRVLIWLNDLEKDSRYQSWPQELEAFLQRTYPGQLPAVRRNANNIVVPVDLSSLEDLNFVVTTMSAFVKKGIPARFAIVPIASSVGQKSQVRVAHYLQETYGLSSLLQYLEESLDKNKAASADKGCFETATKERKVRSDRKELSFEEVLKSDDLENVVSQAVHYQYRLGITADASQSFINGAPVARKSNWMQEVSIRISRDLQQIQQGIADGEIEEATSLPGVFLSKAFPRRSQWVIPEDPKDIRVVDLTKVSDSQKSALSETPLIASTNGDALDSAYLIVVGDFDSESGFQLLTAALEHREKHNEVEVLFIHNAEKQTSAKGGSTTLYRSIKTGKQIEPAQILANIGSAAISPPSAEEADEIAQFWAGQQSLARELGFASGVNGVVINGRAIGPIQHDVTSDDLGQLLVYEQEKRIGPVARACKDLGFGSNIPGPLAFAKLTSLTTLSTVSDVPEGIFESTSDIRMNLFNKWNDSRSVLTVSNSEDPAITILASIDPSSETAQRWLPILKVLSKLASVRVRLFLNPREQIQELPTKRFYRYVLDSEPSFNDNGSISRPTASFRGVPVEALLTLGMDVPSSWLVAPQDSIHDLDNIKLSSLNSDSDVETVYALEHILIEGHSRDLTTKSPPRGVQLNIGTDNNPDYADTIIMANLGYFQFKTQPGLWKINLKPGSSERIFNLDSVGGLGYSPQPGDDNNEVALLSFQGKTLFPRLSRKKGHEMEDVLETGPKAGTAMDYVSKGFSFASGVLSSVGVGSKGSLSQKQADINIFSVASGHLYERMLNIMMVSVMKNTKHTVKFWFIEQFLSPSFKSFLPHLAAEYGFQYEMVTFKWPHWLRAQREKQREIWGYKILFLDVLFPLNLDKVIFVDADQVVRTDMHDLVTLDLEGAPYAFTPMCDSREEIEGFRFWKQGYWKSFLRGQPYHISALYVVDLNQFRALAAGDRLRGQYQMLSADPNSLSNLDQDLPNHMQHHIPIKSLPQEWLWCETWCSDESLSQARTIDLCNNPQTKEPKLDRARRQVPEWTEYDDEIAALSNRVDVERQREEELRAESRQEEEQEEDDSDDVDEDPAWIKDEL

SEQ ID NO: 4221 - protein, 686 aa, Papaver somniferum
MKGQHKFLSDLIMFVSSSMAMRERSSESARFEVLNAKYSAVVFDNDDASIHIDAVIDPLSPLGQKLAPLLRLLSKFVQPSMRIVLNPMSSLVDIPLKNYYRFVLPTMDDFSSSDFAINGPKAFFANMPLSKTLTMNLDVPEPWLVQPVIAVYDLDNIVLENLGDTRTLQAVYELESLVLTGHCSEKDHEAPRGLQLILGTKSRAHLVDTLVMANLGYFQMKASPGVWYLQLAPGRSSDLYVLKEHEDGDEVLPFRKQITIDDLRGKLVHLEVVKKKGREHDQLLSSSDDANNLDERKYIIVSWFSRRVVSTGFNVVSDQGNSKSWNTNLLKWASGLIGGSEHEKRKGGSVERKDGRHGKTINIFSVASGHLYERFLKIMILSVLKNTHRPVKFWFIKNYLSPQFKNIIPHMARDYGFEYELITYKWPTWLHKQKEKQRIIWAYKILFLDVIFPLSLEKVIFVDADQIVRADMGELYDMDMKGKPYAYTPFCDNNKDMDGFRFWRQGFWKEHLRGRPYHISALYVVDLLKFRQTAAGDNLRVFYETLSKDPNSLSNLDQDLPNYAQHTVPIFSLPQEWLWCESWCGNSTKARAKTIDLCNNPMTKEPKLQARRHISNSKIHYSSCPEQGAKRIVTEWPDLDLEARRFTARITGEEIDDAKETITTSTQAKSEASSIVEEDKESKSEL

SEQ ID NO: 4222 - protein, 1599 aa, Echinops telfairi
MRGPHAGATLLVTVSRCPSPTGSGRPRGGRSRRPERGVCGPGAPRCEGLGPASPRYGDVEGSVRGATAPGPPSPGTLPASPPVRSSAASLILCFWLTLQHSLATTVPSVRSLATVACHVFGKLRCPGVIPEFLAEESNEKFWQFLETVQELAIYKKTESAYSYYNLILKKAGQFLDNLHINLLKFALSIRAYSPTIQMFQQIAADEPPPDGCNAFVVIHQEHTCKINNIKKLLKKATSRPRPYLFKGDHKFPTNKENLPVVILYAELGSKAFSKFHKALSEKAHQGEILYVFRHYIQKPSSQKMYLSGYGVELAIKSTEYKALDDTQVKTANNTAVEDETEADDIQGFLFGKLKEIHSDLRENLTAFQKYLIESNKEMMPLKVWELQDLSFQAASQIMSTPVYDAIKLMKDISQNYPIKARSLTRIAVNQQMREEIQENQKVLRDRYAIQAGDTTLYINGLRIDKDTNDPFSILDMLKLEGKMMNGLQNLGINAEDISKFLKLNSHTWEYNYALDIRHSSIRWINDLEHDDLYVTWPTSCQELLKSAIPGNIPFIRRNFHNLVLFIDPAQEYTLDFIRIAELFYYHKIPLRIGFVFILNTDEEVDGKNDVGVALWRAFNYFTKEHGVSQAFIYIVQMYQKVNNQNILTVDIVKSVLQDKFPHADVQDILGIHSKYDGDRQVGASFYKMTGLGPLPQVLYNGLPFKHDEMDFKNLEMAVFHRMMDTCIYLQREVFTGALNDRTNVINFLMDKNTVVPRINSRILHMKPKYLNLIPTSVTADVEDSATFFFLDSQDKSAVIAENMYYLTQEDENVISTVTFWIIADFDKPSGRKLLSNALRHMKTSVHSRLGVIYNPSSKVTEENTVISRGILTAFLTQQSKDLRNFLGMLAKEEIATAIYSGDKIKTFLTEGMDKNAFEKKYNTVGMNIFRTHQLFCQDVLKLSPGEIGIVSNGKFLGPLDEILYAEDFYLLEKITFSSFVEQIKGIVKNMETRSTNLSDLVMKIDALISSLPKPSSRYDITFLKENHSIIKINPQENNMFFDVIAIVDPLTRETQKMAQLLIVLNKMINMKLKLFMNCRGKLSEAPLQSFYRFVLEPEVMLGANDINSLGPVAKFLDIPESPLLTLNMITPEGWLVETVHSNCDLDNIHLEDMERAVTAEYELEYLLLEGHCFDELTEQPPRGLQFTLGTKSKPVMVDTIVMANLGYFQLKANPGAWKLKLRQGKSEDIYQIVGHEGTDSQRDQENVIVVLNSFKSKILEVQVQKKPGKSKEDILTDKDEKTKGMWNSIKSFTIRLHKEEKKKEEDVLNVFSVASGHLYERFLRIMMLSVLRNTKTPVKFWFLKNYLSPTFKEVIPHMAEEYGFQYELVQYRWPRWLHRQTEKQRIIWGYKILFLDVLFPLAVNKIIFVDADQIVRHDLKELRDLDLGGAPYGYTPFCDSRTEMDGYRFWKTGYWASHLLRRKYHISALYVVDLQKFRKIAAGDRLRGQYQALSQDPNSLSNLDQDLPNNMIYQVAIKSLPQDWLWCETWCDDESKQRAKTIDLCNNPKTKEPKLKAAARIIPEWAEYDTEIRQLLELIEHKKKASELSPSVPVNSAIC

SEQ ID NO: 4223 - protein, 1598 aa, Tetranychus urticae
MKINLIHICLCLLLVFDITTGDNEDNVNVLTSRSSSKSSKSVTISLFSKWNQTCLYSEASEYLWEESHNLFWTFLETLTSQPVADRYISSSSFQDDYERILQLTLPLLSPSKKSILKFSLSLRSHSPTVEMFNQMSKDKRVDLGLDSDGNGESNAIIGSDIFCPTFVEFSRPSSQNDIPFACDVESAKSTLTQLLSAQTSFISPLIYKSDHIHPESSSQANYITAILYGHFPSSSFSNLYNFLKTQVIDTGRIKLLIRHYIPFVKPGKVSLSGYGVELAIKSTEYKAQDDTRVKGEATSAALALQSDDGPDELEGFVFSKLKQSYPDSAEKINEFHTHLIETMKEIATFKVWELQDMSLQAAKKIISSPKEDQLRLLKDIAQNFPSLSRTLINIPVDNDLKKEVERNQHIFMHHLNLGTSDSALFVNGMFFDMDTTDIFTLLHYLKKEVKLIEGLHKVIGQDQAKIKKLIKLDVNDDKQEYQIDIRDSAVMYVNDIENDKMYRSWSSSLQDMLRPTYPGMLRNVRKNMYHLVLIIDPSKKESFDIIKLAESFYVHKAPLRIGFVFAVNKNMSVNGFNDAGVALLNAFNYITETKTPYDGLSFLTDVIASIKSNSIEEKDLNPESVVNLLKAKFPKADLDLVFGSDSNYDTGRKLAWDFLQRTGLTSPIKVLMNGVVLKQNHLNSELFEEAVLTEIMRQTPTIQKAVYKGELTESKDILDWLMSQKTVMPRLNQRILNNKGKIIDLVPDETLASPSDETDIVSSTLSLNNFQARIKYIISNEKRCSPITLWIAADYEKKEGRRILLSALSYLRSNNQHMRLGIIYSNVGLVSQTIEAALSSIRDAKSTLSFLIKYLVEVEHDTSLDNVLNAHELVPAEAKDDFKEVFKNIQLDTTLFNLHHEFISKIIELDDSKIGVVVNGRVIEIPTNESFVEDDFSLVERHGMLNFGQKILEVLDTNDKSDPAICSNLVMKISNVLSSSSINKMRHELQNFGSEHSAIILPSSTPELPTLDVTAIVEPLSRGAQKLAPILMALQKVFNINIRVYLNCIEKHSDMPLKNYFRYVIDSEMHFADTQGSKLLNTDAYFGNMPLSPLFTLGMITPENWLVESVTSPYDLDNIHLEEIEGPGVWADFELEYLLLEGHCFEQSTGNPPRGLQFILGSKSDPDVSDTIVMANLGYFQLKANPGAWTLRLRPGRSDDIYSIVSHENTDPVSDSSNVVILISSFQSNVVKIRVNKKPDKQDEELLYDDGDDDENSLWGSISSWTGGSKKKQTNGVQEKETEKLNIFSLASGHLYERLLRIMMLSVIKHTKTPVKFWFLKNYLSPTFKDFLPTMAEKYGFEYELVQYKWPRWLHQQTEKQRIIWGYKILFLDVLFPLDVKKIIFVDADQVVRVDLTELRDLDLEGAPYGYTPFCDSREDMDGFRFWKTGYWANHLHGRKYHISALYVVDLQRFRRIAAGDRLRGQYQGLSQDPNSLSNLDQDLPNNMIHQVPIKSLPQEWLWCETWCDDGSKSKAKTIDLCNNPKTKEPKLTAARRILPEWEAYDNEIKELMREYEESKQSSTMVNEIEVESKDTKPTMPGPEKKTEAKDSAHHTEL

SEQ ID NO: 4224 - protein, 1264 aa, Coccidioides immitis
MPPALCEWLWRRTDLETDGLYVIDDRDAEQSSSSSSSSSEKAKATHGTAKDLKEESPADLKPLSASEVSTLGINAASFIMNSEDPFETLLKLSQDFPRHSSIIANTNATTEFLVELANNQAHMLPAGYNVMWINGVQLDPRRTNAFSLLNHLRYERKVINNFRELDLSAGDVVKLLAHPVVARSQATEEAPRYDYRDETEGGGVIIWLNDLEKDRRYSNWSRGLAALLQRTYPGQFPQARRDVNNVIVLLNLADRTDLRMLVSQLQMFITRKIPIRFGMVPTLPDEASMQQIRVASYLHQTYGLKTLLTYFENALEGAKSQIVWPSKDSFNAAVQDREHHADRPKLTFEEILSSDHFEPTIITKTKAYLKRLSSDGPNPPMFVNGAIIPRDEHWMQPLVTRLAQDLEEIQQAIYGGLYDDDSWLPIHFLDGAVLTRNPLIIPEDPGAIQIRDLHAAFKSRRSAFDALPRIRASSDSNLENWSSLILIADFDSEDGIKQLGSVLEFREKNPGIEVLLLHDSHLDFSGRVSAELFNLMKESRDVDVSALKSILEVGSERLLTQEPDVERRRNYFSSFSPLARELGSNQGGVDIVFNGRLIGPIPSSSLFGVQELEQLLAYERQRRLEPLFGAVKSLELKDVIDGPFKLARLTSLVARSTKLDIPEDIYDSGPALRTNSYEKWSTEHSGFTLSHADDPVIQVVAVIDPASETAQRYIPILKVLSKLSGVSVKVILSPIQPLKELPIKRFYRQVFESEPSFNDDGSVRRPEASFTSIPEDALLTLGMDVAPSWLVAPKESIYDLDNIKLSSLREGANVDAVYELEHILIEGHSRAVTHGSPPRGVQLLLGTEKTPHFADTIIMANLGYFQFKAQPGCWRITLKPGPSERIYQLDSVGGMGYVPKPGDETNEVALLSFQGTTLFPRLSRKPGHEEDDVLEAGSKAGSVKNYFSKGLNFASDVISSITGSQKEKHADINIFSVASGHLYERMLNIMMVSVMRHTKHSVKFWFIEQFLSPSFKSFLPHLAKEYGFSYEMVTYKWPHWLRSQREKQREIWGYKILFLDVLFPLSLDKVIFVDADQIVRTDMYDLISMDLEGAPYGFTPMCDSRTEMEGFRFWKQGYWKKFLKGLPYHISALYVVDLNRFRELAAGDRLRGQYQSLSADPNSLANLDQDLPNHMQHAIPIKSLSQDWLWCETWCSDEALKTARTIDLCNNPMTKEPKLERARRQVPEWTEYDDEIAELGRRVAREQGQAGDEKNEKMRERDEL

SEQ ID NO: 4225 - protein, 1852 aa, Chlamydomonas reinhardtii
MCTPVLSSKPKGASLTVRARFNATSYLLEALEFLAEEEPALVWKYLDAMGSAAPPRAAGEGDGCWQRLTTEATRLVSPSVGKLLPLVLGSRQYSAKLAMVAQLAAQFHPGQTSCCFVAVGGATLTDPAQLPAALKAAAATAATATAAATAGGEHAEAEQLFPFDHVYPTTAAAAAAAATATADGDSSSTGSSTAPAAVLYGSPGLGCFGPLHAALRAAAEAGRATYVFRPLLQPHCESAAGCAASGAGGPLLLPGWGVEAALKNTEYSALDDKGNKDKEAAADSGAGGSDALGSGEAAVVRGFRLDVLAARKPTLRQELLTLRDQLLTAAEDDADGSGSLKVWDLADVGLAAAQRVLGSSDPLALLAEVAGNFPGLVSSLSRQLLGAGGGGKGRGLVSSLSRQPVNGSLRSAVASNQAAGLSAGANLLLLNGLAVDVNSLDYYGFLGRLRAEMRLRDALVSPPAPAPATAAATASTATASTATAATAGGLGLPGDVAATVMALRAEEGAGAAAGGGGGVESEPRLSLGSASTMDKHVTWLNNLDKDAKYQRFGRSVNELLSVYPGRLKPLGRNMFTAVLVAQPLCAASLQLAAAVEQMWQGGYPLRFGVVFELPAVQGRLATSRRYPHLTGATQAPAWEDMDASERFGRAFATLREAFGGPAAWRLWGKVAELVGSGEAQDPGSAVEAAFKAAWAAAARSPPPGARAKAAARKSAADALTMLQEGSGYAAEVGMALTDTAAWLQGRGLVTAPPPTPAGQAGEDAEDCSRAPLVWMNGLAGRSAGGGGGMMGGGGGPAEDLLYKLMGEMQRMQEWVYFGRLADDTAGGDVLQAVLGLAGAVERLNPRLVGPAAARNAKVVPLAPLLRGPARQQLAALWRDTPASSSSSASSPSSSSPSASSLDDDEDAEAEEAEEQQAGGKKGGGKKGAGKKADKAAKADKGPLRLHVPAVTHLVAADLCGEGGEGRELVAEALRFLSDGPPAAVREARLLLAPNPADPQEPPCLLEALATAALQQAAAGRATRAQALSFLRRLLSDGPLVSRLAGPLAGGSAEEATVAVKMAEEAGLDSSSLLGSLTSLVDAALLPGGGGLRRSSQVPALAGRTRLAAALTGGGGGGGAGGGAGGGGGLGLAAGEAAVVTNGRVTRVYRPGGERHELVAEDFPLLHMAVGGVASAVAAALSKAHAAAPLPGVPPYPAAATDAAAAAAATTDALSDLTAATAAALAAASAAATPEAPAGAAGGAAQLGPAASKQLQSVMAKLRKSKIAVEIPGSSSSSSSPSSSSSPSSSSALRLEVILNPLSRPAQRLSGLLLALREALGADVVLALNPQRDLTEMPLKSYYRYALPQGLSPAATAAAPPGTPAAHFARLPPRRVLTLNLETAYAEWELDSLMLTGSCVDVTASGRLTPPRGLQLHLGTPAQPHVVDTLVMANLAYFQLKAAPGLWLLSLAPGRSRELYELTGSTGTSLHDDDNEEEEEGEGEEGEEEGRAVAVVAAGGGKGVAVGVSDPAVSTQVLISSFTGKHMILRVRKRPGMEDEDVLKQGGEEDDVVEIDRPMHELEDDEYADEDDDEAPARKPSSLLGRVSDMITGKGGKDGAAAAAAKKLPGGDVINVFTVASGHMYERLQKIMVLSVVRHTKSRVKFWIIKNYCSPQHRAVLPALAARYGFDYEFVTYKWPTWLHKQTDKQRLIWAYKILFLDVLFPLGVERIIFVDSDQVVRTDLAELYHMDIGGAPYAKTIDLCNNPKTKEPKLTAARRIIGPLWEELDAQQEAVTREVQARLDAAESGLPLLAGATEAATEAAAEAVEAAGAGTGAGVEEDWAVGDAPQQQQQQQQQQGGGAAGGADRTEL

SEQ ID NO: 4226 - protein, 2170 aa, Mucor ambiguus
MTATPRILKAILGLVTVGLCNLKHVSASAGTDASPTVDLTMIAPWSAPNLVVEVAETVATYNKSAYIHFIHDFVALEQQSASWTPYQTYKEAVKVVSALGVDETNFFKLSLAIHEAAPRIEAYSQFYRESIVPGVSAYNDDCDVWAQIGDQQYCDITQFIDALTSQSATSTKPIELLPFDHIVSKSQENPTVALYTDRFSVEFAKYHDALNQHSVSHVIRYRPSTAHVPVPLYLSGYGVEMALKKTDYLVIDDRSTQKASNMKDKIVNMGKKFGQSLFQATQKETIEPVTPGEIHRLGFKATQYISRSNNPLATLNQLVQDFPKYAKSVSELDVDIELEEEILENQLNFLRSGMSAVWLNGKGLEFSQMDPFFLIRALRKERQLIASFEQLGFKPKDAIQVISNPAFTVASQASNSANAEIFDMRDSPEEPFVIWWNDLEKDKRYDDWTTSMEDYAKPQYPGQLLPVKKNIFNLIMVEDLGQQGSIARVVSELHMMIKRLVPVRFGIISIMKERDSVSTWMAQSLSYLIEEHGKGAGMNFLTTVLETLHAEGKSEPTPEIITNAFAKTVSSSGKPKSGKKITFEEALETQASYTQASSQFLQRMGITELGAQDGIMFINGKLLEFNEERPWIQVLMPALHEITRGLQKMVYMGDFLDDKFDYYQHVMTQHYVATHRNSFIVPSNAHPLVIREFPTARKSDALRYFQVGEQDASINLWISADLNTAHGLKLASEALLYAESNPKVRVALIHNPASASTDDEPEISVPVVDEQHHKPTFSDLLGSVIFTNKDTHMEQLVTLVGNAIEQLDSGSFEGNVVPEAIIPGSPVIEMEAKAQSIHWRNLVSALERDGLDTSFQGIVVNGRVVGPIPSSAVFSKENFVALVDLEHSKRIAPIEQAIAQVKYTMPADKDVADVLTTISVLIETDKAVTSKSLVEENEPVYRHRVYENIPKTKHTRLVIGDPENAFLQIGFIIDPLSETAQKWVPLINTLASLEGVTVTMYLNPVNGLQELPLKRFYRYVFDKEPHFDSVTGVQEIPTAYFGDLPTDPLYTLGVETTNAWHVTVREANMDLDNIVLKSLGKEESGVSAVYELENILLEGHCLDSNSKSPPRGLEFEIATPSNHSHRDTLVMANLGYFQLKALPGVWNLGLREGRSSAIYSIEDIGTEGKWNWDASKQNKKAEQGSGVLALTSFEGITVMPLVHKNPGMESEDVLESADDRKQHGDGSGLWSSFSSKLFGGGKKDQDVAIAKPKQADINIFSVASGKLYERFLSIMIASVMEHTQSTVKFWFIENFLSPEFKDFVPHMAKEYGFDYEMVTYKWPAWLRAQREKQRTIWGYKILFLDVLFPLDLDKVIFVDADQIVRTDLKELVDMDLQGAPYGYTPFCSDRTEMDGFRFWSEGYWKTHLRGKPYHISALYVVDLVRFRQLAAGDRLRAQYQQLSADPNSLANLDQDLPNNMQHIVPIFSLPQEWLWCETWCSDESLKTAKTIDLCNNPLTKEPKLDRARRQIPEWENYDNEIDQLRKRVSLGHPPAVVADEHGEQIVISGKKEHLKDELLFSAVAPVRSKKSTRRVHHTNHNNIHDSNEDILRIIKLYNQGTMKTINDEATLNGIKYPCLLKYRASNFYVFLTAALSIFTSIYSNASLSSITLYVIESQIKPTQSSLHSGMDVLSDDAVIYVLSSFYLSGLLLGSFMFGWLGCQIRQRKYLLLIGTCASILAGGALMVSIEYWMLFPAKFLQGLSNASIWLMCTALIADVWPQSKWGSMIGFILCTYPLGMSSGLTIGGVLFEHASHKACFLCALALSCWTLLMQLFVIERCTIPSDWIDSKETVQMDQETEMQEHHFKDMQRELNVMEEGAMWSKSSSMSTINLRDQPIIFEKEKESNIKSSAKVVLQNLLVVRLVRSAELMACLYQLIAITAILGALKPSLMIKLEFQMSVLNMAYRNIVLSTFLLPCAVSAVANGWLCDRFGTKIVGLTSMIISIPAFIWVGVPHQNIQSVVSALAVSGITLSGISVSAIYSTIKVMQNILLQQQFEKTKQQQQQYQQQNMSAIFATICLVFGVGLFLGFFLSKLNDIIGFFWLCFVFSMLLVTCVPLIAYFPKGTLFRKSGSQTGFSASTSKKSIVNNTRPESFAESILSDDETTLGSSSRSDCNVTLESKSIIVIP

SEQ ID NO: 4227 - protein, 1485 aa, Aspergillus mulundensis
MLFRSGIVASWRLSCIVIATLASRTASSPSVNVALQASFDSGPYLIELLETAAEENPTSYFPLLDRIADGTFDDYVTDKELYDRFLQVVVEDGHLSSPESLSSFKLSLSIRSASPRIAAHYQFYNTSVQHSLMAAQDAACPVWVHSDGKQYCSSAMERAQQDVEGELDGRELPFDRILGHQSLPPAILYADVASPMFKDFHQTLSALAKEGEISYRVRYRPPQHWSSRPLFVSGYGVELALKRTDYIVIDDRDAEQRGSNSAESAETEEAPDDLKPLSSSEVSRLGLNTVSYVADSEDPLDMLVKLSQDFPKYSATIAAYNASAELHSEIKANRLGMLPPGASAIWINGHQIDPRQIDAFFLVDHLRRERKLIESFRGLGLSATEAVNLLAHDLVTESVAQVTPQRYDYRDEIEGGNVIIWMNDLEKDARYQSWPSQLTAFLQRTYPGQLPPVRRELNNIVFPIDLTSIEDVDLIVTTLQVFVKRKIPVRFGIVPLATSEGSIAQLKVAHYLQETFGLASLMAYLEEAAKKHKLATPDMTVFAAATQDRTPRAEKQALTLEEVLNKDELDTSARNTAKYQDRLGIQAESPLIIVNGIPVLRGENWPQEMSAKVEKDLRLVQQGIAEGLFEEDAWLPNFFLSQAFGRRVPWIVPEDPKEVELVDLGKVSAHTGDLIDKVPRVAALVEPLESVHMIVVGDFGTKAGLKMLISALEIQVKQDKTEILLIHNPENPSSNAAAPALIYRSLKEGNAVDSARILADILSPASSDADPQEATEFWSQFRPLVEALGLSSGTNGIIVNGRVVKPTQDVTVEDLGQLLLYEDINRIGTVTKAAKDLGLASKISDPLSFAKLTSLVALSTVSDVPEGLYETPSDARVQFFEKWSDSGSVITVAGPDAPTITIAAAIDPTSEMSQRWLPILKALSELDGVKLKLFMNPREEIRELPIKRFYRYVLDSQPSFGDDGSVLRPTATFSGVPVEALLTLGMDVPPYWLVAPKDSLHDLDNIKLSSVKAGSNVDAIYALEHILIEGHSRDLTTKSAPRGVQLVLGTEENPYSADTIIMANLGYFQFKAQPGLWTINLKPGRSEQIFNLESLGRLGYSPQAGDDSNEVALLSFQGKTLFPRLSRKKGQENQDVLESGPKPGSAKDFMSKGLNFASNVLSSAGLTSKGSEANADINIFSVASGHLYERMLNIMMVSVMKNTKSTVKFWFIEQFLSPSFKSFLPHLAAEYGFQYEMVTYKWPHWLRAQKEKQREIWGYKILFLDVLFPLSLDKVIFVDADQIVRTDMTDLVNYPLDGAPYAFTPMCDSREEMEGFRFWKQGYWKNFLRGSPYHISALYVVDLNRFRAVAAGDRLRGQYQMLSADPNSLSNLDQDLPNHMQHHIPIKRLPQEWLWCETWCSDDSLSQARTIDLCNNPLTKEPKLERARRQVPEWTEYDDEIAALAERVQGSEVEVEVEEQILADEIEREREEAKEEHAEWKKDEL

SEQ ID NO: 4228 - protein, 916 aa, Phaethon lepturus
RIGFVFILSTKEEIDGKEDAGIALWRTFNYIAEESDTSQAFTSIINMYHEVKDGTVLTVNHVKDVLRSEYPHADVQSILGVHSEYDEGRKAGATFYKKTGLGPLPQALFNGVPFNREEMDAAELETVILQRIIDATGFFQRAVFMSLLNDHVNAMDFLMDQHNVVSRIKPTILGAERRYIHFRSTSVPFDVEDFSTFSFLDSQDKSAVISDNMKYLTKKGEDALYAVTIWIIADFDKPAGRRLLSNALKHLKTSSHARVGILNNPSSKIKEDNTAIARGILTAFLTQNNSNLKSFLSKLTKEETAKSLAAGTKITKFLIPGMDDNTFEKKYNTLGLDLIKTQQMFCQEVLKLLPGQMAVMSNGRVLGPLDENEFYADDFNLLEKITYSTSAEKIKAIVKEMGNNSKSGSDLIMKIDALLSSLPKTEMRQDAELLNEQHSVVKVDPQQNEPFYDVIAIVDPLTREAQKMAHLLIVLKDIINVKLRLFLNCRSKLSEVPLKSFYRFVLEPELTYGINKHLPSEPVAKFLELPESPLLTLNMVTPESWLVEAVNSSCDLDNIHLQDMKETVIAEYELEYILLEGHCFDVTTGQPPRGLQFTLGTKNNPVMVDTIVMANLGYFQLKANPGAWTLRLRKGRSEEIYQVFSHEGTDSVADLTDVIVVLNNFRSKIIKVQVQKKPDKINEDLLTDGRTGKKGNQVSVTRFSEEIPTEEKEKKSDILNIFSVASGHLYERFLRIMMLSVLRHTKTPVKFWFLKNYLSPTFKDVIPHMAKKYDFKYELVQYKWPRWLYQQTEKQRIIWGYKILFLDVLFPLAVDKIIFVDADQIVRSDLKELRDLDLNGAPYGYTPFCDSRKEMDGYRFWKSGYWASHLGKRKYHISALYVVDLKKFRKIAAGDRLRGQYQALSQDPNSLSNLDQ

SEQ ID NO: 4229 - protein, 1538 aa, Cercospora zeina
MATRSWGNWKAAALASLLACSNALPSVNVAVRTAFGAPPFLVELLETAAEENNTAYFPLLDRIADGYFDSSTTDEQLYKAFRSLLQSDGHLGKEDLSSFDYALAIHSAAPRIEAHYQYYNTSVVPTISKKREGYAGCDTWVYVPFSGQKYCSPDLNEKSAESLGQPGASVKQLPFDRILGDVNSEKPSILYADLSSDSFRKFHKTLSQTAKDGKTSYRVRYRAFEGVETRPLTVSGYGVELALKRTDYIVIDDRQDGENVGKDEGKSAAETTLSEEEVSDLRPLSQSELRKLGVRAASFVMGSEDPFATLLRLSQDFPKHSTSIAATNISKAFIDEHAKNREVLLPAGYNVMWVNGVQVMPRDVEAYALLEHLRRERKMIKSVQQIGLGGSEAIELLSHEAIIEAQVEQDAPRYDWRDEAEGGDLIIWLNDLEKDKRYADWPKSANALLQRTFPGQLPPVRKEVHNLVLPVDFADFNDVLLVSEQLRSFVQRQVPIRMGLVPRVRSETSTEQTAIIYYLVHNYGLGTALKYLEQSLEAAGRKYHKPNEKIFQAVKAAGKLRPNKEDVALENVLNDKTLSDKVARSKKYISRIGSTDPTPPVLINGAPIARTEDWLQVMSQQVSVDLRAVQQAVYTGELGDDDYLPTLFLSKASFRRNPLVVPEDDKSLKFLNLGDHPELEDLPSIPADPKTIERELVHLTVVADLDSEQGFGQFMEAMLYKREHDNVEVAILHVPRDGDSKSRVISDLQKSGAEAVVEALMAQYDTLRAGDDDLEARGKISEVLRLAASRDTTPELDEAVRKRWAQFSRLITAIGVTPGKKALLANGRVVGPVSDDVPIEASDIEALLTYERTRRLLPASLAIEALGLQKKASTPLAFARISNLIALSLISDVPEGIFEAAPTVRTDIFRKFESNHTAINIGHLDTATIQIYAAVDPASEAAQKWIPIIKILSEFDGVHVRLFLNPRDRLEEIPIKRFYRHVLSSKPAFEADGSLAPTGAQFRGLPADALLNMGMDLPPAWLVAPEVTVHDLDNIKLSAVKNDIEAVYQLEHILIEGHSRDVTVGPPPRGAQLVLGTDADPHFADTIIMANLGYFQFKANPGVYSLAMQKGRSEEIFHIDSAGASGYDQQGSDNSTEIALMSFKGATLFPRISRKPGMEEEDVLEPSKSALETLADGAGDLLAHVGLGDGAQKFLGKAAKLGSGLLSKSGSATNAPERKHAEINIFSVASGHLYERMLNIMMVSVMKHTKHSVKFWFVEQFLSPSFKDFLPVMAETYGFEYEMVTYKWPHWLRGQKEKQREIWGYKILFLDVLFPLDLDKVIFVDADQIVRTDMYELVQHDLQGAPYGFTPMCDSRTEMEGFRFWKQGYWKNFLKGLPYHISALYVVDLKRFRQMAAGDRLRQNYHQLSADPNSLSNLDQDLPNHMQALLPIHSLPQEWLWCETWCSDESLKDAKTIDLCNNPQTKEPKLERARRQVPEWNEYDEEVGGFAKRWREEKRKGVGSEGLEGESMQERLQREDAEREERERERGKGKRDEL

SEQ ID NO: 4230 - protein, 1499 aa, Emmonsia crescens
MTSRYHPFPWRLGGLALLAAASLFTSNASASPSVNVALSASFNAAPYLVELLETAAEENSTSYFPLLDRIAEGAFAEITTERDLYERFTQLLQDDGHLTNPESISSFKFALSIRSTAPRIEAHYQYYNTSVEPSLMVAQDAVCTVWAHYDGDQYCSPRLEYAQQSVSGDQHDRVLPFDRVLGDSSLPPLVLYADVASPLFGGFHQELMQKVRDGQFSYRIRYRPSGPETSRPLFVNGYGVELALKRTDYIVIDDRDAEQRVLKDTDAAKPTLTPVEDLKEEPPADLKPLSASEVSTLGMNAASFVMSSDDPFATLLRLTQDFPRHSSAIASRNATPEFTKEFEENRASLLPVGYNLMWINGLHMDPRAIDAFSLLDHFRRERKLINGLRDFGLSARQAVDLLSDPAIAKIQAADDSQRYDYRDELEGGGVIIWLNDIEKDHRYDGWPSDLRSLLKPTYHGQLPTVRRDIHNVVIPVDLTSPVDVGIVVETLQMLVRRKIPVRFGIVPLVHNPNALEQAKVVHHLFDTYGIGASIAYLQASLSTEKVASPDQVSFTAALENRKVREDRTPLAFENVLKSENYDPILSGTKSYLKRLAVEGETTPFFVNGVSFMRDGGFLQNIVTTVSKDLEDIQRRVYEGTLEEDIWVPSHFLQGALQSRNPLLIPEDPSEIRTVDLNEICAKHNDIFDTVLRIPATAESDHPLLDWSSIILIADLNSDAGAKQLGYLLELHEKHPGIEVLLLHNGEGSSTSKDLSTRLYSARNGRDIDPAVAIAALASGIDEPASDSAGASAYWNTVQSLVKEIGIGTSENGMVVNSRMLGPVPSATVFDAQDLEQLRTYEHSKGIGVFARKAFELGLESKIPDPLSLAKLQALISLSAMSDIPEAIYDSGPRLRTNRFEKWSSTHSAISVSNSDDPSIYIVATIDPTTEIAQRWVPILKVLSELSGVSLKLFLNPREQIKELPIKRFYRHVLEAAPSFNEDGSIAKPQAIFHGIPREALLNLGMDVPHSWLVAPKESIHDLDNLKLSSLKEGTNVDAIYELEHILIEGHSQDVTLNAPPKGVQLLLGTEKNPHFADTIIMANLGYFQFKAQPGCWKITLKPGQSERIFHLDSVGGQGYSPTPGDENNDVALLSFQGKTLFPRLSRRPGHETDDVLDAGHKPASAKDYLSKGLNFASSVLHSLTGPSKETHADINIFSVASGHLYERMLNIMMVSVMKHTKHSVKFWFIEQFLSPSFKSFLPHLAAEYGFSYEMVTYKWPRWLRAQTEKQRTIWGYKILFLDVLFPLSLDKVIFVDADQIVRTDMYELVTLDLEGAPYGFTPMCDSRTSMEGFRFWKQGYWEKFLRGLPYHISALYVVDLNRFRAIAAGDRLRGQYHSLSADPGSLSNLDQDLPNNMQRELPIKSLPQDWLWCETWCSDEALETAKTIDLCNNPLTKEPKLERARRQVPEWTVYDEEIAAVQRRVLEEEGNIKAEDEEGDDDGRGKGKGNKKELRKDEL

SEQ ID NO: 4231 - protein, 1597 aa, Fomitopsis rosea
MPGVLPSRSNYGLHGRHRHHFLSQCEYRTRTLVLAPSKVYVRESIALEEPEAFLPLLDALTNPQTQPDPVPTSSEAAHKYAFDTALASGFLAGPGEYASAEMNLALHAATPKIEAFYQFYTDRLSSRKEALNIPNCESWVDWYGQVVCDAESLARLATVDTIDTLNSTDVDRSYTPPKLMSFDHIYPSPASTLERPPRTAILYASLSSDNFRELHSVLYALSRAPTPRLEYVLRPIPPIGGDVSPRSYLSGYGVALDLKKMDYLALDDRTQGLSKHADDADEAATSVQATDPVMALIHRYPENTTTDASAPLTEDELLEIDFQAAQIIRDADEPLLILKQLAQNFPRYATSLARQVTVSAALAEEVENNQAVARGGTNVAWLNGVQLSEKDMNPFALLRLLKKERGIMRSLTSLGLSTAQALELLTHPKINAAQGASDVLDGIVDASDRQEGGGVIQWWNDLEKDSRYGRWAGTLNVFLRPMYPGQFPNYRGNLFNIVIVADLSQTSSLHFLGTTVSNILGRSFPFRWGIVPIAESEEATKVARLVYFLMERVGNANTMEFIRHISQADRPVEKTTTTVDWALVRTAFSSFRASSQDHAETPMPELDKILNGETEGLDESIQKARAYATRLGATVSSAPHGHAFVNGKHFELDDQFLQFMQVELREEMRYVQEQLMLGALTDATAGDVSTYFYDVPGVSKRRNPYIYPSSKAGGLRISNLFDSVLKLGFPSAQESFVYPSDVQQVPLTTYIVADLDSDSGQSLVRETLAATGAEFPSRISFIHNPAVGSIEPVIRPQVSSLFAQLIVHGLLERASPSPRKKVISPEGALDEILGKTELKDSEYREYVKVSRLVAREFGLAPGEQGLVVNGRIIGPVAVGEFVAQDFPVLSTYELRKRVQPVVDALHDVAVSLQEYDRASYAEVVSLASSLISAIELPDPSEVGLLNVPHKSRQLKYRLLDTEYTAFTLGDNSTASYHFGILLDPLSEAAQKWSSLMHWLLEIPGVTIELHLNPAKYGELPLKRFYRYNLYPRLTFDESGKEVHVQTVFTGLPIDPIYTLAMDVPQSWLVRPRESLHDLDNILLAGLSPQGRLQGVKAVFDLDYLVVEGHARDMFIGGPPRGLQLQLASNSGDPIADTLVVANLGYLQFRTKPGVFRLEIRPGRGRDIFKMESVGNEGWHSPSVDESGDEITLTSFEGLILYPRLVRLPGMERADALAEVSSAGTSPIGLLDTVISRITSLFGGQKTQEVTSIENKQADINIFTVASGLLYERFASIMILSVLRNTNHSVKFWFIENFLSPSFLEFLPHFSEAYGFQYELVTYKWPSWLRAQKEKQRIIWAYKILFLDVLFPMDLKKVIFVDADQIVRTDLKELVDIDLHGAPYGYTPMGDDNVEMEGFRFWKTGYWKEFLKGLSYHISALYVVDLVRFRQLGAGDILRGHYQQLSADPNSLANLDQDLPNNLQRDVPIFSLPEDWLWCETWCSKDRLHRAKTIDLCQNPLTVRYIITSNDAPSDLYIPQKEPKLSRARQIPEWEEYDAEIARFARSLAEEGKMLSGIVAADVNVLAEAGSNKPKPELPAEDMAMESGAGEGAPRDEL

SEQ ID NO: 4232 - protein, 1544 aa, Exaiptasia pallida
  MOD_RES (130)..(130): Any amino acid
  MOD_RES (221)..(221): Any amino acid
  MOD_RES (640)..(640): Any amino acid
  MOD_RES (768)..(768): Any amino acid
  MOD_RES (784)..(784): Any amino acid
  MOD_RES (832)..(832): Any amino acid
  MOD_RES (863)..(863): Any amino acid
  MOD_RES (1010)..(1010): Any amino acid
  MOD_RES (1303)..(1303): Any amino acid
MAARKEAFDFYKVAHVTIVLVCCVMYVNSESKPVTALLDARWSWTPLALEASEFLARESNEKFWKFVELSKNSHTLTSDLDNYQFILKNAGKLLSPLGLKLLKFSLSIRNFSPRIELYNKLSRDVPNTSXCSSFIQVGPKVTCDLQEAKTLIENNNNLSIPQIYDFDHHYPNSQDNPLTVVLYGQIGTPSFHSFHEVLVKLSTSGDVHYVLRHYVKTPSKXKVRLSGYGVELAVKKTEYKAVDDTKVKEDSPGTMGKNKQEEEDEVEGFLFGKLRKLYPHLKEQLNQFKAHLKESSREMAPLKVWQLQDLSFQAAQRVLSSDPKSALRVLRDLSQNVPRLARSLVKTRVKSEVREEILSNQKIFTKIGMEAGDSVLFINGRSVDIEDMNPFEIMDLLRDEISTLDKLSTLGVSGETLAKLSGLSVSDDHDSYILDTRDNSVVFLNDLESDREYSGWPSHIQEILRPTFPGMMRYIARNIFHVVFFVDPMDKMSLELLKTADEFLQASMPARVGIVMVAEGSSDVDARKNNAAVAIARAFHFIKNEKDSRQALQLILQVYNKVKSHTDEDLTKGVYDMLVSWFGTDDANDVLGPGSEHDDGRKEWKRFFDRTGLQKVPRVIVNGVPLKEEEHEMIEDAVVXQILLQTGSIQQAVFMGQLHQYSDIYDHVMSKPNVVKRMNNVIQSPEVKVIDLTGQTDMTDVSDYNNFKKLDSAQMTSVLQADMKYFTKKDEEMNLKSVTNWLVVDLASEQGRNIIRDALKQVQSSLNXRVGIIHNPQTTSEPAXKLYMARAVEAVLQSKDHVTPSILEFLEKLLDNKNDFEKLDGDLDEMMXLVKSVKNLKLKVIETKLQSQSSRERVLSHQXFCKTALNFKPGEIGVVANGRILGPLKESEVFITEDFQLLEDFELSSYGKQIKELVDKTVFTGVSADDDTSDFRSNIIMKISSILTARVKKSRIHIPEIESQHSVAHIKSDSQASLDVTLILDPLSKAAQKAAPFLMVLQNVTNLNIXIYMNCREKLSEFPLNRFYQYVMEPELTFSANGKLEPGPYAHFVDLPQSPILTMAMDTPLGWMVEAVRSPYDLDNICLREVSQGVSADFELEYIFIEGHCVDSTSGQPPRGLQFTLGTKSEPDKFDTIVMANLGYFQLKAFPGSWILRLRDGRSADIYEIDSVTGGVQQDENHTYTIFVDSFLGKLMKVKVKRRPGKEGVDLLGDRDDEDKDSGGLWDSLSNMVRSEKKKETKEEEKIINVFSLASGHLYERFMRIMMLSVLKHTKSKVKFWFLKNYLSPTFKAFLPKMAEEYXFEYELVQYQWPRWLHAQTEKQRIIWGYKILFLDVLFPLHVKRILFVDADLIVRADLQELMDMDLEGAPYAYTPFCDSRTEMEGFRFWKHGYWRSHLGYRSYHISALYAIDLKRFRRLAAGDRLRGQYQGLSQDPNSLSNLDQDLPNNMIHQVPIKSLPQEWLWCETWCDDYSLKNAKTIDLCNNPQTKEPKLNSAVRIVKEWPEYDEEIRRLQNKLAANESQKTTTDVPMTDSSQPGKEEL

SEQ ID NO: 4233 - protein, 1590 aa, Wolfiporia cocos
MWSCLLAYSAATLLNAYVSYGIAPPVGVELRSSWPPPPRLLEYIESISIEDSGSFFPLLDVLTNPGTLPDPIPSTDEALLQHVLETAVTQGYLAESGSYATAEMNMALHSASPKIEAFFQFYSDRHAARRSQELSENCGSWVDWYGQVVCDAESLARFASIETIDLPESRGLNDTFVHPRLMPFDHIHPSPAQRLDYPPRTAVLYASLSSSNFRELHSYLYAASSALNPHLEYVFRPIPDEDRDTSKRMHLTGYGVALDLKKMDYLALDDRQQDAKEEGSLVEDAASPASGIDSIMTLLQQYPEHTTADLSAPLSEDELQVLGLQAAQLIHASENPLTTLKHLSQDFPKYATILARRVTVDPALAEEVENNQARAAPGVGIVWLNGMVLQEKDLNPYTLLGLLRKERRTMLSLTSLGLTPGQALDLLTHPSISMAQSESDVLDGVVDASDRPEGGDVIVWWNDFEKDARYQRWARSLSLFLRPMYPGQFPSVRANVFNIVLVLDLSQSSSVHFLSVTVANILTRSFPFRWGIVPIVETEEGARMARLFYYLMEHFDRTKTMAFLKNISQADRPAESLKPTVDWGLVRAAFNYLLANSDPLDESIPTDLDEILAENEHTNVVLDKARTYAERLGASLLAASQGHAFVNGKHFDLDDAFLRAMQMELAEQMGHLQEQIATGQFNDIDIIPTYFYDLPGTAKRRNRHIYPSGKAEGLVIYNLLDLVGQSKFPTWPGSFVYPSEPIEAPLTTYIVTDIDSEAGQLLIREVLSAVNTNYPSRISFIHNPSEAPITRSQTRPQVSSLVAQLISKGLLHRASPSRLLRLLGFGDVAAPKQSPQTVISAEDSLDDILSGTVLTDAEYDEFVTASRLIAREVGLAPGDQAVVVNGRVVGPILPGEFLADDFTVLYLYELRKRIQPVADALNSIMDSFNDYDRESRSDTVSIASSIVSAIQIPDPSEVGFFNTPQKPRQRKYQLLESEYTGYTFGDNNTAVIQFGILVDPLSESAQKWSALTEWLLNIPGVSVELHLNPPKYIEIPLKRFYRYNLQPRPTFLENGQPFEIKTEFASLPIEPIYTLAMDVPQSWLVRPREALHDLDNILLNALSARDRTQGIRATFDLDYLVVEGHARDTLTNAPPRGVQLQLSDNSGTPIADTQVVANLGYLQFRTKPGVFKLEIRPGRGREIFKMESVGNEGWNSPAVDDVGDEITLTSFEGLTLYPRLSRRPGMERGDVLAEVAAVKPTSGGFFDEIVSRITSLLSSEPSTDLAVASNNQADINIFTVASGLLYERFASIMILSVLRNTKSTVKFWFIENFLSPSFLEFIPHFAEAYGFQYELVTYKWPSWLRAQKEKQRIIWAYKILFLDVLFPMDLKKVIFVDADQIVRTDLKELVDLDLHGAPYGYTPMGDDNTEMEGFRFWKTGYWKEFLRGLPYHISALYVVDLVRFRQMAAGDILRGHYQQLSADPNSLANLDQDLPNNLQRDVPIFSLPEDWLWCETWCSKDRLHRAKTIDLCQNPLTKEPKLVRARQIPEWEEYDAEIARFARKLAEEGKMRSEIVAADVNVLADVGKASSASGAAPEAHGEVEHTRDEL

SEQ ID NO: 4234 - protein, 1532 aa, Elsinoe australis
MKPANIGQIGHVLALAAALLLVPVHSAPTVDVSLQAAFDAPPFLVELLETAAGENATSYHPLLDRVAEGHFDTAKTDKELYELFLSTLQDDGHITDSESLSSFKLALSVHSAAPRVEAHYQYYNTTARYRGSKECDTWVVFDSKKYCTPDLASEATESVSSSSVSHSLPFDRVLGDDKATSSILYADITSSNFRKFHKTISLTAKSGKTSYRVRHKPAVSGARKPLSVSGYGVELALKRTDYIVIDDRQAAEGAKKETAEKGQAVLADDEVADLKPLSSSELVDLGLKAASFVMASEDKFGTLLKLAQDFPKHSKALSTTEISEQIKNELSDNAQSFLPPGYNAMWINGRQTLDRDLDAFSLLEQLRSERKLINSAKSLGLTGDETIKLIGHADVSGSSGADGGMPDVQRYDWRDDIEENNVIIWMNNIEKDKRYLEWPDNVQAFLQRMFPGQLPAVRKDLNNVVLPVDFSNKTDVELILENLQNYVKRKVPIRFGLVPITISTEAEQYAKVILSLTDTYGLAAALHFLELSFPDMGKKAKAPVQSYYEAAIKEKTLRKERQPVSFQDARDSDMTVSRIELTRSYLKRLGAAGSSPPYIANGVPIPRGEAWMALMSNQVSMDTRMVQQAIYMGKLDDSSYLPSMFLENATPRRNPFIIPEDEKDIKLLTLSNIPELKDGLLGSIPSVPASEETVEAELVQLVVVANFDTEEGNKLFQEAVKFRGEHDSVELFFAASGPAKKGGFSERLHGSLTSTAPTLQILQGLEWNATPADGQEQSSISVQDFWGSASSFLNALGLPSGTSALVLNGRVVGPVPQGASVDADDMDMLLAYERKKRLLGVGKALKALDLLPKASKPYSFARLSNLVALSQISDVPEGIFEGPPSTRMSIFEQLKGEFTGITLGDSVTSSVQVVLALDPASEVAQHWLPVIRVLSELTGVYVKLFLNPKERLEELPVKRFYRHVLQSAPSFDASGSLADQSAHFTGLPADALLNIGMDLPSAWLVSPKDSVHDLDNLRLSSLKSDQVKAIYQLDHILIEGHSQDATAGSAPRGAQLILGTGKDEHFADTIIMANLGYFQFKANPGFYNLSLQQGRSQEIFHIDSAGLGGYNAQTGDSATEIALTSFRGTTLFPRLSRKAGMEEEDVLEPSKSTLEKTVDSLADAAGNVLNAIGMDKKGAGDWLSKATQKVASLSNGGVGSKAVSTLPHADINIFSVASGHLYERMLNIMMVSVMKHTSHTVKFWFIEQFLSPSFKAFLPILAEEYGFRYEMVTYKWPHWLRSQKEKQREIWGYKILFLDVLFPLDLDKVIFVDADQIVRTDMYELVQYDLKGAPYGFTPMCDSRTEMEGYRFWKQGYWKSFLRGLPYHISALYVVDLVKFRQMAAGDRLRQQYHQLSADPQSLSNLDQDLPNHLQHVLPIHSLPQEWLWCETWCSDESQGVAKTIDLCNNPETKEPKLERAKRQVPEWTVYDGEIASLAKRKQGEEAVVPGLGQGKGEQERLQAEEYQRKKEEEEKKVRLEKEKGNKPRDEL

SEQ ID NO: 4235 - protein, 1733 aa, Spathaspora sp.
MVQKGRGSYENSVKRPPKPSPVSNIAQIASLTRYPDKDYAVSILHEVAKAVAPIIHENNFKVGTLCEMFPKNPNLLGLNVNGGQKILLRLRHSFNDRSFLPTSDIIETFLHELTHNLHSAHDKKFYDFLDGLKRRYEQIKYGGGSNSNYRCEEEKLGSKYSPLPNLVSVREKRIKELSKPKYKAEVRVLGSGSSSSGSTFTSGTSTPSKVRKPELEQKSIRQLILEAAERRQRDSKWCHSETVEKEEVPDDNELDIIEIHDDEDEVSQTKEISEVVDLTGEEHDESTTTAEQEVVVIDGVTVQLEAGWNSTTFLISLIEAISGYDESLYIPTIETIFNLAEDDDEDFELYDATHHQIYFRVISRIGVNEESTSFINFNLVNKIYTPRVASHYDYYSAKVLPLLGSRLQLECARDSFGNEVERDSEGKLPAWLLYNNKFYCSSSDLFALQTDNSKSDEEVLKFDRVIGDNAEAPLLILYGNPDSPITKEFFIPLYNDAKAGKIRFVWRYIPGNTKQPESLSGYGVEVNLRNQDYFKEEKVRGRSKLDITKDFNKINESKELLTVSKDRLDDKLGLKFTSFVLSSTDKYQILKTMLNNFPKFLHHIANIPKLLNYESVKASVYANEDLGISQDSYGFYINGSPIHPLELDVLNLHSKLQTELKIIKNLVKLGFSTIQSKLLITKFALLSAVKQTQFRTGNTLMGNNENRFRVFENKFTKSSKGGVVFFNDIENDVTYDTYSTDRQDTYLGPSSFKLKSNQIPPLKENIHDLIFAMNLANKNQLKVFFTLSKVILDSGIPQQVGIIPIIGDDDAIMDKRLADGFYFLVEHASSKEALAFVYKYFESSEEEFNELLKLIPNHKLSYDYETVLNKFSIEKASVIFNGVINDLTSTNWQINMGKQLSQDINWIKTQLKQGNNIRSLKDLIYSNAKTQRNLRIVPLEPSEILYKPIDQELQAKSILFRSMDKSNEVGYTYWLFSSFNEDIIIEQLISLLEMVKQRKEDIQVRVVNTSTTFKLLEQLSKNFRLNMLTNSQIDQIIEELKKVELSQVNLDSELVKFLEKKSIPVNHSFMLVNSRYFRLDDPFNLSELNQIAEFEHSQRLKLFNDILQTYPDQYNHKSLNEFGSGNLVNDPSDWFDLVCSTVTKSFHVDDKLFIVDVNRFDFASLDMSNAIEPQEKRGTTELDVLVILDPLSETSQKMVSILESIQDFPFVSIKILVQPKVNSEFNIHRFYKGVYPGSTPKFNEQGNWINKYAAEVGALPSDQNVSIDLDMVNRWHVTSKSISNDGIDIHNMKVSSEQGITVKFELSSIIHEGYARDIHTGMSPQGLSFNLVKDDITSDTLVMSTLNYFQIRTNVPGVWKLSLSQEKFNLLSASENKFDANSSPLEYAEIPVFSLKGLTLYPRVVTKADNTTNVSKPTTQKADINVFSIAGGGEYERLLGIMIASVRKQNTNKSVKFWLLDNYMSPQFKRLLPILAKQYNVEYELITYKWPNWLRKQKEKRRTIWGYKILFLDVLFPQDLDKIIFIDADQICRTDLTELINIDLEGAPYGFTPMCDSREEMEGFRFWKQGYWSKVLKEDLKYHISALFVVDLKKFREIHAGDRLRSHYQKLSSDPTSLSNLDQDLPNNLQRSIKIFSLPQEWLWCETWCSNESLSSAKMIDLCNNPLTKENKFDIAKRLMPEWNDYNNEILELYKEASVVQTEPEEDDTSAEKPPLSQEEQENEDDSDYHDEL

SEQ ID NO: 4236 - protein, 1556 aa, Phlebiopsis gigantea
MVLQRLVGPLLLVTSGILASSPPVQVELRTSWAPPPFLVELLETIAIEEPQSFFPLLEAFTDPEFSPLAQSKTDEEIYRNARQYALSAGYLSEPGELASLDMTLALHSSVPRVEAAYEYYLGSHAERDITCESWVDWYGHAVCDLEMLRALVGAETIEPSVEAFANRLPFDHVQPSPELVLDRPSRTAILYASLTSPNFRELHAYLHQASSGPAPHVEYVLRYVPPSGHIDSQERTYLSGYGVGLDLKKMEYLAVDDRRQGSNFDSSSSESFSADVYDSDPISTLLQQYPDDPTVDYTTPLTDDELLNIGLQAAQLAVDAPDALTTIRQLAQNFPRYASAIARRVVVSETVEEEIANNQAKAQGGISVVWLNGAQLSEADMNPFSLLGILRKERRIMRHITSLGLNATKAMELLTHPAVGLAQSDSGVLDGIFDASDRLEGGDVVLWWNDLENDTRYARWSPSLLSLRNLMLYPGQLPSLRLNMYNVVLVLDLSQTSALNFIAGAVAPLISRGFPFRFGLVPAVETADGAKMARLVYWLYAHVGRDRTLQFLTHVSAPESTAVEWSLIAREFLELTQHADAGPIEPKPDFHAIINAQDDATADSAPQKAALYAKRLAADLASAPLGHVFVNGKHFELNDDTVRNMQIVGGQMLQHLQEQMHYGHLSEADAPRMDTYFYDLPEASARRNRYIYPTGKTGDLRIVNWLEVPETAGVLYDNRAFVYPPTEEVTTLTVFVVADLDSEEGLELAKETLKSMTETSVTRVSFIHNPSTSTPPTTTTFSSLLGTLITKGTLSGQSEQVIVSSAATLEELLDGAPLIVPDEFISASRYLLRALRVAPGETVLVVNGRVVGPIEQGGIVAADIPSLATYELRKRVTPVVTALNDVVGPLEGYEPAELSDMIFLASSLLSSIHQPDPSEVGLFNAPIRPRRRNYKMLSGESTTFEYGDESTALFHFGVLLDPLSEAAQKWTALLEWVLNDPAVFVELHVNPARYKELPLKRFYRYNVQPSLRFTELGYEYKSKVVFNDLPEDPIYTLAMDIPPSWLVRPREASYDLDNILLTGLSASERTTGVRAVFDLDYLVIEGHAREDRTMSPPRGLQLQLVSGDGTAIADTLVVANLGYLQFRAKPGVFRLEIRPGRGREIFALESVGSEGWESATVEEAGDEVTLMSFEGLTLYPRMARLPGMDVVDVLADDTPSEDHSLVGKLKTSFSSIFSPKTTKETDVIPTNNQAEINIFTVASGLLYERFASIMILSVLRNTKSTVKFWFIENFLSPSFLEFIPHFAEAYGFQYEFVTYKWPSWLRQQKEKQRIIWAYKILFLDILFPMDLKKVIFVDADQIVRADLRELVALDLHGAPYGYTPMGDDNVEMEGFRFWKTGYWKDFLQGMPYHISALYVVDLVRFRQIAAGDILRGHYQQLSADPGSLANLDQDLPNNLQREVPIFSLPEDWLWCETWCIKDRLDRAKTIDLCQNPLTKEPKLARAKHIPEWEEYDSEIAQFARKLAESGLIHAGMADADATVLADVGAGRRVAADADAQESTEDFVTPGHILDEL

SEQ ID NO: 4237 - protein, 1517 aa, Saprolegnia diclina
MSSGCARRWLAAAMALVLAMTVAGSRKVEVDLTTTYLSSPVYPVLETSAFLAEVDPSLFFRYVDAIDMRAKAIQHIDSINYTTLALDAAHDVLPPDATIAKLLPFVLQTRAQSPKIEMFHQLAIESAYKGCGLAYEAASAWAVVYHETGCAARVICAASNWNDALLTPSTDASCAASGEHDFELPVDHVFDKDVADAPTVLLYGTLGTSSLRAFHAKLAPLAEAKTIRYIVRHAPHNNVLPVHLQGYGVSLHIKNMEYKSFDDSKTPHSKHTPTDDDEDAFIVSVLMKKGAETGPALRAYQLEFEDFSSVNATENNEDAPWQLNHLGYLAASDILASTDPLARLQQLSQNFPKYAAGLALTTELIPSERVAAMATARRTVATQNLLNKLVVNGMPHDLSDVTFNPFDFVKLLAGEVQQGDALRALELDDPTLAAVHSAMTTLSTQAAEVRVRVRGPVDGTAPLYLNAIESDEATAEWPTDLSVLSEPAWNLIFLRRVMYEVIVVLDPTTKQAANVLQQIQFLILRGAPVQFGVLWTSPELLALAPEDRETYVPATDDKAPATAYHVSKLYLAARDHGHAAAKQFLDGIVELAGGVTVKEALLIYVQAVTHRLDRGSALEAARDLLLSASQDDSVWAMTDVVLASQLPLDSYVFNGVLRRDLNLQEGLMAHFGRDQPLYQELARAGKFADDADLLDELFAHEGHYPLYSSWLDASEQVPVLDLHLTSSVWDDVKYLHMPHTATKPKRQSLLLMVDLDTPAGARSAYNALKTTMETPDVRLSLVHLGTSPSSIGSRVSYMLHAISDVDDARYLAILLEIVRFLSKAKSEADIVLHAKLLVQTHLDASPEEARLRDLLRWLDETPAYTHPLPSLLSITTPTLLINGRPLSLDDDQTLLPSLLSVLLQWEGENRSKAVARAFFAPTKHDALSVAAAAHVSQRLQSLLAVVDAYLATPRTGPVFSTLDQHTTFATSAASRSLLDVVAYLDPLSEASQRASVVLRMMRDVLGAKITLVLTPTPSYAEFPLKRFYRYAWGSAPVFRVLPRPPVLTMNVETPELFNVQMVASDTDIDNIQGDATAMYAVQSLLVYGQCIDRTMAYHPSPPNGLQLVLERTAGADVLHRDTVVMKNLGYFQLQATPGVWRLELAKGRASELYEMVDQAATDHARVIVYDFSSAITQLDVKKRRGYEYARLLEEPEDLPAAKKEEDAATQSYWKSLVSWGTKQPVKDVVAARSGETIHVFSVATGHLYERMLKLMMLSVLKRTNNPVTFWLLENFLSPDFKKSVPALQAEFGMDIRLVTYKWPNWLRRQTEKQRIIWGYKILFLDVLFPLGVQKIIYVDADQVVRADLKELWHMDLHGKPYAYTPFCDSRNVGFQFWRQGYWKDHLRGKPYHISALYVVDLVKFRRMAAGDTLRAVYDQLSADPNSLSNLDQDLPNYAQHQIPIHSLPQEWLWCESWCSDESKASAKTIDLCNNPKHKEPKLDMAKRVISGEYFKESWLELDDQVKAAEAAYTARHS

SEQ ID NO: 4238 - protein, 1656 aa, Solanum tuberosum
MNRKHHCIHQDSRMGTRFRFGFWVVIAVAFSICLSGYSVSAVNSKPKNVQVALRAKWSGTPILLEAGELLSKESKDHFWDFIELWLHSADENSDCRTAKDCLKRIIKYGRSLLSESLIAMFEFSLTLRSASPRIVLYRQLAEESLSSFPLTDDDISSSPDEGVFQQSDNAKNKKVNPLLVGENPRSPEGNCCWVDTGGRLFFDVAELLVWLQNPKEVSLDTLHPEIFEFDHVHPDSNVGNPVAILYGALGTHCFEQFHHTLASAAREGKIYYVVRPVLPSGCESKSTPCGALGTRDSLNLGGYGVELALKNMEYKAMDDSTVKKGVTLEDPHTEDLSQEVRGFIFSRILERKQELTSEIMAFRDYLLSSTVSDTLDVWELKDLGHQTAQRIVHAADPLQSMQEINQNFPSVVSSLSRMKLNESIKEEIVTNQRMIPPGKSLMALNGALVNFEDIDLYLLVDMVHRELSLADQYSKMKIPVSTVRKLLSALPPSESSTFRVDFRSDHVHYLNNLEVDEMYKRWRSNLNEILMPVYPGQMRYIRKNIFHAVYVLDPSSICGLETIDAIVSMFENHIPIRFGVILYSAKLIEEIESSGGQLSLSYKEKDSPNQEELSSLIIRLFIYIKENRGIATAFQFLSNVNKLRIESAAEDPPEVHHVEGAFVETLLPQAKTPPQETLLKLEKEHTFKELSEESSLFVFKLGLAKRQCCLLFNGLVHEPTEDALMNAMNDELPKIQEHVYFGHINSHTDILDKFLSENGVQRYNPQIIAEGKVKPRFVSLSALILADNSFFNEISYLHSTETIDDLKPVTHLLAVNMASEKGMRLLREGIHYLMAGTTTGRLGVLFNSIQDPHSPSILFMTVFQITASSYSHKKGTLQFLDQICLLYQHEYMHASSAGTENSEAFMDKVFELANSNGLSSKGLKSALSELSDEKLKMHLKKVGKFLFGEVGLEYGANAVITNGRVISLADSTTFLSHDLQLLESLEFKQRIKHIVEIIEEVEWENIDPDTLTSKFISDIIMSVSSSIAMRDRNSEGARFELLSAKYSAVVLENENSSIHIDAVIDPLSSSGQKLSSLLRLVSKSIRPSMRLVLNPMSSLVDLPLKNYYRYVIPTLDDFSSTDYTIYGPKAFFANMPPSKTLTMNLDVPEPWLVEPVVAVHDLDNMLLENLGETRTLQAVYELEALVLTGHCSEKDHEPPRGLQLILGTKSTPHLVDTLVMANLGYWQMKAFPGVWYLQLAPGRSSELYALKDDGDGGQETTLSKRIIIDDLRGKLVHMEVVKKKGKEHEKLLVSADDDSHSQEKKKGNQNSWNSNILKWASGFIGGSDQSKKSKNTPVEQVTGGRHGKTINIFSVASGHLYERFLKIMILSVLKNTRRPVKFWFIKNYLSPQFKDVIPHMAREYGFEYELITYKWPTWLHKQKEKQRIIWAYKILFLDVIFPLALEKVIFVDADQIVRTDMGELYDMDLKGRPLAYTPFCDNNREMDGYRFWKQGFWKEHLRGRPYHISALYVVDLLKFRETAAGDNLRVFYETLSKDPNSLSNLDQDLPNYAQHTVPIFSLPQEWLWCESWCGNATKPKAKTIDLCNNPMTKEPKLQGAKRIVAEWPELDYEARRVTAKILGEDFDPQDQAAPPAETQKTISDTPLEDEESKSEL

SEQ ID NO: 4239 - protein, 1538 aa, Denticeps clupeoides
MAAASQTGEWTMRNIFWLLLLLLDLQPVSASSKGVTASLKAKWSMTPLLLETSEFIGEDGEEKFWQFVDTVKELTVYKNGESVRSYYNLITKKAGQFLTDLQVRLLKLALSLRVYSPAVHAFQQIASDEPPPEACSAFISVHGQHACSTKDMKKLLKAAVGRPKPYLYKNDHKFPGVNSTDLPVVVLYAEIGTKKFNTFHKLLSERAGEGKLIYVLRHFVVESKPKKMHLSGYGVELAIKSTEYKAVDDTQVKDSKSAMNSEDDYEDEVQGFLFGQLKKSHPELQDQLDDLKKHLTESTNDMAPLKVWEMQDLSFQAADRILSAPKFDSLKLMRELSQNFPSKARSLTRVAVNREMRKEIEENQKRLGETMGLHPGDAGLFINGLHIDLDVHNPFSILDIIRAEAKVLEGLHHLGIKGEHVGKLLRLPVGPVEDNYALDIRHSAIMWINDIESDPTYKTWPSSLQELLRATFPGVIRQIRRNFFNLVLFLDPIQEDSFELVKLAELFYKHKIPLRIGFVFVVNTDDKVDGFLDPGVAFYRVLNYVIEEYDVSQAFMSMILMYNKVDVGETLSVETVTAFLKRKFPKANAGKILGLDSEYDDKRKAGGVFYRKTGLGPLPVALFNGVPLGSEEMDPDELETVLLQRIMDATNFFQRGVFMGHISDGVDVLDFLMEQPNVVPRINPLILSSSRNYLTLTASPVADDWEDSTMFSYMDLKDKTAVVSKRMKYIAKNADEEWVYGVTTWIIADIEKASGRRLLLSCLKHMRSSSGLRLGVVNNPSGKLTMESTLLYRALWASLLTQKSKETFGFIQKLLKEENIRLLHQGTKIKDLLVPGMDQDAFEKKHNTLELDFLRSQQLFCQEVLKLRAGQRAVVSNGRILGPFEEDEELSTEDFHLLEKITLSTSAEKIRGRVKQMGLKGDKASDLVMKVDALLTSAPKQEARKDVKLAKDKHSVLHLTPREDEVFFDVVAIVDPLSRETQKLSHLLIVLAQVVNMRLQVFMNCRAKLSEMPLKSFYRYVLEPDVTFLGNDTLSSGPVARFTDIPESPLLTLNMITPESWMVEAVRSPYDLDNIHLQEVSGVVAAEYELEYLLLEGHCFDLSTGQPPRGLQFTLGMSQDPLMQDTIVMANLGYFQLKANPGAWILRLRKGRSEEIYQIFAHDGTDSPADAADVIVVLNSFHSKIIKVRVQKRTDKLNEDLLSEATESKGLWDTITSVWSSLEKSFTGGSSSEDEDKKKEDVLNIFSVASGHLYERFLRIMMLSILQHTQTPVKFWFLKNYLSPSFKETIPHMAQAYGFQYELVQYKWPRWLHQQTEKQRIIWGYKILFLDVLFPLAVDKIIFVDADQIVRADLKELRDLDLEGAPYGYTPFCDSRKEMEGYRFWKTGYWATHLGHRKYHISALYVVDLKKFRKIAAGDRLRGQYQALSQDPNSLSNLDQDLPNNMIHQVAIKSLPQEWLWCETWCDDGSKKTAKTIDLCNNPKTKEPKLEAAVRIVSEWSRYDSEIKQFLRRVQDQKAKQPESQAAPSSKGNLRDEL

SEQ ID NO: 4240 - protein, 1534 aa, Sphaceloma murrayae
MKPLFGGRVGCIIVTGLGLLYSCARASPIVDVSLQASFAAPPLLVELLETAAGENSTAYFPLLDRVAEGHFDAARTDKSLYDVFLKTLTDDGHITDLESLSSFKLALSIHSAAPLVEAHYQYYNTTARRLGNKNCDAWVLYDGRVYCSPDLAVEAEIVSSSSAARSLPFDRILGDINSPPSILYADISSPEFRKFHRTISLTAKSGKTSYRVRHKPPSSGSRKPLGVSGYGVELALKRTDYIVIDDRQAAKNDKHTPAEKGQTVLADDEVADLKPLSSSELAELGMKAASFVMANDDKFATLLKLALDFPKHSSALSSTEVSDEIRNELSANAQSFLPPGYNAMWINGKQIQSRDLDVFSLLEQLRGERKLINSARDLGLTGAQTIGLITHSAVSDPSAAEGGSPDIQRYDWRDDIEGNGVIIWMNDIEKDKRYLDWPDNVQAFLQRMFPGQLPAVRKDLHNVVMPVDFSNKTDVELILENLQNYVKRKVPIRFGLVPIVLTPEAEQSAKVVLSLIDTYGLAAGLHFLELSFASLGKTPKSLTQSHFDEAIKEKPLRKDRNPIDFQQALNDESRLSQLELARSYLKRLGAAGASPPYIANGVPIVRNEEWMAGMSNRVSVDTRLVQQAIYMGKLDDSSYLPSMFLDGASPRRNALIIPEDEKDVKMLTLSEFPEIQDGFIGSIPGLPASEETIETELIQLIVAANFETEEGGALYRETVKFRSEHDNVEVFFVASVPGKQGSFTERLKDALTSRDLNIQVLEGLDWSMQAQNDSPEATVVVQDFWDSAKPVLTALNLPSDASAIVLNGRIVGPISPTATVDADDLDMLLDYERKKRLLPAGKALKALDLLPKVTRPYQFARLSNLVALSQVSDVPEGIFEGPPATRTSMYELLKGEFTGIEVGQSATASVQVIAAIDPASEVAQRWLPVINVLSELAGIHTKLFLNPRERIEELPIKRFYRHVLQSAPSFDGSGALQDQSAHFKGLPADALLTIGMDLPPAWLVSPRDSVHDLDNLRLSSLESNEVKATYQLDHILIEGHSRDTSAGSAPRGAQLILGTGQNERVADTIIMANLGYFQFKANPGFYNLSLQQGRSQEIFNIESAGLAGYKDASGDSATEIALTSFRGTTMFPRLSRHEGMEDEDVLEPSKSALEKTVDSLAGAASNMLNAIGMDKKSAGDWLAKATQKVASLSNGGTSSKDISTLPHADINIFSVASGHLYERMLNIMMLSVMKHTSHTVKFWFIEQFLSPSFKEFLPILAEEYGFRYEMVTYKWPHWLRSQKEKQREIWGYKILFLDVLFPLDLDKVIFVDADQIVRTDMYELVQYDLKGAPYAFTPMCDSRTEMEGFRFWKQGYWKSFLRGLPYHISALYVVDLAKFRQMAAGDRLRQQYHQLSADPESLSNLDQDLPNHMQHVLPIHSLPQEWLWCETWCSDESLGVAKTIDLCNNPQTKEPKLARAKRQVPEWTVYDEEIAAVAKRKKGEDASVPGLGQGKGEQERLQAEEYQKKIDEETAKAKAQQTEGDATDKPRDEL

SEQ ID NO: 4241 - protein, 1483 aa, Aspergillus nidulans
MLLRSGIVASWRLSCVVIATLLTARATSSPSVNVALQASFDSGPYLIELLETAAEENATSYFPLLDRIAEGAFDDYLTDKELFDRFLQVVVEDGHLSSPESVSSFKLSLSIRSASPRIAAHYQFYNTSVQHSLMAAQDAACPVWVHSDGKQYCSSAMERAQQDVEGDLDGRALPFDRILGPNSLPPVILYADVASPMFKDFHQTLSALAKEGEISYRVRYRPPQHWISRPLFVSGYGVELALKRTDYIVIDDRDAEQRGPNSIESAGTEEAPDDLKPLSSSEVARLGLNTVSYVANSEDPLNTLVKLSQDFPKYSATIAAYNASTQLHKEIKANRLGMLPPGASAIWINGIQIDPRQIDAFFLVDHLRRERKLIDSFRSLGLSAKQAVDLMTHETVTEATAQGTPQRYDYRDESEGGGVIIWLNDLEKDARYESWPNQLTAFLQRTFPGQLPAVRRDLNNIVFPVDLTRMDDVDLIVSTIQMFVKRKIPVRFGIVPLATSEGSIAQLKVAHYLQETFGLASLMTYLEQGLKRNKLAVPDKTCFLKATEDRTPRGEKQPLSLDDILTNEGLDTSVSRTGQYQNRLGIKAGDSLIFVNGIPVMRGENWPQEMSAKIERDLRLVQQGIAEGLFEEDAWLPSFFLSQTFGRRVPWIVPEDPKDIELVDLVKVAAQLGALLDKVPRVAAHVEPLESVHVVVVGDFGTRAGLKMLISTLEMQLKQDKTEILLVHNPEDPLTNAAASSLIYRSLKEGNGVDSTRILADITSSTSSDVDAQEASEFWLKFQPLVEALGLSSGMNGIIVNGRVIKPSQDVTAEDLGQLLLYEDINRIGPVTKAAKDLGLGSRIPDPLSFAKLTSLMAISTVSDVPEGLYETSSDVRVKFFEEWNESSSVITVPGPEDPVITISASLDPTSEMAQRWLPILKVISDLDGVRLRLFMNPRDELRELPIKRFYRYVLDAQPSFSQDGSVSRPTATFSGVPVEALLTLGMDVPPYWLVAPKESIHDLDNIKLSSVKGGSDVDAIYALEHILIEGHSRDITTKSPPRGVQLVLGTEDNPYFADTIVMANLGYFQFKAQPGLWTINLKPGRSEQIFNLESLGRLGYSPQAGDDSNEVALLSFQGKTLFPRLSRKRGYEDEDVLESGLKPGSAMDFMSKGLNFASNVLSSVGVTSKSSDPNADINIFSVASGHLYERMLNIMMVSVMKNTKHTVKFWFIEQFLSPSFKSFLPNLASEYGFSYEMVTYKWPHWLRAQKEKQREIWGYKILFLDVLFPLSLDKVIFVDADQIVRTDMFDLVSYPLDGAPYGFTPMCDSREEMEGFRFWKQGYWKNFLRGAPYHISALYVVDLNRFRALAAGDRLRGQYQMLSADKNSLSNLDQDLPNHMQHHIPIKSLPQEWLWCETWCSDESLSRARTIDLCNNPQTKEPKLDRARRQVPEWTEYDDEIAALARRVAASEVEVEVEQQILADEIEEEKEAAASEWKKDEL

SEQ ID NO: 4242 - protein, 1501 aa, Onthophagus taurus
MKFTTTLIYLLFLNVYNVFGRTKKAKSVTTLLEAKWAVTPLVLEVAEYLADENVDLYWSFIDSICSLDPALEKLGSDKEKYNIIIKHAAKFTTDSQLSVLKLGLSLHIYSPKIEMFSQMAKEVNLPECPIVADVGGTFTCDVKEAKELINKLKESGGKHPEIFNVDTHFPGSQNRSLTVILYGELGTVDFCKFHNLLKNEAQLGKIDYIIRHFVKERPERRLRLSGYGVELQMKSTEYKAQDDTQLHDDSSSEESSQEEEDFEIEGFNFSKLKTLFPDHKKDLDKFKQFLEDSSNEMAPLKVWQFQELSLQAAERIMNAPKEEALKVFTNIAQNFPMQAKGLVKTIVNEKLKDEMRKNSELFSSHLNLQPSDTALFINGLFYDVDLVDVYGILDILRQELRTIDGLHSIGVGSSRLSSLLALDFGDSSSTQEFAIDIRDSAINWINDIENDAKYHRWSSNLMDLLRPTFPGMIRQVRRNLFNLVVIIDPLDPKVRGIVKLLESFVIHIAPIRVGIVFSVNSSPVVTGLEDAGVAMVCAFNYISQNKDSTTALNFLHHIYSIAKSDEKITVEDISNYIRKKYDDDPNDILGDDSDYNFGRQLAEDFIQRTGLKGFPQALINGIPIQSSQINVDDFEEALLQEVMSQTPIFQKAIYRGKLQERDDVFDFIMSQPNVMPRLNERVLNKEGSVYLDLSGTPCSTMKIDDLIKLSPRDMTATALENLKYFTSQRKIEKYHSMTYWIVGDLNDEKSRRLLSEALDHMKSNNDIRVSFLPNVDGDNRDNYLNKLVLAALNELPAKEAYNFVVQLLKDPKIEVPTQLKNKIESQELSLKMLRVYCQRVLSFNDTNRGVIINGRVLGPFETNEDFTGDDFALLDQFTSTTYLKQITETLDQTDDDNVLTTNGLLRIISILNSRPQTKSRFEIKYVGDEHSVLKFPASDPNKAAFDIVAVVDPVSRGAQKIGPILQVLQEVLNCNIRVFLNSVEKNSDMPVKSFYRFVLESEIHFGEDGKQLLGPSAKFGNMPTSPLLTQNMHVPENWLVEVVRSVYDLDNIRLEDVDSNVHSEYELEYLLVEGHCFESTTGSPPRGLQITLGTEHKPVIVDTIVMANLGYFQLKANPGAWLLRLRQGRSADIYDIVSHEGTDTPQNSSDIKVLINSLRSLIVKLKVQKKPDKMYMDLLSEEEPNGGIWNSIASSFGGNEEDADEKLNIFSLASGHLYERFIRIMMLSVLKHTKTPVKFWFLKNYLSPQIKDFLPYMAKEYGFEYELVQYKWPRWLHQQTEKQRIIWGYKILFLDVLFPLDVKKIIFVDADQVVRADLKELQQLDLGGAPYGYTPFCDSRKEMDGFRFWKQGYWRNHLQGRRYHISALYVVDLKRFRRIAAGDRLRGQYQALSQDPNSLSNLDQDLPNNMIHQVAIKSLPQEWLWCETWCDDASKQYAKTIDLCNNPMTKEAKLTAAVRILPEWKGYDEDVRRLQQKIDSGIFDNDEEEDVQGGNDIHTEL

SEQ ID NO: 4243 - protein, 1529 aa, Dendronephthya gigantea
MAAVRINKVVKKKLLILLAVVAVLVKKSFCTSKPVIATLDAKWPSTPISLESSEFLAKEGNDKFWEFVELTKSYHNYETHLDQYNFIIESAGKLLSPTLLNLFKFSLSIRYFSPTIELFNQVSKQLSVPDCAAFIEVDSQVTCDLDEAVRLIDNSQQQSSDIYTFTFDHVYPSSGNNPVTAILYGELGTKIFGQFHEKLQELVQEGKIRYLLRHYVQNASKDKVRLSGYGVELAVKNTEYKAVDDSKIEGDKEDTMNKDKEEEKDIDGFLFGKLRKLHPDLNEQLEQLKSHLLENSKIMAPLKVWQLQDLSFQAAQRVMSTDGDDALNVLQDLSQNLPSKARSLVKTKVSEEMRKEILSNQQEFRKYDIHPGSTELFINGLQISVEDLNTFSLLDLLKEEGKVLDRLSSIGVKGKDLASMLTMSVEGEEESYAVDMRHHSVFFVNDLEHDAQYRDWPSSVTELLRPTFMGMLRYIAKNIFNLVLCIDPLASTTSELINLVDEMIQNQMPIRFGLVLVTEVDDNDVDGRSDAAVGIARSFYFIANDDGPDAAFIFLTKLYANSDGIPTADEVYSQFKKQYSQEEADEILGPNTDHDDLRKSAKLFFDRIGLRRLPQAVMNGVPLDIEDISMFEEMVGREIMIQTGPLQQAVYTNQLRDDMDVYKYIMEKPNVVKRLNTIIQDSTRPRIDLVGRPWTEDLPGTIEEMKALGNDHLVDIVRRNMNYFIGKNEMNLRPITYWIITDLKNTEGRKLFAAALDQMVKSENNRVGVIYNGVDPEYSLPVLMEAILNSDSYVTSGIVSLVKSILNDSHDYDELSSSIDAIIDLATSVKGFKIAKLKENLERNRDSYKRKAAIHQLFCDKVLNLKKGDIGIVVNGRVLAPLQKKDIFISDDFELLETLDMDTYARKIRNQVDGLEFEGLDANDDTSEYRSDVIMKLSSVLGLRSKKNRQDVSFKEEHSMLHFTNAETGINVVALMDPLSNGAQKLIPVLMVLRDVTRVNMKIYMNCREKLSEMPLKRFYRYVLAPNLQFNEDGSLSSGPHAMFRDIPETPLLTMNLDIPQAWMVEAVKSPYDLDNIYLKEVEQSVVGNFELEYILIEGHCSDMNTGQPPRGLQFTLGTKSNLEQFDTIVMANLGYFQLKASPGSWILQLREGRSKEIFDIESISGSSTAKHGSNEIVVVDNFLGEFLKAKVKRKSGKEEADLLADEVGQENGGLWDSISNIVGGGKPSASSNETINIFSVASGHLYERFLRIMMLTVMKNTKSPVKFWFLKNYLSPTFQSFVPYMANEYGFQYEFVQYKWPGWLHHQTEKQRIIWGYKILFLDVLFPLSLKKIIFVDADLIVRADLKELMDLDLERAAYAYTPFCNSRTEMDGFRFWKQGYWRNHLGHRPYHISALYVIDLKRFRKLAAGDRLRGQYQGLSQDPNSLSNLDQDLPNNMIHQVPMKSLPQEWLWCETWCDDASKPAAKTIDLCNNPLTKEPKLVSAVRIVKEWPDYDNEIKRLQERVATNRSQSPRDERNNEAPEKDEL

SEQ ID NO: 4244 - protein, 614 aa, Cordyceps sp.
MSHAAIEIGDAETASIHLAGLLDPVSEKGQRWAPILKVLSELDGVHIKLILNPREKIGELALKRFFRYVMDAEPSFDQSGTVRALKASFRNLPSEALLTVGMDVPSAWLVAPKESVHDLDNIKLGSIKSNVDATYELEHILIEGHSREGLGRPPRGAQLVLATEKEPMVTDTIVMSNLGFFQFKANPGFYNIQLKEGRTAEIYTIESIGSQGWAAVPGDKGTELALMDFQGTTLYPRLKRQPGMEQEDVLDQESAFSTAGLFSKSWKLAEGLLGGGKTKSLSAQEHAEINIFSVASGHLYERMLNIMILSVMRNTKHSVKFWFIEQFLSPSFREFIPYLAEEYGFEYEMVTYKWPHWLRQQKEKQREIWGYKILFLDVLFPLSLDKVIFVDADQIVRTDMMDLVKLDLKGAPYGFTPMCDSRTEMEGFRFWKQGYWANYLRGRPYHISALYVVDLRRFRELAAGDRLRQQYHALSADPGSLSNLDQDLPNHMQFDIPIHSLPQEWLWCETWCSDESQAKARTIDLCNNPQTKEPKLDRARRQVPEWTVYDAEIAELAKRRLHRGPGKKAENDAAPIGDNAATDARGAKQKESGPREINTKGCNWDERAHCIDEL

SEQ ID NO: 4245 - protein, 1378 aa, Trichomonas vaginalis
MILAFFFLFTSSSLLKDRQVNVTLDGSWPDTPILAEAAAFIADANGEAYWTFINGLQKVEKYPETIEEIKNYALNFLTEELRALLELSLLTRAYSPRIEMFREILRNHTKDMNKLAAFYADKLYYTQEDLKNAIEESPKSRPLVYSYEPRNGNLRDTIILYSLINDSALFSWIQFLEDQEESVSFIYRPVGEFTTTPVKFRGYGFEMRPFNYTMTYSKESDENIIHGEETPDTELFINKKIVPGPNVPKAMDLATQLIQFVKTTDDPFKSLLEVCENFPLYADNISRIPAAKSLRDKIFDRLENIISGASAIYVNNRVVLNPDVYHILQASLDELRIAQMLREYFTLTPEAHNKSLSLIQRTRPPKRVIVDYQSDFIFNLNDIETGKIYENWTTDLSSLRTTNPQNIKRNIFNAVFFIDPLNPYDMKTLKFMDNQTRLRAPIRWGYFVQPRSTNKLSKRVMNAWSHIRLRHGFRQAHQFLLDAAKEMVDEEDEPRIAHFNAALAKMGKKKTLTDFDKFDAQSREKKYLKKMKNFQERLGIHEQGCLFNGRFYPGESQEENIVQFMRDSLKRLRKKMAEKILKNSSIETVSGILTGDDVFNRYNPLIQHTDKSPCEFIPLISQSFYFQREFMEWSKKIRYNQEPQKVKFNTIWVFVGEELTGSLESKHIAFQTEEWLKQGIPQNTRLAFFSETTTSNIIRNSMPPPFVQDLLKLQPDEVTVVMNGRVLRMKSRMIFNWHLEDFNVLIKWEYHYSVSMIQSYFSEDVALNYEMLGNQVDDVNTEFHSQLAFYFSLIYGMASHTRISRYPSDNRVFKPSNPAVMNYDNPDSFVHYAIMLNPFELPFQAIAPIVQFLRNSKAFDVKIMINFPTKDIDQFPPNLRAYHRFLLYDDSIQFDRFESQTVYSLMPHPPYNWMVEPVSAPFDLDNFRPREVNPGTTCSSYRLTSILLEGSALDEQYIPVHGLRITLDMDKKGFHDSLSIKTMGYFQLKTQPGIWEISLGEGPSRTVYNISSRNQFSISSFVPPWMTMRVNHNDGMSRYTIYELPKNLKLSMSNDTETVNVFAVVSGYLYEHLVKIMMISAIKNTKNPIHFWFLKNFISSQFMNDLPKFAKKYNFKYSFVEYNWPSFVVHQSERQRIIWGNKILFFDALFPMNISRMIYIDADAVVRGDLSELMKIDLKGCPYGFVPMGMSRKEMKKYHFWTTGYWKNHLRGKKYHISAMFVVDLDRFRRMGGGDKLRKHYSQIVGNTKSLANLDQDLPNDAQDEVPIMSLPKKYLWCCTWCSEKEKDKAIIIDLANNPKTKMSKVDMAKKFIEEWPLLDDEVKHIDDPDYFCSYDLKKIRQEHTEKVQKAIAEVRAKKLAAQQEKKKKAGVEDDDEL

SEQ ID NO: 4246 - protein, 1604 aa, Gloeophyllum trabeum
MKCGVAFYVTWAACMGLVQAASSPSVSVSLRTSWKAPSILLEIIETVSLENPSAFFPLLDILTNSHSSNLPEHATPEAIYQYALETTVSEGLLKEPSAKALVEMNVALHAATPKIEAFYQYYRDRHGGLDEECRSWVDWYSQKVHDVETLAHLAGHETIDPNSSSNETSIPAPFPKPKLLPFDHVYPPLSHLRDRPPHTAILYGSPDTRNFRELHEYLLSLANESTPRVEYVFRHKPPCNKPAEGNEQSYLSGYGVAMDLKKMDYLALDDRRAAGQENALVDAISVDPILSLLQEYPENSTADYTAQLDETELIGKSAPYLIVNSSAPLATLKHLAQNFPKYSKAIARRVVINESLLEEVGSNQLKAQPGASMVWLNGNPVPEQDMNPFGLLKLLRKERTLVGALASLGLTPAQAVDLLTHPAISASQGGSDVLDGIFDASDRPEGGDVIVWWNDLEKDGRYARWSPTIRGILRPIYPGSFHNIKLNLWNVVLVVDLSQSSSLNFLVGTVSNIIQRNFPFRFGVVPVVETEEGLKMARLFYWLVKTYGRAKTMGFMRKISQVQGRPQYLSPTVDWHTVQSELQALIKSEEPPTSDFVPPTLDAILEGDGDERDIQASKEYCTRLGATLGASPTGHAFVNGKHYDLDDDFLRHMQIEVGAQLQHIQEKVYMGEITDETAESISTYFYDLPSASKRRHPLIYPAASAPNKPGSLQIRSLPEVFARIGRPLGVESYLYPPGSSQLALSTYVVADFDTTEGMALLMNVLQSMDEASPSRLTFIHNPAVSGVPSWTERPMSTLLSHLVQNGLLRGATPEKLLKLLGLASPATQDRHPQIVISNEDAFDDLIAGIGASDAEVHTETYRDYVSLSQSLVKELGLPAGEQALIVNGRTIGPLKGAQFLADDFKELYTYELRKRVEPVSQALQEVASSLDFCPHIISMGTFTDVVSLASSIISAMQIPDPSESGLFNAAYRPRTRNYRLMEGNYTRFEVGNAATALHQFGVILDPLSEAAQKWSSLFEWLSNIDEVYVEVYVHPAGYSDIPLKRFYRYNLTPKLSFDPEGREVRIATVFEDLPLEPIYTLGMDVPPAWLVRPREAQHDLDNIQLGAVSVKEWSRGVQAVFDLDHLVIEGHARDTLTNAPPRGLQLQLTTANSTPVADTLVVANLGYLQFRTKPGVFQLEIREGRGREIFNTESVGNEGWDSPSVDEVGNEVTLTSFEGLTLYPRFARKTGMEREDVLEDYDDLLEESDSDSIVQKVWTSISSFFAPKSEAPKTQALEPQQAEINIFTVASGLLYERFLSIMVLSVLRNTKSTVKFWFIENFLSPSFLEFIPHFAEAYGFQYELVTYKWPSWLRAQKEKQRIIWAYKILFLDVLFPMDLKKVIFVDADQIVRTDLKELVDLDLHGAPYGYTPMGDDNVDMEGFRFWKTGYWKDFLQGRPYHISALYVVDLVRFRQMAAGDILRGHYQQLSADPNSLANLDQDLPNNLQREVPIFSLHEDWLWCETWCSKDRLHRAKTIDLCQNPLTKEPKLARARQIPEWEEYDQEISRFARKLAEEGLIHSEITAAGADILASVAAGAATPVADRSEAAQDKTEGKLPVHEEL

SEQ ID NO: 4247 - protein, 1463 aa, Fusarium longipes
MPCLSQCMAVAILAATAASASPSVNVGMHAAFPRGPYLLELLETAAEENSTAYFPLLDKIASGHFAAASSDADLYDQFLTVLQKDDHIATPEALSTFKLSLSLRASAPRIEAHYQYYTTAVDPGSQVDGADDCQSWALIENQKYCSPDLGTVVDSEISTKQVKVLPFDRVLGRGKRAILYADPTSASFGPFHNALSKAARQGMLSYRLRYRRSAGVGNSSLPVSGYGVKLDLKRTDYIVIDDREADQETQKRTVVADVDFDTQEEVADLKPLSSSELASLGLKTACFILNSENPLDALVKSTQDFPKFSASIASHEVTQGFAEEQEKNVAAGVPSGINFLWMNGVQLIERQIEPFTLIEMIRRERKLINGVRELGFDGQQAVSLLGHSEIASSKANDEPPRFDWTDQLEDGKAVMWLNDLEKDARYQKFPSDLTALLQRTYPGQLPQVALNLFHVVAPIDFTDLEDGRAFGQLAQFMQRGITIRFGIVPLATTPASIAQAKVVYHLMETYGFESLITYLQESEEGPEGAANKRSFARAIETREPLPGMAKMTLSEVLEAEPYVQKVKAGQAWASRLNADTTVRPILVNGMAIPREKNWVQTMGQRLTEDQQTIQKAVYFGHISEGVPVSDIFLNAALSKRNTYIFPDDDKALRILDVNKLYTDHADLFSKIAVLPADTESAKEDWAMLTVITDLNTEDGQDLLLAALDFKRNHQGVRLDLIHNPASPTNAHAINGAFKLGEAKLAEMRSKDDLKTVLEASWTAEDDGLGTALANFLSASHIQSGTKSLLLNGRVVGPLPVHVLFKNDDLKQLLEFEQRNRILPVYAAIKELGFTDKLSDPIAAAKLTSITALSTISDLPQGIFESAPSIRSTLYNTWNSTHSAIEVGKPDTASIHIVGLLNPTSEQGQRWAPILKVLSELDGVYLKLFMNPKEVIGELPIKRFFRYVLDSTPSFDNSGHIQSPQATFKGLPSEALLTAGMDVPPAWLVAAKDSVQDLDNIKLSSVKTDIDVIYELENILIEGHSRDGKRGAPRGAQLALATEKDPLVTDTIVMANLGYFQFKANPGFYNIRLMEGRSSKIFNIESVGAQGYGAVPGDEGTEVALMDFKGTTLYPRLSRKPGMEEVDVLESLDSDDDGIIAKGLKFAESLLAGIKSPKEISAQEHAEINIFSVASGHLYERMLNIMMVSVMRNTKHTVKFWFIEQFLSPSFKEFIPHMAAEYGFKYEMVTYKWPHWLRQQKEKQREIWGYKILFLDVLFPLSLDKVIFVDADQIVRTDMIDLVNHDLEGAPYGFTPMCDSRTEMEGFRFWKQGYWANYLRGLPYHISALYVVDLNRFRQLAAGDRLRQQYHTLSADPNSLSNLDQDLPNNMQFAIPIHSLPQEWLWCETWCSDESLTKARTIDLCNNPQTKEPKLDRARRQVPEWTVYDNEIAALDQRRKGIADKNTNVDSRKSEDGTHTKDEL

SEQ ID NO: 4248 - protein, 1241 aa, Trichomonas vaginalis
MFFFFSLSFCKFNLDHQIVIDTKVPWYESTTFDQYFVGLAENSNKKAAEFFKNVANKHCHTDKTCMIQILNSILDKKSANTIISREELNDLLPIIEFNREQARSYRGSNFEDLFIVGSQPDFEYNCIYFNNENITVLPTEFQLGNNNTIVYANLSNPDTFNFVNNLIVNKKSFVLRPTSQGKFGLDVRGYGIELRPFKYSMEYGVKDDQRSSENSETNPEIYDETLSNFDNIQDMKPLQSDIHISKPAFTQYFDENEQPFLKKLTYIAENPSISLPILDSMYNEQENQNVSIDTTIPIKSINGRSISNSEIDTFTILNIINQERNAYEVLKNESHESLDMFKIELPDKTAHRFDYRNKFIAWKNNLEKDQISKDYKVTREELSNKNHIPRVKRNLFNLLVTADPTTQNGVYKYLVMEKIMDKGYPCRFGGLPVFNLNDPLSRKAAFAYAYIKQFSDSLAFDFLIFSAKFTGFDARTYQPLFPSEESIAKAYTYVTKTIKDATSWHDLYKYFSPLSKIHSYVKEMTQKVTDKKLNEYMTIFNGYVFYSLYTDSLDGLLYKEQDYLSSLIEENVIPENFDIFDVFNKFTYVSPDIESKYSLTPILSLHLLNQPKKIMKKFMNFLKNSFDDEFNDFVIVFTESNQEKIENQLKQLNVSYLINPKLPEKLHKALGIEKEMLIVNGRVFYNFDDIQKHLKWTQNFISRLYRKVDCKNYVKFFFYCLTSNFYENDIHRNKDSLIINENDRLSFESNSMSDFTFEFTCNPFDESDQKLIPIVNYLNEKDVIDVKIQLNIPTSVSGQSNNVYRMALDKSEVIFGAVDDLTTYSIIPHFPQTFVCEQMRSEFDADNILTSLLTPGIHKCSYILTNVVANGLTNSSGFAIYLGDKNLSKISGTFLSKSGYWQIQANPGLFDVVLSKEYISSYKTEKSTVFVNSFAQKDNFVTFSQFSSFEQVRTDPKTIETVDVFIVASGQLYERLAKIMMISVRRHTNSSVRFWILKNYLSPSFKASLPKMSQEYNFSYNLISYNWPANLFKQKEKNRIIWANKILFLDNIFPPDLKRVIYIDADQIVRSDLSELMKLDLSGAPYAFTPMCDSRTEIEPYRFWKRGYWQKQLRGKKYHISALFVVDLERFRQMDAGEILRDVYQDLAPDPNSLANLDQDLPNYVQDALPIYSLPQEWLWCETWCSDETMNKAKTIDLCNNPLTHKPKLEIALERVEEWPGLDEEARRITAKPDEYMKNFF

SEQ ID NO: 4249 - protein, 1075 aa, Eutypa lata
MALMQMTYPGQIPPIAKDIFNVIIPVDFSNPDDLSLVIEQIQAFIKRQLPIRFGLVPITTTKAAEDQAKIVYHLLENYGLGSLISYLESYQTERTISEPQQANFDSVTKDRAPRSEATPLPFKEVFEAEHHVKQVELAKHWTERLGADTAVPPIFLDGLSIPRTDGWIKAMSMKIGTDLQTVQQGIFAGTVDDDMWIPSVFLEGAASRRNIYIFPDADNPLSVLDVNKLSVEHTDLLSLVPLIEESKDTSKETWATLTLVADLGTTEGLNLLLSALAFRRNNPGVRLDIVNNPLEITRAHEINSILRKDVEKLLEVENLETLEVLVSSDAVGEDEGYGAALSQFLTANAFKSGDQLIILNGRVVGPIAPAALFKEDDFQLLFEFEQSNRILPVYKAAEALGISEKISDPIAAAKLTSITALSTISDLPEGIFESAPTMRTDMYDEWNSTYTSFDVGDVSTANIHFVAVVNPTSEIGQRWAPILKALSELEGVYMRIFLNPRERMEELPIKRFYRYVLDSAPSFDENGKVRSLGAIFKGLPSEALLNLGLDVPPAWLVAAKESVHDLDNLKLSSIKSDVDALYELEHILIEGHSREGKSPPRGVQLLLGTERDPHFADTIIMANIGYFQFKANPGYYNIQLKEGRSSEIFDIISVGAKGYNAVPGDEGTEVALMSFQGTTLYPRVKRKPGKEEEDVLEQSESQSGGDIISRGLKFAEGLLGGSKQKALSPSAEEHAEINIFSVASGHLYERMLNIMMVSVMKHTNHTVKFWFIEQFLSPSFKEFIPHLADEYGFKYEMVTYKWPHWLRHQTEKQREIWGYKILFLDVLFPLSLDKVIFVDADQIVRTDMMDLVNHDLEGKPYGFTPMCDSRTEMEGFRFWKQGYWSNYLRGLPYHISALYVVDLRRFRELAAGDRLRQHYHTLSADPASLSNLDQDLPNHMQFNIPIHSLPQNWLWCETWCSDESFVEARTIDLCNNPQTKEPKLDRARRQVPEWTAYDEEIAGLHRKVKGLPPSPDEGKKGSGSEEVAGHKVFVGDRGQKVLGGEGGGEEEPKNTKSRTLEEQPPKSTQDEKDEL

SEQ ID NO: 4250 - protein, 1324 aa, Lachancea quebecensis
MLFWALLVWSHTIFASCATVRFPNASSGDKLRLWNAVAGLVKDEQLVQDLYFLIAGVSDELDGLDGGDSLLEQAASVLAHHNPEVASLLPLWYALEPGFSKDDSNQNYFLLNKKRFEHADDLFYLKTDDLNAQKSVCINDILDSGDVVIGPNRDAPVILFYGCDRAEDWEEYNRNLYMEALAGKIRFVWRSTCPNDLPFEFEPTAVALTVKDSQWNSPFDHAFDLPEGLSSGRATRSRAQQVKDEQLKDLDMKAGTLVYDFYEKSQNASETIRYFRQIVNNFPIVARPLAEQKGPQIDKRWEGALKKFAKEGIDNTMLGLFVNGQYHKLSNLDQWSVLQSITLELNRIDFLMTLLQKYQNITSEESLILAKQLLNTFSTRSLVTHQLLQPAKYDLHRIPGFSESIIYFNDIELDSDYAEKLKDDIAMFFEESEFGELPAYRENWNEVVFVIDFSDLRSKDTWEALQGMLRALQIVKKGYPQRIGLLPFSTDPQDYGILRKIYELKQSKPLESLESYLEELSPTERPIESVFQELPPVLDIISDRLKIDKTSIVINGEIYPFKSNLWNYLVSKVVKKDVSYIKNELIRINNRNFKAREILHAKSFIERNRKYAPDFFEDATYSNTNVTALLSLAHRITETSTGGNLNTIHTVTVVEDFNTPTGLHRLINLLQIKLHGVRIRAVHSGSLGKSWDKLKPFISSADIPKLQNYKSSLKLSRNCNHAELDIASQWLLDLPRDLLQNTSYLAVNGRFIHMEQGEVPTTYEYEMIVQREATRVLDAVASLQEVFPSALEQPLDPDYVEMVSAVLTKMFYDGESLYNNGIDFTAETSISRINLGDLLPAEGFGAFQTTKEPRKVDITLILDPLEERTQNLLALASDLAVLDFVKLQIVLMPTTDLKIFPNHRIWIESERDLSIIDTRKFFVDVEAPSNLHIGERKGDVFELEYIIVEVNAFDDKEEPSKGLVEGVGDVCLKLLNAKHEVLDTAITTDTFGYAQFKLRQLEQGLTVESCSSDYRVSSFSSNSKADYISSDKFDVTSLVPTRLYVRLEKAQEKQPSSSEDKHTINIFSIIETMDEEAIFEKQVISAMRTRGSFNIKFWIILGEEPSSSFPTLIENISAESEGEVAFDYLTVDWPRWLRPQRFRPRQLAAAKVMMLDTLFPKDVSKVIYMSPGTRVPNVTELWEYNFDSVFCAPRAYQRDGTPYWKQGYWHNFLSKNNLKFHTTEPMFIVNLDKYRQEHAGSKFRIHYQRLSPGINFLVQLDQDLVNDMQTLYPISSLNKRLLKVTPHLQILDDSYYQSLKDKFNNQKSEQGHKESLEEIVHDEL

SEQ ID NO: 4251 - protein, 1605 aa, Coniophora puteana
MVNRALAAASVLLALGSGHGAYGASPPVKVSLRSAFPAADTLFEALEAIALENSTALFPLLSHFPLSGLPSSYTPQDAHTRVFDLAQEYKLLDGGSLSSARTLLGLHAAAPRLAVSAQHYEDRLQQETSGRAGGKGCESWVDWYGEVLCDAEELKTKVSSAPGDPDYMAFKSLPFDYAHALPPSLDEPPFKVVHYADPTANGFAPIHAALLSLEPKVEYVLRWARTARSGESEGSLTDYLSGYGVALDLKKMDYLVIDDRAHRSDDAASSTNDEDLKTEEGEAMRTPEEILTCIFESLPYVDEAAKERAKANEPLTEDEIAALGMKATQFISRFSSRPHDASLYVHPCWDNHHQAPPDQLTLMSVLSRSFPLYATPLARKVELTEGVVDEVYENWEKATPGVGALWINGRALEQKDGQDGNIFSLLRTIRRERALVQSIMDLGLTGEQAVEVLMHPAYTKWADALDGIVDASDRPEGGDVVLWWNDIETEDRYQSFRPALTGLMRMHPAALFSPMLQIRANIINTVLVLDLSSPSSLAFLSNQVEGIVARGYPVRWGLVPAVETDHAMVMARLVYYVHGRYGSKAMVGFIKSVTGNHDHIVSWDAVRSVFASFEPAHTFDEVAEGVVPLSKPAEAGETQEEAINDQLDVIKKARQYSKRLGQPKNDGLGGHGFVNGRYIELNDWITFSQGFQTESMLHLQFLQELVYTGQLKDTDIPLVSTLFYDLPGTPSRRNPYIHQAQAKGDAKIFSLPELFKESGFTRGKDAFVVPEGSEKHPITMYVVGDFDSPAGRAVLKESLEFTKLNSRSRVTFVHNPATDSDQLIRKLGLEAHTFEHSSQKSFSIEEFDDVLQKDVALNRAPTKLILRKLGLAPGDLAILVNGRLVGPIAPESGFVAEDFATLESYELKKRVERVEIALDDVLEQDSEKPRDAATYSHLASMISSIVASIQQPDPSEVGLFDAAQRPRSASYRKLSGQYTLSWIGTKDYSKTQMTLLIDPLSEMAQKWSSILDCWFDLFPDVYLEVYMNPTQHSEIPLKRFYRSNIQSRLQYNGQGQEVPAIVEFAGLPVEPIYTLAMDVPPSWLVRPREAMYDLDNIQLSTLSPEDRTTGLQALFALDYIVIEGHARETIADSPPSGLQLELTPTSSTTSESNTTTVPVDDTLVVANLGYFQFKAKPGVFELGIREGRGREVYMLESVGAQGWDSPSVEKVGRELAVMSLEGATIYPRFGRKPGMDGVSVLEQPEAYDAHSGGILDNIVVSEFLSPKARQTDLAVSGKPQAEINIFTVASGHLYERFASIMILSVLRNTKSTVKFWFIENFLSPSFLEFIPHMAEEYGFQYELVTYKWPSWLRAQKEKQRIIWAYKILFLDVLFPMDLKKVIFVDADQIVRADLQELVDLDLHGAPYGYTPMGNDNTDMEGFRFWKTGYWADFLNGRPYHISALYVVDLVRFRAMAAGDMLRGHYHALSADPNSLANLDQDLPNNLQMSVPIFSLDEDWLWCETWCIKDRLHRAKTIDLCQNPLTKEPKLSRARQIPEWDLYDTEIANFSRRLAEQGKIHSSAATADTTVLANEAAAKAVVADGAERSEDPPGESHSGGRQVDEL

SEQ ID NO: 4252 - protein, 1313 aa, Nilaparvata lugens
MLLLQKTVFRLSPLLVLLSCLCLLVSGGSGGSQTAGKKKSKAVTTVIDAKWHSTPLVLEVAEYLAEEGSHLFWQFVDAVSQMQPPLSHISTEKAAYDAALDLVRQGDILSAGQVSVMKLALSLRAHSPRVQMYSQMAAERGMAGCANGVDLAGDLLCSPDKLDDHIDAVLKKDPKSVTRLETFRLDHYYPGADNRSVVAILYGELGTPGFAEFHEILKKRAAKGEIDYVLRHHVKEASNKRVRLSGYGVELHMKSTEYKAEDDTKVSDKEKGGEGQPEDDEEEIEGFNFSKLKQMYPDKKEELDKLRQELLETSDELAPLKVWQFQELSLQAAQRIVSAPIEEAIKILTHISQNFPMQAKSLVKTRVNPEMKKEIKMNQDIFANTLNLQPADTALFINGMFFEAENIDMMTILDTIRQELNIMEGLYKIGISDKSTLSKLLALDFSTATGREYAIDIRDSAIQWANDIEADKKYKRWPSSLLELLRPTFPGMLRSIRRNIYNLVIIGDPSQRAVWPLIKMAESFHLHSSPLRIGLVFAVNSTKGTGLNHAGVALLNAFNYVAETKDSFDALSFVTDVYASIKEPDRDVLPGDVYKLLRSRFPSSDPDEVLGADTDYDTGRQLAADFVRKSGFRTFPQVLLNGIPLAESTLTADDFEDSVFSEVMIQTPTLQKAVYKGELSDAMNVLDFIMDQPNVMPRLNDRVLNLGKSRYVDLVDTPSELSKSVMLSLKYASASKKEQKSAHLLTHWVVSDLSTQKGRNLLLNALEQMRSSGRIRVGFIANPSSSDTKLDRLVVAAYETLTADQAAVKIKRMLADYDDIAAGKKDHSDYDLTNVDWPSVDRKVEEHRSFAKQVAWLEGGQLGIITNGRLLGPLADDEEFTVDDYGLLERFSLSAHVEKIHKTLNEGVEPGEDMVSSDVLMKTVSLLVARPQTKSRFQVKAAGEKHSVIHLPAAVAEQPAFDITVIVDPVSRGAQKMAPILTVLRHVVNCHIRIFLNCLEKNSDMPLKSFYRYVLEPEVQFTADGHLASGPYAKFTNMPGAPLLTQNMHVPENWLVESIVSPYDLDNIRLEEVESAVHSQFELEHLLLEGHCFEATMGNPPRGLQMTLGTETQPVVVDTIVMANLGYFQLKANPGAWLLRLRQGRSAEIFDITSHEGSDTPVNSTDIKVLISSFRSHVLKLRVTKKPDKIGMDLLGEDDDSQPGLWNSITSTFGSTKEEQVEAETINIFSVASGHLYERFLRIMMLSVLKNTKSPVKFWFLKNYLSPTFKDFLPRMSKEYGFQYELVQYKWPRWLHQQTEKQRIIWGYKILFL

SEQ ID NO: 4253 - protein, 1513 aa, Trichechus manatus
MGLLVSLTCLWLLSAVKADSKAITTSLTTKWVSTPLLLEASEFLAENNQEKFWNFVEASQNIGSSEDHGTDYSYYHAVLEAAFQFLSPLQQNLLKFCLSLRSYSATIQAFQQIAADEPPPEGCSSFFSVHGKKTCDFDTLETLLLTASERPKPLLFKGDHRYPSSNQESPVVIFYSEIGHKEFSTFHQQLVSKSNAGKINYVFRHYISNPGKEPVYLSGYGVELAIKSTEYKAKDDTQVKGTDVNATVIGENDPIDEVQGFLFGKLRDLYPDLEGQLKELRKHLVESTNEMAPLKVWQLQDLSFQTAARILAAPVELALVVMKDLSQNFPTKARAIMKTAVSSELRTEVEENQKYFKGTLGLQPGDSALFINRLHIDLDTQDIFSLSDILRNEARVMEGLHRLGIDGLSLHNVLKLNIQPSEADYAVDIRSPAISWINNLEVDSRYNSWPSSLQELLRPTFPGVIRQIRKNLHNMVFIVDPAHETTAELINTAEMFLSNHIPLRIGLIFVVNDSEDVDGMRDAGVAVLRAYNYVAQDLDNYHAFQTLINIYNKVRTAEKVKIEHVVSVLEKKYPYVDLNSILGIDSAYDQNRKEARAYYEQTGVGPLPVVLFNGMPFEKEQLDPDELETITMHKILETTTFFQRAVYLGELSHNQDVVEYIMNQPNVVPRINSRILTAEREYLDLTATSKEHFRNIFGLLKRMSSKEIYDDSFIRPVTFWIVGDFDRPSGRQLLYDAIKHQKSSNNVRIGIINNPSEEISYENTQISRAIWAALQTQTASSAKNFITKMAKEETAEALAAGADIRAFSVGGMDFSLFKEAAESSKMDFILSHAMYCRDLLKLKKGQRAVISNGRIIGPLEDNELFNQDDFHLLENIILKTSGQKIKSHIQQLRVEEDVASDLVMKVDALLSTQPKGDARIEHQFFEDKHSAIKLRPKEGETYFDVVAIIDPVTREAQKLAPLLLVLTTLINMNLRVFMNCQSKLSDMPLKSFYRYVLEPEISFTSDNSFAKGPIAKFLDMPQSPLFTLNLNTPESWMVESVRTPYDLDNIYLEEVDSIVAAEYELEYLLLEGHCYDITTGQPPRGLQFTLGTSANPVIVDTIVMANLGYFQLKANPGAWILRLRKGRSEDIYRIYSHDGTDSPPDADEVVVVLNNFKSKIIKVKVQKKADMVNEDLLSDGTNENESGFWDSFKWSFSGGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFSLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAMRIVPEWQDYDQEIKQLQTRFQKEKEAGPQSKENKTEEPSREGPRKREEL

SEQ ID NO: 4254 - protein, 1495 aa, Marssonina brunnea
MGFFTMPWGLTGALLATTYLHSLCGVSAGPSINVGMKASFSAAPYLLELLETAGNENATSYFPLLDRIADGYFTKTSTDKELFEKFVQVLKDDGHMLQPESLSSWQFALSMRASAPRIEAHYQYYHTAAEPSLKGEQDTSCSVWVLFNGKQYCSPALDAAHGDIGGDSQVQELQFDRVLGNSSAPASILYADITSPTFGRFHKTLVKTAREGKTSYRIRHRKSLTAENKPLIIPGYGVELALKRTDYIVIDDRDENESKTASAAPEKEVRFEDEELADLKPLSASELYSLGLKASSFILQSGNPLDSLVKLSQDFPKYSSAISSHDVSKEFAAEHHYNRGQLVPAGNNMVWMNGVRLIDRQIEALDLLDIFRKERKLINGLRELGLTGTQAIQLLSHSEIATVKAENSPPRFDWRDDIEGGNAIIWMNDLEKDKRYAGWSPSLKTFLHRVYPGQLPQCRRDCFNAIFPVNFTNPQDVLLVADNLLNYVKRKVSVRFGIVPLTSTPDSLAHAKVMYHLLDTYGLSAAMAYLEAAYTSQKILAPSAAHFQTAIGERTARNDKKALTLEEVLHPESYQTQIEAARQWVRRLAADSKIPTMFIDGVAIPRDENWLQAMSQKVTTDLQLIQQAIFTEILDEESWLPGHFLLQASTRRNSLVVPEDEKTLKIFDVNKLVGENQEILNNLPRIEADVTAAKADWAHMILVVDLESEAGEKLLATAAVFREANPSVELVIVHNPASDIIDSGLSSDFYQFMLNNDNKAFSSINDLTAVLSAELAAPGQEIQQHALEYWRGGDAIVKFLGLLPGQNAVLLNGRLVGPIPADSDLDEGDLDQLLSYERSKRITPANAALEALGLLDNIANPLAAAKISSIVAISTISDTPDGIFEETSTLRMSQFHVWNSTYTAIETGDALTASIHLTVLLDPASQLGQKWVPLLKVLSELDGVYMKLFLNPKERLEELPVKRFYRYVLESKPTFDEVGALKPLSATFTGVPQEALLNLGMDIPPAWLVAPKVSVYDPDNIKLSSIKTDVEALYELENILIEGHSREIPGGAAPRGVQLTLGTERNPHTADTIIMSNLGYFQFKTNPGYYRIDLLEGRSAEIFNIDSVGSKGWSPTAGDENTEVVLMSFKGATLYPRISRKPGMDSEDVLETKADSKMDLVSRGLNFAQSILGKGKGAVEKQAQADINIFSVASGHLYERMLNIMMVSVMKHTKHTVKFWFIEQFLSPSFKDFIPYLAAEYGFQYEMVTYKWPHWLRGQTEKQREIWGYKILFLDVLFPLSLDKVIFVDADQIVRTDMMELVNHDLKGAPYGFTPMCDSRVEMEGFRFWKQGYWEKFLRGLPYHISALYVVDLHRFRQIAAGDRLRQQYHQLSADPNSLSNLDQDLPNHMQSILPIHSLPQEWLWCETWCSDESLKDAKTIDLCNNPQTKEPKLDRARRQVPEWTVYDDEIAAVDRKRKGLPPISSEAPKVAGERNTKSKTLEVASPTASKKDEL

SEQ ID NO: 4255 - protein, 1484 aa, Penicillium vulpinum
MRAFTGSHISWRWYAAVGALLPGWIVNASPAVNVALQASFDSAPYLVELLESAAEENSTSYFPLLDRIADGAFEDLTTEKELYDRFLTVIKDDGHIQTPESLSSFKLSLSVRSSAPRIEAHFQFYNTSVQQSLMVAQDAVCPVWVHSEGKQYCTSAMERAQQDVVGEFDPRELPFDRVMGDISLPPAVLYADVASPMFKSFHETLSEMAKQGQISYRVRYRPPQHSIPRPLFVSGYGVELALKRTDYIVIDDRDAEQLAEKATESLPTDLDETKEDAPDDLRPLSSSEVTRLGLNSVSYVMDSPDPLGTLIKISQNFPKYSSIVAAHNSTGEMAQEVRHNRIKMLPGGYNAIWINGVQMSTQQIDAFSLLEHLRRERKLIEKFRGLGLSADDVVKLLSHPLLTEDQGDAEEQRYDFRDDLEGNQVIIWMNNLEKDSRYESWPSDLEAYIAGSYPGQLPPVSRDLHNAIVFIDLSDPDHMKLIAGHLQAFINRGIPVRFGLVPSTSSPESIAQLKVAHYLFDAYGMESLVQYFEEYASKSKSGLPDKSCFQTATKQRNLLDEHEALSLDQVLKSEKYNTLVSQTAAYQRRLSFTGDVPQFLVNGIHQGGNWMQGMSMQVSRDLKLVQQAIAEGMFEEDAWLPEFFLAGAFETRNTFLMPEDPRSVQIVDIANIIPLDQDVLSKIPRVLSDMGALESTHIIVVGDFESEAGIKLLTNALDLRKDNDDVEIMMLHNAAVDAEDDVPKNLVSLHLSLVKGETIDQILAKIASGDLDTEALETEDQDISTIQALHQTLAKELGFNPGTEGLVVNGRVVAPIQKEHPLSMEEMRQLIAYERVKRLDSVAAAVDQLGFADKVSTPLDFAKLASLVALSTISDVPDGIFENTPDFRMDVSSQWRTQHSVITVSNTDDPTINVAVSLDPASEVAQRWLPILKVLSELSGVQLKIFLNAKEELTELPVKRFYRYVLESEPSFTDEGALARPQASFTGVPVEALLTLGMDVPSSWLVAPSESVYDLDNIKLSSVKPGTDVDAIYALEHILIEGHSRDLTMKTAPRGVQLILGTENNPYFADTIIMANVGYFQFKAQPGLWQINLKPGRSEKIFKIDSVGGLGYRPQAGDENNEVALLSFQGRTLFPRLSRKPGYEAEDVLETGVQPGSKMDYFAKGLNFASGVLSSVGVGSKSGGEQHADINIFSVASGHLYERMLNIMMVSVMRHTKHTVKFWFIEQFLSPSFRAFLPSLAREYGFSYEMVTYKWPHWLRAQKEKQREIWGYKMLFLDVLFPLSLDKVIFVDADQIVRTDMYELVTHDLQEAPYGFTPMGDSRTEMEGFRFWKQGYWSTFLRGKPYHISALYVVDLKRFRALAAGDRLRGQYQMLSADPNSLSNLDQDLPNHMQHHIPIHSLPQEWLWCETWCSDEDLGVAKTIDLCNNPLTKEPKLERARRQVPEWTVYDDEIAALASRVAGEQAAAVGVESEQTGEDRKDEL

SEQ ID NO: 4256 - protein, 1719 aa, Bondarzewia mesenterica
MDREPRRWVNNAGCMNLKRFVDPSSCVPVEAELPVQTHRHEVGELRAWVERRRIFRYWKLRLWTPEKFEFEATFATFTAATRDMLSQPSGCNLMQRGALGSDIIPWTLEARKAVNSKPAIMRARHALSSLCVAAALIFCSDAASPLVKVSLRTSWPSPPFLLEVVETISLEDPDAFFPILDVITDPETSPSREPLLPEALQQLALQTAISLDFFIKTWRYNPAHIAESRDREACGSWVEWYGEVVCDIERLVHLAGSETIDNANASSPFSHSFSRPRTLPFDHIYPIPSRTLNRPPRTAILYASIESSNFLELHSYLMRMSSSPAPKIEYIFRPIPPTSRGNARTSLSGYGVTLDLKKMDYLALDDRHTSAGGSSAEDDELSENLESAAEPDPVISLLNQHPLKTAHEASEPLTEDELAQIGVQAIQIVYESSDPFATLKQLVQDFPRYASSLARRVVVNPELANEVHRNSFKAQAGASVVWLNGATVPDASMNPFSLLKKIRKERDIMLSLTSLGIEPHQALALITHPSIQAAHGTSGSALDGIFDASDRPEDGGLIIWWNDVEKDSRYARWPAGLHALMRPTYPGQIPVIRANLFNVVLVMDLSQTSSLYYLASTISNIINRGFPVRFGFVPAVESDEDVRMAKIIDYLVNNYGRARTMNFIKKVLQLPMAVQQMPEHVNWELVRSEFQDLIKVEDPKEGGVTMDFDTVTGNTIEELQSKVSSARAYAKRLGATMSSSPQGHVFFNGKHYDLDDVSTISSSFICGFTNMITDFHSNLANGNTEVSPISTRTPAVALKLYQGTLTEENAGDVSTYFYDLPTSQKSRNRHIFPSSNADGLVAYNMPEVIEKTDFVVRPAGFVYPPNINLVPFTIYVVADLDTEGGLSIMESALTYVGASRARLSFIHNPTSPLDGVEERNRVSWLISHLISQDALSGVHPARLLRALGYDTSIVTNDHEQIVLSPDAIFEELTGGVSLDDLDGVVYDDFVRSCRTMARALRLRPGDIALVVNGRLVGPVEPGDFTAEDFKTLENYEYLRRVEPVIRALGEVLPETAEYDQLPRATFADMVSMTSSIVSHIHIVDPSEGGLVNQPQMTRSQNYKLMESEYSGFEMGDNSTALYRFVVVLDPLSEQAQRYTSLFEWLSNFPLTHFAFYINAAPYRELPLKRFYRYNLMPRLVFDESGHEIPSTASFTDLPVEPIYTLDLDEPSSWLVRPKEALFDLDNIQLNVLSSDERQQGVEVMYELDYLIIGGHARDTLTSGPPRGVQLQLTSSAEPIDDTLVVANLGYLQFKAKPGVYRLEIREGRGREIFTMESVGNEGWESPTVEEVGNEITLTSFEGLTLYPRLARLPGMEQEDVLHIVEEPEPTNIISDIFSRVSSLFHPKVTVEVKSASPHADINIFTVASGLLYERFASIMILSVLRNTNHSVKFWFIENFLSPSFLEFIPHFAGEYGFKYELVTYKWPTWLRQQREKQRIIWAYKILFLDVLFPMDLDKVIFVDADQIVRADLKELIDLDLHGAPYGYTPMGDDNYEMEGFRFWKTGYWESFLRGRPYHISALYVVDLVRFRLMAAGDILRSHYQQLSADPNSLANLDQDLPNNLQLQVPIYSLHEDWLWCETWCSKDRLHRAKTIDLCQNPLTKEPKLSRARQIPEWEEYDAEIARFTRQLAVNGRIHSTAATADVNELANAGSSPVRVENSENEIGSEGVQAPTRDEL

SEQ ID NO: 4257 - protein, 1122 aa, Oncorhynchus mykiss
MEGLRSLLIETPFIHDILKLNVQPSDSDYAVDIRNPAVNWINNLETDSRYGSWPYSVQELLRPTFPGVVRQIRKNFHNLVVILDPTHESSAELLNVAEMFYSNNIPLRIGLVFVVSDVDEIDGMEDAGVALLRAFNYITEELDAPAAFDTIISMFNRVPSGGKLSVGDVVKVLEKKFPYVEVGSILGPDSTYDDNRKEGRGYYLQTGVGPLPVVMYNGMPYQREQLDPEELETVTMNKILETTSFYQRAVYMGELATDQDVVDFIMTQPNVVPRINPRILSTARTYLDLSNTNNHFIDEYARFLFLDSREKSTAVANSMNYMTKKDDGYIRPVTFWVVGDFDQPSGRQLLYDAIRHMKTSNNVRLGLINNPSDSPSEENSRVARAIWAAMQTQTANNAKNYITKLAKEETAKALETGADVTQFTVGGMDVALFKSAFEGPKFDFLLSHTVYCRDVLKLGKGQRAVISNGRIIGPLEDGEVFNQDDFLLLESIILKTSGERIKSKVQQLGVEEDRASDLVMKIDSLLSSQPKGEARIEHAFADDRYSAVKIRPTEGDVYFDMVAVIDPVTRDAQKLAPLLLVLKKLVNVNLRVFMNCQSKLSDLPLKSFYRYVLEPEVLFQTDGSFSPGPLAKFLDMPQTPLFTLNLNTPESWMVESVRTRYDLDNIYLEEVDSIVAAEYELEHLLLEGHCFDVSTGQPPRGLQFTLGTPSDPVIVDTIVMANLGYFQLKANPGAWILKLRKGRSDEIYKIYSHDGTDSPADADDLIVVLNNFKSRIIKVKVQKRPEKFSEELLSDGTQENDSGFWESLTRGFTGGVKTEESKQEKDDVINIFSVASGHLYERFLRIMMLSVLKNTKTPVKFWFLKNYLSPAFKEFIPYMAEQYGFQYELVQYKWPRWLHQQTEKQRIIWGYKILFLDVLFPLSVDKFLFVDADQIVRTDLKELRDLDLEGAPYGYTPFCESRREMDGFRFWKSGYWASHLAGRKYHISALYVVDLKKFRKIAAGDRLRGQYQGLSQDPNSLSNLDQDLPNNMIHQVPIKSLPQEWLWCETWCDDNSKKKAKTIDLCNNPQTKEPKLQAAVRIVAEWSDYDQEIKRLQNRVQERGAENHTTQKDKPDDTHIEL

SEQ ID NO: 4258 - protein, 1488 aa, Colletotrichum tanaceti
MMRLSRLPMGFALTMWAAVNVLAVPSVTVDMKAAFPSGPYLLELLETAAGENATAYFPLLDRIAGGYFNEAKTDKEVYDRFLHILNDDGHITAPEALSTFKLALSLRTAAPRIEAHYQYYRTAVEPKLGSDAPDGCEVWAERGGKQYCTPALDTPKESILHAKALPFDRVLGSGSETILYADPTSSAFGPFHSILARKARSGEIEYRLRYTKPAGSHEEALPVSGYGVELALKRTDYIVIDDREAHHDESQKVVNAEEVLDAAVEVADLKPLAKSELQELGLKAASFVMQSQNPFEALLRLTQDFPKFSTSIAAHNVSSDFLAEHQLNRQQLVPSGMNVLWMNGVQLIDRQIEAFTLIDLLRRERTLIDGVRDLGFTGGQAVSLLGHPKVAESKADEEPPRFDWTDDSEEEKVIMFLNDLEKDERYKNFPSQLMSLLQRVYPGQLPPIKRDIFNLIVPVDFSKIEDLNVVAQLNSFIQRKLPIRFGLVPLTPTEDAFGISKVLYYLLDNYGLGAFIDYLDAAMQDSKTEKPDQSVFEKATKDREALPDSKLLPFDDVLQSEELDHVVKLAQKWAKRLNANTPIPPVFINGIPVPRENNWLQAMSMKATDDLQTIQRAVYLGMIDEQGWVPDFFLENAIKRRNTYIYPEDDKSLKILDVNKIYTEHDSLFGKVPVIEAFAESTKENWAVLTVVGDFASDEGANFLVSALAFRRNNPGVRLDVVYNPLTPASASAVNAALKNGGDKFTEAESLSEIRSILDNAAGEPDGIFTAALNEFLSFSAIKPGSNVLILNGRVVGPFTEAEPFEADDFQYLLEFEQKTRILPVYAAVDELGLTDKISGPLAAAKVTSVTAISTISDLPAGIFESAPSLRVSAHDAWNSSYTAIEIGNPETSSIHVVGVLDPASEQAQRWAPILKVVSELDGVYLKLFLNPKDKIDELPVKRFFRYVLESEPSFDEAGKVRALEASFKGLPSEALLNAGMDVPPAWLVAPKFSLHDPDNIKLSSIKSNVYASYELESILIEGHSREGGQSQPPRGAQLVLGTEKEPHFADTIIMANLGYFQFKANPGFYNIQLKQGRSSDIYTIDSIGARGWTPVPGDEGSEVVLIDFQGTTLYPRLSRKPGQEEADVLAEPEDKSIVGRGLKFAEGILGKKKSASDDEHAEINIFSVASGHLYERMLNIMMVSVMKNTKHTVKFWFIEQFLSPSFKDFIPHMAKEYGFKYEMVTFKWPHWLRQQKEKQREIWGYKILFLDVLFPLSLDKVIFVDADQIVRTDMINLVNHDLEGKPYGFTPMCDSRTEMEGFRFWKQGYWDNYLRGNPYHISALYVVDLRRFREIAAGDRLRQTYHSLSADPNSLANLDQDLPNHMQFQIPIHSLPQEWLWCETWCSDESQKDAKTIDLCNNPQTKEPKLDRARRQVPEWNVYDNEIAALDRKRKGLPVEAPKKGENKVGGGDDGEQQKPDVAEEKNTKSRNWEEPPAEKTHVIDEL

SEQ ID NO: 4259 - protein, 1633 aa, Cucurbita maxima
METSCFGSGRRALVVLSLLVIYGGSGAFSEIRRPKNVQVAVQAKWSGTSVLLEAGELLAKERKDLYWDFIEIWLREEGNDADADASSAKDCLKKILKHGRLLLSEPLASLFEFSLILRSASPRLVLFQQLANDSLSSFPLPEENNSNIVGEGNESIERKKSDISVVGLNQKTPGGKCCWVDTGGSLFFDVPELLTWLQNPADCVGDCLQPPDLYDFDHVHFGSSSGSRVAILYGALGTDCFKQFHVTLVKAAKEGKVKYVIRPVIPSGCEVKINSCGAVGTRGSLNLGGYGVELALKNMEYKAMDDSAIKKGVTLEDPRTEDLSQEVRGFIFSKILERKPEITSEIMAFRDYLLSSTVSDTLDVWELKDLGHQTAQRIVQASDPLQSMQEINQNFPSIVSSLSRMKLNDSVKDEITANQRMIPPGKSLMALNGALINIEDVDLYLLIDMIHQDLLLADQFTKLRIPNHTIRKLLSSLPPADSDLLRVDFRSSHVHFLNNLEEDAMYKRWRSNINEILMPVFPGQLRYIRKNLFHAVYVLDPATVCGLQTIDTILSLYENSFPIRFGVLLYSSKFIKETESGDDGLNKSEADTSSLIIQLFLYFKENHGIQTAFQFLSNVNKLRLEADGLADDAPEMHHVEGAFVETLLPKTKSPPQDVLLKLEKEQTFKDLAEESSMFIFSRGLSKMDCSLLMNGLVLESSEESLINAMNEETPRIQEQVYYGHISSRTDVLEKFLSESGISRYNPQIVAEGNSRIVSMFASTHGGEFLLNGFNYLHSPGTTDDLKPVTHLLVIDAASKKGIKLLKEGLHYLMRGSKSARVGFLFTASNHAQESSLLLVKFFEISASLHSHKKKVLDFLDQLCSIYIQKFIPESSEVVYSPQEFIEKACELAEANDLPPKAYRIPFSDSFVDELRNYLGQVERLLSGQLGLESIVNAVITNGRVTLLTDGSSFLSHDLHLLEAVEYKRRIKHIVEIVEEVKWDDFDPDTLTSNFLSDVIMFVSSSMAQRDRSSESARFEVLNAEYSAIVLGNENSSVHIDAVIDPLSPSGQKLSSILRVLSKYIQPSMRIILNPLSSLVDLPLKNYYRYVLPSMDDFSGTDVTVNGPKAFFANMPLSKTLTMNLDVPEPWLVEPVIAVHDLDNILLENIGETRTLQAVFELEALVLTGHCSEKHQEPPRGLQLILGTNSTPHLVDTLVMANLGYWQMKVSPGVWYLQLAPGRSSELYLLKHGGDGSRDKTLSKRIIINDLRGNVVRMEVEKKKGKEHEKLLVPDGGDDLLENKKEGPTNWNSNILKWATGLIGSSDQSKKTKDTSVQGKGGRHGKTINIFSIASGHLYERFLKIMILSVLKNTHRPVKFWFIKNYLSPQFKDVLPRMAEEYGFDYELITYKWPTWLHKQKEKQRIIWAYKILFLDVIFPLSLEKVIFVDADQIVRTDMGELYDMDIKGKPLAYTPFCDNNKDMDGYRFWRQGFWKEHLRGRPYHISALYVVDLKKFRETAAGDNLRVFYESLSKDPNSLSNLDQDLPNYAQHTVPIFSLPQEWLWCESWCGNATKSKAKTIDLCNNPMTKEPKLEGARRIVPEWPDLDLEARTFTAKISGDANPQTPDLPTDQTETSVSKKSIDEDVESKAEL

SEQ ID NO: 4260 - protein, 1599 aa, Fomitopsis pinicola
MRQATCSLCSALILFAYRSYATSPPVQVELRSSWPAPPPLLESIETIALENPDSFFPLLDSLTNPETAPDTVPTSAEAAHKYAFDRALSAGFLAEPGAYGSAESNLALHAATPRIEALYQYYADRHAAQRDAIENTRCDSWVDWYGEVVCDAKTLARLAGVDTIDPPDSTKVEESYSAPKLMSFDHVYPSPASTLERPPRTAILYASLSSDNFWELHSLLYAASRAPKPHLEYVLRSIPPTARDASKRSYLSGYGVALDLKKMDYLALDDRTQGSSENADEADETTASSSASDPVVALIHQYPENTTLDASTPLTEEELLEIGLQAAQIISDAEEPLSILKQLSQNFPRYATSLARQVTVDAELAEEVENNQAIARGGTSVAWLNGVQLTEKDMNPFALLRLLRKERDIMQSLTSLGLSTTQALELLTHPNITEAQSSSDVLDGVVDASDRQEGGEVVQWLNDFEQDQRYLRWAKTLNILLRPMFPGQFPNYRGNLFNVVIVADLSQTSSLHFLATTASAIIARGFPFRWGIVPLAETEDGTKMARLLYFLIGRVGRQNTLEFIRHIAQVNRPMQQTTPTIDWALVRTAFNSFRASGQDHGEEPIPELDAILKGDVAPMNENIERARKYAARLGATAAASPQGHAFVNGKHFNLDDSFLQLMQMELREQLGYIQEQLVLGTLSDADADDIATYFYDLPVASKRRNRHIYPSTKAGDLRIHSLFDTVVKYGFPNAQGSFVYPPEPKAIPLTTYVVADLNSEAGQALVKEALAAMASEFPSRVSFVHNPAVGPADSTIHPQVSSLFAQLIMKGLLERVSPGRLLEILGAGDVASPDHTRQVVIAAESGLDEILERTELKDEEYQEYAKASRLVARALGFVPGEQGLLVNGRVIGPVAAGDFEAQDFPVLSAYELRKRVQPVVDALQDVTGMLEEYDRASYAEAVSLASSLISAIELPDPSEAGLMNAPHRPRQLKYQLLDGQHTGFTLGDNTTAFYNFGIIVDPLSEAAQKWSSLMQWLLEIPGVTIELHTNPAKNSELPLKRFYRYNLHPRLTYGESGEEVHVQTEFTGLPVEPIYTLAMDVPQSWFARPRESLHDLDNILLASLSPQDRSQGVKAVFDLDYLVIEGHARDMFINGPPRGLQLQLASDSGEPIADTLVVANLGYLQFRTKPGVFRLEIRPGRGRDVFKMESVGNEGWHSLSVDEAGDEITLTNFEGLTLYPRLVRLPGMERVDVLAEVAPAGPPSAGLLDSVVSRITSLFGGQHVQEVTAIENKQADINIFTVASGLLYERFASIMILSVLRNTNSTVKFWFIENFLSPSFLEFLPHFSEAYGFQYELVTYKWPSWLRAQKEKQRIIWAYKILFLDVLFPMDLKKVLFVDADQIVRADLKELVDLDLHGAPYAYTPMGDDNVEMEGFRFWKTGYWKEFLQGLPYHISALYVVDLVRFRQMGAGDILRGHYQQLSADPNSLANLDQDLPNNLQRDVPIFSLPEDWLWCETWCSKERLHRAKTIDLCQNPLTKEPKLSRARQIPEWEEYDGEIARFARTLAEEGKMLSGIVAADVNVLADVGRSSSSGPAPDAPKEDAEKAPEENNVPRDEL

SEQ ID NO: 4261 - protein, 1517 aa, Oryctolagus cuniculus
MAPAKAEAVMRLLLGAAALWLSLLDAGTASASKAVTAHLAAKWPETPLLLEASEFMAEESNEKFWQFLETVKELAIYKKTESDYSYYNLILKKAGQFLDNLHINLLKFALSIRAYSPTIQMFQQIAAEEPPPDGCNAFVVIHQKHTCKINEIKKLLKKATSRPRPYLFKGDHKFPTNKENLPVIILYAEMGTRAFGQFHKVLSEKAQNEEILYVLRHYIQKPNSRKMYLSGYGVELAIKSTEYKALDDTQVKDTAVTNTTVEDETGANEVQGFLFGKLKEIHSDLKDNLTAFQKYLIESNKEMMPLKVWELQDLSFQAASQIMSTPVYDAIKLMKDISQNFPIKARSLTRIPVSHQMREEIQQNQKDLRDRFEIQPGDARLFINGLRVDMDVYDPFSILDMLKLDGKMMNGLRNLGIHGENMSKFLKLNSHVWEYSYILDIRHSSIVWINDLENDGLYVTWPTSCEEFLKPGFPGSVPFIRRNFHNLVLFIDPAQEYTLDFIKLAEFFYVHKAPLRIGFVFILNTDDIVDGTNDAGVALWRAFNYIAEELGISEAFISIVHMYQNVKNKNVLTVDNVKNVLQNKFPHANILDILGIYSQYDKERKAGASFYKITGLGPLPQAVYNGEPLNKEEMNRKELEMAISDKMMDTSVYLQRDFFMGTLNDRMNAIDFLMDKNNVVPRINSLILSTKPQYLNLIPSSVTADIEDFSTFSFLDSHDKSAVIAKNMYYLTQEDDVISSVTLWIIADFDMPSGRKLLFNALKHMKTSVHSRLGIIYNPTSKINEENTAICRGILAAFLTQKDNFLRSFLEKLAKEETATAIYSGDKIKTFLTEGMDKSAFEKKYNTVGVNIFRTHRLFCQDVLKLRPGEIGVVSNGKFLGPLDEDLYVEDFYLLEKITFSNVAEKIKGVVEAMESNSKNISELIMKVDSLVSSLPNRGSRYDVTFLKENHSIIKMSPQENDMFFDVVAIVDPLTREAQKMAQILIVLGKIINMKMKLFMNCRGKLSEAPLDSFYRFVLEPEVMSGSDNVPSLGPMAKFVDIPESPLLTLNMITPEGWLVETVHSNCDLDNIHLKDIERTVTAEYELEYLLLEGHCFNSMTEQPPRGLQFTLGTKTQPVMVDTVVMANLGYFQLKANPGAWILKLREGKSEDIYQIVGHEGADSQPDLEDVIVVLNSFKSKILKVQVQKKQDKIKEDILTDKDETSKGMWDSIKSFTRRLHKEDDKDKKDVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLAVDKIIFVDADQIVRHDLKELRDFDLDGAPYGYTPFCDSRTDMDGYRFWKTGYWASHLLRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLKAAARIIPEWVEYDTEIRQLLDQLESKKKNAILAHDEL

SEQ ID NO: 4262 - protein, 1504 aa, Venturia nashicola
MRVPSWVLPAEILLLVGSLGLFPLTGAAPSINVGLQASFNSAPYLVELLETAAEEEPDVYYKILDRISDGYFSDASTDKELYEKFVRLLKNDHLITDSESLSSFELALSIHNAAPRIEAHYQYYRTTIQPMLEKSKAEDCETWLAFTGKQFCSPQFEKEDATIKGMTIEGGEPVLPFDRLYGPPTTIPAVIYADISSPVFKKFHSLISEAAKNGRVSYRVRHKPSKSDRKPLGMSGFGTELALKRTDYIVIDDRKAEEGKEADKEPAKPADIDLVDEEVADLKPLTSSEVMELGLKASTYVLGSEDPLETLVKLTQDFPKYSSVIAGVNSSEAFLTEHQENRALLLSSGYNVMWINGVQFDSRKVDAFSLLDHMRRERALLGSFQEMELTSEEAIKLLTHPSIAEAQADVEIQRYDWRDETEGGNVIVWMNDIEKDKRYGQWSNAIYGLLQRGYPGQLPSVRKDIHNAIIPIDFSDPISIHRATETVQDIVKRKIPIRFGLVPVTSTEGAAKQAQVVYHILDNYGLGALMQYLESSLAAKKTAAPHEATFKTVIEKRKLKAGREAASFQAVLQSEDSRTQVDGAKKYLIRLGATGSTPPVFMNGVPIRNDDDWLQNMVQRVSQDLQWIQRGVFEETLTQDMWLPSYWLNDSSIRRNPLVIPENDKDIKLLNLVNVLKREEEQILKTMPTIPADEDSDKAIWVQLILVGDFDTQVGLQMILDAIKFRRENPNVELVFVAQSGSPMIKSPRIVQFWPKEGKWTMETIQAVYRDVKALLAAPYDNAAHDNSQFWPVDTERLAQTFGFDQGQNGLIINGRKIGPISADSAFTKDDFLALYAFELKKRIAPASEAVTELEYQDKIKTVLDAAKLCSLLAVSTVSDMPEGIFELPPPLRTRMYYGWSDSETAITVGDNTTALINIVAVLDPASELAQRWSPVLRVLSKLEGVSLKLFLNPREMLQELPVKRFYRYALSDKPSFDDDGAVTAPGVKFEGIPKDMLLTVAMDVPPSWLVAQKESLYDLDNVKLSSLPLGDNVDATYELENILIEGHTRDSKGDQPPRGAQLVLSTAKDPLFADTIIMANLGYFQFKANPGYYNITLKPGLSSKIFKLDSAGALGYEPTPGDETSEVCLLSFQGLTLYPRFSRNPGMEDEDVLGSTKSNTAADLASKGAELVDGLLNKAGIKKGKGVQTVQADINIFSVASGHLYERMLNIMMVSVMRHTKHTVKFWFIEQFLSSSFKSFLPTLAKEYGFKYEMVTYKWPHWLRAQKEKQREIWGYKILFLDVLFPLDLDKVIFVDADQIVRTDMYELVTHDLKGAPYGFTPMCDSRVEMEGFRFWKQGYWKNFLRDLPYHISALYVVDLKRFRQIAAGDRLRQQYHQLSSDPASLSNLDQDLPNNMQMMLPIHSLPQEWLWCETWCSDESLKDAKTIDLCNNPQTKEPKLDRARRQIPEWTEYDDEIAALAKRTKQSEKVPTGDEQAGTEGRPKESIVESNSAESTHVKDEL

SEQ ID NO: 4263 - protein, 1331 aa, Conidiobolus coronatus
MKLNKIINLILSTSPLLAATAEGDNSSQISLKIKTKWKQNSPSLELLELLASENPSHYYPTLELIFKNIVAETQGKTSVQKTFQDTLIKLKSKLGSKVNFDLLNLGLSLKLSSSKLETKFNYYDSYVKDKFAKECGDWIQVGENEQFCDVDKFENWWQANKQNISEITPFDIIFPSVGRNQPKIIYYTNFNSKSLKFYENLVRLTRPNRGFNFALRYQPNMGGKDSKNVELSGYGVYLDLKNTEYKVQDDRYQNKNEKDSKSTSEDPDASSKIPVEYTSIWNEELSHFQQNIQQIQKYEDSDLEGFNQKFTQLIKSSKSPLQTWIYLLQNLPHHAQTVLNETLAEGHCEGITLGRNFFFQQPIQDQILINGIEIDLGQLDIFNLVKFLNLEFNTFKLFNYLDITNEEARNLLIGKSNEGGDEELESTKEKKSLWENVYNTRDNTEGEDNKVVIWLNNIEEDEIYEDWSSELSSLQTYMYGYLPQTRRNFANSVFPLNLNNLDDLHFFAKNLIKFSSSPVPIRFGLVTLVDEKNGDDSKKINNLVHYLFDHLTKSELKEYLEEVAKSSTESNEPIVNAFKSHYPSLKKNNPSLKLELTEIFNLSDSEYIAPSINYSNRLQLKLDEEVLFINGKRVEFEGNFQKPLIQNLFQQIPVIMEMASEGEFDNGGIYDIWLNNPQVLNNFNPFLNFIRSSTNSDENENGPLTTVWIAGNFESVESNTIIEDAIKYLKSGAKGVRLSFVPTNLEGKNNELLFNLINSQDQLADLPDTFEELKNYKFSYKPSYKELFAYFSRTNSYFYQDCCVSLIENNEDGDGIQLVLDTKKLQVSSKEFKFIQLGSIVDYYNIKFKAPLVSRLSNNLNNYSKLDEVGKSNTLIQVSAILNQNLKVHQSLVRFGSYEGERGTLPEINRPQCELKLTHEDEKKDTWANIEFILDPLGDNAAKWSSILNKLRDLDGVKLKGYFSPNSPPGEFKKTHLNRFYRYLLPNSLEFDETSEELKAPKIEFSDLPESSLLTLGLDTMTSWVVMAKDSPHDLDNLKLSSLPSTGTHPEFELKHLLIEGHCTDFDLASGHLYERFLSVMVASVMKNTDRKVKFCHLPMASLVKYSIRKTRIIWGYKILFLDVLFPLDLDKVIFVDADQSVRADLGELVDLDLEGKPYGYTPFCTSRESMKGYRFWEQGYWKSHLDGKPYHISALYVVDLKRFRSQAAGDILRQHYQMLSQDPNSLANLDQDLPNHLQHELPIFSLPQEWLWCETWCDDASLKSAKTIDLCNNPETKEPKLDRARRILPEWQKFDDEVRSIDTEDEDTTGKDKKDDVKGDGDESAEDEEL

SEQ ID NO: 4264 - protein, 1469 aa, Ophiocordyceps sp.
MARHTCLPWPLYVTVMTAMTVVAVPSVNVGMKAAFSAGPYLLELIETAASENSTAYFPLLDRIADGYFAGASSDAVLYNSFLELLVKDSYIASSEALSTFNLALTLRSAAPRIEAHYQYYSTAVEPAVDPSCLNWVLLEGKQYCTPELDKPIKEGLFSSSEVTSLPFDRTLGSGKDVVLYADPISESFGKYHEAVVKASRALGLRYRVRYRRSEASPRRNLPVSGYGVELALKRTDYIVIDDRDAAVDRSQKPLTSGGFDEEDEVADLRPLSTSELALLGLKTASFIQTSSDPFAMLVKLTQDFPRYSASIAAHNVSDAFHAADEKVVPGGINFLWMNGVQLIERQIEPFALVEMLRRERRLVDGFRRLGFTGKQAISLLGHPAVSASKGDDEVLRYDWTDKPEDGGAIFWLNDLETDSRYENYPKSLVALLQRTFPGQIPQIGRNVFNIIAPVDLSNTDDIAFVSQVVSIVRRGIPLRFGLIPLTSTATAVSQAKVAFYLMENYGIEAFFAYIDGLSENRQSTIDEKLFADIIGRVDTVTDAEKLSLSEVVQAENWATRIKSILHWVKRLKADTIIRPLFINGAVILRDASWMQTMSTKITGDLQSIQKEIFQGSVTEDSNSSGIFLKGAFLRRNPYISVESDKALQMLDVSRIYNEHGKLLGIMPVLEPYSESTKENWAVVTVLADLTTVSGRELLLAALEFKRSSPGVRLELVHNPEDPLKASRVSSAIKTQQDLIKDMETMEQLTTVLDSADGVPDDDDYAPILSAFLDMAKMEPGRNAVILNGRVVGPIPSDEAFTADDFQLLLEYEQGQRILPVYTAIDDLGLGDKLSNALSAAKATSIVALSTISDLPEGIFESAPTIRSTMYDSWDVSHATIEVGDPETASIHIAGLLDPASEKGQRWTPILRVLSELDGVYLKIILNPREKITELPLKRFFRYVMDAKPSFEENGSVKALKASFESLPSEVLLTAGMDVPPAWLVAPKESVHDLDNVKLSSVKSNIDATYELEHILIEGHSREGRGAPPRGAQLTLATEKNPMITDTIIMSNLGFFQFKANPGFYKIRLKEGRTGEIYTIESIGAKGWEATAGDEGTELALMDFQGTTLYPRLKRRPGMEQEDVLETSDGNSSGGILSKGLKLAEELLGGAKTKSPSAQKHADINIFSVASGHLYERMLNIMMVSVMRNTKHSVKFWFIEQFLSPSFKEFIPHMAEEYGFEYEMVTYKWPHWLRQQKEKQREIWGYKILFLDVLFPLSLDKVIFVDADQIVRTDMMDLVDLDLKGAPYGFAPMCDSRTEMEGFRFWKQGYWANYLRGRPYHISALYVVDLRRFRELAAGDRLRQQYHALSADPASLSNLDQDLPNHMQFEIPIHSLPQEWLWCETWCSDESLATARTIDLCNNPQTKEPKLDRARRQVPEWTVYDDEIAALNRKRTASLDGADQTREPINTKSRRLDGDNEQKVHTMDEL

SEQ ID NO: 4265 - protein, 950 aa, Zea mays
MYKQEAEESSHFVHKLGLYRLQCCLLMNGLVHEASEEATMNAMNDELPRIQEQVYYGHIQSHTDILEKFLSENSYKRYNPSITGKNAEKKFVSLFASYHQDSFIFNDMKYLQSPGTTDDAKPVTHLLAIDLSSKVGTKLLYEAILYLMDGSDRARVGLLLYVHTGGSSPILLLKDIFDRTISSFSYKEKVLVFLHGLLKFYDAQPLPASSVADDWTRTMMEKVYTLAAETALPVDDYKAWFKSFSADTVLKGMDKLSDFLFGQLGLVFGSNAVITNGRVFIMNEGKSFLANDLGLLESMEYDLRTKYIFEIIEEVEFASVDPDDLTNQFYSDIAMLISSSMSVRERTSERAHFEILHAEHSAIKLNNANSSIHIDAVIDPLSPTGQKLAPLLRILWKQIQPSMRIVLNPISSLADLPLKNFYRFVLPSMDDFSSTDHSVHGPKAFFANMPLSKTLTMNIDVPEPWLVESVIAIHDLDNILLENLGDVRTLQAVFELEALLLTGHCMEKDRDPPRGLQFILGTKQRPHLVDTLVMANLGYWQMKVSPGVWYLQLAPGRSADLYELPPKLIAIDSLRGKLMHIEVQKKKGKEHEDLLNAADDYHFQEKTDNKGWNKNLLKWASSLITGDASSKSKADKTTDRKDARQGETINIFSVASGHLYERFLKIMILSVLKKTQRPVKFWFIKNYLSPQFKDVIPHMAREYEFEYELVTYKWPTWLHKQKEKQRIIWAYKILFLDVIFPLSLRKVIFVDADQIVRADMGELYDMNLKGRPLAYTPFCDNNKDMDGFRFWKQGFWKDHLRGRPYHISALYVVDLAKFRQTASGDTLRVFYEQLSKDPNSLSNLDQDLPNYAQHTVPIFSLPQEWLWCESWCGNATKARAKTIDLCNNPMTKEPKLQGARRIVPEWTGLDSEARQFTARILGDDVEPADATPPPSEAPKPEDDQDVKDEL

SEQ ID NO: 4266 - protein, 1636 aa, Paxillus rubicundulus
MTFAPPCVLFALTGVVLSALSVQGASPPVAVSLRSSFSGSDPLLEAFETVAMEEPSVLFPLLSAFSLPEGPLTPQDVHEAVFDIASSHMDGSALASAHALLALHAASPRLAASAEYYDSHIANLTDSHKLFSPDCASWVDWYGHIVCDADTLLQLADSENNTPATRPKRLPLDHVHRVTATLEEPRYTALHFADPTAPSFTSLHGTLLSLEPKVEYILRWAKGTIEKRGSELSSYLSGYGVALDLKKMDYLVLDDRNQHQGGSAAHDTSSGDNVEDEDNRPSDEEIISCIFDSLPYIDEEAEATARAGEPLSSEEITNLGVNAIQFVMSFSSRPQAGPLYIHQCWDNHHQVPFPAVALFSTLSTSFPLYATSLARKIKVLDDLRDEVHENWAKASPGVNMVWVNGRVINENEGSAGSIFGLLRTLQRERGLVKFLVDLGLTSSQAIEFLVHPAHSATQQPTPSIHLDTSRKGTTQGSAEKKTFAISPKFAEFFDGLVDASDRQEGGGVVLYWNDLEADQQYAGFSPSLHGLLRVHTMSLFSPMLKIRLNLVNVILVLDLSETRSLSLLGSLSETFVARGFPVRWGLVPDCQGDSLKMARLLYYLKQKYGRDRMTAFIRGVSYSHTERRLPSLSWQIVHETFNALSAGHDFAAVARGDEPVIDEATGEDVLVRAQKYARRLGLGLQGVAGKGHAFVNGRYFPVNDNIFRQLSGEVMTQLQILQEMVYTGEIMDTDASLMSTFFYDLPTTFSRRNPYIFVNNAPGGGHLLDATGLQMFNLPELFIKAGSEQKDGSFILPSDSDDLPITMYIIADFDSPEGLELAKEALTFVTNSDRTRVSFIHGPGKMTTGVVSTFISTLVHSGGLSDVPPSRMLEALANRSDEQLAAFRDELMAGKRLTDAELLRILQTNRLVARELGLKPGQRCILANGRLVGPFESGSDFDAEDFEMLEAFEIKQRVGRVMEAIDAVLDDGDALDVTRRAHLVSMASSIIYADQQPDPSEAGLFDSAPKPRTQNYRSLSGKYTKLDFGDPSGAQSHITLLLDPLSETAQRWSAILARSFDFFPQVYIELYFNPTQHSEIPLKRFYRPNVVPYLKYDANGQEIPAQVTFTGLPMEPIYTLSMDVPPSWLVRPREALYDLDNIHLGKLPAEERTSGIQAVFALDYLVVEGHARELKTSNPPRGVQLQLISSKDGSVVDDTQIVANLGYFQFKARPGTFRLEIREGRGREMYELASVGSEGWNSLPVAEAGNELTVMSFGGLTLYPQLARKPGMERMDVLNGLHAPIEESPTVMESFMSKMSSFFKSRDEGKDVEVIKKQTHGQADINIFTVASGLLYERFASIMILSVLRNTKSSVKFWFIENFLSPSFLEFIPHMAEEYGFQYELVTYKWPSWLRAQKEKQRIIWAYKILFLDVLFPMDLKKVIFVDADQIVRADLKELVDLDLHGAPYGYTPMGDDNHEMEGFRFWKTGYWHDFLAGKPYHISALYVVDLVRFRQMAAGDILRGSYQMLSADPNSLANLDQDLPNNLQRDVPIHSLHEDWLWCETWCSKDRLHRAKTIDLCQNPLTKEPKLSRARQIPEWGEYDNEIAQFARKLAAEGKIHASVATADSNILAGSNAQPSTSGEAKDSSRSHDEL

SEQ ID NO: 4267 - protein, 1597 aa, Dactylellina haptotyla
MWFSTLWSQRPSRGALLTSVLALSSIQLASARSQPQDIVEDGTVKRWEGLNLSLKTSWNAGPFILEILECAALENQEFYFTLLKLLGAETLKIVHPDKKMYDSLVEYVEKNELLNHQFLPTWKFCMALRETSPRIEAQYQYYLNNVDFAKGNDCPVWFDDGERQSCKAEDLAKVQPKSSSASRIKEVAFDRSSTDDVRKGLVIFYIDVLHKDFPKAYAEMVEAAEKAGIAYKIRYRPSPSLQNPKPVALSGYGVSLVLKKTDYMVIDDRDAKEGEDPASSSSTTSSVKPSPSPKYKFKTVEGLESKEPRFPLWDLEDIDDPVKDLRDLIPLSQKYLGDLGFKTANFVSKSGIYPPDILMKILSDFPKYAHTIGHMGGVLPEFMEEHHANREQWLPEGFNAMFLNGMMLDPSEVTATTLLELMRRERKYTLQIRELGLNQKETLDLITHENITQSKLVEEKPRFDWREQEREQGAIIWLNDLETEESYKDWPESINEILMPTYGGQLANIRKNIHNLVIPLDFSNRDDLVLLAERLFMFVKRGLALRIGVVPIVRNNLGSTNARIYAALADSYDLITANSYLKDGLDADKYNVRYPAPEYIHHAIKGRTLKDGKEKISLSGVMESSYWQARHQSAGVWEERLGVSTRPYPFFINGIGQPFGDDWINVLTNSLPNDIRRIQQAIRAEELTDENDIVSFVLDRPIRRRSTLIFKDEAPNVVNLCDLREADPETFDKLPYFPGMLTEEAETASADVWVIGDFDTPTGYSLLEEVAAVQDRKPGISVTAISNSEYKTQVQTLSALLYSLGGNTLVSTTPGILQKLIAEVKPEKDYVDMKIEGADQKILGADAKTAGWAIPDQVAAEKFWRETAAFLERKLGIKPGQRAVLVNGRLLGPFDNSINFFQEDFETLIEVELKARITPVLTAAKTLGVLDRLRAANYKGRLTSAMTVLQTPHNTGLVDRSSNVRTNLYNMWKRSKTVLKSGDPIWSTFRFMVSLDPLSEVAQKWAPILRVLMSMDGVGIFTWLNPKERLTEVPIKRYYRHVLYSQPKFDVNGDILEPKAQFIDLPDKTLYSLSMDIPPSWLVAPSETIHDLDNIKLQTFKERFGTSDLNATYVLRNILIEGHSRDTSLNEPSAGAQMELGSSKNPVMEDTIVMQNLGYFQFKSNPGHWQIRLKPGRSADIFHIQSLGAGGFDLADNSEDDVKDVTLMSFRGVTLYPRLKRNKGYQGVDVFAAHPEDNSGSGDKAGGFADGLLSKLGIMKGKEKKDVGKATAEINIFSVASGHLYERFLNLMMLSVMKHTNHTVKFWFIENFLSPAFKDFIPTMAKEYNFEYELVTYKWPHWLRQQKEKQREIWGYKILFLDVLFPLNLDKIIFVDADQIVRTDMKELVDLDLEGAPYGFTPMCDSRTEIEGFRFWKQGYWKTFLGDLKYHISALFVVDLKLFRQLAGGDRLRQQYHQLSADPNSLANLDQDLPNNMQRFLPIFSLPQDWLWCETWCSDESFKTAKTIDLCNNPMTKEPKLDRARRQVPEWTAYDDEIAALAKRVKAKGVENMREALVQKEVLGEQEKAVKEEAKKEVKEEKTETEAEKAVPPKDEL

SEQ ID NO: 4268 - protein, 1494 aa, Chaetomium thermophilum
ETGQVAASPSINVALKAAFPSPPYLVELLETAASDNTTIYYSLLDRIAKGHFAEATTDKALYEKFLEVLRDDGHMDPEALSAFKLALSLRTATPRVEAHYQYYTATVEPSLSGTQEGCDQWFLIDGEQYCSPTLDTSHGKVKGEDQLRTLPFDRKFGVGCRDVILYADITSKSFAPFHEVAMDLAKKGKASYRVRYRRSPSHSRESLSVNGYGVELVLKRTDYIVIDDRDTGAAAKPAEENDQKPLVGHETVLDDGEEIADIKPLEKSELAALGMKAASFVMQSEKPFEALLKLTQDFPKYSNSLGSQNVSAEFEAEHRGNREVFLPEGSNVLWLNGLHLIDRQIQPFGLVDLLTRERKLIKSVLDLGLTGQQAVDLLGHAEVAHAKSGDDEPRRFDWRDDIEEGQVIIWLNNLEKDKRYKSFSPSIWVLIHHFGHGLPQIRRDVFNLVVPVDLTKADDVKIVVEGLLSFVKRLIPVRFGFVPLTPTGQAIDQAKVVYYLLENYGLAAATAYLEKSYEEQSTGQPNERIFNEVIKDKSLRPDGVELSFKDIFISEKHEKQIHLSKHWVERLRAGGDVPTVFFDGFPIPREDNWLRVMNHRLMQDLQALQQAGYFGMLNESMWLPGFFLEKALSRRNTLIFPEDKNELTVLNVNKIYIENHDLMSKVPVIEASKESTRDDWAALTVVADLDDIEGQELVYYALRFRKSNDGVRLDIVHNPKDCSRSPSVLAQRLKSREDKLLDFTRFLDLETALETGEFEPDVAYDASLANFLASSNMKAGDNFVILNGRVLGPITSADDFKKEDFEVFLQAERRTRILPVYKALEDLGLDDKVSGPLSAAKLTSVTALSTISDLPQGIFDNAPTVRTTLFKQWNSTYTSFEVGDASTATIFFVAVINPASEIGQRWVAVLKVLSELEGVHLRVFLNPTVMIEELPVKRFYRYVLSSSPSFDESGKVKALSARFTGVPRETLLVVGMDVPPAWLVTSKVAVDDLDNLRIKDIKAKRGTEHVEAIYELEHILIEGHSREIPGAHAPRGVQLVLETENNPHFADTIIMANLGYFQFKANPGVYNIRLKEGRSSEIFTLESVGAKGWGPIPGDDNTEVVLMDFQGTTLYPRLRRKPGMEEEDVLEPSTKSGEESGSGARNLVSRGIKFAEGLLGRGNKAAEATKSVSKTEHAEINIFSVASGHLYERMLNIMMASVMHHTNHTVKFWFIEQFLSPSFKDFIPHMAAEYGFKYEMVTYKWPHWLRQQKEKQREIWGYKILFLDVLFPLSLDKVIFVDADQIVRTDMYDLVEHPLDGAPYGFAPMCDSRVEMEGYRFWKTGYWANYLKGKPYHISALYVVDLQRFRELAAGDRLRQQYHALSADPNSLANLDQDLPNHMQFTIPIATLPQEWLWCETWCSDETLKDARTIDLCNNPMTKEPKLDRARRQVPEWTKYDEEIAELARRVREEKPKKKEEEKVQKNPKSRRLDGDEEEVKTVREGTKHHHHHH

SEQ ID NO: 4269 - protein, 1612 aa, Spatholobus suberectus
MGCLCRSECWVLIVLGLLAIGSAFADTPQRPKNVQTALRAKWSGTPLLLEAGELLSIEQKDLFWDFIEIWLDTDKDAVDSQTAKDCLKKILECGRPLLREPLRSLFELSLMLRSASPRLVLYRQLAEESLTSFPLGDENYSDDETEEKLQTEKKIERRKLDPLHAGVNLKSHGGKCCWVDTGEHLFLDVYELLTWFQGFAAAELVGDSFQRPEIFDFDHVYYESNIGSPVAILYGALGTNCFKEFHVALVKAAKEGNVKYVVRPVLPAGCESNITHCGSVGAGESVNLGGYGVELALKNMEYKAMDDSTVKKGVTLEDPRIEDLSQEVRGFIFSKILERKPELTSEVMAFRDYLLSSTVSDTLDVWELKDLGHQTVQRIVRASDPLQSMQEINQNFPSIVSSLSRMKLDDSVRDEIMANQQMIPPGKSLMALNGALVNVEDVDLYLLIDLIHQDLLLADQFSKLKIPQGTLRKLLSTLPPSESSIFRVDFRSTHVHYLNNLEEDAKYKGWRNNINEILMPVFPGQLRYIRKNLFHAVFVIDPATRCGLESIDMIMSLYENNFPVRFGIVLYSSKFVMQLENHATKEHSNKSDEDISTTVNKLHVKLDGNAGDALELHHVEGVFVDTILSKVKSPPQEILLKLYKDQKLKELSQESSKFVFNLGLSKLQCSLLVNGLVIEPTEEALINALNDETPRIQEQVYFGQIMSDTDVLAKFLSEAGIQRYNPKIISDSKLRFISLSLFTVGEESVLNDIIYLHSPGTMDDLKAVTHLLAVDVTSRNGMKLLQQGIHYLTEGSKNARVGLLFNANQSPNLFSLLFVKVFEITASLYSHKMNVLDFLDQLCSLYEQNYILTSPMEAASTQAFIDMVCELGEANGLPSKDYKSALPEFLADDVRKHLTKMQNSLYRVLGLDSSVNAVFTNGRVTYPIDESSFLSADLHLLESIEFEQRTKHIVEIIEEVEWHDVDPDMLTSKFISDIVMALSSSMAKRERNSESARFEILSDQHSAIILNNENSNIHIDAVLDPLSSTSQKLSGILRVLWKYIQPSMRIVLNPMSSLADLPLKSYYRYIVPTMDDFSNTDSVINGPKAFFANMPLSKTLTMNLDVPEFWLVEPVIAFHDLDNILLENLGDTRTLQAVFELEALVLTGHCSEKDHDPPRGLQLILGTKTTPHLVDTLVMANLGYWQMKVSPGVWYLQLTPGRSSELYILKEDGEGSHDKQSSKLITINDLWGKVVHMEVVKKKGKEHEKLLLPDNADNAQEKKKGSSLNSNFFKWASGFIGGNKLSKMAEKSSPEKGKGGRHGKTINIFSIASGHLYERFMKIMILSVLKNTHRPVKFWFIKNYLSPPFKDLIPHMALEYGFEYELVTYKWPTWLHKQKEKQRIIWAYKILFLDVIFPLSLEKVIFVDADQVVRADMGELYDMDLRGKPLAYTPFCDNNKEMDGYRFWRQGFWKDHLQGKPYHISALYVVDLKKFRGTAAGDNLRVFYETLSKDPNSLANLDQDLPNYAQHTVPIFSLPQEWLWCESWCGNATKYKAKTIDLCNNPMTKEPKLQGARRIVSEWPDLDFEATRFTARILGDDQESEPIQSPNQSKDLTNEDSSNEDKESRAEL

SEQ ID NO: 4270 - protein, 1534 aa, Acanthaster planci
MAWPRFCSVLLLVLLQALRSSSIKSKPITTSLQAKWPATPLVAEASEFLADKGVESFWSFVDSLSELRDGDVGETDESKYAFVMKFAGRLLSDTERDLLKLTLSIHSYSPKIEMFNQIAQDLPPPSGCDAFVHVHGQVTCSLTDMAELIASAPERAKPNVYAVDHRYPRSQNNSITVILYGHIGNLRSQVKHFHQRLKGLANKGTVQYVLRHFVKDQSAQRIRLSGYGVELAIKSTEYKAVDDTEVKEGDGHSQDEEDNAPDEVQGFIFSKLKELHPDLVDNLNSFRASLLESNRKMVPLKVWQLQTIAFQAAQRVLSSPTKDALRVLREISQNFPLLASSLVKTQVKDEVRKEITENQKIFEATYGVGEGDTIMMLNGLVIDTDVAEPFLLLELLRSESQILDGLYSLGVSGEASGQLMRVQVASHDGTYAVDIRDNSVLYLNDLEKDERYAHWPSGVQEFLRPMFPGMLRQIKKNVFHLIFMLDPTQPESLQFLQQAEMFVLNEIPVTVGVVFVVSKEDEVNWREDAGVAMMRAFNFAMIDGGSPQALDLLIKILTAAEDEVVTPENVVQTFKKMFPGEDLDEILGPGTEYDDRRQDGKAYFERTGLGSLPQVMMNGVPFTSKQLQPDEFEESVVTAILMATPDLQRAVYRGKINDRTNLMDYLMAQPNVMPRLNPRILADDTRLLDLTAQPGDLPNLSLSVFQGLSTSGQTAAVTNSMKYLTKKDDLSLRPVSMWIVCDLETTEGRMLVSNANKYMKTSNTLRIGVISNTADSSDNRQWLARAIHSVQKTQTRNHAKNFINKLLKEENYQSIEGGKTKVEDYEVHGMNMGAFKQAFKESEFLKIQRVFSDKVLHLLPGQRAVIASGRVFGPLSQDEQFTEDDFSLAEKLILQTSAASVKKKMEKLASNFASTGDSLSDLTLKVDALLASNSRQEGRKEVSFWRDKHSVIDIPPRDQSKPCFDIVAILDPLSSQAQKWSHILGVLKEVINVKIRIFMNPKDKLSEMPLKRFYRYVLEPELSFRVDSSLTAGPMAKFSDMPPDTLLTLNLLTPESWLVEPVRTAHDLDNIKLSESEMGIHGQYELEYLLVEGHCFDQASGQPPRGLQFTLGNQQEPVIQDTIVMANLGYFQLKANPGAWLLRLRHGRSADIYQVSGHEGTDSLPGVNDTIITMDSFKSKIIKIKVNKKPGKEDESLLSDSQTDKRVAGGIWDSLSSFVSSLTGSGGKEGDSDQDKTLNIFSIASGHLYERFLRIMMLSVLKNTKSPVKFWFLKNYLSPTFKEFIPHMAAEYGFEYELVQYKWPRWLHQQTEKQRLIWGYKILFLDVLFPLDVKKIIFVDADQIVRADLQELANLNLQGAPYGYTPFCASRREMDGFRFWNSGYWKSHLAGRKYHISALYVVDLVKFRKIAAGDRLRGQYQALSQDPNSLSNLDQDLPNNMIHQVAIHSLPQEWLWCETWCSDAEKPAAKTIDLCNNPLTKEPKLESAVRIVPEWTGYDNEIKALQERVAQGLTTQSVGGDKTQANPADDHTEL

SEQ ID NO: 4271 - protein, 1536 aa, Parus major
MGCAQGPARLAVTQHLMAGCAGLLSPVLLLALLCPRPWPCGISPASSQPVTARLAAKWPATPLLLETSEFIAEDGNEKFWQFLETVRELTVYKQGDSEYSYVNLILKKAGQFLSNLQINLLKFALSIRAYSPTVQMFQQIAADEPPPEGCSAFVAIHGKHTCKTKRIKKLLEKATKRPRPYLFKGDHKFPALKEDGPVVILYAEIGTKGFVKFHKILSEMAKKEEIVYVLRHYVQKPNSRKMYLSGYGVELAIKSTEYKAVDDTQVKGAKETKEEEDEEESDVQGFLFGKLKRMHPDLKSNLLEFKNHLIETANNMEPLKVWEMQDLSFQAATRIMSTPVYDALKVMKDIAQNFPIRARSLTRVPVDKKMQNEIEENQKHFHETLGIQPGEAHLFLNGLHIDLDVHDPFSILEILKLEGKAMHGLHELGIKGEILNAFMRLHIHPADNYALDIRHSSIIWINNIEQDHSYSTWPESYQALLKPTFPGFLPEIKRNLYNLVLFIDPVQEDTGDYIKLAELFHHHYVPLRIGIVFILSTKEEIDGNEDAGVALWRTFNYIAEESDTSQAFMSIINMYHEVKDGNVLTVDDVKYVLRSEYPHADVQSILDVHSEYDEGRKAGATFYKKSGLGPLPQVLFNGVPFPREEMDAVQLEKLILQRIFNATGFFLESVHMGLLDDHVNAVDFLMDQNNVVSHINPNILGAERRYIHFRPTSVPFHVEDFSTFSFLDSQDKSAVISDNMKYLTKEDEDALYAVTIWIIADFDQPAGRQLLSNALKSLKTSSHTRVGILNNPSSKIKEDNTAVARGILAAFLTQNNSNLKSFLSKLIKEETAKSLAAGTKIVKFLIPGMDGDAFEKKYNTLELDLIKTHQMFCQEVLKLLPGQMAVISNGRVLGPLDENEFYAEDFNLLEKITYSTSAEKIKAIVKEMGNSSKSGSDLIMKIDALLSSLPKMEMRQDVELLKDQHSVVKVKPQENDPFYDVIAIVDPLTREAQKMTHLLIVLRDIINMKLRLFLNCRSKLSEVPLKSFYRFVLEPELTYGINKVPSEPVAKFLELPESPLLTLNMITPESWLVEAVNSSCDLDNIHLQEIQGAVVAEYELEHILLEGHCFDVKTGQPPRGLQFTLGTKKNPVMVDTIVMANLGYFQLKANPGAWTLRLRKGRSEEIYQIFSHEGTDSGADLTDIIVVLNNFRSKIIEVQVQKKPDKVNEELLTDGTTGRKGKVESIARFSEETPTDEKEKKSDILNIFSVASGHLYERFLRIMMLSVLRHTKTPVKFWFLKNYLSPTFKDVIPHMAKKYGFKYELVQYKWPRWLYQQTEKQRIIWGYKILFLDVLFPLAVDKIIFVDADQIVRSDLKELRDLDLNGAPYGYTPFCDSRREMDGYRFWKSGYWASHLGKRKYHISALYVVDLKKFRKIAAGDRLRGQYQALSQDPNSLSNLDQDLPNNMIHQVAIKSLPQEWLWCETWCDDKSKKKAKTIDLCNNPQTKEPKLKAAARIVPEWVDYDSEIQNLIQQIERERKNLTSLFQKALKHDEL

SEQ ID NO: 4272 - protein, 1536 aa, Choiromyces venosus
MRLPNFGGRLSLGLLLLSPCLQLVSCGPAVNVALKASWNGAPFLLELLETAAEEVGASYFPLLDRIAAGDFAGIESDKALYDIFLRVAREEGYLVDQEELASFNFALSIHAAAPRIEAHYHYYENSLEPRMGRLYEATCEVWLQWSHKQICDTGGDFRDMLKSWERYRNDRRKLQFDRVLETQEDKPAAILYADIEAPIFKQFHEILRDYAKQGILTYRVRYKPQTNRKERPVILSGYGVELALKKTDYIVMDDRDVSGEGDVKKSKNTQVPIGELDDQEIQDIKPLHPKDMSFLGMKAASFVMNSEDPLATLLKLLQDFPKHTSSVAAIDINTDVTDELRENWDSFLGPGQNSLWINGVQLENSDINAFALLEHLRRERRFVNSFKMLGVNSSEAVQLLSHQILADSKQEEVPQRFDYRDNIEGGKTIVWLNDLEKDLRYREWPAAVDTLLRRVYPGQLHPLRRNVHHLVVPVDLASKDDLALITEQLRLFVDRKIALRFGVVPLTNTPEATAQAKVFYYLNDAYGLPVALGYLELVLGSGQFSKPNAKVFDQVIKEAELIEGQTALSLEEALSSETVEERIKASKSWAGRMGANSLVPPVFINGLSLAKDEQWMQMMSARLQVDVQLTQRAVYENVANDETDFVALLLGNAATRRNSHIFPEDEESIKTIDVGNLLQEYAHIFEKLPTIVSDKPDKLVETTIWVIGDFDEKDGYELLQGASELQKFAPGVTLIIIDNPQIVSENPALSTLLHQLYQVGFFKGPEQLQQLLEEVSPLKEHVNIPKVETLMQMWVPDVKSQSWQFPDHIESGNFWKESQKMLKAAGFKPGQRGAIINGRVVGPVPIGEEFGVEDFRQLLEYEHSRRILPVLKAANEIGVLEKLKGPQASACLTNLVALSNIPEVPTSMFQGPSLARTDAFNKLWKQEHVAIKSGDKDKAIFQVVASIDPASELAQKWVPILKVLSEMKGVYMTIYLNPQRMIAELPVKRFYRHVLNSAPTFDEYGNLTDSQARFENIPELPLLSLSMDVPPSWLVTPKESPYDLDNLKIQSLKDRLKGSDIEALYELRSILIEGHSTDIINGGPPKGAQLVLGTEKEPHFADTIIMANLGYFQFKANPGYYKMELKEGRSKEIFHIDSTGTKGFQQGKQEVTDEDSEIALLSFQGATLFPRLSRNPGMEVEDVLEQSSGMPKNVGDFTSKFLKKVEDVLVNIGLLAPAAGFKAQADINIFSVASGHLYERFLNIMMLSVMKHTDKSVKFWFIENFLSPSFKDFIPIMAKEYGFEYELVTYKWPHWLRGQKEKQREIWGYKILFLDVLFPLDLDKVIFVDADQIVRTDMKELVDLDLQGAPYGFTPMCDSREEIEGFRFWKQGYWKNFLKGLPYHISALYVVDLKRFRQIAAGDRLRQQYHQLSADPHSLSNLDQDLPNHMQSMLPIHSLPQEWLWCETWCSDESLKTAKTIDLCNNPMTKEPKLDRARRQVPEWTAYDEEIAALARRSLKKEAEEESEAVKQVDVEKEGTAKTPEESEKPTIKGEL

SEQ ID NO: 4273 - protein, 447 aa, Hordeum vulgare
MNLDSSDSLMIMAKTAKYDLDNIMLKNVAENNLYALYELRHVIVEGNCYEQASGAAPNGLQLVLKSTFDELEEKHDTVVMQNLGYFQLKSNPGIWNLDLAEGKSSEIYEFVDKSFHTVVIDSFNGKLVKLNVNKKEGKGGEKLYEDVKKSGGLWDSISHMWGNKKKSDNETIHIFSVASGHLYERFMSIMMMSVVKHTKSKVKFWIIENFVSPEFKLFVPQLAKSHNFEVQFVAYNWPRWLNAQKEKQRKIWAYKILFLDVLFPLDINRIIFVDADQTVRGDIKELWDLDIGGAPYAYVPFCPADSRPETKGFRFWDSGFWHDHLGGKPYHISALYRVDLDTFRRSRSGDILRSTYNNLSRDKNSLANLDQDLPNYLQHMVPIFSLPQEWLWCETWCSDELKKTAKTIDLCNNPLTKAPKLDNALRIVSEWKDYDQYVADFREKSKI

SEQ ID NO: 4274 - protein, 1298 aa, Trichomonas vaginalis
MFSYLFTLSFSQFLNHAQIKGDIVAPWNKTSIIAETLSFLQDIDHSLYWDYLEQIQQLKKQPKTIDDVLSTMKDFLDYEQFQLLNISLQIHYYSPRVQNNRALGEDSRGSNVRCNNAIIQNIDELPECNSEFFEYEPVYGSGKSKYILYADVDSNDWINLYTNLLSKDSQLKFVLRAYGHSTEQMVLSGYGAQLKPFKYSMEFKVGDQRKKIKATTKAKPAKTFEDIGLKVNLNDVKRSKKTRISTQIIKFIKESKDPLKAISELTQNYPVLLPQLKNITATEDDAKQIQRMVQFIGPGATALFVNGRKLTGYDLNAFTVYQTLLDEYNFHTTLKRVFDVNEESLNNYERAGHTPKPAQQAIIDLRHPDFLYWVNDLEKDEKYVEKYSKSLITFVSDSENWPQVARNVANVIFLLDPAETEDMDVIAFIDDLVEVQYPVRFGYIIVPKHNSAMSKKIYYAYAHLAQKYGIHVAHKFLLRVNDQRSYLDEKTRKRGPIKSSFWKTAFSAVATQRSSPSFDKMTDFYKPSSAESIFLSRLKKHISRVGVSAPAIILNGMIVEAPHPETYLNSFLKEELKQVRELMGNQKIYEDTVDIHNAILKARNAMLRFNPLVQKTRNEFTETLDIGRQNANNQRIFAKWMTEIKYQHGSSFNVKNQTSWLFLNTDDEQCLNELEMYTAEIMNKESSRISVFKKDELPNEIIQNIIGIPPNKITVVFNGRIVRFDPDQFTRYDLQLLEMCEQSYSTSFAMKYLKLSQNSRSLGQSRTHRELSDSLLYMLLHVSHLAHNNMLHTGSPISAFEPGPLNVFRSKLKQNTELSIYASIDPFSFDGQRLASLSSLLGNLSFSFIVNPPPSIEKEHLESLSCFYRFSTDSKGFSFEYMNSSTTYSLVDDVPSSWQTIRTVSNFDIDNIVADDFEKGTHKVRFDLKSLVVEGCESDKNGRIVPAVEYSLYNSKNEFVDETRVIQSNGYWQLMAVPGMYRVRTNADDEFKVVVDSFIHKFEFRESKPDPYVATNRSKIDDGKIHIFYVASGHLYERLMRISILSVVKHTKSPVKLWLLENFASPNFRNSLKEFSEKYKFEYEFCSYKWPRWLPREEARQRTFWGYKILFLDVMFPNDLRRVIYIDSDQIIRTDMRELMTMDFEGKPYAFTPFCNDRPEMQEYRFWEIGYWQNLLNGKPYHISALFAVDLPEYRSLDVGGMMRKGYMDLHNDKESLSNLDQDLPNMMQNRGAPIFSLPQEWLWCGSWCSDETMKKAKTIDLCNNPRTKVGKLEYAKETIPEWIPYDEEANGVFSKEL

SEQ ID NO: 4275 - protein, 1369 aa, Phaeomoniella chlamydospora
MTAAQDAACPVWVHFEGQQYCSPALERAQQPVEYAGTDQVLPFDHILGGTTEAPPSIIYADITSPLFAEFHQIVSKTAKAGQTSYRVRYRPTLDASPHDPLFLNGYGFELVLKRTDYIVIDDREASTSAPEDQVPLEKLAEHTPADIKPLSKSDVSKLGLKAASFVMSSSEPFDTLLKLTQDFPKHSAAIAAHNATDAFLTEFNTNREEFLPAGYNIMWINGLQIDARQVNAFSLLDHLRKERALINSFREEGLSAAEAVNLLSHGVIAQAQVDNVPQRYDFRDEAEGGNVIIWLNDIEKDSRYENWPSRLSSYLQRVYPGQLPTVRRNLHNLIIPVDLADTKELELVVATLYNYVKRTVPVRFGLVPSLHTPGSEAQAKIAYHLVESYGISALLKYFELCLESGKVGTSGKSSFNNAIKEKSVRTGQQALSFDAIQTSDTTDQRIKALNSYVERLALTGPTPPILINGVALPRDDSWLESMSSRVGADLRQIQRGIVEEVFQEDSWLPDFFLFQAARRRNALVVPEDSSSIQNVAISQLLQEHKAFMSSLPSVSPSPGIKGSELIYLLLVANLDTEEGRSLLVDALEFTKLHPEVELAVLQNPQSYNSCSELSLLAQTLLSEDAIAVDDIILQVRTASLDLQEGCSLSENEAAIRGVVSFLGLQPSENGLLLNQRLVSPVKKGQFIAEDFEHLLHHEKTKHFLPLTTALQDLGLDSRIHNALSMAKLNSMVALAFISDLPEGLIEGPPLIRIDKFKGWMCQDSCIHTSTSTDPSLRIIVAIDPTVELAQQWVPILKVLSELHGVDLKIYFNPRERIQELSIKRFYRQVLDSQPRFDSNGKLQRPQAVFTGIPEAVLLNLGMDVPPTWLVAPKTSTYDLDNIKLNSVAAGQNIDAVYELKNVLIEGHSRDTTTGQPPRGVQLLLGTESNPHYTDTIIMANLGYFQFKANPGIWQISLQPGPSSRIFTIDSVGSKGYRAQPGDEGTTVALLSFQGVTLYPRLSRKSGMDTEDVLESGPKPGSPMDFLSRSASFASSALSSITKSSSGSTNADINIFSVASGHLYERMLNIMILSVLKNTKSTVKFWFIEQFLSPSFKELLPHLSVHYNFSYEMVTYKWPHWLRGQKEKQREIWGYKILFLDVLFPLSLDKVIFVDADQIVRTDMLSLTQVDLHSAPYGFTPMCDSRTEMEGFRFWKQGYWKQYLQGKPYHISALYVVDLKRFRQLAAGDRLRQQYHTLSADPNSLSNLDQDLPNHMQFFLPIHSLDQDWLWCETWCSDESFSSAKTVDLCNNPMTKEPKLDRARRQVPEWTLYDDEIAEVARNIAKDLQQDSDEEGNQTPSHLKGGVQAELEGSVKEGGKKDSERKRDEL

SEQ ID NO: 4276 - protein, 1516 aa, Ceratosolen solmsi
MLFFILFSPLLLNISPILAEKRINKYVTTLINAKWKDTPLILEAAEYLNDENPNYFWRFVDEVSNRSLEFEKHVTEKDHYDFVMSISEKFLTSAEIAVMKLGLSLRIYSPRIEMFYQMAENKKTSNINCNNFIDVGGKFVCSIDELQKFIDNNDVILIDTYSVDHFYLEKRYTNKTLVLYGQMGTHGFSVLHEKLKYLVTSNKINYILRHYSKNRLNKNLRLSGYGVELQMKSTEYKATDDSDIKHNQEKNEDLGEGVDEIDGINFSLLKTLYPKEKKKLNDLYTYLIENNHEIGALKVWQFQELSHQAAERIMSSPAGEAINVLTDISQNFPMQAKSLIKEKINNNMKKEMKLNQEIFSVNLNIQPTETALFINGLFFDLEAIDILTLLECLRYELRVMESLHKIGLDSENINKLLTLDISNTGDSKDFLIDIRDSAILWINDIENDFRYKSWSSSLSDLLRPTFPGMLRNIRRNFYNLVIIIDPLKKESAPLISSAESLYAYSAPLRIGFVFFTNFNVNETGNTDPSVAINNAYHYLIESKNSKDAMSFLSSLYNNIGPNGLQINDVKKAIKIIDPMADINYILGEESEYDVGRYLANDFIKRTGLKKLPQVLLNGIPLSTNQLNADSFEETVLSTIIMQTPMIQKAVYRGEIIESDDVVDFLMNQPHVMPRLNERVLKTEKNIWLNLIGSIPKNNDYTKWSSQDISSWLMKHLCYLYIPRKSVSSHVYTLWIVADLELELGRKLLKEALIYLESNAEARLSLIIYSQNNNLSEFNINKITLAAINTLSLEKSYTYIRNLMKEETYNSIKNGEFSIEEKAIKEYLKNEFFLLNIQQHYAKHILNLSNNERAVIMNGRIIGPFDEEEEFTSDDFALLERFSQSTYGDKLFKYLRKCQVNNDEYENGDISDIIMKITSLLVSKPQTRSRFNVPFHSDKFSVIKIPASNRNLVTFNLIAIVDPVSRGAQKLGPILNVLHQSLNCDIKVFLNCVDKNSDMPLKSFYRFVLEPELQFTSNGEIVGAIAKFTKLPSSSLLTQNIHAPENWLVEVIKSVYDLDNIKLDNVAIGVHSEFELEYLLLEGHCFETSIGNPPRGLQITLGTEKEPLMVDTIVMANLGYFQLKANPGEWLLKLRLGRSADIYDIVNVDGLEVIHNESKVKVLISSLKSNVLKLKVTKKSEKVDIDLLAEDDKESGIWNSISRTFTNAEKSNEQNEKLNIFSLASGHLYERFIKIMMLSVLKHTKTVIKFWFLKNYLSPTLKDFLPHMAKEYGFEYELIQYKWPRWLHQQTEKQRTIWGYKILFLDVLFPLDVKKIIFVDADQVVRADLKELIAMDLGGAPYAYTPFCDSRKEMDGFRFWKQGYWRNHLQGRSYHISALYVVDLKRFRRIAAGDRLRGQYQALSQDPNSLSNLDQDLPNNMIHQVAIKTLPQDWLWCETWCDDNSKQYAKTIDLCNNPMTKEAKLQAAMRILPEWITYDEEIKSLQLKIMRIIDNENKQTEKEEGFINEESAKHEEL

SEQ ID NO: 4277 - protein, 1437 aa, Cyprinus carpio
MRLIFLVLVLLRVQHVHSASKGVVASLQAKWSMTPLLLETSEFIREDDEEKFWKFVDTVKELTVYKNGESVRSYYNLIIKKAGQFLTDLQVNLLKLSLSLRAYSPAVHAFQQVSTFLPRPYLYKSDHQYPGVNGTDLPVAVLYAEIGTKEFNTFHKVLSERAQDGKLIYVLRHFVSEQKNEKMLLSGYGVELAIKSTEYKAVDDTQVKESKSVTTDNVDENDEVQGFLFGKLKKSHPELQEELGELRKHLLESTNDMTPLKVWELQDLSFQAASLIMTVSKFDSLKLMQDLSQNFPSRARSLTRVAVNQDMKKEIEENQKRLSESMGIHPGDAGLFINGIHVDLDLHNPFSILDILRTEAKILQGLHNLGIRGSSISKFLHLPSSTTLEDGYALDIRHTSIMWVNDIEKDSMYRHWPSSLQELLRATFPGVIRQIRRNFYNLVLFLDPVQEESIELVKLAELFYKHNIPLRIGFVLVVSADDKVDGYLDAGVALFRLLNYISEEYDEAQAFTSMVSIFNRVEVGETLSVDTVTAYLKKKFPKANAARILGVDSSYDDNRKAGGGFYRKSGLGALPVGLFNGVPLSSEEMDPEELETVLLQKIMETTNFFQRAAFMGQITESVDVVDFLMEQANVVPRINPLILSSERRYLDFTSSPVADDWDDTTVFSYLDSRDKTAVVSKRMKYFIRDEEEVLYGGTVWIVADIEQPPGRQLLRNALKHMKSSSSSCRVGVINNPSGKPTEDNSSLYRAIWASLLTQSSKNTLDFTLKLLKEENVELLKQGTKIKHLLKQILSLLDEEEEFSVEDFHLLEKITLRTSAEKIKSKIKQMNLNAEKANDLIMKVDALLTSSPKGEARKDVKLLKDKHSVLQLAQREDEVFYDVVAIVDPLTRDAQKLAPLLVVLGQVVNMKVQVFMNCRAKLSEMPLKSFYQYVLEPDVSFFGNNSLSPGPVARFTEIPESPLLTLNMITPESWMVEAVSSPYDLDNIHLQEISGVVNAEYELEYLLLEGHCFDLSTGQPPRGLQFTLGMRQEPLMHDTIVMANLSEVCHNTKPAEREHDGTDSPLDAGDVIVVLNSFHSKIIKVRVQKKPDKLNEDLLSEGTESKGLWDSITRSVWSSLEKSFAGGPSVDEDDKKKDVLNIFSVASGHLYERFLRIMMLSVLQHTKTPVKFWFLKNYLSPSFKDTISHMAKAYGFQYELVQYKWPRWLHQQTEKQRIIWGYKILFLDVLFPLAVDKIIFVDADQIVRADIKELGDLDLEGAPYGYTPFCDSRKEMEGYRFWKTGYWASHLGQRKYHISALYVVDLKKFRKIAAGDRLRGQYQALSQDPNSLSNLDQDLPNNMIHQVAIKSLPQEWLWCETWCDDRSKAAAKTIDLCNNPKTKEPKLSAAVRIVPEWSKYDNEIKQFLKQVKEKITEGRLSSSPSSPQHTAGTGRDEL

SEQ ID NO: 4278 - protein, 1549 aa, Dothistroma septosporum
MAMAMKAALVASLLAGAWAAPSINVDLRTSFGAPPYLIELLETAAEENATSYFPLLDHIADGYFDLAKTDQELYERFRLLLKEQGHLKDEDLSSFDYALSIHSAAPRIEAHYQYYNTSIHPLVTGHEAINCDSWVHVPFSAQSYCSPELDQATARPFGKAGDELHELPFDRVLGDPLSQRPSIVYAELGSGSFREFHKTLSKTAKEGKTSYRLRYKVSKDAERKPLTVSGYGVELALKRTDYIVIDDRQAEDEAKEGTGSSPDASLNEEEVSDLRPLSQSELKRLGVKAASFIMGSETPLDTLLRLSQDFPKHSSSIAATNVSDDFLQEHIGNRDVILPPGYNVMWINGVQMMPRDIDAYSLLEHLRRERKMINGVREIGLSGSEAVNLLSHEAITESQVEQETQRYDWRDEPEGGNVIIWMNDIEKDKRYEDWPEVVSALLQRTFPGQLPSVRKDLHNLVIPVDFAEYADATLVAEQLRSFVSRKVPIRFGLVPYIRSLASTEQTKVVYYLVDRYGLSAALEYLEKSLESAGKKYTRPDEKQFQAVVDSRTLRPNKKALSLGGIDENADLQHRIAGSQAYISRIGSIDPTPPVLVNGVPVARTEDWFQTMSQRVSLDVRMVQQAVYEMRVTDDDYLPNLFLEKASVKRNPLVIPEDDSSVRQLNLGELPQFAELPGLPAKKDTIERELVHLTVAADLDSKEGFEQLMEALLLHREHDNLELAVLHIAKGHSEGQTLATGFDKHAGEAILQTLLEQFDSLSTEDQFEPKDGGANFLTRQKIYPELYRKFAADNTPDAEKHARSVWAKFRDIVAALGVAPGQKALVVNGRIVGPMSDGLSLDVSDLEALYSYERKKRLLPAAQAIEDLGLAGKASTPLAFARISNLIALSLVSDVPEGIFEAAPTVRTDVFKKWNSTHTAIHIGDEDTATIQIYTAVDPASEAAQRWIPIIKVLSELEGVHTRIFLNPKDRLEEIPIKRFYRQVLSSKPAFETDGSLRGNGARFSGLPAEALLNLGMDLPPAWLVAPKETVYDPDNIKLSLVKSGNIDATYELRNILIEGHSRDPSAGGMPPRGAQLVLGSEHDSHFADTIIMANLGYFQFKANPGLYNLALQKGRSEEIFHIDSAGTRGHAVAPGDNTTEIALMSFRGATVYPRISRKPGTEDEDVLEPAKSALDSVAEGADKLLAQVGLKSPQTSKYLSKAAKLGSDLLSRTSKTDISVDHHADINIFSVASGHLYERMLNIMMVSVMKHTEHTVKFWFIEQFLSPSFKDFLPTMAEEYGFKYEMVTYKWPHWLRAQKEKQREIWGYKILFLDVLFPLDLDKVIFVDADQIVRTDMYELVQHDLKGAPYGFTPMCDSRTEMEGFRFWKQGYWKNFLKGLPYHISALYVVDLKRFRQLAAGDRLRQNYHQLSADPNSLSNLDQDLPNHMQSMLPIHSLPQEWLWCETWCSDESLKGAKTIDLCNNPQTKEPKLDRARRQVPEWTEYDNEIAAVAKRHKEQRSATDKVAEAGLPDVHDGSLEEESIQERLQREDAERERKREKQKGHDEL

SEQ ID NO: 4279 - protein, 1490 aa, Erysiphe pulchra
MGGSNIALRIILILLINVFQNSVYGFARPSIDVELRTAFPAPPFLLELLETAGDENSSSYFPLLDRISDGIFSTTSTDEELYKKFLKVLIDDGHLADPESVSSYQLALSLRLSAPRIESHYQYYDTTAETSFISDPNESCLNWFLFQGLKYCSPSFDKAPGSVSLGLKEEKLPFDRILGNSSAPVTILYADIKSPSFALFHKVLAKNARDGKSSYRIRHRKSTNSQVKPLNIPGWGIELALKKTDYIVIDDRNDDDSKTVLPVTEKEAKLENDELDELKPLSTSEVSLLAIKASSYIMQSESPLDTLVKLSQDFPKYSSSISSHNVSMEFLTEHHYNRAQLFQDGRNTIWLNGLQLTERQMEITNLIDIMRKERRLISGMSDLGFVPSEAIKLLLHTEIASAQSPDGIDRFDWTDKIEGGNVIIWLNNIEKDKRYADWPVSLNAMLQRGYPGQLPFVRRDAFNLIIPIDLTDHLDLELILETALNFVNRRLPIRIGLVPIINNSNTMNQAKVFYHLVDTYGLQTAIAYLRSLNESKPSINLKNSEDIFDQITQKAKVKMDKTRLSFEEVLGLEDLNSRILASKKWAERLCADDVVPPVLINGVIIPKDESWLQKMSQQIYTDLQLIQQAILLGTESVKSKDFWVPSIFLDEAIHRRNKLIIPEDQKDFKFFDLNVLEKNYPEAFKDMPRFLSSSSSPNLDSVLMVLIVDLDSESGENLLINAAALHKLLPSIELLILHNPKSESESKLSHDLFFFLQNNKFRGLEGIEDIAATIDRHEKNHDSSKLEESRIYWQRFAPISSSLGILPGQNAILVNGRLTGPILNAKNFEVEDLELLISFEQKRRIAPIIKAVKDLGLENRIQSLLDAAKLSSIIALSTVPEITNSIFEEATSIRVNKFSIWKSQYTAIEVGDAMTASIQFTVLLDPASHLGQRWASILKVLSNLKGVYLKIFLNPKNGLTELPVKRFYRYVLDSKPLFDETGAIQSPNGSFSGIPQEALLTVGLDINPAWLVAPKISVHDLDNIKLSSVKSSVSAIYELKNILIEGHSREVTGEQPPRGAQLILGTKKAPYMGDTIIMSNLGYFQFKANPGYYTISLKKGRSSEIYHIDSIGARGWGSVPGDDETEVVLMSFKGATIFPRLSRKPGMEREDVLEIKSSPETSFVSQGLKYAQSILSRGNNSHENQASINIFSVASGHLYERMLNIMIVSVMKNTKHDVKFWFIEQFLSPSFKDFIPHLAEEYGFSYEMVTYKWPHWLRAQSEKQREIWGYKILFLDVLFPLSLNKVIFVDADQIVRTDLIELVNLDLNGAPYGFTPMCDSRTEMEGYRFWKKGYWAKFLRGLPYHISALYVVDLRRFRQMAAGDRLRQQYHALSSDPGSLSNLDQDLPNHMQNVLPIYSLPQEWLWCETWCSDEALKDAKTIDLCNNPLTKEPKLDRARRQVPEWTKYDDDIAALDKRRKGGNDFTEKLSESRPFETVSEIKTTSKKDEL

SEQ ID NO: 4280 - protein, 957 aa, Paroedura picta
MPSGKHSGHLHETLGLQPGEGRLFLNGLPIDLDFHDLFSILETLKSEGKAMHGLHTLGIKGDVLSKFMRLSVHDADDAYALDFRHSSVIWINNIEKDQTYDKWPTSFQELLKPAYRGMMRQIRRNLYNLVLFIDPLQEEALAFMKLVEVIYHQKVPIRIGFVFILNTNEEVDGNKDAGVALWRALNYVADEVDVAKAFTTITNMYHEVKDGDVLSVEVVKRVLRREFPYADMQDILGVHSDYDENRMAGAAFYQKTGLGPLPQALFNGVPFNRKEMNVAELETSLQKIMDATESFQQAVFMGQLNDHKDAVDFIIEQQNIVPHINEKILHTEKSYLNFIASPVPVDMEDYSTFSFLDSQDKTVVLSENMNYVTRKDEDVIYAVTIWIVADFDRPDGRQLLSNALKHLKTSSHIQLGIVNNPTAKITEDNTLVARAIVAAFLTQKNTSLRSFLDKIVKEETAKSLARGTKIKKFFVPGMADDAFEKKYNTLGVDSIRAHRIFCHEVLKLLPGQMAVISNGRVIGPLHENEFHTKDFDLLEKVTLSSAAMKIKILVKGMGLGRKRGSQLVMKVDSLLSSLPKTEVRQDVEFLKEQLSVLKIDPQQNEPFLDVVGIVDPVSREAQKLSHLLIVLGQVLNLRVKLFMNCRTKLSEAPLNSFYRFVLEPELTSGADNVFPRAPGANFLEMPESPLLTLNMITPESWIVEAVNSSYDLDNINLKEAEGVVVAEYELEHLLLEGHCFDVTTRQPPRGLQFTLGTKNNPVKVDTIVMANLGYFQLKANPGAWTLRLREGRSEEIYQIFKHEGAESSEVLDEVIVVLNSFRSKIIKVQVQKKADEIDEDLLSDGVTEEDGSFASSTGHAQLEEKEKKMDILNIFSSLPQEWLWCETWCDDESKRKAKTIDLCNNPKTKEPKLEAALRIVPEWAEYDSEIQQLISRNKKRKEKVTRPSQKESKHDEL

SEQ ID NO: 4281 - protein, 1699 aa, Echinococcus multilocularis
MFIGICCLCICFLPGQSILALSYQVSVQLGSSWKETPIIAEAAEFLAQLSPNHFWDFVDSLEYLSKTNGSSDFFSSSEKISLDAMRELEETILNVQGVPVDMDGNRDLQRRLFSLTLASRALSPAVQTANHMARVAHFQWLFDKSEVCKDSKTWGRIGSTFICNLEILEDSVRKASLACSNGCPESLADSALLSDNVYPTTNESNAVPRLVIHGDLRRKEFYAWHKKAKQLAKENRIVYIFRHFFKTASSSKTWLNGYGVALSLKSTEYKAMDDKNSEGSQDMSDDTPDLNETGSTLQGFNFAQLRANYPHLTTELNAFQSHLITGITEVKPLRAWQMQDLGLQAVQTIMDVANESRNDIAGLLMLQDISQNFPSRAYQLSQHKVSTKLRDEIKYNHEALEHLYGIRPGSSLLLLNGLALSPDIDIYALLDLLRSESRLLNQLHGLGLSTGQATQLLQASPRGEDSYRLSTFMESYKHTVTGEHLLDMRNAPILFLNDLERNFGYNSWTASIHALFTMGPPGALRHIRKNLFNVVFVVDPSQPTSIEMLKLAEIIIMKKVPIRIGLLWSVNPEVASVSRSMVRTFNYLASNVKTYPNRRGVTPGLGNPGAITALNFLTDLYANSNNGDKDLLTNDFVKTEFESSFPEAYHEDVFVEQGFQCPYDAEIKNHYDYLDISGIRQSVGSSSLISNGMVFSMDGISKMGGLQETVMTAALEQTTYFQQAALEGRLHDSLSVVDLFTADDLFVSRVNRRLLPISPPLVNKFSLGDGSDGTSVTPFLHFGRFNVPNGGLDMKNASAGEITNYLADEMRYLQKGELESETRANTVWVVLGDVEPSAGVISSHSLQLLAQAAKFMRRHAAVGTRLGLVLNPSRPPTGQAIGIWGGWGWLTRALLIIGHPAERMLHPSTVKQSQKYMNIMAAKNFVIKITEEALKVVRGEMKGVRPFSELAVTGLEVDKFLQAFTELDLDQKLSLHMTFCQKALRIQPGDSAVIINGRVYGPLGDNEIFTSEDFRLAEQLSIRSAGMDEMAKRLTKMVPDTTSSNYVSELVWRAASVLESAKWRLNAFAKSLSSEGIFTSSGISRMTFRGTKSTYSAFTLPAKNAGLNYDIVALVDPISRDAQRLSQILLVLQRSLPCSITVILNPVNGLSDLPLKNYYRFVWHPSLYAPGGGLADPPSAFFDQLPGQSLLTLGVDAPHNWMVAPIRAEEDLDNLRLADIAAHTGNHRVEAEFELEYLLLEGHCLDESTRQPPRGLQFTLGTAEKLDRYDTIVMANLGYFQLKANPGAWHLNLREGPSRDIYNIVGHEYADSPPDAPSLIAVIDSFRPKIIRTDVQKKLGHLRDSVLDVNEGEAKVSSDDSNRGKPLEKLWSVVDSTLNFIKKSSYASEDPARNPNNETINIFSLASGHLYERFLRIMMLSVIRNTKSPVKFWFLKNYLSPSFKEFIPHMAVKYGFEYQLVQYQWPRWLHAQAEKQRVIWGYKILFLDVLFPLSVKKIIFVDADQIVRADLQELVNLDLEGAPYGYTPFCDSRKEMEGFRFWKSGYWQSHLGGRPYHISALYVVDLVRFRKMAAGDRLRGQYHALSKDPNSLANLDQDLPNNMIHQVPIKSLSQDWLWCETWCSDEGKAQAKTIDLCNNPMTKEPKLSAAMRIIPEWKVYDNEITALQHHLADVKKNTSKEHTTSDSLLTQGITGKDEL

SEQ ID NO: 4282 - protein, 1383 aa, Callipepla squamata
MAGDPTAAGGELFSTLFLLGLCFCHYFKATEDFYCGISLKKVNLWTIHFYFLNSEFIAEDGNEKFWQFLETVRELTIYKQGDTEYSYYNLILKKAGQFLSNFQINLLKFALSIRAYSPTVQMFQQIAADEPPPEGCSAFVVIHEKHTCKTNEIKRLLKKANKRPRPYLFKGDHKYPTLKEDGPVVVLYAEMGTRDFVKFHKILSEKAQKEEIVYVLRHYVQKPSSRKMYLSGYGVELAIKSTEYKAVDDTQVKVTNETKKEEEEEEESDVQGFLFGKLKELHPDLKNNLKEFKKHLIETTNSMEPLKVWELQDLSFQAAARIMSAPAYDALKVMKDIAQNFPLRARSLTRVPVENQMRNEIEENQKWINNIEKDRSYITWPASYQELLKPTFPGVIPQIRRNLYNLVLFVDPVQEDTDDYMKLVELFYHHNVPLRIGFVFILNTEEEIDGNEDAGVALWRTFNYVAEESDVFQATTCIIKMYHEVKDGDVLTVNHVKNILRREYSRADVQSILGVDSEYDEGRKAGTTFYKKTGLGPLPQALFNGVPFNREEMNAAELETVTLQRIIDASGFFQRAVFMGLLNDHVNAVDFLMDQYNVVSHINPNILGAERRYLHFRSTSVPFDVQDFSTFSFLDSQDKSAVISDSMKYLTKKDEDALYAVTVWIVADFDKPSGRQLLSNALKHLGMNDDTFEKKYNTLGLDIIKTHQMFCQEVLKLLPGQMAVVSNGRILGPLGENEFQTEDFNLLERITYSTSAEKIKAVVKEMGVNTKSGSDLIMKIDALLSSLPKTEMRQDAKLLREQHSVVKIEPQENEPFCDVIAIVDPLTREAQKMAHLLIVLKDVVNVKLRLFLNCRSKLSEVPLKSFYRFVLEPEIMYGINKHLPSEPVAKFLELPESPLLTLNMITPESWLVEAVNSSCDLDNIHLQDIKETVVTEYELEYILLEGHCFDVSTGQPPRGLQFTLGTKNNPVMVDTIVMANLGYFQLKANPGAWTLRLRKGRSEDIYRVSSHEGTDSVGDLEDVIVVLNNFRSKIIKVQVQKKPDKMNEDLLTDGTTEKGNLESVTRFSEISPEEKENNSDILNIFSVASGHLYERFLRIMMLSVLRHTKTPVKFWFLKNYLSPTFKDVIPHMAKKYAFKYELVQYKWPRWLYQQTEKQRIIWGYKILFLDVLFPLAVDKIIFVDADQIVRSDLKELRDLDLKGAPYGYTPFCDSRKEMDGYRFWKSGYWASHLGKKKYHISALYVVDLKKFRKIAAGDRLRGQYQALSQDPNSLSNLDQDLPNNMIHQVAIKSLPQEWLWCETWCDDESKKKAKTIDLCNNPQTKEPKLEAAARIVPEWVDYDTEIRKLIQQIEKEKKSKTFSEKGNGVIRRIRCIFIAFHPL

SEQ ID NO: 4283 - protein, 1597 aa, Auricularia subglabra
MRSSTIAGLALTALQWRAHAVSPPVKVALRTSWPAPSLLLEIIESAALENPASYFGVLDLLTSDEALPSTTLTSQAIYESSIELLATHGFLSEPGSRESLELALALHAATPKIEAFYQYHSDLNIKAPACGSYVEWYGERVCDAATLRRLVEVDTIDATYPRPTLLTIDHIYPDPSTALQTPNRTAILYASLDSPNFRELHEALLALSKPIGEHQIQYVARYVPPGDRSAAPKSYLSGYGVALDLKKMDYLAMDDRHDGTADEATAEETLLDESAEILHTLVNALDDEQKASALSKEEIAELGLRASQIILDASNPLAMLKEVSQNFPKYALAIGRKASYAEELREELAENQHRVGGGVNVLWLNGMMVQEGDLNPFNLLSILRKERTIMRSLMSAGLSAPQALDLITHPLVADSQSSGEVTDGIFDASDRKEGGGVCVWYNDLTKDSRYAKWSADLKNLRRPMFPGQFPHIKQNLWNVILALDLSQSASLNFIAGSVSNIIQRNFPFRWGIVPLIESDNAAKAARLFYYLIDNYGRAKTTQFLMDLAGEGATSTLDWTVARAGFAALVAEQAPRREDATTDFDAILSGEDGRIEQAKAYAKRLALRAPADGPGYGFVNGKFYDIDDDFFRHLQTEQSAQMEFLIAKVRTFLRKDELAEDVDIENFFYDLPTSSASRNEHIFPSSKSGNALRVANLPDLFGRFSLGTTFEGVAPESAGPFQYLQLLSNANLGYAAVDALLVTLWIVADFDTPEGLAFAKEALKAAELEAATPFRVGFIQNSDPAMSVTLEDSPLRSSHVLYLLAKSNAAAAVSPGQVLLLLDLLEKHDYDEAPVAELFKAASFDKAERTAFGRYHVATRLISRELGIEAGQHGILVNGRVVGPVQPGDFSSADFVTLVKYEISKRIKPVVDALLAVVPELADGEKHAWADSVAFASSIISAIQIPDPTSVGLFQQQPMPRQRVYRTHLQGNHSTFEVGDSSKSIFNFGLLLDPLSEAAQRRVDLLEWLARSPSAHIEVYLNPHGLPLKRFYRYSLRPRLQFGEDGLEVAAFVKFEDLPVDPIYTLGMDVHQSWLVRPHESQHDLDNIHLASLSGRDAVRGVEALFRLDYLVVEGHAREAGTNAPPRGLQLQLNTIGDNSVAIADTQVVANLGYLQFKAKPGIFRLEIREGRGRDIYNLDSVGNEGWESPLVTQVGANIALAGFDGITLYPRFSRKPGMEKTDVLEVPEDAPEEPGFVGKMVNHGQKEPSTDVAIVEDPQADINIFTVASGHLYERFASIMILSVLRHTNSTVKFWFIENFLSPSFLEFIPHLAEAYNFQYELVTYKWPSWLRAQKEKQRIIWGYKILFLDVLFPMDLKKVIFVDADQIVRTDLKELVDLDLQGAPYGYTPMGDDNEAMEGFRFWKTGYWKDFLRGKPYHISALYVIDLVRFRQDRLRGSYQGLSADPHSLANLDQDLPNNLQHEVPIYSLDKDWLWCETWCSMDRLDRAKTIDLCQNPLTKEPKLARARQIPEWSEYDAEIARFARTLAEKGLIHSDAAAVDVDALASVGGGKPAAEKAETEVAPTTVAEATQSDAAEEPESTRTEPAPSEHTRDEL

SEQ ID NO: 4284 - protein, 1555 aa, Candida boidinii
MKHFGIFQFYFLFQAISFAVCSIAVNATDHSIDLSLVGTWKKISFYLNVIETFSNESPDLYGPLIAKLLGLSVSIESEEDEYVEDTETIESNKIVYYSVQAEEDFQLNEKSFYEYAVQLFESESEHNKFKRSLLDIKLANKFYTPRIESHYQYYQNEVIPEFESKLKTEDLKSSWLYDATKYFYTNPEDTFALKTVSRTLEDKILLPFDRVIGKSGNIFILYGHFEDPVFKQFFTNLYQLALNGDLRIVWRYTPDISHESDDSEFETLGGYGIDLTLKRTDYIVVDDRGFTKEQQEKLVFDSPAEEIENSRNINSVGDITLELLNEYSKNIHLVEKEKLSELGVKLVKIILDLKDKGRSPNELLSLLKSLILEFPKHSHKISNLYNDEELELDPESESHPESELSKLKDKLSDSKLHQLPTGFYFNGAPISENNLNLYEILKVLERELNYINSLKENLGLESTEKLKQLMLNFSQYINQVESKNLTKKRYNVDSFENAIIYFNDIESDRMYAGLRTPKIAYKAKPTFGQVPQARSNIHDLVFAIHFSSQAQLYYLLQTFTVIMNYKIPQRVGVIPLIDNELDEKITKEFISTVNSKGPIEGMKLLIAIYEEIFASQLDQAEIFKYLETLEIPDAQFDLDKFYKPTKDLIENLSITQPSIISNGVFIKFTDNWQNSLAEQLDFDCNLLFEASNGDKIRKGESYRNHLMKGSLKRKVPILIPDDFSKSYEMYKQINDIPKLLNLFKNYSIIFDKPFNSDKSNDIEFNNKASTLTVIGSFYDKNFISHIITALNYLKSENSNDISRLRILNTSNNSEIFKQLEDIKDIELAVEFFENISSKFTVSKNLVNQSLASELSELFDIDLSSITPSSTFMFISGRFIDTTGIKLKEEDLESLMEFEIVTRLGIINTELIGLIKSGELVLLNTNDDLIQVSEIVSMILTSSYFYDDGRLLIDESIKRLNFSVLKPDEISHLILPASSDEKDNLIDIDLVIDPTTEYAQKLISMISLFDNMSFIKLRIHFVPDFSEKAPLSTIKRLYKGVYPSKVEFDENNHNSDNGLKALFTNVPETALFTLDVDVPQSWIVTIKEAETDLDNVKLDISGSISGIYELKNILIEGHAREGSSNVTPRGLSIEISNKKGYSDTNVMANLGYFQLKANPGLWDLQIREGTKSSEIYSLVEIYDKFISLSSKNNFAKEKKSVKLSVLDLSGREVYPIFLKKKGQENEVLVDLDPTQGQIKKSSNLWKSWSGKLNSLIKPKNVKPHADINIFTVASGRLYERFLGIMMASVMKHTEHTVKFWLIENYMSPLLKKDLPKLSEYYGFEYELITYKWPSWLRGQREKQRTIWGYKILFLDVLFPQDLDKVIFVDSDQIVRTDMKELVDLDLHGAPYGYTPMGDSRKEMEGFRFWKQGYWAKLLGDDMKYHISALYVIDLQKFRSIGAGDRLRQHYHALSADPNSLSNLDQDLPNDLQDRIKIYSLPQEWLWCETWCDDESLKKAKTIDLCNNPLTKEPKLDRARRQIPEWVEYDTEIANLLSDKPVDESTDDSNSDDHDEL

SEQ ID NO: 4285 - protein, 1676 aa, Ustilago hordei
MRALTLLSVGWAWLALALTLTSAAHLARADSPPAKVQLRASWLKIRLPSNGSPFLLELLEAARSQRPSSFFPLIDLLTSTHTATQLRSASDKWLAQTIENLIRSHQLFGTSQTHVDEALDTWRMSLALKNSTPRIQAFVHLYKALQLEDTWRSRSNKDPCVSWVHHEGKVLCSAEELHQALQDNAASSSAVSSTKQVAFGHPRSASEASYKFDTASSQIFELYADPYSDNFRELFSTLEKHATDAEGGVKYTLRWRPSLDNQPTATSGSQQTTFLSGYGAILDLKKVDYLVIDDRKLKDDSDIGDLGIATNTHDEEAAASQRASADLRWLQDQIGADSFLASTSLSSLTDSEIADLGIKAARLIMSSPDPLRALQELSQNFPSHAAALASSTKFDDGDASAALFEAVLGLSSMRIEPGASDLWLNGKRTPAKEFMPLTLLETLKQERNWSHALQHRLAGGGLNVTEAGDLIASSLVGRAFLAQAEGEGAAAIFDASDRIELKNAPEGTVQGAITWLNDLETDEATKAWSSDLMDLLRPMWPGKFPRLSLNLFNVVLVLDLRQRESCRFLSDTVIQSLGRVGLHWGLVPGGLEDDANSDSIRMARLFWFLLEEASPQVLSDVLRKTAASRAGTADTLDVSLAIKEAKFALKAVDSDETLSSKLDSILAGQDPAYTVREELSKAYINRLRATRQESPTGHVFVNGQHQPFHPQIVHILHQSIQEQIQLLAPQIYYGQLSSLSPGLSTFFYDSVGALSFRSALVPGAGSAADGEEEGVRHEAVDLFSVLVDDDVPSATSEGLFNFFYPSSGSSSSEGEEKPAALLNSTVWVLADLDSQGGLDLLTRTFEALAKEDAKFRLGVVHAPSPASQRSNREVAISTAFHRFLTDSQSSRPSPALIHDALRQPEQLRSALGLSQSSIDSDQAAFRFWNSIALPITAKLDLATPALIVDGHLVSNFDSSTVEARDITALVEYEADQKLPYITQALTLLREDVDSVDPVQRQNLVFASLSVMNGVYDSRRQNAFSSKLASRSGLPEQLGTADHIFEVGDKANADIRITLLLNPLSESAQRWSSILLMLRELEGVYLRVILNPEIKLRELPLKRFYRFSAPHRLQFDLAGKVLSEELQFFNMPEEAVLTMGLDAPAPWLTMPVEAVYDLDNIRLSDVPSSSRGKGVKAVYELKHILIEGHAREKSANSLQVGVPRGLQLLLETPDGSTSLDTIVMANLAYFQFKAQPGLWKLRIRAGRSDELYEMQSVGSAGWDSPSVGVKGDLVTLDTFSGLTIYPRVSKRKGKETEQLLEELDAQGRPVKKTRTASQSTVDGVAVSASNFLSSAKDKITSLANQITSSNPGASNAVATRKHADINIFTVASGHLYERMTYIMILSVLKHTNSSVKFWFIENFLSPSFKEFIPHFAKEYGFEYELVTYAWPHWLRAQREKQRTIWGYKILFLDTLFPLDLSKVIFVDADQVVRTDLKELVDLDLQGKVYGYPPMGDDSEDMDGFRFWKQGYWKDYLRGRPYHISALYVVDLNRFRLFAAGDRLRGQYQALSADPNSLSNLDQDLPNNMQASLPIFTLDKEWLWCETWCSNDWLDKAKTIDLCSNPKTKEPKLNRAKRQIPEWTVYDQEVARLAQRLVEEKVVGKSVVAPESQMEKKQPQEASGLMANDDGTPVHDEL

SEQ ID NO: 4286 - protein, 1562 aa, Condylura cristata
MRAAQPPAQSNGLELPPPEVGGGAPGGAGYCGVAAGGGAGRSRFHLHAMAKAADVLRLLLGITAPWLWLWLLGARTALASKAVTAHLAAKWPDTPLLLEASEFVAEESNEKFWQFLETVKELAIYKQTESDYSYYNLILKKAGQFLDNLHINLLKFALSLRAYSPTIEMFQQIAADESPPDGCSAFVVIHEKHTCKINEIKKLLKKASSRPRPYLFKGDHKFPTKKENSPVVILYAEIGTRAFGKLHSVLSEKAQNGEILYVLRHYIQKPSSQKMFLSGYGVELAIKSTEYKALDDTQIKTATNTTVEDEIETSEVQGFLFGKLKEIYPGLSDNLTAFQKYLTESSKEMIPLKVWELQDLSFQAASQIMSVPVYDAIKLMKDISQNFPIKARSLTRIAVNKQMKEEIQENQKDLHNRFAIHPGDACLFINGLRLEMDSYDPFSILDVLKLEGKMMNGLRNLGINREDMSRFLKLNSPIWDHSYILDIRHPSIRWINDLESDHMYGTWPASCQELLKPVFPGSIPSIRRNFHNLVLFIDPVQEYALDYIKLAKLFYFHKIPLRIGLVFIVNTDDEVDGANNAGVALWRAFNYITEKQDVSQAFISIVQMYEDVKKQNMLTVENVKSVLQNKFPHANIWDILGIHSKYDNERQAGANFYKMTGLGPLPQALYNGELFNHEELNTEELEMAVLHRMIDTTVYLQRDVIMGTLNDKTRAIDFLMEKNNVVPRLNPLILHTKLQYLNLISTSVTADVEDFSTFFFLDSQDKSAVIAKNMHYLTQEDDSIIFPVTFWIIADFDKPSGRKLLFNALKHMKTSVHSRLGIIYNPTSKINEDNTAISRGILAAFLTQKNSFLKNFLRKLTEEETATAIYSGEKIKTFLPEGVNTKAFEKKYNTVGVSVFRTHQLFCQDVLKLSPGEIGVVSNGKFIGPLDKNFYAEDFYLLEKITFTKSVEKIKGIVENMEMNSKNMSDLVMKIDALFSSLPKHMSRSDVTFLKENYSVIKINPQEDDMFFDVIAVVDPLTREAQKMAQLLIVLGKIINMKMRVFLNCKGMLSEAPLKSFYRFVLEPELISGSNDILRPVAKFLEIPESPLLTLNMMTPDGWLVETVHSNCDLDNIHLKDMEGTVVAEYELEYLLLEGNCFDVTAEQPPRGLQFTLGTKKKPVMVDTIVMANLGYFQLKANPGAWILKLRQGKSEDIYQIVGHQGTDSEPDLRDVIVVLDSFKSKILEVQVQKKPGKMKEDVLTDKEEEKKGMWDSIKSFTRRLHKKNDKEETDVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLAVDKIIFVDADQIVRHDLKELRDFDLDGAPYGYTPFCDSRTEMDGYRFWKTGYWASHLLRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLKAAARIVPEWVEYDTEIRQLLEHLGKVKKNEILTHDEL

SEQ ID NO: 4287 - protein, 1528 aa, Denticeps clupeoides
MYLPNMAAAAGSLEAGFGTMWKVLSALLALLHLALAGTDSKAVTVTLSTKWQSTPLLLEASEFLAEESQDKFWDFVEANQNILNEHDETDLAYYELILKRAGALLSPVQLSLLKFALSLRAYSSTVHSFQQIAHNEPPPSGCAAFFNVHGQKSCDLAKLDGMVDTASERQKPHVFKSDHKFPSTNPEAPVVILYAEIGKREFSVFHQRMLFNANKGQINYILRHFVVSPSYKKVFLSGYGVELAIKNQEYKAKDDTQVEGAGVNATVIGENDPVDEVQGFLFGKLKTLYPDLKEQLKELRKHLVESTNEMAPLKVWQMQDLSFQTAARILAAPSVDALTVMRDLSQNFPTKARSITKTVVNSEIRKEIEENQKFFKGTLGLQPGDSALFINGLHIDLDVQDIFSLFDVLRNEARVMEGLSSLLIETPFIHDILKLNVQPTDSDYAVDIRSPAIYWINDLEMDSRYNSWPSNVQELLRPTFPGVIRQIRKNFHNLVIIVDPTHEDTAELLSVAEMFYSNNIPLRIGLVFVVNDEDFVDGMQDAGVALLRAFNYIVDEVDNQHAFDAVISIFNRIPSGGTLKLEHVLRFLEKRYPYVEVSSILGPDSAYDKNRKEGKGYHKQTGVGPLPVVLYNGMPYQKEQLDADELETVTMHKILDTTPFFQKAVYLGELASDHSIVDFIMNQPNVVPRINPRVLTTNRQYLDLSNTNKSTAVANSMNYMTKKDDGFIRPVTFWVVGDFDQPSGRQLLYDAIRQMKTSNNVRLGMINNPSESPSKENSRVARAIWAAMQTQTANNAKNFITKMAKEDTAKAINDGADITDFAVGGMDLTLFRSAYDSPKLDFLLSHTTYCREVLKLQSGQRAVISNGRIIGPLEDGELFNQDDFLLLESIILKTSGERIKNKIEQLGVEEDRASDLVMKVDALLSSQPKGEARIEHGFSDDRYSAVKIRPEEGEVYFDVVAVLDPVTRDAQKLSSLLMVLKQLVNVNLRVFMNCQSKLSDMPLKSFYRYVLDSEISFMADGSFSPGPMAKFLDMPHSPLFTLNLNTPESWMVESVHTRYDLDNIYLEEVDGVVAAEYELEYLLLEGHCFDVSTGQPPRGLQFTLGTPSDPVRVDTIVMANLGYFQLKANPGAWVLKLRKGRSDDIYKIYSHDGTDSPTDADDLIVVLNNFKSKIIKVKVQKKPDRMNEELLSEGSSENDSGFWESLTRGFTGGTKVEEIKQEKDNVINIFSVASGHLYERFLRIMMLSVLKHTKTPVKFWFLKNYLSPAFKEFIPYMAAEYGFQYELVQYKWPRWLHQQTEKQRIIWGYKILFLDVLFPLAVDKILFVDADQIVRTDLKELRDFDLEGAPYGYTPFCDSRREMDGYRFWRSGYWASHLAGRKYHISALYIVDLKKFRKIAAGDRLRGQYQGLSQDPNSLSNLDQDLPNNMIHQVPIKSLPQEWLWCETWCDNASKQKAKTIDLCNNPQTKEPKLQAAVRIVAEWSNYDQEVKKLYSRFQKEKERPGAVDSWQTKAQDAKQGADSHSEL

SEQ ID NO: 4288 - protein, 1563 aa, Trametes cinnabarina
MLRLGVLLPLLTWPLLHTSAAKPSVNIDLRTSWPAANLLMESIEAVVIEEPEAFFPLLDAITDPDVFPLPTERSSAKHVLEHVFNAALALGYLAEPGAYASAEMHIALHSPSPKLEAFYQYYNDHSASRADIRAAKSCGSWVDWYGTVVCDVETLARVVEVELIDSSDAVLDHTAVRAPKALPFDYILPDPSQRVDTPPRVAILYASLESPNFRDLHSYLYSAACAETPTLSYIFRPVPPVKRNTNIRTYLSGYGVALDLKKMDYLAVDDRLQSGSGSGTHADEDVASGSQEDETDVIVTRLQQYPIDDTVDVTEPLTDAELLEIGLQATQLIYDAEEPHDRLATMKHLAQNFPRYAGALARRVTVSQSLFNEVAENRARAPGGASAIWINGVNVEEKDLNPFALLRAIRRERGIMLSLLSLGLSPEQAIELLTHRTIAEAQSSGGILDGIFDASDRPEGGDVIGWLNDLENDPRYGRWGGTLRVLLRQMYPGQSPNVRLNMFNVVLAVDLSQASSLEFIGVTVNSLINRGLPFRWGVVPLVETEDGARMARLFYYLLENFGPDETLGFLLSLSQRNVPLDLLKPNVDWSAVRLNFNRLIGAQEELDEDLEQDLDVILEGTEGDLEGPRAYAMRLGATLSSAPQGHVFVNGKHFDLDDEFLRLLQTEYTEQLQHFQMKVYKGELTDEDAPKISTYFYDLPTTAKRRNTYIHPTQKAGSLRIFSLPELIKKNGLNSTAGAFIYPADTEQILLTTYIVADLDSEESRVIIKEVLKSIKPGSLSRLSFIHAPSTTSSVRDLPETTPSHIVGRLIAGNALSNVSPEQLLNVLGLSDPLEDNAQAPLSEKTAEELLSDVAGSGAAYEQYLTACRLIVRKLELKPGEAAVIVNGRLVGPMPPSAFLADDFEDLFAFEHLRRAQPVYQALSDVHEAIHEASREDLAEISSIASSIISSIQQPDPSEVGLFNAPQRPRLRNYRRLSGTYTAFTIGDNTTALYHVGALIDPLSEAAQKWTSLLEWLAEIPGVFIEVHVNPGRSTELTLKRFYRYNLLPRLSFDEHGNEVHASTRFTDLPIEPIYTLAMDAPQSWLIRPKEAVYDLDNIQLGLLSPQDRAHGLKAVFNLDYLVIEGHAREGETNTPPRGLQMQLVTSNSTPIADTLVMANLGYLQFRTKPGVYKLEIRPGRGREIFKMESVGNEGWNSPPVDEAGDEITLTSFEGVTLYPRLSRNPGMERADVLMTDVQSAEDHTSVLDNFVHKVSSLFGSKKEEKAVVPVDDGQAEINIFTVASGHLYERFASIMILSVLRHTKSSVKFWFIDNFLSPSFLEFLPEFAAEYGFQYELVTYKWPSWLRAQTEKQRIIWAYKILFLDVLFPMDLKKVIFVDADQIVRADLKELVDLDLHGAPYGYVPMGDDNPDTEGFRFWKTGYWKDFLRGMPYHISALYVVDLVRFRQTCPTTCNAKFRSTPFLRIGSGARLGVCIALYPEFHDMLLMDSAHTCITGSKDRLDRAKTIDLCQNPLTKEPKLDRARKIPEWEVYDAEISAFAKRLHERKAEPMDKPKSVHDEL

SEQ ID NO: 4289 - protein, 1714 aa, Rhodotorula sp.
MRIRRVVATLSLASAGLVVHAYTSPPVFTSIEASWPAPDLVTQYLETLALEAPNEFFPSLDFLVSHPHSHLFWPTSEPPLRPAALATAQSYADRGINPIFASQSPDAPDRLWANETIALLEASLAQIPNLANERGLLESLRVAVANREASVRIEGIRRMWEDRVAEMEVGASSTVEADDEAADSTTSAQPWRSCESWIDVGGKAACSVDEFWSFVGEEQRDETLPILLPSDLPLPNRTVYYAVDHVSPAGANDHLDRVVLYGSPVSPAFPELFHFLYHLSITKIAPHVNPKTGQTRSGPPRPPRIQFALRWKPSSRAQMTREKLVLGGYGAMLDVKKSDYLAIDDRVTGSTAAAEAGVGKAEPSEPILEIEGDAPPKMEPVKKADIAELSVRTAQFIHSAQDPFSAFVDLTSAFPRLASHLPVLVPDPSPHLISEVSTNQMTSPLARRPAFFLNGKHLTEDEVEPFALLRIMRKERKIINDLLGLEAQMTGADARHILIAGGPKEPTPSQDRIDPELLGELYDATDQQEGEGVILWWNDLEKDRRYKSWTKSVRELLRPSYPGSMAQVARNLNNLVFILDLSRSDSLQHITRNIKQYVSRGLPIRFGVVPHVGPSGDSSSVSTLMAQMTWHLTDAAGRTATMAFLDRIAQALPSGGRISEDLVKRAYSQLRTSSTDLDGEPLAPLEQVRQYGIGAKGRGSHSRLSKTRSYLERLALPQEAKGSVFLNGAHFPLDEDFTQNLQRTLGLHTQFLSQEVYMRSLTDDTDASTYFADLPQTHKRRNPFIFPSDESNPLKIVNLVEALKGVTPSWLEHGFISAPSHSADEAGHDVEPPPPIASLIVVTDLDSRDGIDLARHALLLADTDARVRVSFLHNPATAPATTHAWSLSRVFWKLVETGATEELLPRELGEWIDLGLTQAGPREQDGQAWPEENPLRQYLANGLPGRDGAEAELYWALLAFIRVRFGFAAGESGLVLNGRVIGPFRPTQFPTPDLQTLLTLELEKRILPVVAAVNATSLDSTAHDAHDLSQFYMLATSVVGAAHIADPAAGLFATSSTERRRDYLRLHASHTAVYSPQNPAALYEIAVVIDPATELAQRWAPIIRTLNELNSTIVSLYLNPSLHLTEVPIKRFYEFCFASKLTFSPSGAELQPQVRFDAIPPDVLVTYATDLQRAWLAFPRTGIHDLDNIKLGDLPLDSRERGVEAVLELETLIVEGHARDMPSSRPPRGLQLELSRPGSLNAAADRTASIVMANLGYVQLKANPGLWRLDIRSGRSADVFELESIGADGWKSAEVAKTGNEFFVSTLEGKTIYPRFRRRPGHETTELLDESAAEAVKDKTATLGIWNRVKSMLPFVAPSSTDLVDTGKRADINVFTVASGHLYERMAFLMIVSVLRHTKSSVKFWFIQNFLSPSFKAFIPHMAKEYGFDYELVTYKWPHWLRGQKEKQREIWGYKILFLDVLFPLELDRVIFVDSDQIVRADLKELVDLDLKGAPYAYAPMGGYDGEKPEMEGFRFWKTGYWARHLQGRPYHISALYVVDLDRFRQIAAGDLLRQQYQALSADPGSLSNLDQDLPNNMTPNLPIVGAGGFKRPFARTDQESLQQYTLPKEWLWCETWCSDEDLATAKTIDLCNNPLTHEPKLQRAKRLIPEWTEYDDEVASLAKRVATAQGESVAFEARADEMEQALQQQQERDDFVGSSQVEPPPAEHVKDEL

SEQ ID NO: 4290 - protein, 1494 aa, Rhinocladiella mackenziei
MRTSTLPWRSIGLALLSLTLPSTLAQSSPSINVALETSFSAGPYLVELLETAALENSSSYFPLLDRIADGVFSDLHTEQELYNKFIDVLKQDGHLSDPESLSSFKFALALHAAAPRIEAHFQYYNTSVQPYLMAAQDAACPVWVYLDGKQYCSPALDRAQQAVALPDVTDNLPFDRVLGDVLEAPPSILYADITHPLFGQFHHDVCQTAREGRSTYRVRYRPSMGSGETKPLYVSGYGVELVLKRTDYIVIDDRDAHKTGSGNVDPVSLEQVQEDELTDLKPLTTSEVVNLGLNAASFITASSHPLESLLQISSDFPRYSTLLASTNASREFLSEHTANREQFLPSGYNVFWINGVQIEPRLVNAYSLLDHLRRERRIIGELKEIGLTSAEAINLLSSEVIAEAQANEMPQRFDWRDDVEADKVLMWLNDLEQDKRYAAWPSTLPSLFQRVYPGQLPQLARDIHNLIVPVDMTDIKDIELVATSLQSLVRRLVPIRIAIIPTGTGETANLYSKLAYHILDTYGLSSLMAFFSDIVSSKKLSSNPEKSFASAIKGRPLREGREQSSYQDLLTAESLNLRLQARDNYLNRLALGGSRPPFLINGVVLPRTDNWFELMSARLYSDLQLIQQAVLQDAILEDTWVPQFFLFQAAARRNEIVFPHDPKDVKIVDVNYLTANFGEDISSLPRVAGTEAMLLSDRAHLLIIADLDSEAGRVFLSEAAAFQQKHPETDMLILHNPSSDSPPDQPSRWLYAFVQKSGRDLTIEQLQRSLENESDPLLGESDLAEASARFWSSKEGLIGSLGLSAGQTGLWLNGRLLEPSDQPLTAIDLESLLDFERRERIAPVTTAITGLGLEDRFSDALDLAKVTSLVARSLKSDLPEGLRESAPLIRMDRFKIWQDTHTSISVSNSNDPIIQIVAVIDPASEVVQPWVPILKTLSQLDGVSVKIFLNPKDRLTELPVKRFFRQVISAEPRFNADGSLENPNASFTRVPKDTLFNLGMLVPPSWLVAPKSSIYDLDNIKLSSLGDGENIDALYELEHILIEGHSRDVTNGPPPRGVQLLLGTAQEPHFTDTIVMANLGYFQFKANPGYWQISLKPGRSSKIFHIDSVGPHGYSAQAGDETTAVALLSFQGLTLFPRLSRKAGMEEEDVLGSSVLGGALDYLNKGASIASSALSSLGFKSASSSSSSSSVNADINIFSVASGHLYERMLNIMMVSVMKHTKHSVKFWFIEQFLSPSFKSTLPHLAKHYGFDYEMVTYKWPHWLRGQKEKQREIWGYKILFLDVLFPLDLDKVIFVDADQIVRADMMELNKVDLKGAPYGFTPMCDSRTEMEGFRFWKQGYWENYLRGKPYHISALYVVDLKRFRQLAAGDRLRQQYQALSSDPNSLSNLDQDLPNHMQHNLPIHSLSQEWLWCETWCSDESFSSAKTIDLCNNPLTKEPKLDRARRQVPEWTAYDEEITAVIKAATEEKEEEPVVPEEAHEEVFHDEIKRDEL

SEQ ID NO: 4291 - protein, 1500 aa, Dipodomys ordii
  MOD_RES (348)..(349): Any amino acid
  MOD_RES (354)..(354): Any amino acid
MGDASAARVAAARRVTGLCYKMGILIALTGLWLLSSVKADSKAITTSLTTKWFSSPLLLEASEFLAEDSQEKFWNFVEASQNIGSSDHHGTDYSYYHAILEAAFQFLSPLQQKLLKFCLSLRSYSATIQAFQQIAADEPPPEGCNSFFSVHGKKTCDFDNLETLLLTASERPKPLLFKGDHRYPSSNLESPIVIFYSEIGHGEFSNYHQQLISKSNEGKINYVFRHYISNPKKEPVYLSGYGVELAIKSTEYKAKDDTQVKGEKFSTNLLGLNLLFVKFRDLHPSLNEQLKELRKHLVESTNEMAPLKVWQLQDLSFQTAARILAAPVELALVVMKDLSQNFPTKARXXTLRLXNYFKGTLGLQPGDSALFINGLHIDLDTQDIFSLFDVLRNEARVMEGLHRLGIEGLSLHNILKLNIQPSEADYAVDIRSPAVLWVNNLETDSRYNAWPSSLQELLRPTFPGVIRQIRKNLHNMVFIVDPAHESTSELMNTAEMFLSNHIPLRIGFIFVVDDSEDVDGMQDAGVAVLRAYNYIVQEKDCYHAFQTLAHIYNKVRTGEKVKVEHVVSVLEKKYPYVEVNSILGIDSAYDQNRKEAKGYYEQTGVGPLPVVLFNGMPFEKEQLDPDELETITMHKILETTTFFQRAVYLGELSHDQDVVEYIMNQPNVVPRINSRILTAEREYLDLTASRMSSKEIYDDSFVRPVTFWIVGDFDSPSGRQLLYDAIKHQKSSNNVRISVINNPSQEIRNENTRIFRAIWAALQTQTSNSAKNFITKMAKEETAEALAAGADIEEFSVGGMDFSVFKEVFESSSMDFILSHAVYCRDVLKLTKGQRAVISNGRIIGPLEESELFNQDDFHLLESIILKTSGQKIKSHIQQLRVEEDVASDLVMKVDALLSAQPKGDARIEYQFFEDSYSAIKLRPKEGETYFDVVAVIDPVTREAQRLAPLLLVLTQLINMNLRVFMNCQSKLSDMPLKSFYRYVLEPEISFTSDNKIAKGPIAKFLDMPQSPLFTLNLNTPESWMVESVRTPYDLDNIYLEEVDNIVAAEYELEYLLLEGHCYDITTGQPPRGLQFTLGTSANPVIVDTIVMANLGYFQLKANPGAWILRLRKGRSEDIYRIYSHDGTDSPPDADEVVVILNNFKSKIIKVKVQKKADMANEDLLSDGTNENESGFWDSFKWGFSGGQKTEEAKQDKDDIINIFSVASGHLYERFLRIMMLSVLKNTKTPVKFWFLKNYLSPTFKEFIPYMASEYNFQYELVQYKWPRWLHQQTEKQRIIWGYKILFLDVLFPLIVDKFLFVDADQIVRTDLKELRDFSLDGAPYGYTPFCDSRKEMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGTLYKEKTKEPSQKGSQKREEL

SEQ ID NO: 4292 - protein, 1597 aa, Galerina marginata
MKRIFTLLGATLPVLQVAGSASSPSVKATLRSSWPAPPFLAEILETVSLENPNGFFTYLESLTDPEALASPRTSTPEAIHQAALQVAMDSGVLNEPGSLAIVEMNLAMHAATPKLEVFYNYYADNHNNSRGTKCGSWVDWYGEVVCDVETLAQLAGVEAIDAANAPPPRPKPKILTFDHIFPLPNDILERPPRTAILYASLTSPNFRELHTYLLKLTNRLDPHVEYVFRHIPPSSLAEERNYLSGYGVALDLKKMDYLALDDRHTNSEGAHNGASKLDDEGQEQRVDPLLPLILAHPENTTAPGADVPLTEEELGSLAGKAAQIIAESPVPLTALTHLSQNFPKYATSLARRVVINESIADELQNNSIKVQRGLNAFWLNGLQLEAKDINPFGLLRALKKERGVVRTLVAQGLQRSQAFDLLTHPAIAATQKNSGLVEALFDASDRPEGGDVIVWWNDMEKDSRYARWNPSLFALLRTMYTGAMPSIKANLFNIVLIMDLSQTTSLNFIAGPMTNIISRDFPLRFGLVPTAETEDGKKMARLFYHLIKNFGRKKSLDFMKSISQVQLPPDLQTPRVDWHTVKQAYEQLVEAEREEKPDAEYPHLDSILVGEAGDVAPLDKIAVYTERLGSTLAHSKQGHAFFNGKHFDINEDFLRHLQGEMGQQMAFLQEKVYEGSLTDADLAETMGNYFYDLPTTSKRRNSYIYPSTGSKNVHILNLPDVFAKTRFRVSASTYLYPSESESIPESLYIVADLDSENGLGLVKEAISSLTPDSKTRISFIHNPAIPHTADSAARSPTSWLFAHLHTRELLATVAPSTLLSALGSPAAPVDGSQTPIGKSSAFEEATGGVVLGDIMPEEYADYLKTSRLVAREVRLLPGQAAFIVNGRVVGPIKGNDFSVADFKALEDYEFRKRTDSIVQALQEVAPLLLEDKHTYANIVSMASSVVASTQQPDSSETGLFDTPPRPRQRSYQLLDSEYTSFEYGDNSTALCHVAVLVDPLSETAQKWSSLLKWLSNIPDTFIEIHLNPGRYSDIPLKRFYRYNLVPTLSFDEEGREIPAKAVFEDIPVDPIYTLAMDVPTAWLVRPREALYDLDNIQLGKLAPGDTAVDAVFDLDYIVIEGHAREASNIVPRGVQLQLVAGDNVPIDDTQVVANLGYFQFKAKPGVFQLEIREGRGRKIFKLESAGNEGWDSPTVEEAGAVITVTSFEGLTLYPRLSNLPGMETADVLQEEEEQSSKGVFEDLSSRVMSMFKAAKKEVSTEVVTVKPQADINIFTVASGLLYERFVGIMILSVLRNTNSTVKFWFIENFLSPSFLEFIPHMAEKYNFQYELVTYRWPSWLRAQTEKQRIIWAYKILFLDVLFPMDLRKVIFVDADQIVRADLKELVDLDLHGAPYGYTPMGDDNTDMEGFRFWKTGYWKEFLQGRPYHISALYVIDLVRFRQLAAGDILRGQYQQLSADPGSLANLDQDLPNNLQAQVPIYSLHEDWLWCETWCSKDRLHRAKTIDLCQNPLTKEPKLARARQIPEWEEYDTEIARFTRDLAAQGKIHSRIATADVNALAGGSTSVDSKKEDEDVETDTKPVHQEKTDNTEPTRDEL

SEQ ID NO: 4293 - protein, 1475 aa, Dipodomys ordii
MVPAKAADAVRLLLGATALWFTLLGATTASASKAVMTQLAAKWPEPPLLLEASEFMAEESNEKFWQFLETVRELAIYKQQESDYSYYNLILKKAGQFLDNLHINLLKFAFSIKVYSPAIQMFQQIAASEPPPDGCNAFVVIHNKQACKINHIKKLLKKATSRPRPYLFKGDHIFPTNKENLPVIILYAEIGTRAFSEFHRVLSQEAQNGKILYVLRHYIQCGEHLTNTVLYHPSGELYSDLRDNLTIFQKYLIEINKEMIPLKVWELQDLSFQAASQIMSTPVYDAIKLMKDISQNFPTKARSLTRIAVNQQMRQEILENQKYLGERFGIQPGDARLFINGLRIDMDVHDPFSILNMLKLEGKIMNGLQNLGIDGEDMKKLFKLNLHAQEYTYVLDIRHSSIVWINDLETDGLYVTWPTSYQELLKSVFPQTIPSIRRNFHNLVLFIDPSEEYTLEFIRLAELFYYHKIPLRIGFVFILNTDNEVERTDAAGVSLWRAFNYIAEEYDVTEAFNSLVQMYQKVKDLLTVDNVKSVLQNKFPHANIGDILGTYSKYDKERMAGSSFYKMTGLGPLPQALYNGEPFNLEEMTIKDLEVAILHKMMDTSVYLQRDVFMGILNDQMNAIDFLMNRNNVVPRINSLILDSTYQYINLISTSVTADIEDFSTFFFLDSQDKTTVIAKNMYYLNHEDDNEDEEVVSAVTLWLIADFDTPSGRKLLSNAIKHLETSVYSRLGLIFNPTSKINEENTAISRGMLAAFLTQKNSPLKSFLKKLTEEETATAIYSGDKIKNFLTEEMDKNAFEKKYNTIGVNIFRTHQLFCQSVLQLDPGEISVVSNGKFFGPLEEEFHTEDFLLLEKITFSNLMDIIKDIVESIKINSDDLSDLVMKLDALISSLPVHASRYDVTFLKENHSIVKINPQENDMVFDVIVIVDPLTREAQKMAHLLVVLGKILNMKITLFMNCRSKLSEAPLKSFYRFVLEPELVSGTDNNPSPGPVAKFLDIPESPLLTLNVITPENWLIEIVHSNCDLDNIHLKDIESTVMAEYELEYLLLEGHCFDTAEQPPQGLQFTLGTRRKPVMVDTIVMANLGYFQLKANPGAWILKLRQGKSEDIYQIVRHEGTDSQPDLGDVIVVLNSFRNKILKIQVQKKPDKMKEDILIEDKHEKKGMWDSIKSFTRRLHKEDNKDENDVLNIFSVASGHLYERFLRIMMLSVLRNTKTPVKFWFLKNYLSPTFKEVIPHMAKEYGFQYELVQYKWPRWLHQQTEKQRIIWGYKILFLDVLFPLAVDKIIFVDADQIVRHDLKELRDFDLDGAPYGYTPFCDSRTDMDGYRFWKTGYWASHLSRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLKAAVRIVPEWVEYDTEIRQLLDHLENKKKNTILAHDEL

SEQ ID NO: 4294 - protein, 1523 aa, Fundulus heteroclitus
MTMEKVLLLSLLLLMLHRVPAAPKGVTASLKAKWSMTPYLLETSEFIGEDGNEKFWHFVDTVKELTVYKQGETVRSYYNLIIKKAAQFLTHLQVNLLKFALAMRSYSPAVHASQQIASDEPPPEGCPAFVSVHGQRSCSTKDIKKLMKAAAGRLTPYLYKNDHTYPGLNKTDVPVVILYAEIGTKKFNSFHKVLSEKAEEGTLVYVLRHFVAKPKPQKVLLSGYGVELAIKSTEYKAVDDTKVKDSKAVINTEDDRNEEVQGFFFGTLKKSHPELEEQLGELRKHLLESTNDMAPLKVWEMQDLSFQAAARIMSVPKFDALKVMRDLSQNFPSRARSLTRVAVKQEMRKEIEKNQKHLGETMGIQPGDGELFINGLHIDLDVHNPFSILDILRGEAKVLEGLHNLGIKGEQKAKLLRLPVNTVDDSYALDIRHPAIMWMNDIENDQMYRSWPASVQELLRATFPGVIRQIRRNFFNLVLFLDPLQEETVELVKLAELFYKHKIPLRIGFVFVVNTKEEIDGFSDAGVGFYRLLNYIADEYDLSQSVMSIVSLYNKVDVWEGLSADTISAYLKRQYPKADQERILGADSEYDYKRKDGALFYRKSGLGALPVALFNGVPLNPDEMDPEELETIILQRIMDTTAGFQRAVFMGQLTEGSNVVDYIMEQANVVPRMNPLILSTDRKYLDLTGTPVVNEWEDTTMFSYLESKDKTAVVAKRIKYFTNSDEDGLTAVTMWVVADFEKVSGRKLLLNALKHLKSSPGLRVGVIDNPSGKLSEDNTVLYRAVWASLLTQKNKAAAEFAQKLLKEESNQLLQQGTKIKDLGMQGMDLDAFEKKFNTLEVDFIRSQQMFCQDVLKLRPGQRAVISNGRILGPLEEQEEFTVEDFHLLEKITLSGSAEKVKAKVKQMGMKPKQASDLVMKVDALLSAAPKGEVRRDVSLKDTQSVLQLSPRENEVFYDVVAIVDPLTREAQKISSLLIVLSQVVNVKLQVFMNCRAKLSELPLKSFYRFVLEPDVAFLANDTASPGPVARFTELPESLLLTLNMITPESWMVQADHSLHDLDNIHLQEVNGVVAAEFELEHLLLEGHCFDLSTGQPPRGLQFTLGMSQEPLMYDTIVMANLGYFQLKANPGAWILRLRKGRSEDIYQIVTHDGTDSPPDAEDVIVVLNSFHSKIIKVRVQKKAEKINEDLLSETSESKGIWDSIVSVWSTFEKSITGGGSKKDEGEKKKEDILNIFSVASGHLYERFLRIMMLSVLRHTHTPVKFWFLKNYLSPSFKETIAHMAKSYGFQYELVQYKWPRWLHQQTEKQRIIWGYKILFLDVLFPLAVDKIIFVDADQIVRADLKELRDLDLEGAPYGYTPFCDSRREMEGYRFWKSGYWASHLGQRKYHISALYVVDLKKFRKIAAGDRLRGQYQALSQDPNSLSNLDQDLPNNMIHQVAIKSLPQEWLWCETWCDDASKVTAKTIDLCNNPKTKEPKLMAAARIVPEWVEYDEEIKKLLRQVQEQTPTPSLHKKENRRDEL

SEQ ID NO: 4295 - protein, 1530 aa, Apis florea
MSFMENLKMRLIICLYFLILCTIYIEAEKRVNKYVTTLIDAKWKETPLALEAAEYLNDENPSYFWKFIDNFANYDLRNVTEKDNYDAVIAFAEKYLSHSELALMKLGLSLRIYSARIEMFTQMVENKNLSFLDCYNIVDIGGVFTCSLEELEKLAIQDTWMRPDIYSVDHRYHTSQQSDKIIILYGQIGTPKFLDFHNKLKDLAETNGINYILRHYLKDRTDKNVRLSGYGVELQMKSTEYKATDDSDIKDNTGKDSETTTDNMEEIDGINFVTLKNLYPNKQLELDKLQTHLLETSHEIGALKVWQFQELSYQAAERIMNSPTNEAINVLTDISQNFPIQAKSLIRTKVNNEMKKEMKLNQAIFSTSLNIQPTDTALFINGLFFDLEAVDVLSLLESLRSELRIMESLRKIGFSNKEISTLLALDLSTNMDKQEFAMDIRDSAIIWVNDIEQDSAYARWSSSLTELLRPTFPGMLRNIRRNLYNLVLIIDPLSGESSPLITLAQSLYLHSAPLRVGFVFVTNYDSSITGLTDASVAINNAYHYFAETKGSEHALQFLIDLGNYIGPEGVDIEDIKKTIKIQDSSANINYILGEESEYDVGRHLASDFVKRSGFRKFPQALLNGVPLSSDQLNANSFEEAVLSTIISQTPALQKAVYRGEITEGDDVVDYIMNQPNVMPCLNERILKPEKHTWLNLIGTIPNDEDYNKWSPQDLSTWLINKMRYIYVPRRTTVHHLYTFWIVTNLNELKGRQLLREALEYIESNADVRISIIVNPLADTNNNTIDINQIVLAALHTLPVEKIMRFIRNIIKEDMATVILNEKKVDIEEEIIKERLKNQIDELYIHRRYIKTVLNLEKGARAIVCNGRLIGPLDDDEEFTNEDFSLLERFTQSTYDDKLLKKLIKGQLLENDEYEKNEITDDMIMKITSLLASHPQTRSRFHIPFHGDDYSAIKIPAMNPDEVSFNLIAIVDPVSRGAQKLGPILKTLQQSLNCNIKVFLNCLDKNSDMPLKSFYRFVFEPQLQFFLDGRINGAMAKFTKLPTSSLLTQYIHAPENWLVEVIRSVYDLDNIKLDNVAIGVHSEFELEYLLLEGHCFEAVIGNPPRGLQITLGTEKQPLMVDTIVMANLGYFQLKANPGEWVLRLRQGRSAEIYDFTTVGGQDVLQNDNDVKVVISSLRSHVLKVKVSKKPDKVGMDLLSEDDKSSGLWNSISSFSKFWTFTTTDDSDDQDEKLNIFSLASGHLYERFLKIMMLSVIKHTKSPVKFWFLKNYLSPTLKDFLPHMAKEYGFEYELVQYKWPRWLHQQTEKQRTIWGYKILFLDVLFPLNVKKIIFVDADQVVRADLKELATMDLGGAPYAYTPFCDSRKEMDGFRFWKQGYWRNHLQGRAYHISALYVVDLKRFRRIAAGDRLRGQYQALSQDPNSLANLDQDLPNNMIHQVAIKTLPQEWLWCETWCDDASKKYAKTIDLCNNPMTKEAKLQAAVRILPEWIGYDEEIKALQLKLENDNRQTEKEENEIFEDTENFTKHEEL

SEQ ID NO: 4296 - protein, 1512 aa, Erpetoichthys calabaricus
MSLLLCLGFLLPTVLHCDAASKGVTVSLKTKWPMTPLLLETSEFIAQEGNEMFWQFVDTVREITIYKKDDSEQAYYNLILKKAGQFITDLQINLLKFALSLRVFSPTVQKFQQMAADEPPPESCSAFISVHGKLTCSPNEIKKLLKKAASRPRPYLFQSDHRFPAFNQDNLPVVILYAEVGTSSFNAFHKILSEKSGKGEILYVLRHYTANPRLEKINLSGYGVELAIKDTEYRAVDDSEVTGSQIPNATIPENEDEIDDVQGFLFGQLKNSYPYLKEQLGELRKHLIESANEMAPLKVWELQDLSFQAAALITSARKYDALKIMRDLSQNFPIKARSLTRVAVNTELRKEIEENQKHLTDTLGIQPGEAGFFINGYQIELDTTNPFSILDRISSEAKVMEGLYGHGFKEDNLNKMLKQSVHSVKDSFALDIRHPAVLWINDIEKDSMYSSWPSSCQELLRPTFPGVMRQIRRNFFNLVLFINPAQEHTNELLGLAQRFLKHSVPLRIGLVFIINSSDNVDGHKDVGVALFRIISYLTEEYDTSLALSFMFSVYSGLKSGEVLTIDKLIKFLNKKYPRANVDTIIGSDSPYDNNRKDGGAFYKKSGLGPLPQILFNGLPFIQEALNLDDLEIVTMQHIMDSTNFIQKAVLMGEMTDEMDALQFLMEQSNVVSRMNPLILSSKKEYLDLTSKPALEDWQDFVTFSFLDSRDKSAVVMENMKYLTNHDKDIIYAVTIWIIADFDKPSGRRLLSNALKHMKKSTNIRIGLLNNPESKGLSDDNTVVARATWSAILTQKQQVVVNFIQKLIKEETQQRLHQGTKMKYLVVQGMDSNSFEKMFNTLGVDFIKSQQLFCRDVLHLLPGQMAIVTNGRILGPLDESKDFDPEDFHLLEKLSFDGSAENIRLRVKQMGIKGKQASDLVMKVDALLTSLPREHTRRDIQFIKNKLCVIHQAPREDEVYFDVIVIVDPLTRQAQKVAHLLIVLGQVINMKLQVFMNCKSKLSEMPLKSFYRLVLEPDIIFLANKRISAGPVAHFIGLPEAPLLTLNMITPENWLVEAVRSSYDLDNIHLKEIDGLVRAEYELGHLLLEGHCFDATTGQPPRGLQFTLGVKNNLLIQDTIVMANLGYFQLKANPGAWMLKLRKGRSEDLYQIVLCDGADLPPNADNVIVVLENFLSKIIKVQVHKKPHKIGEEILGDESEEQITMSFEEESNNLEKKNADVLNVFSVASGHLYERFLRIMMLSVLRHTKTPVKFWFLKNYLSPTFKETIPHMAQAYGFQYELVQYMWPHWLHQQTEKQRIIWGYKILFLDVLFPLAVDKIIFVDADQIVKADLKELRDFNLSGAPYGYTPFCDSRKEMDGYRFWKSGYWASHLGKRKYHISALYVVDLKKFRKIAAGDRLRGQYQALSQDPNSLSNLDQDLPNNMIHQVAIKSLPQEWLWCETWCDDQSKTKAKTIDLCNNPKTKEPKLKAAMRIVPEWTEYDEEIKQLLKQAEGQKKRAKSKSKKNVAHDEL

SEQ ID NO: 4297 - protein, 1486 aa, Hirsutella minnesotensis
MMHSPSMSLALGAIILTALPVHALPSVTMGMNAAFSAGPYLLELLETAAAENETAYFPLLDRLASGYFDPASSDADLYGKFVEVLEKDGHVSSPEALSTFNLALSLRSAAPRIEAHYQYYDTAVKPLIAASECQTWVLLEGKQYCNPKLDGSRKEGLPLIDKSVLPFDRTWGSGKEVVLYADPTAKDFGDFHNVLYKAALDRRMKYRLRYRRSQTTTKQHLPVSGYGVELALKRTDYIVIDDREGSKESSQKPLSSAEVLDGEEEVADLRPLSTSELASLGMKTASFIQKSDKPFETLVKLMQDFPRYSASIASHNVSDDFQSSHEKNQLRTVPGGVNFLLMNGVQLIERQIEPFALVEMLRRERKLLNGVRDLGLDGKQAVSLLGHKAISTAKDDDEPLRYDWTDKAEDGKAILWLNDLEKDARYEGYPKSLTSLLQRVYPGQLPPIALNVFNFIIPIDFSDKSDLEFLIQIAPLVSRGIPIRFGLVPLASTDEATARAKVAHHLMETYGFEALVSYLDSLDQDSQVVIDDKLLNRITADLELLSDTKKLSINEISTAEVLEQRIKSAQHWVSRLKADTRPKPFFVNGIATLRDKSWMQTMGMRVSEDLQTVQQAIFDGSLNEDTWIPGIFLKQAASRRNVYIALDNDKALRMLDVSRCYTDHAKLFRSVPVLEPFSESTKENWAVATIIADLATDDGLQLALAALEFKRNNPGIRLELIHNPEEISTATDFVAAIKASEDKLGDIETAEQFNLLLDNAAKAGIDEDYAAVLTAFLKMGKISAGTKTIVLNGRIVGPLPGNESFTTDDFQQLLDFEQTRRILPVYAALDDMGLSDKLSDAVAAAKATSITALSTISDLPEGIFESAPALRSTMYEKWNMSHSTIELGDPQKANIHIAGLLDPVSEKGQRWVPILKVLSELEGVYLKLVLNPREKIDELPIKRFFRYVMKSKPSFDESGKVEALRASFKNLPSEALLTAGMDVPPAWLVAPKESMHDLDNVKLSTVTSDVEATYELEHILIEGHSREDRGKAPRGAQLALATEKDPMVTDTTIMSNLGFFQFKANPGFYNIKLKEGRTAEMYTIESIGAQGFEAVPGDEGTELALMNFQGATLYPRLKRRPGMEDQDVLKKTDDASGDSLVSKGLKFAGGFLGGSKDKPSSALEHAEINIFSVASGHLYERMLNIMMVSVMKNTKHTVKFWFIEQFLSPSFKEFIPHMAKEYGFNYEMVTYKWPHWLRQQKEKQREIWGYKILFLDVLFPLSLDKVIFVDADQIVRTDMMDLVNLDLKGAPYGFTPMCDSRVEMEGFRFWKQGYWATYLRGKPYHISALYVVDLRRFRELAAGDRLRQQYHALSADPNSLSNLDQDLPNHMQFEIPIHSLPQEWLWCETWCSDESQAAARTIDLCNNPQTKEPKLDRARRQVPEWTLYDDEIAALDRRVRGAKPRSGTGGEPDHAQSVASEEKDHQAQRATSKKASETESHSKDEL

SEQ ID NO: 4298 - protein, 1483 aa, Plasmodiophora brassicae
MPLSLCWASAALVGVIVAVAAASDVDVELRSEFPPGSLTHQALEFYGELSLFWEAVAIAADAHQANGTEQDEFARIMSSCLEHHTASVCSVLQMTLALNAYSPRLETNRQLLKETLRRKGPVTACSKAAIVSYGDEAVSCGFDESLAVSVSNASIFSFDHLHPLSSSPGRPVIVYADLGRQGFAEIHKRITESRSLAYVVRLVSLDDIEDARVPSFNLNGYGIELAFKNMEYNVLDDRNADSEQKQEAAVNGVFFETLSKRYPKSASALQKMKGEGDDIKVWDMGKFGLQALQRIASSKDSLGTLASLAGDFPNYAASLRKVRVPKEVSESVDALHASGIPAGFSALTLNGISLDSSDLDIFDIHAIAVKEAAYIALLDKMGLDHSQVRNLLQPPNNGRPPSPATLFARVADNNGVRLDTRDDVIVWMNDLEKGSKQYRDWPRSFFSLLQIGYPGQIRALARNVYTCVAIVDPTTTDGLVLVDWLKEFVKMNAPLRVGIVFNIDHGGENRGASEVAAREVLGPDLRESLGVNGTTNQPERSGNSQTSGAVIAAVFKALFKLSKKKAFTFLSKLATHVQSPAPPTLSTIRFCMPSSDRALLDTAVDEFNDYIVSCKQYVKGRRLNSGSLFFVNGVAHVFDSLVGRQAFQQRLIRIIYLWQHAVSLAVRDGLLNDDTDLERFMFDADDVVQVQSDVVAVPKSSHKYVGDYHVVAAPSGLRYVSEGFTTVWVNADLDTDLGARIAFNAVQFAIRNGDVRLAFVFPTSVTANGQASDRLTSVNWVVASLQNVQDIARVLAVKCSQSLWSPTVTVEHALSLVLGSGAALRDDLPSLGASFPDPAVVVDGRVFGPLSRPLDISEFGVVLQGRQVIPDDIVQDNAWLVRSILGCRARDSSVQALPALPHGQATSLRFPSPSSSLSVTAVIDPLSETAQKLAPVLLALRKDLHWDITLVINPTTQATSVPIQRFYRYVFRPTLEFLANGARDHRAATASFSSLPTAPVLTLSIETSEPWMVESVDAAEDLDNLQLVQNGRVQATFALKHLLVYGSCTDAATGSPPAGLKLLLGTPSDLHVQDTIVMENLGYFQLKASPNIWELTLAPGRASEIYEFPQDAGHVTGFATGSDGRLRVIVRSFVGSHLRLNVARRPGMEQADLSLEVTAPASKGFWGSINSMFGSDNNRGNAADKTIHIFSLASGHLYERFLRIMMLSVIKRMAGTGYSVKFWFIRQFLSPQFKSTIGAFAEQHGCSVELVTYKWPYWLRRQREKQRVIWGYKILFLDVVFPIQLDRIIFIDADQVVRGDLSELWNLDLRGRPYAYTPFCDSNKETEGFRFWKGGFWRDHLRGKPYHISALYVVDLKQFRRMRAGDTLRALYDNLSADPNSLANLDQDLPNYAQDHVGIYSLPQEWLWCETWCSMGSLKKAKTIDLCNNPMTKEPKLSRARRLLPEWNELDAEANPRDESRGIPSVPASPGRPAPNDDERNEL

SEQ ID NO: 4299 - protein, 1369 aa, Kazachstania africana
MKMLLLLVYLLCQFLSRTLAIKLSVPNDAFGVPESLRIWSIVNKLALDNNIDASILNELYPVITKLEELDEAQSVTDLVYDHLNDAVSNDMAQFFKLFDSLYPMGLQFEDDLNTPLNNDNFFMLNDQKYSKPDDVFYLKSKELKNQAKLGDSDVIASRNDVVIGKNADAPILLFYGCPVNDEFDDFNRNLYNEAITTDKIRFIWRSTCSMNFPSKINSEFPLTFTVNEESDLKSLLDTKLPFNIPHEFTDLDKLSFAKPTQEELSDMDMKVTSFLVNHYQETKNLTESLEYTRAVLNNYPFLMQHFIEMQPNKKLNSLISRSNEELERMGIDYKMLGLYINGQNHKYSTLDQYTLLNAIYKEYREIQNLQDILEKYLPTNVLTPTLAKDLLNSYSSFSLPHLKELQPIKLDLHRIRGFSESVIYFNDIEEDEQYEELEKDATKFFEKSKFGEIPEYRRNWAELIFVINFDILNKDPDTQHALMGLNRAVQITGEGYPQRIGLLPLGSRENPIVKKIYELKDTDSSELKLFLEELGSKEDVIFSDFSNIPNVGKLLKQLQIAETSIIVNGEIYPFKMNTWNYLIAKVIKKDVAFIKQELNEFAARNNVQGDKNVDVRALLHLKSADSRHPKYTPDYFADSVYTKSNDNTLNTIPQNIIEFSFSEKYNILHTITLYDNFDSQIALKRLKALSKIKFHGIRIRMVHSGDVTSSNWISLKNNLSSRKQLIAKVDNLITKSYRNIPDTTSIPLQVLHSWLPDIPLEHLKSHSFFLFNGRFIHLDSDEVLSVKRLQAIVKREAQRTLDTVYALNEIDPAFGEKMADPGFIETVSSILTMLYYKGTTIYEDGIEYTTETTLSRMDFSQILAVNNITYFEQHNHVEKPVDLLLIIDPLEERTQHILSLLSKVENLEFINIKVLLISTLSLNIVPIERVYTLNQKIQMKELRENDLLNNWEVDIETPTHFSINSFTRLESTVIEVHAFNEDSPISGSNVDGIGGVRLQLLDSSGSIIDTLSTMTTFGYGQFHLNQLGKNFTIKSADDGYEVESFSLHGYADYVPSSSFDMLDFNPKKIYIKVKILDRVSKAVEQDGGFNIFSVLKTHEDEESYKRMILSILLWKLVEDDTEQLTFWILDQPFISEEFKQYCEIINEQNELRGKIRFIDYDWPAWLRPQRFRSRKVDISKLLFLDVLFPENITSIVYMAPVATPIDPSSLFELDAKAKSFRLFRVKGKGYWDEGYWEKVLKENNLSFYSIGPAFLMNLDVIRANGDADKLRIHYQRLSADPKSLINIDQDLLNDLQTAIPMGSLRRALLDKPKLDTTLIERWESVIQDSIAAANSAAMDKEHDEIDYKNVSNDETTTLEEDEDYFHDEL

SEQ ID NO: 4300 - protein, 1678 aa, Ustilago maydis
MKALPLLGIGWAWMALILAFSIPTSTVKAEAPPVKVQLRASWSRIELTSGGSPFLLEVLEAAQAQRPSSFFPLIELLTSKHPPSELLQASDEHVAIIVEELIRSHELFSASSEHAEEALDAWRMSLALSNSSPRIQALVQLYQTLNLDKVWQQGSRNTSCVSWVHHQDQVLCSGNDVRKAIQKSKSASTTQTQIQGVSLGHSRKNTRSKTAAHSFVLYADPYSDNFRELFSTLEEHTSQHDTEFTYTLRWRPSDNHDDRPTSESKSHVQRLSGYGAILDLKKVDYLVIDDRKLKDDSNVGDVGIPGESESEQANAAQRASQDAQWLREQIDADVEASAVTLSSLSNDQIADLGIKAARLILDSSDPLRALQELSQNFPSHATALASSTKWDDASTSAALIDAVLNLASMRIEPGQSDLWLNGQTTNARDFMPLSLLETLRKERGWNHALQHRLAGGGLNVTEAGDLISSSLLGRAWLAQADGNAAAATFDASDRIEIKNAPEGTSTGAITWLNDLEKDQATSEWSNDLMDLLRPLWPGKFPRLSLNLFNVVLVMDLSQKETCRFLSDTVLQSLGRVGLHWGLVPGGLEDEANADSIRMARLFWFLLDHAGAEVTSDVLRKAAASKTGSAGALDVSIAIKEAKFALKSLDAESSLTDQLEKALAGDNDIYIQKESLGRAYIQRLRADRHESLTGHVFVNGQHHAFHPQIVHILHQTIQEQIQALAPQIYYGQISNDTPGLDTYFYDSVGALSFRSALVAGASGAQEGGLVHSAVDLFSALVNDEEVVASNEEVFDFFYPAASQDLMNSTVWVLADVDTQDGLALLTRSFEALARDDAKFRLAVVHRPSAWNDRKTTMSTLLFHLLKQGDLGQLLPSEMLQALRQALDEPSITWQQMSDQLRVHTDGPISESEVRRFWNSVGLAVTSKLAIPEGPAILVDGHLVSNLTVASIEARDITALVEYEAGQKLPYLTQALKLIRRDLDDMDPKQRQSLIFAALSVMNGVYDQTGQGVFTAKTSTRSGLAEQLGTSAHMFEIGHRETADVRITLLLNPISEAAQRWSSTLLMLRELKGVYLRVILNPEIKLSQLPLKRFYRFSSPQRLEFDSDGRVIAPELRFFGMPEEAVLTLGLDAPASWLTMPMEAIYDLDNIRLADVPSTSRAKGVKAVYELKHLLIEGHARELVAGSAVSVPRGLQLLLETPDESKSLDTIVMANLAYFQFKAQPGLWKLRIRPGRSDELYEMQSVGNQGWNSPPVEQTGADVTLDTLSGLTIYPRVAKRSGKEKEELLEQLDAQGRPVKKQNSVDSGLAVSASAAGQLMLSAKDKLFSLARQVGGTTPTHSATAVATARKHADINIFTVASGHLYERMTYIMILSVLKHTSSSVKFWFIENFLSPSFKEFIPHLAAEYGFEYELVTYAWPHWLRAQKEKQRTIWGYKILFLDTLFPLDLGKVIFVDADQVVRTDMQELVDLDLEGKVYGYPPMGDDSEDMDGFRFWKQGYWKDYLRGRPYHISALYVVDLQKFRLFAAGDRLRGQYQALSADPNSLSNLDQDLPNNMQTSIPIHTLEKEWLWCETWCSHDWLKDAKTIDLCSNPKTKEPKLDRAKRQIPEWTLYDAEVARLAQRLVEEKRVGSSVVAPDSQVETRAREHNQQHQANKASQDVPAHEVEAHADAPVHDEL

SEQ ID NO: 4301 - protein, 360 aa, Plutella xylostella
MKVIVSKDDFIDLTPDARLKVISVVAGRGAHSRTPLPAGLRTEHSLVDLPPLYPDEAAIEMVAVLDPASAAAQRLAPLLLVLRKVINCRVKLFLNPQDKNSDMPLKSFYRYVLEPELQFTPSGSQTGGALARFARLPHAPLLSMELRTPPNWLVECVKSVYDLDNIRLADVDTVVHSEFELEYLLLEGHAWDTTLGTPPRGLQLVLGTRETPDLMDTIVMANLGYFQLKANPGAWILRLRPGRSEEIYEIVGADLALDFDWNESLPYMAKEYGFSYELVQYQWPRWLQRQKDRQRTIWGYKILFLDVLFPLHVKKIIFVDADQIVRADLKELVDLDLGGAPYGYTPFCDSRKEMEGFRSP

SEQ ID NO: 4302 - protein, 513 aa, Aphanomyces astaci
LPDQHVIYVNGRPLELVAPVTPSLFDGLVTYESATRSKAVSKAYVSQFKHNVLTAEDAADKTLQLNVVLSMVDSYLKTPRVAAVLPDDVQRPTYSYVTPSGSSSLDVVAYLDPLSDTAQRASGILRMLHSVLHAKITLVLVPPPSYDEFPLKRFYRFLWGGTSSSLVEFDRLPRHPVLTLNIETPELWNVQMVQSDVDIDNIQQNASATFTIKDVLVYGQCVDKTNAQYPTLPNGLQLVLERSVAKLHSHKDTVVMKNLGYFQLQAAPVPVIVYDFLSKTLQLEVKKQPGQEGVRLLDDGPEATKAPAQPEETSVWTSLTDKQRIIWGYKILFLDVLFPLGVDKIIYVDADQVVRADLKELWTMDLQGKAYGYTPFCDSRNVGFQFWRKGALYVVDLVKFKRMAAGDSLRAIYDQLSADPNSLSNLDQDLPNYAQHQIPIFSLPQEWLWCESWCSDESKAEAKTIDLCNNPKHKEPKLDMAKRVISGDLFPESWLQLDAEVKAAEAAYELASN

SEQ ID NO: 4303 - protein, 1756 aa, Leishmania infantum
MLLILGVTAQRTLGKGIHAAVEASWNETSLYQEGCEWAARSFGDEAFYSCLDALWPPSPSQDRGRSSADSEGAREATSARFLTQQLQYMRLLEVLFRLPETRGTNRAVFEAEMAARVYSPAVEAHYTLADKALRETTPPSLSERDDSDQGERGSGNRLACGEPFAVVYTRTAPGAPLQALRVKTPSALKNAAGGAGPQHRDALVSIDEVAFASFDHRHPASSLAAVREVPAVVVLYGLPGSPAAHALHRVAVELSTPSDAASATVSGVPAYFWRHLPVSVSRLCAAAGAPERSLAAAMTSLWDSPLVVQGYGVTVDIKNMEYKVLDEKAAAQQRAKEQSSTAVDAGSSHDGTDAPAAAKRVPKTQVDRIVGGFHVGRLKERYPGLAASLDEFAILLDEEMGSDDVKVNFDVRELQKIGLAATQYISEVENHIRRLHVLTDLVMRFPTYATALSRIAALPGRLVEVQKTLLILHQRMRPGQSAFFVDGWRVEEKELTLFGVLHALHEEERLVRRIKTVLTTYAVAADDAASAAEDAVREARTVPLAPAVLEKVADYVKRTTRRTIASFEGSVDTEAAYAIPSVHIIWINNVETNPRLKRLPPVLSILLARGYAKTPLPRRNLLNFVFLWNPVSRSSLQMISLLFRLHQEGLIARYGLALADQTWSPVFEAGVQGGAGGFKGESAGSQAALQVFALVYHLAARGKENNVLIFLMELLEEAKQARADTIPDVVITRVCTRTAQAQLNSDVGKLTSNADFLSHYHETQAALRRFRVPEYPVTFLNGVLLENSMAVMSTALQREIALLRGWAASGALRDEMKDMYSAILKQRGAADHLQPALVRAPVTMRWSDTPATVAYIESLPYVYSASYAEEVPALTQLVMLPCEFTTAMLQQLQTVMEALEECGVAVKAQGAIHEVCGMLRLSLVSSPAATSLFHRHIGALQQQLARSRTPKAARYTTLRRYVSHIAKAVTSANVGVNPVLGTETVAAALAAAPLPADLQELVGVSRITGTSASSQWARAKVQFWSAFAEAYHGSAGSVALVINGRIVAMDASFSAADVLSAARLVAPITKAAQKALMNVRFAEMSTADGGYAADELDNNFFASKAACLSSVFGDEISQHMGKQSSSVSALMREERILGSENDWKPLQAVLFTVSNVARNAGEEAGTASGAVPQPLHHVTVVVDPSSRDAQVIVSLAHYLVQSPLHIRLTVLLNPSLDVKFPIRNFYQYVASPALAFEATSGRVVAPHATFSQMPSSTLLTLGIDEPPSWTVFSQDAEVDLDNIMLSRLPRSNLFVTAVYRIHSVLITGGTTDVQTGVAPDGLPLSLLHSSRARGASEVDSAAGTTDTQVMASNGGYYQLQANPGLWHLSIKEGPVAAAYCIKAIDGHAVRGCTEGANGPLLTNRTHGQRIPLVIDSFRGRYLSLQVGHTPTSEVAADLHTILQQMASDVRPEWPPSYSARDAKPALPAKPTLNIFSVASGHLYERFLRMMMYSVHKTSSDQHGSNTTRIKFWVIENFLSPQFKRYIPLLAERLGFEVGFVTYRWPWWLPRQTEKQRKIWAYKILFLDVLFPLDVDRIIFVDADQTAQADLHELYNMDIGGKPIAMTPFCLKFKNKATMSFRFWERGFWKDHLRGKPYHISAIFLVDLRRFRAMFAGDQYRDTYASLEGDPNSLQNLDQDLPNYLQHSIPIFSLPEEWLWCETWCSDKSKSRAKTIDLCNNPRTKMPKLENAKMIIPGWEELDNKLQNLSDSVLASL

SEQ ID NO: 4304 - protein, 1519 aa, Danionella translucida
MRLLLLVLVLLKVQHVCSASKGVIASLQAKWTMTPLLLETSEFIREDGDDKFWQFVDTVKELTVYKNGESVRSYYDLIVKKAGQFLTDLQVNLLKLSLSLRTYSPAVHAFQQIASDEPPPDGCAAFVTVHGQCACSTKEMKKLLKNAASRPRPYLYKSDHQYPGPNVTEMPVAILYAEIGTKDFNSFHKVLAERAQEGKLVYVLRHFVSEAKAEKMLLSGYGVELAIKSTEYKAVDDTKVKDSKSVASEDDDEADEVQGFLFGKLKKSHPELQEELGELRKHLLESTNDMTPLKVWELQDLSFQAASRIMSVPKFDSLKLMQELSQNFPSRARSLTRVAVNQDMKKEIEDNQKRLGDSLGIHPGDASLFINGIPIDLDTHNAFSILDILRSEAKTLEGLYNLGIRGSSMNKFIHLPASAAVEDSYALDIRHSSIMWINDIEKDSMYRHWPSNLQELLRATFPGVIRQIRRNFFNLVLFLDPAQEDSVELVKLAELFYKHNIPLRIGFVLVVNADEEVDGYSDAGVALFRLLNYISEEYDEAQAFASLVSIYNRLEAGETLSVETITAYLKKKFPKENAARIFGVDSNYDDNRKAGGLLFKKSGFDALPVGLFNGVPLSSEEMDPEELETVLLQKIMETTNFFQRAVFMGQVTESIDMVDFLMEQANVVPRINTLVLSSERQYLDFTASPVTDDWDDANMFSYLDDRDKTAVVSKRLKYFTKADEGVVYAVTMWIVADTEQPSGRRLLQNALKHMKSSGSNCRVGVINNPSGKPTGDNSALYRAVWASLLTQSSKNTLDFTLKLLKEENVELLQQGTKIKHLLKQGMDHDAFEKKFNTLEVDFLQSQQKYCKDILKLIPGQRAVVSNGRIIRLLDGQEEFGAEDFHLLEMVTLRTSAEKIKPKIKQMNFPPQRASDLIMKVDALLSSSPKGESRKEVKFFKDKHSVLQLAQREEEVFYDVVAIVDPLTREAQKLAPLLVVLGQVVNMKVQVFLNCRAKLSEMPLKSFYRYVWEPDVSFFGNNSISPGPMARFSEIPESPLLTLNMITPENWMVEAVRSPHDLDNIHLQEVSGVVNAVYELEYLLLEGHCFDVSTGQPPRGLQFTLGMRQEPLMHDTIVMANLGYFQLKANPGAWILRLREGRSEDIYQIQAHDGTDSPADSDDIIVVLNSFHSNIIKVKVQKKPDKLNQDLLSEETEPKGLWDSITSFAGGPSVNEDLKEKDVLNIFSVASGHLYERFLRIMMLSVLRHTTTPVKFWFLKNYLSPSFKETIPHMAKAYGFQYELVQYKWPRWLHQQTEKQRIIWGYKILFLDVLFPLAVDKIIFVDADQIVRADLKELRDLDLEGAPYGYTPFCDSRREMEGYRFWKTGYWASHLGHRRYHISALYVVDLKKFRKIAAGDRLRGQYQALSQDPNSLSNLDQDLPNNMIHQVAIKSLPQEWLWCETWCDNNSKVNAKTIDLCNNPKTKEPKLGAAVRIVPEWSDYDHEIKMFLKGLKNQQEESKPGSPSPIKKNGSQRDEL

SEQ ID NO: 4305 - protein, 1516 aa, Tremella mesenterica
MWWSTVLLVGSALAQSSQPLSIQLTASWPAAPLVLEILETIYDESPSSYFPLLRHLTSLPPDLSDRDLLSAAKEMILFHDLLPETSWGTFDLALTLHTASPKIEAFYTWYEANVVGETPEILLPFDHISAPTGLSQAIFYFDPSSPSSSPLLGYLDHHASQYPSFRYVVRYAPPKNRHEGPKTQLSGYGVEMVLKKTDYLVVDDRTSRGKTQAHSKSTQGTSSANHSRMFEILGDDPWDQWAEPLTKSEVQNLGLQASALIMSSEDKLDALLHLSQDFPKYSAAIARNIDIPQNLAARREHLLTRGPASPTLVINGRNFKSSDMNAFSLLNTIRAERHHILSLSSLGLTPKQAFELLADPLIGQSQTSDDPTEGMVDASDRDEGGKAITWWNNIERDKRYSSWPKQMQGYLRPLYPGQFHSIRRNTFNLVFVLDLASVPSLDIIAASISGMIQRGVPVRFGIVPMVSPEQEDISMQMARVFLYAVKTFGRGVTRDMLNEILKASPSSPANPATVRLEVVERVYNWAAMQSDKESLPFSQVLESHEFDPQFKALQTYTERVAALKEDAPSGHLFLNGKHIPLNGHWATAVQSEIQTQLAFLQESIINKVPMEDVANFFYDLPMTAKRRNKLIVPTQIDNKLRAHNLLDVFKHDSMNVLTTNFVYADDYNQAPITIWIIADLDSSAGRRTVMDALESLQLPSNLARIGFVHVPSDVSATNGARLSTLIYKLMSSSILNEVQPSQLLDVIQSLEKGDSVEWKEGTPLHAFSSSGWSAADDIAAARFWEVGSTIGAELKIRSSHPHLLINGRLVGPITPRSFGVADFQPLATFEYRKRVQPVVALVATMYENINSFDRTTLAGMIATMTSIVSAAYIPPGSDGIFTPAPAPRSKWYEQLDDGDMSFSVGRKDTALVHVAAVVDPISEAAQRFAPILKMLSQMDHVAVSVYLEPDLTSTDLKLKRFYRSSLSPYPLFDVDGKSIAPGLTFTDLPTSPIYTLGLDLPPSFIVSPKTSPVDLDNILLSTLHDPTTVQFELKQLVIEGHARETTNTPPRGLQLQLIANEKEVSDTLVMINVGYLQFKVTPGVYDLDIRPGRGQEVYELESVGNEGWDSKSVNETGRRVTVTSFEGMTILPRFVRKKGMEQADVLQESEIVQPDSMGKAVFSRMKELVGIKPEETKPTTRHADINIFTVASGLLYERFASIMILSVMRHTQSSVKFWFIENFLSPTFLEFLPHLAEEYKFQYELVTYKWPSWLREQTEKQRIIWAYKILFLDVLFPMDLDKVIFVDADQIVRVDMKELVDVDLHGRVYGYAPMGDDREEMEGFRFWKKGYWRDALRGRPYHISALYVIDLKRFRQLATGDRLRSQYHTLSADPNSLANLDQDLPNSMQDQIPIYTLDQDWLWCQTWCSDESLARAKTIDLCQNPLTKEPKLVRARQIPEWDEYDREIAALAARIQGGSGLAGSVDDLAGEKGRESESEPVTGALSVEEHEEGDKEEEEREAKEVGEKVRRIDDEL

SEQ ID NO: 4306 - protein, 1495 aa, Phialosimplex sp.
MALVTGPLALWRAYALILAVLACHVCASPSVNVALQASFDSAPYLLELLETAAEENATSYFPLLDRVADGTFDSALTDKDLYDRFLDVVYEDGHLKSPEGRSSFKLSLAIRSAAPRIEAHYQFYNTSVRHSLAAAQDAVCPVWVHSDGKQYCSSDMDRAQQDVIGDEDPRELPFDRVLGDPSSPPAVLYADVASPMFKEFHPMLSALAKEGQVSYRVRYRPPHHWSPRPLFVSGYGVELALKRTDYIVVDDRDAERRNQKGSDGDTPADAQWKDDSPDDLRPLSASEVARLGYNTVGYVADSDDPLETLVKLSEDFPKYSPRVAAHNASASLLKEIQSNRGRTLPPGANVMWINGVQVDSRQMDAFSLLDQLRRERRLIEKFRGIGLSAQETVDLLSHRFIGQAVANDEPARFNYRDEPEGGRVIIWLNNLEKDARYKSWPSELMAYLQPTYPGQLSPVRRDLHNIVFPVDLANAEDVELVVETIQVFVQRRIPVRIGLVPTASSPGSVSQLKVAHYLQDAYGLASLLHFLGESSSRKKVTSPDKSCFQSATKDRKLRADKQPLSLEDVLKSEELDTIVSRTTNYQNRLSLERGTPIFFVNGVPIVRNDRWVQEMSLRINRDLQSIQQGIMEGDLEEDTWLAGTFLSKSFDRRNSLVIPEDPKDIQLVDIARTCEANKEILDDIPRVESNQDVLESVQMIVVGDFDNEHGIKLLNSALGFRREHSEAEVLFLHNPETHGHSLSGSAMLNRRLKRGSTEDAAQVVVDMHSADITDSAVPDSEAKEASEFWESKQPLAAEFGFVPGTSGLVVNGRVVGPLPVDSTLTADDLAQLVAYERAKRIGPVSKAIMDLGLDSKLSTPLGLAQLTSLVALSSVSDVPEGIFETTSDIRMNLFDKWSSTSRSVITVANSEDPTINIVASIDPTSETAQTWLPILRVLSKLAGVRLKILLNPRDDMEELPIKRFYRYVLDSEPAFSSDGSLSRPKASFSGVPVEALLTLGMDVPSPWLVAPKDSEHDLDNIKLSSLKPGSNVDAIYALEHILIEGHSRDMTTKSAPRGVQLVLGTDGNAHLTDTIIMANLGYFQFKTQPGLWRINLKPGRSQRIFNIDSVGSLGYSPQPSDENNDVALLSFQGKTLFPRLSRKKGHETDDVLETGPSPGSAMDYVSKGLNFASGILSSVNPKHRRAEQQADINIFSVASGHLYERMLNIMMASVTRNTKHTVKFWFIEQFLSPSFKSFLPHLAQEYNFTYEMVTYKWPHWLRPQREKQREIWGYKILFLDVLFPLSLDKVIFVDADQIVRTDMHDLATLDLGGAPYGFTPMCDSRTEMEGFRFWKQGYWKNFLRGQPYHISALYVVDLTRFRALAAGDRLRGQYQMLSSDPGSLSNLDQDLPNHMQHSIPIRSLPQDWLWCETWCDDASLQSARTIDLCNNPLTKEPKLERARRQVPEWTAYDEEIAALVDRVAREQAGLAYGAGGVQEEEEEEGEGGEWKKDEL

SEQ ID NO: 4307 - protein, 1479 aa, Penicillium roqueforti
MRVPTGSHIPWQWYAVVGALLPGWVANASPAVNVALQASFDSAPYLVELLESAAEENSTAYFPLLDRIADGTFEDLTTEKELYDRFLTVVKDDGHIRTPEGLSSFKLSLSVRSSAPRIEAHFQFYNTSVQQSLMVAQDAVCPVWVHSEGKQYCSSTMERAQQDVVGELDPRELPFDRVLGDASLPSAVLYADITSPMFRDFHETLSDMAKQGQVSYRVRYRPPQHWISRPLFVSGYGVELALKRTDYIVIDDRDAEQLEEKGAQSLPTDPDETKEDAPGDLRPLSSSDVTRLGLNSAGYVMDSADPLGTLIKMSQNFPKYSSIVAAHNFTGEMAQEIRHNRLKMLPGGYNAMWINGVQMDKQQIDAFSLIEHLRRERKLIEKFRGLGLSADDVVKLLSHRLLTEAQASGEEQRYDYRDNLEGNQVIIWMNNLEKDSRYESWRGDIEGYIAGSYPGQLPPVSRDLHNVVVSMDSSNPEHMMLVAGNLHAFINRGIPVRFGLVPTISSPESIAQLKVAHYLSDAYGIESLVQYFQEYAAKGKMGFPDKSCFQSATRERDLVDEHEALSLDQVLKSEKYDAVVSQTGAYQRRLSLTGDAPQFLVNGIPVSREGNWMQGMSVQISKDLKLIQQGIVQGIFEEDTWLPEFFLADAFAKRNTFLMPEDPKSVQIVDIANILASDEDALSKTRVLSDKGALESTHMIVVGDFESEAGVKLLTDALNLRKENSDVEILMLHNAASDAEDDAPKNLATLYLSLAKEETIDQVLAKIASGNLETEVQDISTIQTLHQILAKELGFNPGTEGLVVNGRAVGPIEKEHPLSVGEMSQLIAYERVKRLDSVAAAVEELGFADKISNPLDFAKLTSLVALSTISDVPEGIFENTPDFRMDVSGKWRTEHSVITISNSDDPTIHVGVSLDPASEVAQRWSPILKVLSELSGVQLKIFLNPKEELTELPVKRFYRYVLESEPSFTDKGALARPQASFTGVPVEALLTLSMDVPSSWLVAPSESVYDLDNIKLSSVKSGTDVDAVYALEHILIEGHSRDLTTKTPPRGVQLILGTENNPYFADTIIMANLGYFQFKAQPGLWQINLKPGRSEKIFKIDSVGGLGYNPQSGDENNEVALLSFHGRTLFPRLSRKPGHEEDDVLETGVQLGSKMDYFAKGLNFASDVLSSVGVGSKSGGEQHADINIFSVASGHLYERMLNIMMVSVMRHTKHTVKFWFIEQFLSPSFRAFLPSLAREYGFSYEMVTYKWPHWLRAQKEKQREIWGYKILFLDVLFPLSLDKVIFVDADQIVRTDMYELVTHDLQEAPYGFTPMGDSRTEMEGFRFWKQGYWSTFLRGKPYHISALYVVDLNRFRALAAGDRLRGQYQMLSSDPNSLSNLDQDLPNHMQHHIPIHSLPQEWLWCETWCSDEDLGVAKTIDLCNNPLTKEPKLERARRQVPEWTVYDDEIAALASRVAGEQAAAGVEFVQTGEDRKDEL

SEQ ID NO: 4308 - protein, 1579 aa, Serendipita indica
MTSLRRALPVLLFTVSHLTRANAALPVTVGLRTSWPAHNLLLEILETAALDQPQSFFPLVDLLTPPDTFPEPLGKLSPEAIHQAALALFQHHGFFTHDTLKQFELALSLHVSAPKLEAFYQFYNDRNLENIRLPNGYISDGDGCGSWIDWYGSRLCSSEDLHAVLSREALDAASGQSATPPKKAKLLPFDHIYPDPATTVFAPPRTAILYADLTSPNFLDLHKTLMESAAAFPPKIQYVFRHVPAPKVVPPKGESPAPVKQQYLTGYGVGLDLKKMDYLALDDRRSRNSANNDIKDVAIEENAPLVDIVREILNSLPSSSSEPLNLTAPLTKEEFQYLGVQATSLILQSQNPLDTFIQLAENFPLYATELARKVDINGELQFEMAFNSRRVPKGMSLLWLNGKPIEDMSSFNPFNVLNMLRSERTIMEGLTSLGLTSTQALEALAGQPVAESFSQGNLFDGIFDASDRPEGGDVILWLNDLQKDDAYKAWPKGIESLLTPIYPGSFHTLGINLWNVVLAVDLSNRDSLIWIFKHVSNIINKKFPFTWGIVPLVDTPEGAKAARIFNYVHKHYGPKETMDFIRSLIAAQSEGETIDFLIANAFFNNLGINVKPLLQIELDESVSHDYDTVLAGQEPHSVERLAKAERWAKRMDVQSRKWELGHVFLNGKHFPLDTNFLVSLQREVGLQTQYLQTEVQVGRLSSNQPVDMSTYFYDLPSTPKRRNRFLFPDPETSPLRVERLDTLFRTSGFEWPNEDLLYPEGTESLLATVWVIGDLDDSIARGMATEAMKALDVEKNFRLGFIHAPRTLPFSDTTSTPRLSTVLQQLSGRLSTLSLPAFAEKWESDAPNPVNSAEYLKYCMSGQLLARDIGLKPGQTGLLVNGRVIGPLEAGDFGAIDFSPMLAYEKQRRATPILEALKEIGTTFADMISTAASIVASVQIPDPSAEGLFNMPQRPRQRQYRHLDSKHSKLTIGDESKALFHFAVLLDPVSETAQKWGALIKWLTTLDSVYLELYLVTDQTREELPLKRFYRSVLREALVFDDVGEEIPAMATFKNLPEEPIYTLSMDVPSSWLVRPRESIHDLDNIHLSALSSHEKVAGVKALFDLDFLVIEGHARDTTSGAPPRGLQLQLTKYDSTPIADTLVMENLGYLQFKAKPGVFQLELKRGRGEDIFTIESVGNAGWDSPPVESEAGAEVTLTSFEGLTLYPRFRRQQGQADADVLQPPRREGFFSSAVQKVVQAVAEWIQPPQESPEADINIFTVASGHLYERFASIMIASVMKNTNSTVKFWFIENFLSPSFLEFIPHLAEEYDFQYELVTYKWPSWLRSQREKQRVIWGYKILFLDVLFPMDLKKVIFVDADQIVRADLQELVDLDLQGAPYGYTPMGDDNPDMEGFRFWKTGYWKDYLRGKPYHISALYVIDLVRFRQLAAGDRLRGHYQQLSADPNSLANLDQDLPNNMQFEVPIFSLDKNWLWCETWCSKDRLDQAKTIDLCQNPLTKEPKLSRARQIPEWSQYDAEIAAFARRLVHEGKIGETALGAEVDALAGEKKSDVPPASSEESTSASPGVAGQEPLVHPEL

SEQ ID NO: 4309 - protein, 1391 aa, Rutstroemia sp.
MADAEALSSYQFALSMRVAAPRIEAQFQYYHTAAEPSIKSEADSSCPSWVLFDGKQYCSPTLDESHGEIMGDPQIKELPFDHILGSPTGPHSILYADITSPSFSNFHKTLVKTAREGKTSYRLRHRKPISSSPSNPLIIPGYGVELALKRTDYIVIDDRKEEADDVPKIPAKTEVKFEDEEVADLKPLSTSELSSLAVKASSFIMQSEDPLDSLIKLTQDFPKYSSAIASHNISADFLAEHTSNRAQFLPPGYNILWMNGVQLTERQMDAINILEILRKERRMIGSVRELGLTGPQAVQLLSHPNISAASTDSGVQRFDWRDEIEGGSVIMWLNDIEKDKRYADFPSSLGALLQRTYPGQLPSVRKEIFILVMPVDFSTPEDITLVAETLSSFVKRKLVVRIGLVPVTTSPEATIQAKVIYHLLDTYGLAGAIGYLESSIMGNVAHPTKEAFDAAIEGRKLRVDKTARSLEEVLHTDDYNDRIDAARRWTKRLSADGEFPPIFVDGVALPRDESWLQAMVGRFSTDLQVIQQGVFNDIFQQDSYIPDFFLSEAAPRRNAIIIPENEKTLKIFDVNNLVKQHGTMLAKLPVIKADISSPQDKWAHMIVIADLSTEEGRSLLQSAAEYRKTASSLELVILHNPITEDLDSSSDLSSNLLAHIRKESNKLESVEELETILQAKESVQDQSSQGFWHEAQPFVRSVSLVPGQNALLVSGRLVGPIPVGTEINLEDFEQLFAYESAKRLVPAYAAMKDLDLAEKLTDPLVAAKLSSMVALSTISDTPDGIFEQAPTARISAFDGWDSSHTAIKVGDPLIATIHLTVAIDPASEQGQKWVPILKAISELEGIYLKMFLNPKDRLQELPIKRFYRYVLDSKPQFDDEGALVRPGASFTGIPQDALLTVKLDIPPAWLVAPKISIHDLDNIKLSSIKTDVEALYELENILIEGHSRELPSGSPPRGAQLILGTERDPHFADTIIMSNIGYFQFKANPGFYKIDLKNGRSSEIYKIDSMGSKGWAPVPGDESTELVLMSFQGVTLYPRLSRKPGMEDEDVLEAKTDSPMDYVSRGLNFAQSILGGKSKTVAAKEEHAEINIFSVASGHLYERMLNIMMVSVMKNTKHTVKFWFIEQFLSPSFKDFIPHLAAEYGFKYEMVTYKWPHWLRAQKEKQREIWGYKILFLDVLFPLSLDKVIFVDADQIVRTDMIELVNHDLQGAPYGFTPMCDSRTEMEGFRFWKQGYWEKFLRGLPYHISALYVVDLHRFRQIAAGDRLRQQYQSLSADPNSLSNLDQDLPNHMQSVLPIHSLPQEWLWCETWCSDESLKDAKTIDLCNNPLTKEPKLDRARRQVPEWNVYDEEIAKVDRKRKGLNENGDVKNTKSRTLEEVVEIKTKKDEL

SEQ ID NO: 4310 - protein, 1462 aa, Penicillium griseofulvum
MRVPAGSQISWRWYAAVGALLPGWIASASPAVNVALQASFDSAPYLVELLESAAEENSTSYFPLLDRIADGTFEDLTTEKELYDRFLTVVKDDGHIRSPESLSSFKLSLSLRSSAPRIEAHFQFYNTSVQQSLMVAQDADVVGELDPRELPFDRILGDVSLPPAVLYADVASPMFRDFHETLSDMAKQGQISYRVRYRPPQHWISRPLFVSGYGVELALKRTDYIVIDDRDAEQLEEKGAKSLPTDPDESKEDAPDDLRPLSSSEVTRLGLNSVSYVMGSADPLGTLIKISQNFPKYSSIVAAHNSTGEMAQEIRHNRSKMFPGGYNAMWINGVQMDTQQIDAFSLLEHLRRERKLIEKFRGLGLSADDVVKLLSHRLLTEAQASAEEQRYDYRDDLEGNQVIIWLNNLEKDSRYESWPGDLEAYIAGSYPGQLPPVRRDLHNVVVSMDLSNPEHMMLVAGNLQSFVMRGIPVRFGFVPTTSSPESIAQLKVAHYLFDAYGTGSLMQYLEESASKGKMGFPDKSCFQSAIKGYDLVDEHEALSLDQVLKSEKYNTVVSQTAAYQRRLSLTGDELQFLANGIPVPREGNWMQGMSMQVGRDLKLVQQGIVEGIFEEDAWLPEFFLTSALERRNTFLMPEDPKSVQIVDIATILASGEEVLSNIPRILSDKGALESAHMIVVGDFESEAGIKLLTDALNLRKENDDVEMLMLHNAASYAEDDVPRNLVTLYHSLARGESIDQVLTRIASGDLDAEVLETEAQKISTIRALHQTLAKELGFNPGTEGLVVNGRAVGPIGEEHSLSVKEMSQLIAYERMKRLDSIAAAVGQLGFADKISNPLDFAKLTALVALSTISDVPEGIFENTPDFRVDLSSTWRTEHSVITVSNSDDPTIHVAASLDPASEVAQRWLPTLKVLSKLAGVQLKIFLNPKEDLKELPVKRFYRYVLESEPSFTDDGALARPQASFTGVPVEALLTLGMDVPSSWLVAPSESVHDLDNIKLSSVKPGTNVEAIYALEHILIEGHSRDLTAKSAPRGVQLILGTENNPYFADTIIMANLGYFQFKAQPGLWQINLKPGRSEKIFKIDSVGGLGYRPQTGDENNEVALLSFHGRTLFPRLSRKPGQEEEDVLETGVQLGSKMDYFAKGLNFASGVLSSVGVGSKSGGEKHADINIFSVASGHLYERMLNIMMVSVMRHTKHTVKFWFIEQFLSPSFRAFLPSLAREYGFSYEMVTYKWPHWLRAQKEKQREIWGYKMLFLDVLFPLSLDKVIFVDADQIVRTDMYELVTHDLQEAPYGFTPMGDSRTEMEGFRFWKQGYWSTFLRGKPYHISALYVVDLNRFRALAAGDRLRGQYQMLSSDPNSLSNLDQDLPNHMQHHIPIHSLPQEWLWCETWCSDEDLETAKTIDLCNNPLTKEPKLDRARRQVPEWTVYDDEIAALASRVAGEQAAAAVDFVQTDEDRKDEL

SEQ ID NO: 4311 - protein, 1403 aa, Asparagus officinalis
MASLVRSRVLLSSLWILLLLTGIVAAEHRRPKSVQVSLRAKWPGTSLLMEAGELLSKQSNGLFWEFTDLWLQLDRGSDCQSARCCIKKIVDDGRSMLSNHLGSIFEFSLTLRSASPRLVLYRQLAEDSLSSFSIDEEVGSLNFTGDESGRVADSSVVSNNQSIPPSSCCWVDTGSMLLFNVSQLLSWLDTSFKQPLGASENPELFEFDHIYDGLSIAGPIAIFYGALGTECFNEFHVALVDASKKGKVRYVVRPVLPIGCPVAASSCSVVGTSGAVNLGGYGVELALKNMEYKAMDDSAIKKGVTLEDPRTDDLTQEVRGFIFSKIMERKPELTAEVMAFRDYLLSSTISDTLEVWELKDLGHQTAQRIVQASDPLQSMQEINQNFPSIVSSLSRMKLNESVKDEIIANQRMVPPGKSLMALNGALINIEDIDLYMLMDLVHEELLLADQLSRIKLPQSAIRKILSAAPPSESNSFRVDFRSSHVHYLNNLEEDAMYRRWRNNINEILMPVFPGQLRYIRKNLFHAVYVLDPATSCGAESIDMILSMYQSNVPMRFGVILYSSKLIKTIEEKGHNYAVNNEAKNGEDISSLIIRLFIYIKENYTTQLAFQFLSNVNKIWSVADDLHEEAPEAHHVEAAFVETVLPKADSPPQDTLLKLQREGKYVEEAKGSSLFVFKLGLSKRHCCLLMNGLVQESSEDAAMNAMNEELPRIQEQVYYGYITSKTDVLEKFLSESGHQRYNPQILGEGKEKKKFISLFTLFFGGETTLQEVKYLHSSETADDLKPVTHLLAVNASSREGMKLLHEGINYLIEGSTRARLGVLFYGNSEANSPALLLAKVFERTVSSFSHKENVLEFLDQLCTFYESQYISVLSLASDSLSLFVEKISELAEMHGLPSDDYKSILSSVSSDMIKKQMDKVFNLLSRQIGPEFGNAAVITNGKVLIPIGVTSFLSDDFSLLESVEYDQRIKYISEIIEEVDWKDIDPDDLTSKFYSDLIMLASSSMAIRERSSERAHFEILNAEHSAVIMNNANSALHIDAVIDPLSPAGQKLSPLLRVLWKCIQPSMRIILNPISSLADLPLKNFYRYVVPSVDDFSAVDYSVNGPKAFFSNMPLSKTLTMNLDVPEPWLVEPTVAIHDLDNILLENLGDVSTLQAVFELEALLLTGHCSEKNHDPPRGLQLFLGTKQMPHVVDTLVMANLGYWQMKVSPGVWYLQLAPGRSADLYVLKESEDESLSSKRITINDLRGKVLHIEVAKKRGKEHEELLIASDDNKVNERKTDDRHSWNANLLKWASGFIGGNGKKSLGHKKTERHGETINVFSVASGHLYERFLKIMILSVLKNTQRPVKFWFIKNYLSPQFKDFIPHMADEYGFEYELITYKWPTWLHKQKEKQRIIWAYKIFF

SEQ ID NO: 4312 - protein, 1468 aa, Verticillium dahliae
MTLLCRSPLGLVAIFWAAVNVSAGPSVNVHMQAAFPAGPYLLELLETAAGENATSYFPILDRIASGHFKDSSTHKALYDDFLQLLQDDNHINSPDALSTFKLALSMRLSAPRIEAHYQYYDTAVATHVTGGKQQDCEIWLQFAGSQYCSPTLENPEARVSSIVKLLPFDRVIGTGTDVALYADPASSAFGAFHQALAQKARNGEISYRLRYRRAVGALQEPLPVNGYGVELALKRTDYIVIDDREAQTDGPQKSIATEVVLDKEEEVADLKPLSTSDLAPLGLKAASFITQSQDPWDALLKLTQDFPKFSSSLATHEVSEDFLAEHDKNRAAMAPSGLNALWMNGVQLTERQIEAFTLIDMLRRERRLIDNIRNLGLTGQQAALLLGHPKVASAKNDDEPPRFDWRDEIEEGKVIIWLNDLEKDARYKDLPSELTSLLQRTYPGQLPSIRRNIFTLVVPVDLTSPEDVTVISNLFTFVERRLPVRFGLVPLTPSDDKVAQAKAVYHLMQNYGPEAMVAYLQQSVEDAKISRPDQIVFDRVVAESVALPEASTASFDDVMQSEEQAERIKLAQHWVKRLNAGTTIPPFFLDGLLLPRDKGWLRTMSMKIGGDLQTIQRGIYMGLIEEDEWVPGRFLKGALSRRNSYIFPEDEKSIQILDVNKIYAEHDNLFSAVPVIQGYAEATKETWAALTIVGDLTTQAGRDLLFAALRFQRANPGIRLDIVHNSASTTTGPLINAALRKEESALTEVETPEQLKAILDAAETGSDGDYTIALASFLSAATIAPGANALILNGRVIGPITEDLPFDEDDFQLFLESEQTARILPVYAALEDLSLADRLSGPLAAAKLTSITALSTISDVPEGIFESASTVRVNSFEAWDSKHTAIEVGNAETASIHLTGLLNPVSEQGQRWAPILKVLSELDGVHVKLFLNPKEEISELPVKRFFRYVLDSAPSFDESGKVRALGATFKGLPSEALLTTGMDIPPSWLVAPKVCVHDPDNIKLSSIKGDVNVIYQLENILIEGHSREGKAGQPPRGAQVVLGTEKEPLLADTIIMANLGYFQFKANPGFYNINLKDGKTTEIYTIESIGAQGWAPVPGDEGTEVALMDFQGTTLYPRLKRKPGQEKADVLQEDEAEEDGGIISQGLKFAESLLGGSTKSLSAQEHADINIFSVASGHLYERMLNIMMVSVMKNTKHTVKFWFIEQFLSPSFKDFIPHLAEEYGFKYEMVTFKWPHWLRQQKEKQREIWGYKILFLDVLFPLSLDKVIFVDADQIVRTDMMDLVNHPLEGDPYGFTPMCDSRTEMEGFRFWKQGYWANYLRGQPYHISALYVVDLRRFRDLAAGDRLRQQYHALSADPNSLANLDQDLPNHMQFTIPIHSLPQEWLWCETWCSDESQAEARTIDLCNNPQTKEPKLDRARRQVPEWTVYDDEIAALDRRRRGVPEEVIEKNPKSRTLEEPKSTGKDEL

SEQ ID NO: 4313 - protein, 1532 aa, Verruconis gallopava
MRVPSWLLPAELLLLVGSLHLLPIAVDAASQSVNIGLKASFSSAPYLVELLETAAEENEGVYFKILDRIANGYFQSAASDKEYYERFIQLLEEDELITDPAALSSFELALAVHSAAPRIEAQYQYYKTSIEPLLQRSGAKDCKTWLEFAGKQFCEPQLEKEDATIQDLNIRGSGALPFDRWERQNKTLLPATLYADILSPDFGKFHTLMRDAAKEGKVQYRVRHKPSQTETHALAMSGFGAELALKKTDYIVIDDRDKDVKTEEKATEQDLEAADEEIADLTPLSSSELTDLAMKTASYIMTSEFPLKRLLKVTQDFPKYSSFLASQEVSALFRKEHVGNRELLLPSGFNVIWLNGLQFDPRKVDAFSLIDHMRRERKLIASFKDLGFTNAEAIQLLTHPALAESQQDAANSDITRYDWRDDIEGGDVIIWLNDIEADKRYEDWPSNLMSFLQRTYPGQLPMVRRDLHNMILPVDFSGARSVGPIVQTVQDFVKRGIPVRFGLVPLSHSESAAKQAKVVYHIYEYYGLSALMQYLESALTANQFGDPNEGIFQAVIEDRKIKAGFEPRSLQHVLEPDDTDERVRKAQKYLARLGANSESPPLFINGVPIKNNDDWLQSFSQRISIDMRMVQRKVWEGAIDEEMWLPGMFLEDASLKRNALVIPEDEKQIRLVSLLKAYEGKNADLVKSLPTISASDDTPAEDKSQLVVIGDFTSEHGLRLLMEAIAFRQQHADVEVVLLDNNANTKSRLGHVIQELRVDESGLQDFSEKLAGLLSSAERIDADYPVPWGDVTPLIEIFGFTTGEAGLVLNGRKVGPIPSDEVFAKDDFEALYAFELKKRIMPARTAIKHLNFGEKVGNALNNAKLFSTLALSTVSDIPEGIFELPPPIRTRLFYDWNATNTAITVGDNSTATIQIVAAIDPAAEIAQQWVPILNVLSQLDGVYLRIFLNPIEKLKELPIKRFYRYALNTKPTFDERGEATALGVKFEGIPKNALLTAGLNVPPSWLVAPTDAVHDLDNIKLSSLSAGTNIEATYTLENILIEGHSRDVTTGLAPRGAQLALSTAKDQHFADTLIMANLGYFQFKANPGYYNISLLPGLSKKIFNIDSVGAFGYDAQPGDESTEVTLMSFSGVTLYPRLSRKPGMEEEDVLGTPKTSAADVVADAAADLVSDVAGMVDTLLSKVGVKLPHAGKYFTKAVAGAREYLFKTMANLSPVAEVVTTSPHADINIFSVASGHLYERMLNIMMVSVMKHTNHTVKFWFIEQFLSSSFKTFLPTLAEEYGFKYEMVTYKWPHWLRAQKEKQREIWGYKILFLDVLFPLDLDKVIFVDADQIVRTDMIELVNIDLKGAPYGFPPMGDSRTEMEGFRFWKQGYWKNFLKGLPYHISALYVVDLKRFRQIAAGDRLRQQYHQLSADPGSLSNLDQDLPNSMQMVIPIYTLPKEWLWCETWCSDEDLATAKTIDLCNNPMTKEPKLDRARRQIPEWTVYDEEIAALARRTKGEVPKGDEQERLQKDEEAKEGKRAGSAPEHNEL

SEQ ID NO: 4314 - protein, 1047 aa, Bodo saltans
MDDERHYYATAFGVDGTAVESSAPPLKASVSALIQAVAFTLEDSTLLTEFLIDLLRNTVKPEVTEEQVRESAARFLGEVTLDSIISSPNFYTHYRDLSRYVKSTGLRTFPVMLFNGVVVTENIEQAFFPTFQQEFHLVRDMITRNELTDDIADIFDFMMQVTGALRRYQPAIFDKPTYVALKDTAQASFLELRPFVRGSGYDGQASLISHILVLPAVLNTLSLKMLDRALDHLEQCTTCPGVQLTIAACSSADGSATLSPSSSVVHRVLEGTLQGVSKKTEDGAAVKALRAVTKEILSFIDGQYPTQQALKLELVADIDAAIAQHLRESSASLPDEAKQALYNEKIVSPASELGTRNFCSATAESEPKMVGLVPFLLTNGRRIVFDESFTTDDYLLLEVDEAALTNTVFGCIETVDIPSLLAKTLTEADVTKHVISTKLGLINSILRHDHVSRGARMEKLYLPYPTTPYSFAVNATVSPNSARHTFNVVLNPVARESQQLAALVRFVSSLDELGVSSIVYVNPPAEIQKVPITNFYQFVGQKKPSFDEEGNVVSPAAYLKNMPQSQTLTLGLVEPEAWMVFASAAAQDLDNIRLNTLHGSKLRAEYTLQSILLTGSCQDVTTDNRPRGLPLVLTRAGAEGRMVTTDTQVMSNYGYFQLQASPGVWQMSVQDGLASSIYEVVDIEEKDPSALWSAYYARKISSAKQQEFSSRPVPIISFTGKHVNLLVKKREGKESVDFLEALKAQEDAAQVWPPTSGPQPTRPVKPTLNVFSVASGHLYERFMRMMMHTVMKSSSDVHGANTTRIKFWMIENFLSPKFKALVPRLAEKFGFDYGFVTYRWPHWLRRQTEKQRTIWGYKILFLDVLFPLDVDKVIFVDADQIVQADLHELYNLDLEGKAVGYTPFCQVNKNEETVGFRFWNQGFWHDHLAGKPYHISAIYVVDLKRLRRMAAGDQYRMIYENLSADPNSLANLDQDLPNFAQNQVPIHSLPEEWLWCETWCNQESKARAKTIDLCNNPLTKTPKLENVKRIIPNWEETDAMLEAMMSE

SEQ ID NO: 4315 - protein, 1569 aa, Trichoplusia ni
MKATGFRFSLFLVAYVFVGLVSSDETSKPYEKKSKSVTSFVSAKWEATPIVLELAEYLAGESTDLFWSFFDGINSLKSSLDTLETDKEVYDACIGVASTLLAPAQLRMAKLALSMHLNSPTVRMFDQIASQSGAKEVQCDAFVSIASRKICDNDALRDTLKAYKQYDVEEHKQETYLLDHSYPSSDNKSLTAILYGELGMKDFTAKHKILSTYADNGAINYVVRWNVKPRGKAKLRLSGYGVELQLKSTEYKSQDDSTPKESEDGESSSAPSEEEDENDPQNQIDGFNFGRLKNLFPGLRSPLERFRRHLSESNEEIAALKVWQMQALSMQAAVAVVDANDAGGDEALKVLMSIAQNFPMQTKSLIHVNVPQSFRDEVLYNQDIWASSLGLRPAEPLLLVSGAQYDAEEVDVMALLTALKEDIGPMNTLHALGLSKKLINTLLSLELGESYSWEEYGLDIRDTAITWLNDLESDERYRRWPSSYMELLRPTYPGMLRNLRRNIYNYIIVVDPTSTASGPPLKLGETLLKHATPVRVGLVLAPNTENPALEAAVRSAFNYVAQEKNSNKEAYYFLTQLLHPTKDEKLDLEFVKKQLNKYTSSNADIDEIISEDSEYNFGRQLSEEFVTKIGSSKYPQVLINGVPLVEEGQSPVTSSVELLEEALVTALSRHTGRLQRAVFRGELADTDDALNYLMKQSHIMPRLNQRILASEPSQYLDLSGVPSSHELFAEDKIHRLLHLTGRDALATALPLLKYFAKSGKTEKITQTIWVAGDLNNAESRELLKNALTFMKESRGVRVAFIPNIDGAAKSDQSLNKVALAALITLSPSEATAYMTKLLEDEGCHEKENCDILPALVPALNKYEWVLKASRVLCARSFKLRGGARALVHNARLIGPLHSHERFTLDDLALLERYSNQMYADKLSEVLDSKKKSKDSNSIFEDDDDEYESKQLSTEERLKVVTVVAARSPRVRTQLPPGLRTQHSLVDLPPLRDNEAAIEIIAVLDPASTAAQRLAPLLLVLRHVVNCRIKLFVNPQDKNSDMPLKSFYRYVLEPELQFTSAGALTGGALARFARLPHAPLLSLELRTPPNWLVECVKSVYDLDNIRLADVDTLVHSEFELEYLLLEGHAWDPTLGTPPRGLQLVLGTRDKPERMDTIVMANLGYFQLKANPGAWLLRLRPGRSEDIYEIVGHENTDTPAGSQDIQVLMSSFRSHVIKLRVSKKPDKQHLDLLVENDDKNSGGIWNSIASSFGGGDEQEAQDETINVFSVASGHLYERFLRIMMLSVLKNTKSPVKFWFLKNYLSPSLKDILPYMAQEYGFEYELVQYQWPRWLQKQRDRQRTIWGYKILFLDVLFPLHVKKIIFVDADQIVRADLKELVDLDLGGAPYGYTPFCDSRKEMEGFRFWKQGYWRNHLQGRSYHISALYVVDLKRFRRIAAGDRLRGQYQALSQDPNSLSNLDQDLPNNMIHQVAIKSLPQEWLWCETWCDNNSKAYAKTIDLCNNPMTKEAKLSAAMRIVPEWSQYDDEVKALQARVRRGLYQAADHEQEIESTDHEETPVSQQKHDEHSEL

SEQ ID NO: 4316 - protein, 1666 aa, Peronospora effusa
MRVTTLLNAGLAALVATVQLSVTSARGVHVNLTASWPSSPFFPLLETSEFLAEENPLYFWKFVDELSTRTSYVNDIRNDVDALGALAVFIAESIAPGSKNILELMLATRAYSVKVEMFRQLALDSKARLCGADVDTWAVFYQEPQCVESVACSVNELEAILHGNKQQETHEVCVAAGSNDVELQVDHKYPHIASSTVKTPMSVILYGLVGTEKFYAFHTNLAKKAKKDEIQYMVRHYPRDSPLDTLLQGYGVALDIKNMEYKTFDDSKKTGEENAVGDDKGDEEENEEEEDIEDEEVGGFLFKPLMARHKAIADDLKQFYDVLVKKADGDQEQELKAWHLKDVGVSAARAIMDAKNPLKMLETLSQDFPVQVKKLVFSRKIISPELRKEISVTRMQAANRLLTNKFIMNGIAVDPMERSFNVFDFMKTLKEEWSVAKQLGRLALNQTELEDMLTHVRETNQEQPVVRIHMRGSMNGTTPLYLNNIETDSNYADWPPDVNLLRRPAWNLIFVRKNMYECILVLDPLTGAGRAALTHIAFMRMRGAPVQWALLISSKELMASKTSDDRRALLEKYKSLKDYEKATPWHFAKLLMLAQSKDTASAENKTPESGNEKTGEAEVEADHTVSTRKIASAFLERVGGIEQAEVLVENLLEAYTGAAADIGTFEENEEEALAYLRSDQFDNELLAMTEFIHMKHVPLGSFVFNGVIQKDLDIQRSMMNSFGRDQPLYVDMAHRGMLDNEMDLIEELLIAQNAHPAFLSIFESPESRHPGDIEVESHLFADDVDGRLEAAAWPAITYLHAPGSRIVPKMQTVIFPADLSDLRDANYAYRVVKAVLEDSEQTLRVGVVPQLKGESKTNDMSNDVGELVAAILVAVGNSDNEAHIAFILEALNCVIMQKTADAMKEKLIGIWKTTKNEDSSKDLVYDKVLALLENKTGGWLTTTQRDILTQFNTLLRSRFPPAFEEESEVGSSKIALPHLFINGRQVSLPSQSFSDGDMATIAKFDLQYRTQPVAKALLKRSVIQTTEDADKLSFDIMKTTGIVDKYVKTERESRLGVEENSLNSVRLPGDPSLQVAAYVDPLSEAAQVISSMLRTFHSQLNATIELVLVPADEYTEFPLHRFYRYLFEKRPSLAATSVEFRKLPVQPILTMKIDTPEAWNVQSLHAGDDLDNLRVDPESLTEVKSTTRAVFRLESLLVYGQCRDATLQMYSPPNGLQLALERQVGAQLLHRDTLVMKNLGYFQLQATPGVWSLHLARGRAADLFDIIDPETDLPLKTHPIIVYDFGSHIFQLLVRKKDGMEHEELLQSVEDAATSSKSKSDADAKSTGKDDGALRSYWSSMLQMMGKHDNEIESTPQAVADKTDETDLTNKGNTMQQKQRTGETIHVFSVASGYLYERFVKIMMLSVLKRTNNPVTFWVLENFLSPDFKASIPALREQLGMDIRLITYKWPNWLRQQTEKQRIIWGYKILFLDVLFPLGVQKIIYVDADQVVRADLKELLELDMEGKPYGYTPFCDSRNVGFQFWRQGYWKDHLRGKPYHISALYVVDLAVFRQMAAGDMLRATYSQLSADPNSLANLDQDLPNFVQHQLPIFSLPQEWLWCESWCSDETKATAKTIDLCNNPKHKEPKLDMAKRVIAGELFKESWIELDQEIKDAETKYTAQAAA

SEQ ID NO: 4317 - protein, 1509 aa, Achlya hypogyna
MSSGSCRGLAMALLLVAAVMGIASARRVEVNLTTTYLASPVAPVLETSAFLAEVEPSLFFRYIDAVATRSNAIKRKDSMNYTSLALEAASDVLPSDATIAKLVPFVLATRAQSPKIEMFHQLAIESAYKGCGLAYEDATSWAVLYHETGCAAHVICDINAFEKAMLAPRESSSCAASGEHDFELPVDNILNKELAAPTVIVYGTLGTEPFQRFHRTFLVLAEAQAVRYIVRHAPQGNVEPVLLQGYGVSLHIKNMEYKSFDDSKSPHSKHTPSDDDEDEFIVSVMMKKGDETKAALKEYQLEFEDFSSVNSTDDEEPWQLTQLGYLAAREVLTASDPLARLQHLSQNFPKYASALSLATEPVAFDSMSAMGAARRVVQSHQLLNKVVVNGMAHDLSDATFNPFDFLKLLAAEVQQGDALAALELDAATLAGVHSAMTSLSTRATDVRVRVRGAVDGLAPLYLNAIERDASTADWPSDLSVLTEPAWNLIFLRKVMYEVVVVVDPTSKEGAAVLQQIQFLILRGAPVQFGMLWTSPDLLAVPDEDRAAYEPAVDNALPATAYHITKLYLAARDHGADEAKQFLAGIIELGGGVTVKEALLVYVQAVTHALASDEALEAARTLLRTAAQDDAVWAMTDLVRETQLPLDSFVFNGVVRRELNLQESLMSHFGRDQPLYQELARAGKLADDMDLLDELLAQETAYQVYSPWLDPEFDIPTLNLHLSRTDVWDGVRYLHMAGTATKPKQQSLVLIVDLDTPEGARSAHNALKTVLETPETRLSLVHRGAADSLGARLGHIAHAIGDSDEPRHHAVLLELLRLVGRGKTEADVVTHGELFVQLHADAVPEDALLPQVRAWLTAARDIAHPLVALLSPATDVLLVNGRPVERAPTQELTPALIRVLLQFEADTRSKAVAKALFAPTKHEALSVVTAARHSHALYHVLAVVDAYLATPRTGALFPEVDPRTTVVAAGGSLVDVVAYLDPLSEASQRASVFLRMLRDVLGASISLVLVPTPTYTEFPLKRFYRYAWGHAPVFAGLPRPPVLTMNVETPELFNVQMVHSDGDVDNIRGDAAATYAVQSVLVYGQCIDRTMAYHPSPPNGLQLTLERTAGTTQLHRDTVVMKNLGYFQLQATPGVWRLELANGRASELYQMVDQQAADHARVIVHDFLSAITQLEVKKRPGFEYARLLDDAAAPAPVEDAATQSYWRSLVAWGTGGAKDVRADGRTGETIHVFSVATGHLYERMLKLMMLSVLKRTSNPVTFWLLENFLSPDFKKSVAALQAEFGMDIRLVTYKWPNWLRRQTEKQRIIWGYKILFLDVLFPLGVQKIIYVDADQVVRADLKELWTMDLHGKAYGYTPFCDSRNVGFQFWRQGYWKDHLRGKPYHISALYVVDLVKFRRMAAGDTLRAIYDQLSADPNSLSNLDQDLPNYAQHQIPIHSLPQEWLWCESWCSDDSKAVAKTIDLCNNPKHKEPKLDMAKRVISGEYFQESWLELDEEVKAAEKAYFAALN

SEQ ID NO: 4318 - protein, 1429 aa, Spathaspora passalidarum
MVHPINLVSVRLEASWNSTNFLINLIESVSGYDESLYFPTIETIFGLTEEENDFELYDVTEQEVYTRVIEKVGLSAESASFVNFNLVNKIYTPRIASHYEYYTNKVLTQFEKRLNVECARDSFGNEVERDSHGKLQTWLLYNNKFYCSASDLFALQTDSTEVDDVLQFDRVIGDNTKAPLLILYGNPASPTTKEFFVPLYHDAKAGKIRFLWRYTPPSGNQLGESLSGYGVELSLKNKDYHKDGKKVSALDLTKDFKKVNESKELLPVPENKLDQIGLKFTSFVLSNTKDKYELLRTMLNNFPKFLSHVANIPKLMNYEQVKANVFANEDLGISQESYGFYINGSPIHPLELDILSLSAKLQTELKIVKDLIKLGFSTIQSKLLITKFALLSAVKQTQFRTGNTLMGNNENRFRVFENAFSKRTKGGVVFFNDIEKDVTYDNYSTDRQDTYLGPSSFRLKPNQIPPLKENIHDLIFALNFANKNQLKVFFTLSKVILDTGIPQQVGLIPLIGDDPMDKTIADAFYFLVQQASSKEALAFLYKYLESKNEDDVNEILKLIPKSQKLEFDYSTVLNKFSIDTPSVIFNGVINELSSSNWQITMGKQLSQDINLIKSRLREGVSMSLKELIYSNAKTERNLRIVPLEPSEILYKPIDREIQDKSVVFRSMDKSDDVGYTFWLFSSFNEQRMVDQLVSLLEIVKKRSEDLQVRVVNTGTTFTLLEKLSKKYKLNMLTNSQINEVIEELKQVEIPREVSLNTAFVKFLEKKQIPVNHSFMLLNSRYFRLDNPFTAAELEQIVIFEHSQRLKLFNDILETYPDKYDKKRLVDFNIGLDPSDWFDLVCSIVTKSFHVDEKLFVVDVNRFDFGTLDMSNSIDIGEKESPVDVLLIVDPVSEYSQKMVSILESIRDFPFVSIRILLQPKVNSEFHIGRFYQGVYPASTPQFDGHGNWISRYGAENESLPSDETLSIGLDVPNRWHTTTKSVSNNIDISNVKVTEDFGVKFELTSIVHEGYARDIHTAMAPSGLAFNLDKDNVHSDTLVMSTLNYFQIRTTPGIWKLSLFDKEKFDLLSCSENKFDANQEALQFAEIFVFSLRGLTLYPRVTTKDKSVSKEKSKKQADINIFSIAGGGEYEQLLGIMMASVRKHNTKSVKFWLLDNYMSPQFKALLPILADKYNLEYELVTYKWPNWLRKQKEKHRSIWGYKILFLDVLFPQDLDNVIFIDADQICRTDLTELVNLDLEGAPYGFTPMCDSRKEMDGFRFWKQGYWSEVLKDDLKYHISALFVVDLKKFREINAGDRLRSHYQKLSSDPNSLSNLDQDLPNNMQRSIKIFSLPQEWLWCDTWCSNDSLTSAKMIDLCNNPLTKENKFDIAKRLIPEWKDYNIEIQKLYEEVANTSEIVYESGDDGISTGQYVQEDDNDDDDDSDYHDEL

SEQ ID NO: 4319 - protein, 1488 aa, Capronia coronata
MRPSVAPWGIAAFTLWALGLFTSPALCGPTVNVALEASFAAGPYLVELLETAALENSSAYYPLLDRIADGAFSDFQTEQELYNTFIDVLQQDGHISRPESLSSFKFALALHAAAPRVEAHFQYYNTSVQPRLMAAQDAVCPVWVYLDGQQYCSPELDRAQQAVSLPDGTEQLPFDRVLGSNPGGPASILYADITHPLFGQFHHVVSQTAREGRSTYRLRYRPSAVADSKPLFVSGYGVELVLKRTDYIVIDDRDSSTPESPNADDISLQKAKDDDISDLKPLTTSEVVNLGLNAASFIASSSDPLQSLIQITSDFPRYSSLLASTNASKEFLLEHKSNRERFLPSGYSVFWINGVQIEPRQINAYSLLDHLRRERRIIGDLKDIGLTSSEAINLLSSEVIAEAQANDMPQRFDWRDAIEEDNVLMWLNDLEHDRRYAAWPTDLRHLFQRVYPGQLPQLRRDIHNLVVPIDMSNIKDIELTATSLQGLVRRLVPLRVALVPAGTGATADIYARVSYHLLDTYGLAPLMAFYSDLAAAKKLPSSPEKSFQKAVKGRPVREGKQPLSYHDILSSEDLTQRIQARNDYLSRLALNKSDPPFIINGVVLPRTDNWFEPMSSRLFADLQLLQQAVYQGIVPEDGWIPQFFLLEASPRRNEIVFPHDPKDVRIEDISRLAADFSTELDTLPRIRGSEATLLSDRAHLLIVTDLESEDGRKLLGDVLAFRQQRPETDVLILHNPASASQPSKLACAVYMLTQDNGRDFAPEELQLILESDSSLADGTPGDDACAAFWSSKVALTRSLGFLPGQSGLWLNGRVVGPLKQEFTLDDMASLLESERRERIAPVTTAITSLGLEDRFSDALDLAKVTSLVARALKSDLPEGLRESVPLIRMDRFKIWNGTHTSIKVSNTDDPSIQVVAVVDPASEIVQQWVPILETLSQLHGVSVQIFLNPKDRLSELPVKRFYRQVINSEPSFQEDGSLAIPTASFSGVPKDTLFNLGMIVPPSWLVAPKESIHDLDNIKLSNLADGENIDALYELEYILIEGHARDVTVGPPPRGVQLLLGTEQEPHFTDTIVMANLGYFQFKAKPGHWQISLKPGRSSKIFQLDSVGPNGYAPQPGDETTSVALLSFQGLTLFPRLSRRPGMEEEDVLESSGHGGALDYISKGASFASSALSSLGLKKTSGSNAEINIFSVASGHLYERMLNIMMVSVMKHTQHSVKFWFIEQFLSPSFKATVPILAEHYGFEYEMVTYKWPHWLRGQKEKQREIWGYKILFLDVLFPLDLDKVIFVDADQIVRTDMMELVKVDLKGAPYGFTPMCDSRTEMEGFRFWKQGYWESYLKGKPYHISALYVVDLKRFRQLAAGDRLRQQYQSLSSDPNSLSNLDQDLPNHMQHTLPIYSLSQEWLWCETWCSDESLSSAKTIDLCNNPLTKEPKLDRARRQVPEWTEYDEEVAAVIEAARGEEREHSTTESQQGPDQHVVEEERRRDEL

SEQ ID NO: 4320 - protein, 1498 aa, Trichophyton mentagrophytes
MSTMIPWPIRPLSLLLAGLALLPNVSQASPSVNVALSASFNSAPYLVELLETAAEENSTSYFPLLDRIADGRFVDATTEKDLYEQFIQVLSEDGHITDPVALSSFKFALSIRSTAPRIQAHYQYYNSSVENSLMAAQDAVCQVWAHYDGSQYCSPTLEHAQQPLIAGRDESLEKLLPFDRVLAVPNGEDEENQQSLVLYADITSPLFSEFHKAVSKRARDGEISYRVRYRPSTAGLAKPLFVSGYGVELSLKRTDYIMIDDRASGKDDSKEAPLDSKPTLAVDGLSDSPTADLEPLSSSEVSTLGLNAASFVMNSDDPFDTLIKLSDDFPRHSKTIAGVNATSEFLAEYEENRKNGLQPGINTMWINGVQMSPQNIDAFSLLAHLRQERKLMNSLNELGLPVQDAVKLLSNPAITMAQKVHGSQRYDYRDDIEGGGVIIWLNDLEKDSRYEDWSDDIATLLQPTYPGQFHELRRDVHNVIVPLDLANKEDITLFVEEIQAFVLNNVPIRFGLVPTQLSELSKGQAKIAYYLNKTYGLESVFSYFTEIYSAQKFNLPSKVDFETAIKDREPKDDQSAILFEDVLKSTELDAFIQKSKGYLKRLAVDGENPPVYANAIPIERDERWLHFLIDRLFKDVQGMQRRIYEGDYKGDVWLPSFYLEEASPKCNALVIPDDPSDITVKSINDAYSKHKEAFETIPRIPGKSDSGIEKWAQLALVIDLDDEYGAKQLANAAAFHKTNPELEVLILHKPSMPENGPGLSTELHKLLDDGRDLEIDAIDALLSKETRSKKGSADAQRFYSTIQPVITELGADGNGMHVILNGRLIGPLNQTTILDTQDLELALQYERSKRLTPVVSALESLKETEKIRDHLAFARLTSMVALSTISDIPEGTFQRPPMIRTKIFNSWVTKYSAITVSSSEAPLIKIVATLDPATEVAQRWIPILKVLSQLHGVSLRIFLTPLETIKELPVKRFYRHVLEPAPSFHDDGSLNRPGASFHGVPQEALLNLGMDVPPSWLVAPKDSVHDLDNIKLSSLKEGTNVDAIYELEHILIEGHSRDMSKNKPPRGVQLLLGTERDPHFTDTIIMANLGYFQFKAQPGHWQITLKPGRSDNTFNLDSVGGMGYSPKPGDDNNEVSLLSFQGKTLFPRLSRKPGHESDDVLEDGSKKQGSAKNLLSQGLDFASGVFSGVSKTRKEKHADINIFSVASGHLYERMLNIMMLSVTKHTKHSVKFWFIEQFLSPSFKTFVPHLAEKYGFSYEMVTYKWPHWLRPQREKQREIWGYKILFLDVLFPLSLDKVIFVDADQIVRTDMYDLVSLDLEGAPYGFTPMCDSRTEIEGFRFWNQGYWKRFLRGRPYHISALYVVDLNRFRAIAAGDRLRGQYQSLSADPESLSNLDQDLPNHMQHSIPIKSLPQDWLWCETWCSDESLKTAKTIDLCNNPMTKEPKLDRARRQVPEWTVYDEEIAQLARTVGAKDTESGHTQQEAEEIETEDTNKDEL

SEQ ID NO: 4321 - protein, 569 aa, Euroglyphus maynei
MERYAQNFWSEKIMNTLTDDERSAGTRKCSDLVLRICSVLLSKPSLSSGSSSYKQRYEINNVRDEHSVLMLEPRNPNEPFIELTAILDPLTRGAQKISPILATFYEVFNARVKIHFNAVEKHSDMPLKLFYRFVLDQEPRFDTATGSIINPVAMFKSMPKSPLFTLGMSVPENWMVEAVDAIYDLDNIHLAQVDSNIVGAVFELEHLLVEGHCFEQSSGSPPRGLQFTLGTKTKPTIYDTIVMANLGYFQLKASPGIWLLRLRQGRSTDIYTIVSHDNTDQVANTTEVIPIVSSFRSLVVKIRVNKKPGKQNEELLYDSDDSSSDDQSGGWFSGWNSEKSTRQNSADKGKDSSGEDEDSKRINIFSLASGHLYERLLRIMMISVLKHTETPVKFWFLKNYLSPQFKQILPHMARRYGFEYELVQYKWPRWLHQQTEKQRIIWGYKILFLDVLFPLDVKKIIFVDADQVVRADLRELRDLDLEGAPYGYTPFCDSRKEMDGFRFWKSGYWATHLHGRKYHISALYVVDLQKFRRIAAGDRLRGQYQGLSQDPNSLSNLDQDLPNNMIHQV

SEQ ID NO: 4322 - protein, 1147 aa, Cricetulus griseus
SDYSYYNLILKKAGQFLDNIHINLLKFAFSIRAHSPTIQMFQQVAAAEPPPDRCNAFVVIHRERTCKTNEIKKLLNKAASRPRPYLFEKDHKFPTVNENLPVVILYAEIGTREFAEFHRVLSKKSKNGKIAYVLRHYIKPTNVYFSFNVATTDATTEKETEADEVQGFLFGKLKIGFVFILSVDNEVDGAADAGAALWRAFNYIEESYDVSEAFISMIHMYQKVKGGVLTVDNVKSVLQNKAPHTDILDILGTGSKYDKRRAAGTSFYKMTGLDSLPQALYNGEPIDLTEMSTEELKGAVLEKMLDAFTYLQRDVFMGTLNDEINAIDFLMDKNNVVPRLNSLILHTEPQYLNLISSSVTAEIEDFSTFSFLDSQDKSSVIAQSMHYLTAEDDVVSAVTVWIVADFDMPSGRKLLSNALKHMETSVHTRLGIIYNPTLKIYEENTVISRGILAAFLTHKNSLLRRFLRELAKEETAEAIYSGEKIKTFLNMEMDKNAFEKKYNTVGVNIFRTHQLFCQDVLKLQPGKVGIVSNGKFLGPLHEEFYVEDFHLIEKTTFSNSVEKIKDIVENMEINSKHLSDLVMKIDALVSSLPVRSSQPITLLREDHSVIKINPPENDLFFDVIAIVDPLTREAQKMAQLLVVLGKIVNTRIKLFMNCRSKLSEAPLGSFYRFVLEPELMSGANSSPSDGPVAKFLDIPESHLLTLNMITPEGWLVETVRSNCDLDNINLKDTGGIATAEYELEHLLLEGHCFDLTTEQPPQGLQFTLGTENNPAVVDTIVMANLGYFQLKANPGAWILKLREGKSEDIYDIVGHEGTDSETDMGDVIVVLDTFKSKILKIEVKKKSGKIMEDILADKHEDKGMWESIKRIMMLSVLQHTKTPVKFWFLKNYLSPTFKVSMLLFYSAAKFDTNFCVVIEVIPHMAKEYGFQYELVQYKWPRWLHQQTEKQRIIWGYKILFLDVLFPLAVDKIIFVDADQIVRHDLKELRDFDLGGAPYGYTPFCDSRTDMDGYRFWKTGYWASHLMKRKYHISALYVVDLKKFRRISAGDRLRGRYQALSQDPNSLSNLDQDLPNNMIYQVAIKSLPQDWLWCETWCDDESKQRAKTIDLSTVEEENKCAARLDPEVVLLVEGGDGSSSTWEGSFQF

SEQ ID NO: 4323 - protein, 1525 aa, Amphiprion ocellaris
MRSLVVLSLLLLNIHHVISAPKGVTASLKAKWSMTPFLLETSEFIGEDGNEKFWQFVDTVKELTVYKQGESVRSYYNLIIKKAGQFLTILQVNLLRFALALRSYSPAVHASQQIASDEPPPEACPAFVSIHGQRGCSTKDIKKLLKAAAGRPKPYLYKNDHTYPGANKTDVPVVILYAEIGTKKFNSFHTVLSEKAKEGTLAYVLRHYVADPKPQKMLLSGYGVELAIKSTEYKAVDDTKVKDPKTAVNAEDDDNDEVQGFFFGTLKKSHPELQGQLVELRKHLLESTNDMAPLKVWEMQDLSFQAAARIMSVPKFDALKLMRDLSQNFPSKARSLTRVAVKQEMRKEIEENQKHLSETIGVHPGDGELFINGLHIDLDLHNPFSILDILRGEARVLEGLHNLGIKGEHQGKLLRLPVNSVDDSYALDIRHPAVMWLNDIENDFMYHNWPAGVQELLRATFPGVIRQIRRNFFNLVLFLDPLQEESVELVKLAELFYKHKIPLRIGFVFVVNTKDEIDGFSDAGVGFYRLLNYIADEYDLSQALMSMVSLYNTVDVGETLSVDTVSSYLKRKFPKANSERILGVDSEYDDKRKDGALFYRQSGLGAMPLALFNGVPLSPDEMDPEELETVILQRIMDTTTAFQRAVFMGQLTEGSDVVDYLMEQANVVPRMNPLILSTDRKYLDFTSTPGFAVVNDWEDTTMFSFLDSRDKTAVMAKRMKYFTSSDEDGMTAVTMWITGDFEKVSGRKLLLNALKHVKASSGVRVGVIDNPSEKPSEDNTILYRAIWASLLTQKNKAAAEFVHKLLKEESRQLLQQGTKMKDLLMQGMDVDAFEKKFNTLEVDFIRSQQLFCRDALKLRPGQRAVISNGRILGPFEEQEEFTVEDFHLLEKITLSGSAEKVKTKVKQMGMKPKHASDLVMKVDALLTAAPKGEVRREVHFIKDSHSVLHLSPRENEVFYDVVAIVDPLTREAQKISPLLIVLSQVVNVRLQVFMNCRAKLSELPLKSFYRFVLESDVAFLANDTVSPGPVARFMELPESPLLTLNMITPESWMVQAVRSPHDLDNIHLQEVSGVVAAEFELEHLLLEGHCFDLSTGQPPRGLQFTLGMSRDPLMYDTIVMANLGYFQLKANPGAWILRLRKGRSEEIYQILTHDGTDSPAEAGDVVVVLNSFHSKIIKVRVQKKAEKISEDLLSESNESKGIWDSIASITGGGSKKDEGEKKKEDVLNIFSVASGHLYERFLRIMMLSVLRHTKTHVKFWFLKNYLSPSFKETISHMAESYDFQYELVQYKWPRWLHQQTEKQRIIWGYKILFLDVLFPLAVDKIIFVDADQIVRADLKELRDLNLEGAPYGYTPFCDSRREMEGYRFWKTGYWASHLGHRKYHISALYVVDLKKFRKIAAGDRLRGQYQALSQDPNSLSNLDQDLPNNMIHQVAIKSLPQEWLWCETWCDDASKVTAKTIDLCNNPKTKEPKLMAAARIVPEWVEYDNEIKQLLRQVQEQEDTTMQKQSPSPSQHKKDNRRDEL

SEQ ID NO: 4324 - protein, 1445 aa, Talaromyces marneffei
MMRASLLGLATSLLVLLQPQSVVASPSVNVALRASFDAGPYLVELLETAAQENATSYFPLLDRIASGIFEDATHDKDLYESFLQVLIQDNHLQNKENLDSFKFALAIRSAAPRIQAHYQYYNTSVASTLGTGQDAACPVWVHMDGKQYCSSTLERAQQDVSGDKDPRELPFDRTLGDTSATPAVLYADIASPMFADYHRTLKALADEERETTKANTKAPSAQDLEAEEDEALPDLKPLSSSEVAKLGMSAASFVLDSADPFTTLVKLSQDFPKYSSSVAAYNASEEFSEEYMKNRQAGLPVGRNSMWINGLQIDPRQVDAYSLLDYLRRERKSIAEFQKIGLSASETIEILSYPALAEVQGSGEVQRYDWRDEIEGGGVVVWLNDLEKDKRYATFPKTLQALLQPTYPGQFPSVGRDIQNVVVPIDLANVDDVQFVAKYLYAFIKRLIPVRFGLVLTANTEESKAQAKIAHYLHQAYGLASLLQYLEASLASEKVSHAHKPSFEAAIAERSLRPDQESLSFEEILQSEALDATVANTEKYLKRLALKGPSPPTLVNGIAMSRGENYLQELPMQLSRDLQIIQQGLMQGVFSDYDYIPDYFLSQATQSRNEWIIPERDSGILIADICRAAEAHNDFADILRFPADRKHPAANVQLIITGDFNTEHGFALLISALKFHQTHPEVEIVPLHNPDTDEKVGENSSKLYELLRHPEPVDLDDVLAQIQSDGSHQATQKEEEQAYWTQVQQLVTDLGLSAGNSTLILNGRVVGPLPPSVEFTEADLELLLSYETSQRLGPLSAALKDLDIEAKIASPLNFAKLTSLVMLSTDSDAPEGVFEQRPKFRLNVLKRWNSTHSAIDASTNTKDASINIAAAVDPTSEMSQKWLPILKTLSKLAGVNVRIYLAPNSELSELPIKRFYRHVLESEPTFDESRYLERPEASFTGLPQDALLTLGMDVPSSWLVAPKYSIHDLDNIKLSAIKDGSDVDAIYELEHILIEGHSSDTTLRSPPRGVQLLLETEKGSFFADTIVMANLGYFQFKAQPGFWKIELKEGRSRDIFQLDSIGGGQQSSGTNEVALLSFQGKTLFPHLSRKPGQEQEEVLETGPKPGSAMDYVSKGLNFAQGVLSSVGVKHTGKSESDEKHAEINIFSVASGHLYERMLNIMMVSVMKNTNHSVKFWFIEQFLSPSFKSFLPHLAEEYGFTYEMVTYKWPHWLRGQREKQREIWGYKILFLDVLFPLSLDKVIFVDADQIVRTDMYDLVTLDLEGAPYGFTPMCDSREEMEGFRFWKQGYWKSYLRDLKYHISALYVVDLQRFRELAAGDRLRGQYQALSADPESLANLDQDLPNHMQTLIPIKSLPQDWLWCETWCSDEALKTAKTIDLCNNPLTKEPKLERARRQVPEWTVYDDEIAELAKRVASTSTSTSTSEKDDVDEGGEEEEIYERKDEL

SEQ ID NO: 4325 - protein, 1553 aa, Lucilia cuprina
MKLHNSKTKSLWGKASLLSLLTLFTFCKEALCQETATSKSFPITTLINAKWEQTPLHLEIAEYLADENANLYWDFLKDITDLETTLSSYETPSQSYNAAINVVRKRLTDLQMPLMKLIVSMHSLTPRIQTHFQIASEVLAQGSCSDSATFAQVGSELACSLDELRQKLKLNKQDSLDAHVDTYAFDHIYPGSENNTRTVVLYGDIGSKTFAQYHYLLTEKALSGDIKYITRHYLPLKYQKSQKRVRLSGYGVELHLKSTEYKSQDDAPKPSEDAANDSSVESGVEMEVQGFDFKVLKERFPTLSHSLDKLRQSLQQGNEEIAQLKAWEFQDLGLQAAQAIAEIDGEEALKILQFTAHNFPMQAKALLSHKVSDQLRNEVKHNTESFGRSLNIIPPDGALFVNGLFFDADTMDLNSLVETLRSEVRVLESLHNSQVKGSLASSLLALDFAGSGSKEFAIDIRDSSILWINDIETDPQYRRWPSSVMDLLRPTFPGMLRNIRKNVFNLVLVVDPLKPTSRSLIKLAESFVVHSAPVRLGLVFDASKSSEDTKEDYMALVCAFNYVTQKKDARSALGFLTDVFTAVDSKQEITRKHIKMQLKKTFDKLSSSAVDDILDEDSDFDYGRQLALEFVERLGFSDSPQALLNGVPMQQNILSSDSDFEEAIFSEIIQQTTSLQKAVYKGDLTDSDNLLDYLMNQPHVMPRLNQRILGNNENAKFLDLTGQPHIDLNNVKDLAQLSNRDMTATLLNNIKYFEGKHSYETIGEANLHFLTIWLFANAESKEGKELLNNALKYVKAGSSVRIAFIPNVEGSDLSRKNNLNRLVWAAQQVLKPQQATDVVLKWLKQSSDKWEIPAQVNDFLDFTELHMKILRVYAQRVLNLKANERLVIGNGKIIGPIGTNEQFGIEDFGLIDRFNAIQYGDKLRKVLKQKSLDIEESDFDSDTLLKLYACLIPRQSKTRFKIPDDVKEAHSVVKLKPKHEDLPHFEINAVVDPASRSAQKLAPILILLRNTVNCNMKVYLTPVNQHSDMPVKNFYRYVVESEIQFLPNGELAEGPIAKFTGVPANPLLTQNVQVPENWLVEAVRSVYDLDNIKLSEIGGPVHSEFELEYLLLEGHCFDASTGAPPRGLQVTLGTQDNPTMVDTIVMANLGYFQLKANPGVWTLRLREGKSADIYDITFAEGPNTLHQEGNTQVVISSLRSHVIKLRVTKKPGMQHADLLGDEENQQQSGIWNSIASSFGGGSSHEGEPETINIFSLASGHLYERLLRLMMLSVMKNTKSPVKFWFLKNYLSPQFTDFLPHMAKEYGFQYELVQYKWPRWLHQQTEKQRTIWGYKILFLDVLFPLNVRKIIFVDADAIVRADLKELYDMDLGGAPYAYTPFCDSRKEMEGFRFWKQGYWKSHLMGRRYHISALYVVDLKRFRKIAAGDRLRGQYQALSQDPNSLSNLDQDLPNNMIHQVAIKSLPDEWLWCQTWCSDNAFKTAKVIDLCNNPMTKEAKLTAAQRIVPEWKDYDAEIKALMARIEDHENADHNEQIVGEHNLTPNADDPPKHSEL

SEQ ID NO: 4326 - protein, 614 aa, Blastocystis hominis
MSLIRGYFGDFGDVAPSFPANSPFVVSHTADASFLDITAVMDPLSVDAQRILGVLLEFRKIVPISYQLLLVPSRDYSELPLKRFYRFVGSDGEQATWFNLPSHYLYTMSIETPFKWNTIAYYAECDLDNLRVLDDTTYILAQYFVDALIIEGSCFDRETHEPASRVMLKMSHFGDGAMESDTVVMNDRGYWQLRGNTGLFEIAPSRGSADTVDTIDSVDSKDSMNEQTRNENSEHAGDAAKKLFKNLKSKLFSFASHNEMNELNKVIDSEAEANDDDDDDDDDEEINVFSLASGHLYERFLKIMMLSVSRSSSKKLHFWLIENFLSPQFKAFFLFVFHTQDIVPELCRHFGYKVSYVSYKWPRWVYPQTEKQRIIWAYKILFLDTLFPLRVKKIIYVDADQVSRVDLSELWDMDIHDCVYAYTPLCTSNQETKGFMFWTQGFWKEHLQGKPYHISALYKVDLELLRKRGVGDILRRVYNQLAPDPNSLSNLDQDLPNFIQEQVPIYSLPQEWLWCESWCSMETKEKAKTIDLCNNPMHKEPKLDMAKRVISGPLFNQSWISLDEEIHHFEDGVSGGNQRQPMQFLRVCLNKERELWGNRCGELKSDKTYEKMQK

SEQ ID NO: 4327 - protein, 1669 aa, Acaromyces ingoldii
MFALTSVLLLLLRPLLPLLLLLLASAAGEARAQEASPPVHVSLRSGWPASPFVVELLEAAHQEAPSSFFDIVAIVAGPWFFNDTDDGTHDLASATPQQVFKGAKRAFDRYGVLPGEATRRRWEAALALRAQSSKVAAFTHLYRTSGLEQRWEEAMAARDSSDECRSWVDWDGKVLCSRDELQRHLDETGSTAVTKSPYPGPVAFDHVLAHPLDETDGEQEQEAATAVLYGDPASSNFFGLHAALSEYALGARAEVPFRYILRWRPPPQSSTGGAATKEEEEERDYLAGFGASLDVKKVDYLVIDDRAVAASGSEDGGGDSNDGDGSTATRRGAATEREAARAQLDDRRWLDAQLGGPPSDEAEEEEGGDAGLRAAYIVAKSSEPLRALRQLSHDFPLHAGALARSSAARPSRRFLDEMLGLHQMYLQQATTDVWLNGRSLSATSDEAGAASALTLLPLVRDERRLLDSLIALNLSAEAAVSLLTYAPLQQQQQQPQSQQQVHDAYFDASDRPEGGAVVSWWNDVEADEAYVRFQPELRGLLRPLYPGSFPTVRRNLFNVVLLMDLRRAETCRFLAESVSLATKRLALHWGFVPTGLVEPGDESSQLARLYWLAMERGGSTLAAEYLARLANAMQTHVTVAQARAQLQAVLLAAAHVDGSDEEEEAAAVEQAIEAALAPASEWTEREAKARRYAKRLGAVVADKDHRGDVFVNGRHVPFTAALIQHVHQLIAAQVQALAPLVYYGTLTDEADVSTHFYDLNTTFAARSPLAFPPPQASNISADAVDLTQVAAQLDDSTLLRRFFLPRQATTATTATTTPIDTTLWLVGDLDSDEGTSLLRETIKAQQALPQAFRLGLVHAAPSQSSLGTVSRAIYDQLQRDDGAASEALLEVLNSSVSRGDDNKNEEPARRFWRGQARLARLFGVAKSKSPFAIVINGRIVAGFDAAKVESIDVESLVAVERQRRIAPLVEGLQTPAIAQHDAALAELARDADAITTLTSIIARAGFVDAASEGLFARASTARSTAIDDVPTTNGLTSFELGADRAHARLRLTLMVDPLSKEAQRWADLVEHVLQLDDAIWVRVLLNPAGASRAGAATDEAEAAEAATTLRRFYRASSPARLAFDGDGQLRRPRASFYGMPADAVLTMAIEAPPAWVTMASVAVHDLDNIRLSDVARASAGTRAVVAATFDVKHVLIEGHARDTAARSVPRGLELVLETLDGSLVDDTIVMANLAYLQLRAPSPGLYTLRIRGAGSKSAELYEMESVGSAGWNSPPVGGGGGGGGESSSSDDVVTVDSPAGLTIYPRVRKRKGREHDRLVFDSEGEGEEAHAMGAGRSPAAAQGLVPFAWSLVADAARRIQTSFSAATATATSRRKAETINVFTVASGHLYERMASLMILSVLRHTQTPCKFWFIENFLSPSFKDFVPHLAREYGFEYEMVTYAWPHWLRAQSEKQRQIWGYKVLFLDVLFPLDVSRIIFVDADQIVRADLLELVQLDMGGKPYGFPPMGNDSYDMDNYRFWETGYWKKFLRGLPYPISALYVVDLDRFRLLAAGDRLRGHYQALSADKGSLSNLDQDLVASLIHQVPIYGLAREWLWCETWCSWDWQAQAKSIDLCSNPKTKEPKLDRARRQIPEWTAYDDEVARFAERVRAQQATQKTTQGTVQHDEL

SEQ ID NO: 4328 - protein, 1373 aa, Ixodes scapularis
MDHFYAGSPNPQLPLVILYGDLAAKGFRRFHEALQKRAQDKQISYILRHFAPSARKVRLSGYGVELAIKSTEYKAQDDTKVKGGFEGKSVVDSEETEKAENIAGFDFKKLKELYPEKKDKLNELKAHLMDSGNDLVPLKVWELQELSLQAAQKILLAPLEDALRIMRDTSQNFPSQARSLVNVAVDAGFKKEVERNQQMFLQTLSLEPSDAALFFNGLYYDAEVTDVFTMLQMLKQETRLLEGLHNIGISKDTIPRLMKMDLLNNKQEYGVDIRDTAVQYINDIEHDPSYRGWPTSVQDMLRPTYPGMLRNVRKNMYHLVVVADPSQDNARDILKLAESFYVHRAPLRIGIVFAVNPNMSVTGYQDAGVAMLNAFNFISQDRVPYEGLSFITDVSGVYAAGREGVTAEIVIKQFKTKYPGEDLDLVFGEDSDYDTGRKLAWEFINKTGIGTGPQALLNGVLLKQSHLNADMFEEAVLTEIMKQTPNIQRSIYKGDLNDSQDVLDFLMEQPNIMPRLNQKILSPGANYLDMTGRVVVGLSLEDFAALTMPDMVSTFASHLLYLYPKEKTRYYPLTAWVVGDFDTPSGRLLLSSALEHFMETNEMRVGVIFNPSEAEGRQERSVNRAVWTALESLPSDEAASFIRKLLKEKNYDDFLAGKRAAEELLSPNSKPEAFKKALEDCDGAFLGWHSSFARLALKLGPTERAVVINGRVIGPLEDGEEFNTDDFNLMERYSMSTYGTKIKEVISEEGAEPSELDSELAMKTACVLLSHMQTKSRHSVLSFGEEKSVLKIPASQPEEPAHEVVAVVDPVSRGAQKVSQLLLVLQNVINANVKIFFNCVDKHSDMPLKSYYRFVLESEPSFGLDGQFGQGPYAKFVNMPQSPLLTLGMATPENWLVEAVRSPYDLDNIHMEQVESRVHAEFELEHLLLEGHCFEQSSGNPPRGLQFNLGTQSNTVVADTIVMANLGYFQLKANPGLWTLRLRQGRSSELYDVTSHEYTDSPQDSDEVLVMINSFRSHVLKVKVSKKPGKQNEDLLSDGDEDPNDIWSSFTHSIVGERPKTDDEEQEDRINIFSLASGHLYERLLRIMMLSVLKNTKTPVKFWFLKNYLSPTFKDVLPHMAKEYGFDYELVQYKWPRWLNQQTEKQRIIWGYKILFLDVLFPLDVKKIIFVDADQVVRADMKELRDLDLGGAPYGYTPFCDSRQDMEGYRFWKSGYWASHLGGRRYHISALYVVDLKRFRRIAAGDRLRGQYQGLSQDPNSLSNLDQDLPNNMIHQVAIKSLPQEWLWCETWCDDDSKKQAKTIDLCNNPKTKEPKLVSAARIISEWKDYDEELKQFIERYEKGAAKATLSEGARLAEVKPDDGTPHDIHTEL

SEQ ID NO: 4329 - protein, 1527 aa, Periconia macrospinosa
MRVLNPLFRLQSLALLSAVVGHIGVLARGPSINVALRASFNSAPYLVELLETAAEENATAYFPLLDRIADGYFDKAKTDKDLFDSFVQLLETDGHITDPATLSSFQFALSVRSAAPRVEAHYQFYNTSVEPGLVGEQGEECDTWVAFGGKQYCSPELKDSHGSINGERTKKLPFDRVLGNASHALPSILYADITSSSFAKFHKTLRATAAEGKTSYRVRHKPSASSKKSPLIVNGYGVSLQLKRTDYIVIDDRNAEQSKKAASLDAELHDEEDVSDLKPLSKDDISELSLKAASFVANSENPMDTLLRLIQDFPKYSSAIVAHNASEGFIKEQAFNLAQLPGYFSSPGSQSFWVNGVQIPARDINPFALLEHLRRERSLINGMRSQGLSGADAVSLLSHSAITDTQAEDEPQRYDFRDEIEGGNVIVWLNNIEKDERYENWPSNLQALLQRTYPGSLPSVRRDIHNAILPIDLTSEDDVISVVETALNIINRNIPLRWGIVPSSRTAGASDQAKVVYHLLDTYGLSAVTNYLVAAVREKKLDQPSKAVFDAAIEGVELLPEREALEFADVLKSEEVERQVEGAKKYLDRLSANHDDPPFFINGIPMPKAGNWLGALSQRVSVDLNQIQRAVFERAFEEDAWVPKYFLFQALPRRNSLIIPEDEKNITLVNMAEFEILHGAAFLKMPTIKAAESANPAEWVHVTLVGDFDSQNGMSLLKSVAEYRDENPNVELVLIHNPQPGAQQVSVSEDLLETWVKSGRSVSSEQLLDILGRPLITSPSTANATAFWAAAEPVYEALNLQPGQSGILVNGRFVGPIPDTNPFGKDDVEMLVSYEMTKRITPLSKALEDLKFNEKVSSPFDVAKLQSLVALSSVSDGPEGVYDSASTVRADHFKKWNQTHTVITTGDLGKATFQIVASIDPATELAQRWVPILKTLSDMAGVHLKLFLNPKDTLEELPVKRFYRYILDSKPNFTKDGSVQDLEARFNGIPKEALLNLAMDVPPAWLVAPEESVHDLDNIKLSSLPAGTNIDAIYGLESILIEGHSRDITNGGQPPRGAELVLATEKDPHLADTIIMANLGYFQFKVNPGFYNIHLKSGRSQEVFKLESAGPLGWAPVPGDETSELVLMSFQGTTLFPRLSRNPGQELTDVLAPEESLASEIVEKGSQQVNKLFSKIGLNVNSEKVLKKGASFFSGGKSSTAGKRTQADINIFSVASGHLYERMLNIMMLSVTKHTNHTVKFWFIEQFLSPSFKSFLPHMAAEYGFEYEMVTFKWPHWLRQQSEKQREIWGYKILFLDVLFPLDLDKVIFVDADQIVRTDMYELVQFDLEGAPYGFTPMCDSRTSMEGFRFWKTGYWANFLRGRPYHISALYVVDLQRFRALAAGDRLRQQYHSLSADPNSLSNLDQDLPNNMQFNLEIKSLPQEWLWCETWCSDESLKDAKTIDLCNNPQTKEPKLDRARRQVPEWNVYDEEIAALARRVRGSVEGEIGAVDKVGIQEAEQIRERERKEAERKKEVEEEEERVRDEL

SEQ ID NO: 4330 - protein, 1498 aa, Sodiomyces alkalinus
MIRLSKLPLGFALSLLAAIHVSAVPSVNVAMNAAFPAGPYLIELLETAAGENETSYFPLLDRVASGYFQDATSDKALYEKFLEVLQEDGHITSTEALSTFKLSLSTRSAAPRIEAHYQYYDTAILSHLADSSQDGCDHWAQLDGQQFCSPSLDSPRPSLPGAIKQLAFDRVLGTGKDAILYADPASPSFGAMHEILARKARNGEVSYRLRYRRSSVTNLEPLPVSGYGVELALKKTDYIVIDDRETGQDDAQKTTGTEVVLDEEEEVEDLKPLSTSELGPLGIKAASFILRSQDPWDALLKLTQDFPKFSTSVAAHDASDEFVAAHMQNQLQVAPGGVNVMLMNGVRLSDRQFDAFTLVDKLRQERKLVNSVRELGFSGKQATSLLGHQEIAAAQAADEPLRFDWRDEQEDGRVIIWLNDLENDEAYKDFPAPLQSLLQRTYPGQLPPIRRNVFNLVVPVDFTQSTDLKVVNTLHAFVQRRLPVRFGLVPIAATEDKANQAQIVYHLLETYGIDTFVEYLQKAVGDDSHPTLNQTAFDLVVNDAKVLPDGAPSSFDQVIQSEDLSKQVRLAQHWVKRAIADTPTPTMFVNGLPASRDNSWLQTMSAKITADLKIVQQAVFRGLVGEDDWVPGLFLQDAVSRRNPYIEDTKSVQVLDVNKLSTDHRNLFSQIPIIQGNPEATKENWAVLTVVLDATTDLGKNLLFSALQFRRNNPGIQLEVLHNPEAGLPSSAINHVLKEQQDTLLEVESLAQLQQVLLLDGAEPESDNDYAAALASFLSATGIAPGSNKLILNGRVLGPINAEFAFGEEDFQQFFDFELKARILPVYAALKEMELTDRLSDPVAAAKLTSIIALSTIPDVPEGIFDSGPATRVNAFQSWDSTATSMEVGDAEEASIHLVGLLDPVSEQAQAWVPILKVLSELDGVYVKLFLNPKDNIEELPVKRFFRYVLESEPSFDESGKVRAPRASFKALPSEALMTVGMSTPPAWLVFPKISAHDLDNIRLSSVKGDIEATYQLEHILIEGHSREGKTGNPPRGAQLVLGTEDEPHFADTIIMANLGYFQFKANPGIYNIQLKEGRTSEIYTIESIGAKGWTPVPGDEGTDVALMDFLGTTLYPRLNRKPGQEEADVLEEPETEGDGGIIAQGLKFAEGLFGGGGSKSTKSVSAQEHAEINIFSMASGHLYERMLNIMMASVMKHTKHTVKFWFMEQFLSPSFKDFLPHMAAEYGFRYEMVAYKWPHWLRQQKYKEREIWGYKILFLDVLFPLSLDKVIFVDADQIVRTDMIDLVRHDLEGKPYGFVPMCDSRTEMEGYRFWKQGYWANYLRGLPYHISALYVVDLRRFRDMAAGDRLRQQYHALSADPNSLSNLDQDLPNNMQFSIPIHSLPQDWLWCETWCSDESLATARTIDLCNNPETKEPKLDRARRQVPEWTAYDEEIAALDRRRKGVPPPPVEAATGGEEQKVVVAEEKETESVQKNPKSRNWEEPPSAESTHKRDEL

SEQ ID NO: 4331 - protein, 1520 aa, Hippocampus comes
MWLLWISLLSALATVSGGGADSKAITTTLTAKWADTPLLLEASEFLAEESQEKFWDFVEASQDIEEDDADTDQTYYELIVQKAATLLSSVQVNMLKFALSLRAYSATVHSFQQIASNEPPPAGCSAFFSVHGEKTCDPDALEALLKTALERPKPYLFKGDHKYPGSKPDAPVIILYGELGKAYFRELHLAVVDKVGEGLATYVLRHYVAHPNRKRVSLSGYGVELAIKNQEYKAKDDTQVQGAEVNATMIRENDPVDEVQGFLFGRLKTLYPELKEQLKELRKHLVESTNEMAPLKVWEMQDLSFQTAARILAAPTTEALNVMKDLSQNFPTKARSITKTVVSAEIRKEIAENQKFFKGTLGLHPGDSALFINGLHMDLDSQDIFSVFEVLRSEARVMEGLRSLLIDTPYIHDILKLNVQPSESDYAVDIRNPAISWINNLETDHRYSSWPYNVQELLRPTFPGVIRQIRKNFHNLVIILDPTQENAADLLSVAEMFYSNNIPLRIGLVFVVSPEDNIDGMQDAGVALLRAYNYIRDEVDSHSAFDAVVSIFNRVPSGGRLTVDHVIKVLEKRFPYVEVNSVVGADSSYDNNRKEGRAYYEQTGVGPLPVVMYNGIPYQREHLEPDELETITMQKILETTSFYQRAVYLGELASDHDVVDFIMNQPNVVPRINSRVLSTTRTYLDLSDTNNHFVDDYARFSTLDTREKSTAVANSINYMTKKDDGYVRPVTFWVVGDFDLPSGRRLLYDAIRHMKTSNNVRLGMISNPSAGPAAESSRVTRAIWAAMQTQSANNAKNFITKMAKEETAAALRKGTDIVEFAVGGMDVSLFKSAYESHKFDFLLSHAAYCRDVLKLKKGQRAVISNGRIIGPLEDDEVFNQDDFLLLESIILKTSGERIKSKVQQFGIEEDRASDLVMKVDALLSSQPKGEARIEYGFADDRHSAVKIRPKEGDVYFDVVAVVDPVTRDTQKLTPFLMVLKQLVNVNLRIFMNCQSKLSEMPLKSFYRYVLEAEVAFQADGSFSPGPMAQFLDMPQSPLFTLNLNTPESWMVESVRTRYDLDNIYLEEVENIVAAQYELEHLLLEGHCFDVSSGQPPRGLQFTLGTASEPVIVDTIVMANLGYFQLKANPGAWKLKLRKGRSDEIYKIYSHDGTDSPADSDDIIVVLNNFKSRIIKVKVQKKADKINEELLSDSSAEENDTGFWKSLTRGFTGGSKPEETKPDKDDVINIFSVASGHLYERFLRIMMLSVLKHTKTPVKFWFLKNYLSPTFKEFIPHMAKKYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDNASKKNAKTIDLCNNPMTKEPKLQAAVRIVSEWSDYDREVKRLQTLVQREVAQESPAAESPSTEIHTEL

SEQ ID NO: 4332 - protein, 1600 aa, Hypsizygus marmoreus
MKRFRSLQLLGLSLVVLGGNAASPPVRITLKSSWPAPSPLIEVLETVALDNPSAFFPLLNRLTNPDLLPLPQKMSPEAVHEASLEIAAVHGFLAEPGSLAAVEMNLALHSATPKIEAFYQHYVNHHNSSRGSECGSWVDWYGEVVCDIETLVQLAGTETIDPAIKSWNDSPFSRPRLLTFDHVYPPPSRTLRHPPRTAIFYASPFSDNFRELHTYLLSLAIQPDPHVEYVFRHIPPKERHAGIRNNLSGYGVALNLKKTDYLAIDDRNTLTNGASKDVALDSDNSELNVDPIITLIHNHPENVTAPDAKTPLSEAELKDIGFQAIQLIADSSTPLDTLTQLSQNFPKYATSLARRVVVNSSLSTEIHANSLKAQGGVRMFWLNGAIVQDKDINPFGLLRLLRKERAAVMSLTQLGLGRGEVLDLLTHPDVTQTATGSATLDGLFDASDRPEDGEVIVWWNDLEKDKRYERWSPSLYALLRAMHHGLPNIRLNLFNVVLVLDLSQVSSLTFITGPMADIIEKNISLRFGVVPITETEEGTRMAKLFFHLVRNYGRKKTLAFLSDLLTAVAQRSEQGVQTIPWDAVRILFPSFVENMASPDDVIASLDDIIAGNVTPEPPLEKAAAYAERLGATLSASSQGHVFLNGKHFKFDDDFFRLMQPELGRQLRYLQEQVYEGKIKEEDNEAMSTYFYNLPTTSLRRNRYIYPESTPGSLRIFNLPQLFSRTGYRVSSTGFIYPSETPVIPLSLYVIADLDSETGLGLVKEALSSITPDSHTRITFIHNPSIDPDEANPLPAASWLLAHLITSHSLAQASPAQLLRALGLDEPVPAKDGPQAVLSSKEDIWHALTGGVKVADFDTNRYANYVRASRLVARDVGIAPGELGLMVNGRVVGPIDAGEFRAADFGALEAYEIRQRAEPVMKGLEAVDPSLTQLDRETYAQLVSMAASVISSIQLPDPSETGLFDAPQRPRSKQYQLLDSEYTVFEAGDNITALYHIAVLMDPLSVTAQKWSSLLQWLSNIPDTFIQVHLNPARHSEIPLKSFYRYNLIPSLSFDENGLEIPSQAIFKDLPIEPIYTLAMDIPSSWLVRPQEALYDLDNIQLGSLSPQDHSVDAIFSLDYLVVEGHAREVPAGNPPRGVQLELTQGEGTPIDDTQVVANLGYLQFKATPGVFGLGIRRGRGREIFKMQSVGNEGWDSPTVEEGGSEITLTSFEGLTLYPRLVRLPGMESADVLEEPKPESGGLGGIFGGFKDKVTSLFKPKETSVARTEEQAEINIFTVASGLLYERFASIMILSVLRNTKSTVKFWFIENFLSPSFLEFIPHLAEKYHFQYELVTYKWPSWLREQTEKQRIIWAYKILFLDVLFPMDLKKVIFVDADQIVRADLKELVDLDLQGAPYGYTPMGDDNTDMEGFRFWKTGYWKEFLQGRPYHISALYVVDLVRFRQLAAGDILRGQYQQLSADPNSLANLDQDLPNNLQREVPIFSLNEDWLWCETWCSKDRLHRAKTIDLCQNPLTKEPKLARARQIPEWEEYDAEIARFARELAEAGLIHSGLAVADANVLANAGATASEGTKDEPAQEPEATADDESTLPKDEQPRDEL

SEQ ID NO: 4333 - protein, 1627 aa, Phalaenopsis equestris
MGISPRSRVSALWLIPMFYLAFGGLSYSVEGHRPKNVQVSLRANWPGTSLLLEAGELLSKEWKDLFWEFTELWLQPDRASNCSTARCCLDIILNDGQSFLSNRLGSIFEFSLTLRSASPRLALYRQLAEDSLSSFPVDEEVNSTTIGLTSDGDHSHSTRLVKSGRSCCWVDTGSVLLFNVPELLSWLDTSLDLEADSLEEPELFDFDHIYFGSLISNKVAILYGAVGMKCFQEFHVVLAEASKKGKIKYVARPVLLSGCQAVANSYCSFVGASDAVNLGGYGVELALKNMEYKAMDDSAIKKGVTLEDPKTEDLSQEIRGFIFSKILERKPDLTGDIMAFRDFLLSSTISDTLEVWELKDLGHQTAQRIVHALDPLQAMQEINQNFPSIVSLLSQMKLNDSIKEEIITNQRMVPAGKSLMALNGALINIEEVDLYQLMDMVHEELSLADQFSILKLPQNAILKLLSAPPPSGSNVFRIDFRSTYVHYLNNLEEDAMYRRWRSNINEILMPVFPGQLRYIRKNLFHAVYVIDPVTTCGAEIINMVLSMYQNSVPMRFGVILYSSKLIKHIEESKSRLPIVAKNDDFNEWDDISSLIIRLFLYIKESFGSQTAFQYLYNVCKIKDATDVLDEEAVQVHQVEEAFIETVLAKTKSPPQDLLLKIEKEPKYKEEAEGTTHFVYKLGLSKLQCCLLLNGLVHEPSEDSSINAMNEELPRIQEQVYYGHITSNTDVLDKFLSESGHRRYNPQVVDGGKEKNNFISIAKSYIAKESILHDISYLHSPGTLDDLKPVTHLFVVNVTSMKGINLLREGLHYLMADSRKARIGVLIYGDVLFSSPGLLFAEIFDKASSIFGDKRNVLNFLDDVCSIYESQFMQICSSDTTNLNNFIEKVCELALANELPSDDLRSILSKFSSSMRINQFEKVSYFMHEQLGLEVCSDAIITNGRVFAFMNGVSFSIDDLELLESVEYQHRIRYIYEIINEADWSNADPDELTSKFYSDLIMLVSSAMSNRERSSDRAHFEVLNAKHSAIILNSGNSSIHIDAVIDPLCASGQKLAPLLLILWKRIQPSMRIVLNPMSSLVDLPLKNYYRFVIPSMDDFSSIDHSVNGPKAFFANMPLTKTLTMNLDVPEPWLVEPIIAIHDLDNILLENLGDTRTLQAVFELEALLLTGHCSEKDRDPPRGLQLILGNQQMPHLLDTLVMANLGYWQMKVRPSVWYLQLAPGRSADLYMMKKDEEGTRFSLSKEIIIDDLRGKLVRLEVEKQKGKEHIELLSGSDDEHIKEKKDDHTGWNANLLKWASGFIAGNGLSRKRNESSSDNKKSERHGETINIFSVASGHLYERFLKIMILSVLKNTRRPVKFWFIKNYLSPQFKDVIPHMAQEYGFEYELITYKWPTWLHKQKEKQRIIWAYKILFLDVIFPISLKKVIFVDADQVVRSDLGVLYDMDLRGKPLAYTPFCDNNKDMDGYRFWRQGFWKDHLRGRPYHISALYVVDLVKFRQMAAGDTLRVYYETLSKDPNSLSNLDQDLPNYAQHTVPIFSLPQEWLWCESWCGNSTKSKAKTIDLCNNPMTKEPKLQGAKRIIPEWADLDAEARRFTSRILGEELEETQQISPATISHKKTDLESKAEL

SEQ ID NO: 4334 - protein, 1544 aa, Pediculus humanus
MIFSSILNLYFAVGIICLSNILCAKQKAKTVTTLIDAKWEVTPIVLEVAEYISEESKDDFWSYINDVSQLKPQLIEVENDKIHYDTALKLAKKYLSNSQIKAIKLALSLHIFSPKIEMFGQMASECGVPESRCPSAVDFNGRLFCHINEFLQYFNDNEKKKSEKPELYDVDHIYPTSENHSHVAILYAELGTSEFAEMHLAMKDLASQNRLSYVFRHYVKERPFKRVRLSGYGVELQMKSTEYKVMDDAQVKANESSSASETEDPDEEVEGLNFYKLKNLYPEQKMELEKFRSHLLETSNEMAPLKVWQVQELSLQAAERILSSSSGEEALKTMTHIAHNFPLQARSLIKTRVRPELKKEILKNQEVFDSVLNLSPNDAAIFINGMYFDVEVLDIISLLEVLRQELRIMEKLHKIGVEEEDIKNLINLDLSVSSTDYAIDIRDSAVIWINDIENDRQYRKWSDSLLDLLRPTFPGMLRSIRRNLYNLVLIVDPSKKESKPLLKLMESFYIHSAPLRLGLAFAITDDKTKTGLNDPGIAMLNAFNYVAEAKNPYSGLSFMTDVYASVPDEKDVTVEDIHKKIKAKYPSIDIDQVFGEDSAYDTGRKLSVEFLQRSGFRKVPQALLNGVPLSDKKLNADDFEEGVLSEIMTQTPQLQKAVFKEEFIDTDSAIDFLMSRPNVMPRLNERILSENAVYLDLTGNAVPTSSPSEYKKLSMQEKIGTLIKNMKYFTGKIGQKKKPDLITHWVVADLDCPKGRQMLKSALEQMKGSSSIRVGIIVNPVSSTVAPITELILTSLGTLNSDVAANYIYKILDNEPVFEALDGFRRPPDFLLPGLNVADIAEALLDGNLAKKIVAMHRIFVKSVLKFKPGERGIVTNGRVYGPFDSEETFVADDFALLDRLSYNHIGQKIFQGLNKDKKSTTEEGNFNYLTSDNLMQTISVLASRSDSRVRFKIPLKSTDQVLSCVDIPPFNSSIPSFDIVAIVDPVSKGAQKIGPILSVLHQTVNSHVRVYLNCVEKNSDLPLKNFYKYVLEPELHFQPDGKLTPGPIAKFSNLPTSVLFTQNMHVPENWIVESIRSPYDLDNIKLDNVLESGVHSEFELEYLLLEGHCFEAMLGNPPRGLQITLGTEINPAKYDTIVMANLGYFQLKANPGAWTLRLREGRSSEIFNIIDTDESGNSVIVKDIKVIISSFRSHVLKLRVQKKPDKMKLDLLSEDDGGTGIWNSITSSFGSKSEDVDDVINIFSLASGHLYERFIKIMMLSVIKHTQTKVKFWFLKNYLSPTLKDFLPHMAKHYGFEFELVEYKWPRWLHQQSEKQRIIWGYKILFLDVLFPLHVRKIIFVDADQVVRADMKELRDMDLGGAPYGYTPFCNSRKEMDGFRFWNQGYWRNHLQGRRYHISALYVVDLKRFRRIAAGDRLRGQYQALSKDPNSLSNLDQDLPNNMIHQVAIKSLPEEWLWCETWCDDKSKEFAKTIDLCNNPLTKEAKLTAAMRIIEEWKDYDHEIKELQRKIDLSSNIEEITDNNNNNNNNNNKPSHTHVHTEL

SEQ ID NO: 4335 - protein, 1213 aa, Gymnopilus dilepis
MEKDSRYARWNPSLLSILRPLYPGAMPTVKANLFNIVLILDLSDVLNLNFVSGAMSNIINHIPLRFGLVPVVETDDGKKMARLFYHLIKSYGRRKTLDVFRSIVLNYQRQGIQRDKIDWADVRQAYEELVEKEREGNPEGDFPDLERIVDGSVGEAAGVSEDSTTATEAEAEAEADGSDVNANGKAKKDLSAPLDKIGKYTDRLAAKLARSPKGHVFFNGKHFNFDDDFFRYMQTEMSMQVQYLSEKIYSGILTDENKPPSMSNYFYDLPNASKRRNVYMFPAGGSKDVQIVSLPEVFRKTRFRVSEGTYLYPTAAESVYESLYVVTDLDTEDGLALVKEAISSLTSDSKTRISFIHNPTTPQTPTPENGKRPLASYLLAHLHIRGLLSQATPSQLLAALGLESGPSASPAAAASPDVVADVEEGVQAALKDKVDADVVFKQLTGGAGLRDILAEEYADYVRTSRKVARELKVLPGQSALVVNGRVVGPLPADDFKLADFKTLEDFEFRKRAEPVLQAVQEVAPALIEDKFAAANMVSMVTSVVAAAQRPDPSESGLFDVPPRPRQKGYLLLESQYTSFTIGDNSTALYRIAVLVDPLSEIGQKWSSLLQWLSNIPDAFIEVHLNPGRYADIPLKKFFRYNLLPSLSFDEEGKEVPAHAVFEDLPIEPIYTLAMDVPTAWLVRPRESLYDLDNIQLGKLFPGDTAVEAIFELDYIVIEGHAREVPHNTVARGVQLQLVTGDGMPIDDTLVVANLGYFQFKAKPGVFKLEIREGRGREIFELESVGNEGWDSPTVKEAGAEITVTSFEGLTLYPRLRRLPDMEQADVLEEESDEEDSKKGVFEDLSQKVMSIFKSPKKEPSTDLIPVKPQADINIFTVASGLLYERFVGIMILSVLRNTNSTVKFWFIENFLSPSFLEFIPHMAEKYNFQYELVTYKWPSWLRAQTEKQRIIWAYKILFLDVLFPLDLKKVIFVDADQIVRADLKELVDLDLHGAPYGYVPMGDDNKEMEGFRFWKTGYWKEFLQGKPYHISALYVIDLVRFRQDILRGQYQQLSADPNSLANLDQDLPNNLQHQVPIYSLPDDWLWCETWCSKDRLDRAKTIDLCQNPLTVRVTPLDVADSDTHFAFAFQKEPKLARARQIPEWEEYDAEIARFTRELAAQGKIHSRLAVADVNALAGGAPSAAMPETEETGSELTGAEHDSSGSKEHQRDEL

SEQ ID NO: 4336 - protein, 1700 aa, Zea mays
MVAARGARSGGSVAAAALVSVLLVGCLVAGGQGAEIRRQKNVQAALRAKWAGTPLLLEASELLSTEWKDLFWDFIDLWKDLEKGSECLTAKCCAQKIVEDAHILLNEPLSSIFEFSLTLRSASPKLVLYRQLAKESLSSFPIDDSPENISGHGTGKTFDGAVDPGSSGGTCCWVDTGNVLLFNSADLHEWLGGLGKLAMDSTEQPELFEFDHIYRRTNITAPVAIFYGAVGTKCFKELHVQLVEASKQILHANFIWLLAIKDFKSISRVESTRYALRPVLPSGCETTSTFCGSVGAVDAVTLSGYGVELALKNMEYKAMDDTAIKKGVPLEDPKTEDLSQEVRGFIFSKILERKPELNAEIMAFRDYLLSSAVSDTLEVWELKDLGHQTAQRIVQASDPLQSMQEINQNFPSIVSSLSRMKLDDSIKDEIIANQRMVPPGKSLMALNGALINIEDLDLYLLMDMVHGELSLADQFVRLKLPQSAVLKILSAPPPAESNSFRVDFRSSHVHYLNNLEEDAMYRRWRSNIQELLMPVFPGQMRYIRKNLFHSVYVLDPASACGSDGTLTNNDGEDTSILITRLFLYIKETYSTQLAFQFLGNIHKSRNGEDDYNEELVEAHHVEGAFVDSLLSTAKSHPQDVLLKLQKENMYKQEAEESSHFVHKLGLYRLQCCLLMNGLVHEASEEATMNAMNDELPRIQEQVYYGHIQSHTDILEKFLSENSYKRYNPSITGKNAEKKFVSLFASYHQDSFIFNDMKYLQSPGTTDDAKPVTHLLAIDLSSKVGTKLLYEAILYLMDGSDRARVGLLLYVHTGGSSPILLLKDIFDRTISSFSYKEKVLVFLHGLLKFYDAQPLPASSVADDWTRTMMEKVYTLAAETALPVDDYKAWFKSFSADTVLKGMDKLSDFLFGQLGLVFGSNAVITNGRVFIMNEGKSFLANDLGLLESMEYDLRTKYIFEIIEEVEFASVDPDDLTNQFYSDIAMLISSSMSVRERTSERAHFEILHAEHSAIKLNNANSSIHIDAVIDPLSPTGQKLAPLLRILWKQIQPSMRIVLNPISSLADLPLKNFYRFVLPSMDDFSSTDHSVHGPKAFFANMPLSKTLTMNIDVPEPWLVESVIAIHDLDNILLENLGDVRTLQAVFELEALLLTGHCMEKDRDPPRGLQFILGTKQRPHLVDTLVMANLGYWQMKVSPGVWYLQLAPGRSADLYELPPKLIAIDSLRGKLMHIEVQKKKGKEHEDLLNAADDYHFQEKTDNKGWNKNLLKWASSLITGDASSKSKADKTTRRPARSEEGRRPTADEQDTRGKAQRQGLALAWADLSRRGLGGATRKEMERWLMGSGHHAVVEEGGPWPRLRASAGRGGCAAREQRRYERFLKIMILSVLKKTQRPVKFWFIKNYLSPQFKDVIPHMAREYEFEYELVTYKWPTWLHKQKEKQRIIWAYKILFLDVIFPLSLRKVIFVDADQIVRADMGELYDMNLKGRPLAYTPFCDNNKDMDGFRFWKQFFVDTFFYPLKGFWKDHLRGRPYHISALYVVDLAKFRQTASGDTLRVFYEQLSKDPNSLSNLDQMSCIETLSVIYRVQKLGDKTPGQIHMDLPNYAQHTVPIFSLPQEWLWCESWCGNATKARAKTIDLCNNPMTKEPKLQGARRIVPEWTGLDSEARQFTARILGDDVEPADATPPPSEAPKPEDDQDVKDEL

SEQ ID NO: 4337 - protein, 1486 aa, Venustampulla echinocandica
MGVLNLPWGLTGALLASTYLHSLCVSASPSINVGLKASFSSAPYLLELLETAADENSTSYFPLLDRIADGYFSKSQTDKALYEQFLQVLKDDGHISDPETLSSYKFALSMRSSAPRIEAHYQYYHTAAEPSLKAEQESSCPVWVHFGGKQYCSPSLETPHGDVSGGMQMQELPFDRILGNLSAPTSILYADITSPAFAQFHRALVETAREGKTSYRVRHRKSLGAEPQPLIVPGYGVELALKRTDYIVIDDREGDETKPAQEGSEKEVVFEDEELADLKPLSSSELVSLGIKASSFIMQSENPFETLVKLSQDFPKYSSAIASHNATKEFVAEFEHNTAQSLPSGYNVWWLNGVQMIERQVEALSLLDMLRGERKLIKSVRDLGLTGLQAIQLLSHDEIGTTKAENEPTRFDWRDDIEGGNVIIWMNDIEKDKRYEDWPSSLAALLQHGYPGQLPTVRRDLFYLVLPIDFTDAQDVLLVVETLRGFVQRKLNLRIGLAPITSTANSLEQARILYYLLDTYGLSTMISYLEGSYTSQKLSAPDRSTLEAVVKEKAVRPEKAARPIDEMLKSDDYQNQIQASKKWMRRLSADTTTRPVFVNGVAVPRDENWLQSMSQRVTGDLQAIQMEIFNEKFAHDAWLPSYFLSKAIKRRNSLIVPENEKALRIFDLNKLLVESPDILNSLPSIKADPLSVKTDWAHMILISDLESESGAKLLATVTAFRDVNPSIEVIIVHNPTSDTVGSGLSYDFVAQMQENREGVESVNGFTALLSNPSVKNDLTEKEAKQYWKGAESLIKALTLRSGQSAILLNGRLVGPIPDPSDLTNDDLDQLLAYERAKRILPAYTAMESLGLSDKIMDPLSGAKISSIVATAMVSDNPEGIFEQASTLRVGKFDLWNSSYTSIEVGDVSTATVQMTMLLDPASEQGQRWIPIIKTISELDGVYVKIFLNPKERLKELPIKRFYRYVLDSKPTFNSDGSLQSLSATFSGVPQEALLTVGMDVPPAWLVAPKASIHDLDNIKLSSIKTNVEALYELEHILIEGHSREMPSGSAPRGAQLVLGTERDPHFADTIIMANLGYFQFKATPGFYKIDLQQGRSSEIFKIDSIGSHGWSPVPGDESTEVVLMSFQGATLYPRLSRKPGMEDEDVLEAKTDTKLDIVSRGLSFAQGILGKGKSVEPKQEQAEINIFSVASGHLYERMLNIMMVSVMKHTNHTVKFWFIEQFLSPSFKDFIPYLAAEYGFKYEMVTYKWPHWLRAQTEKQRQIWGYKILFLDVLFPLSLDKVIFVDADQIVRTDMIELVNVDLKGAPYGFTPMCDSRTEMEGFRFWKQGYWERFLRGLSYHISALYVVDLHRFRQIAAGDRLRQQYHQLSADPGSLANLDQDLPNHMQSILPIHSLPQEWLWCETWCSDESLKDAKTIDLCNNPLTKEPKLDRARRQVPEWTVYDEEIAAVDRKKRGVKNGNGEHKNEKSRTLEEPPKTTSKKDEL

SEQ ID NO: 4338 - protein, 1508 aa, Pyrenophora teres
MRASASLLSAKALLALSAFTHIAAYASPSINVALRAAFSPAPYLVELLETAAEENATAYYPILDRVAEGYFDDKSTDQDLYTAFVHLLQTDGHITAPEALASFQFALSVRSAAPRIEAHHQFYKTSAEPSLVAEQTDACEIWVSFHGKQYCSVHLDEPFGNIQSERTYQLPFDRILGNSSALPAILYADITSPRFKKWHKTLSSTAKEGKTSYRVRHKPSTKASTSPLIVNGYGVELQLKRTDYIVIDDRQAVQGESAAQKPMGTELNDDDEVADLRPLSKEEVSNLGIKAASFVAQSEQPMDTLMKLVQDFPKYSSIIAAQDASEDFVEEHLKNREQLLPAGFSVIWINGVQIPARDVNPYSLLAHLRRERKLITGIQKQGLTGSEVISLLSHPAIAETQTEDEPQRYDFRDASEGGNVIVWLNDIEKDSRYESWPADLRALLQRTFPGQLPSCRRDIHNAIVSVDLTSADDVTNLLDVILSLIKRGIPMRWGIVPQTTETGAPEQAKIIYYLHEAYGIDAVTVYLQKSLDDKKLAHPDKAIFAATVKSAQILDEQEALEFDDVIKSESLDQRVTGAKQYLKRLSAEGPKAPIFVNGVPIPANEEWLSTISQRVGMDLRLVQKGVFEGVFNDDSWVPQLFLFQAANKRNPILIPENEKNITVLNMADFQEIHGGAFSKMPRIRASESASKSDWVHITLVADFDSVSGSALLKSLATFREANPNIEAVLIHNPQTGAEQSNASEDLLEAYTKSGQQLTSEALMEVMAQDANPRAVPAESTAFWKTAEPIYDAFGLKPGQHGLLVNGRYIGPIPDDYAFSNDDMETLVTYETNKRIEPLNKALQGLELLDKIASPFDIAKIQSLVALSTVSDVPEGMFETASTLRISAYSNWTAEHTAILKGDQDKAIFHIVASVDPATELAQKWVPILKTLSDMDGVHLKLFLNPGQMLQELPVKRFYRYVLEARPHFKPDGSVGSLEAHFSGIPKEALLNLGMDVPPSWLVAPQESIHDLDNIKLSTIPAGTNIDAIYGLESILIEGHSRDTTNGGQAPRGAEVVLSTEKDPHFADTIIMANLGYFQFKANPGFYNIQLKSGRSQDIFNLDSAGTIGWAPQPGDETTEIALMSFQGATIFPRLSRKPGQETADVLAPEESLASELVGKSAQKVNSFFGKMGLNINSEKVFQKGADLFAGGKAVKKGTQADINIFSVASGHLYERMLNIMMVSVMKHTNHTVKFWFIEQFLSPSFKSFLPHIAAEYGFEYEMVTYKWPHWLRGQTEKQREIWGYKILFLDVLFPLDLEKVIFVDADQIVRTDMYELVQHDLQGAPYGFTPMGDSRTEMEGFRFWKTGYWANFLRGRPYHISALYVVDLVRFRQLAAGDRLRQQYHSLSADPNSLSNLDQDLPNNMQFNLPIHSLPQEWLWCETWCSDEDLAKAKTIDLCNNPQTKEPKLDRARRQVPEWNVYDEEIAALARRVKGEKQAAEVVDVQEQEQLREKKEKDAENKVEHNEL

SEQ ID NO: 4339 - protein, 1293 aa, Eremothecium gossypii
MLHLRRQLAVTWLCLATVAAYDAARLWQSVVRAGINDVGQWYGALTGAEDEISVQELWAELGEDESTLLELLYETSVGVVEEVEHGAATNWFELNGKRYTGSDESFYLQSGELDAQQAVADATVLRVGEGVVGTAPEAPIVVLYGQAGSEEFEAFNWNLYREAQQGRIRLVWRPTCAGAGCGQPRVGAVYAHEYSVKGDWWSSTVRGEVAVPAEFAAKKYRLGGVKDENLSLLDLKVAALIAEQHGRTEDFAETLEYARQLINNFPLLAEHLVDREVDTNSTEVQLEEVTATGVTYDAIGLYINGQPWKLSSLDMRTFLLAIMNERKKMQHLVTTLQSKYGQLGVEDARSLLSKFCQVSVLNAQDMQPARYDFHRVPGFSESVIYFNDIEKDPQYSNMSTKLESIFEKSDYGVIPSYRKNWNELVFVVDFDSLDNEDTREILSGMVRAFSVADEGYPQRIGLLPLYRGDSNPIVENIYRHKESGIAEVKNYLRLLVLGERPGSEGAADIPPVKKILQDFSIFNNSLLINGQIHPFKKNTWHYLIASTVKHDVEILKSMAGRFPSTNVRELLHSKSLITRDSRYIVDYFDDATYTVEQISALDDLEKRVTVYQKGEAKKLYHTITLVDDFESKPALERLKNLLQIKFNGVRIRLLHIGETFSLYEELQRSLNEEENPLDTIGALLRKARDAPRFYTAIAERLQAWVPDLTREQTVGTAFAVINGRYVQFGPENSVSKSLWESFLQREASRTLDLLGIVDTHVPGMGDAKEDSDFVEQLTSILSQLFYSGSNIFHSGIEHTSESTLPRLNILEILPDELTGALIANGNRAAPVELAVILDPLEERSQTFLHLVDQVKSLSFLDIRLLLLPTKKLTIFPIHRIYSDDALSLSPTEAFTVGRELPHFLFPEPSNPEVASIIIEGYAFDEKLPVSKTTVESRMDVCLELLNAEGEVVDSTSTMSVFGYFQFLSPTLGYGFSIRSCSPEYEVTSFSTNAKADYVPSAEISIVDVTPQRVFVKLRGTDEKATGRDTNEQEGINIYVNIYDRSDETSFKEKLFAILAGTPQHTSVTFWLAYGAPISPDLQAVLRTAESLPGRHVACKPIRYAWPSWLRPQRFVDRRLDAARLLFLDVMLSHTMRGRLIMLSLTEERTPDVLELSELQTSAYLTMRPHRGHGYWEEGYWQNYLGKHNLRFFNPSRTFVVDLGRYRSLSAGDHLRVHYQRLSADATSLLDIDQDLVNSVQLLLKIRPLRINKFLPPATGEWIAAWPSNSVNDWTGNPPDTESASEEALDHDEL

SEQ ID NO: 4340 - protein, 1753 aa, Bathycoccus prasinos
MTKTTTRTLTVFSLVLITFLLLSGGVSSKSSDEHRQQKATAKTREKSIDVSLVSSLFPATSHALETAEAISTCCGEEKFWQFVSVWRNQNALNGKRCQRFIESAMRRAVGGPPEKEEEKENAREETMMTSAVKMSVGLRQFAPRLKMFQTLKDEAVEEVVRDDLKKEEVKTACCFATVGARGRYATDVASLRTEVSEARKEEAEVERSEEENDARRKPRYSYLVPTEFDHAYPTGKESDIMEGNEVEEKAKKERLPMVYLYAATGSQCFLDMHEFLAEKIDEEEVRYVLRPVFEKSCLNDEKAVKQCTAYGAFNYDGDTKNEKEDKDDELLRVPGFGVELAIKNMEYKAVDDQITAKDDEEGGDDGDEEIVLGFNFKTLRERLAEKGGEDAQEKLDGFKKQLEMEEKSIKGDMFEPLPKWKIANLGLLATQKIVSANDPLSMLRDVTQNFPSLMNKMANTMRVQKKTRDEVKENQRAVPPSSVIMSLNGQPMELDTVDAFAITDRVISELRDAERVRTIGLGEKAAAETLHLRPKGVRMKEPPKIDVTFSPVEFSYDFEKDKQYEKWSKSYSKFLKAMMESQGQGGLPPIRRNLINIVAIVNLGTAEGMEIVNVLERYRKMNIPVRYAILAIGNDDKTQLFEDDDYMGDGFGEEIPDDSLPDTQTYSNLVAKCAHYILAKYGAKPMRAFAIDIIEGREQLAAGDYFSPPVMAPPKWEDARSSFIQIARAIEVSNALGKGNEKSVSVTDRKEVMERVVKELNDVLDKMEDDEDEDENKKYSADALKAKRAIESRGLESNSVLINGVYYDSETSRRTLGASLSRAMGHLIGSVVQNLQQAIHTKQLKEDMDAYAFVNKGAAKKLRPEIQDESAFPPTFLPEIPHLFYISKTWIEGGAQNEAKPVSIWVVANPDCALGKAHLSEAMKFLRSSYDEPENGEGQDASDDGRESVAKQTRFFFVNPQMSDSAKPTLVARAVVAATQLTSAREHIPTLVLELLKDGDGDKNFIDRAVRASGVKADEFRKLFRNEETIDYLLKLQRTINAKHLGNTRRAFVVNGRLLDPVVLNTEFDASDLHVVAEADLEKRSNDARKIVERDAQEKTDPKGVTTTNVPFRIISARIAALSHFIAKRYEQAASRGVVESLEFLSTNRTAFTLGKDDAQGNVSMVEIEVILDPLSKEAQRIAPVLKVLKDSLGNHASLKVIMNPVEKLSDVPLSSYFRYCAQDLTDWSKSPKVVFEAGSLPQSKTLTAHLDHPEPWMVTTKKAKYDLDNLILENVKEDTVFAEYSLESLLVTGHAFDGGNPRNPPRGTQVVLQKKWFMEDIHEQKEIKDNAIAGTIIMANLGYFQLPASPGRFALALKEGRSRDVYEMVSTDLINIDDRTNTFSSGRTDPSKFRAEITVASWSGKRVEMKLRKRAGFEMADVLSEDDDENDENKRGLGSKISSLFGGKNKKKKQVQLDENGLETIHIFSVATGHLYERFLKIMMASVRRHTKNPLKFWFIKNWLSPSFKDFLPHFAKKYNVEYELITYKWPTWLHKQTEKQRIIWAYKILFLDVIFPLSLEKVVFVDADQIVRGDMNELWNIDLQGAPYGYTPMCDNNKEMEGFRFWKQGFWKTHLRGKPYHISALYVVDLKRFRELAAGDQLRGMYDQLSKDPGSLANLDQDLPNFAQHQVPIFSLPMPWLWCESWCGNETKAAAKTIDLCNNPLTKEPKLVGAARIVSEWTELDNEVRAYTSEVEKSGLLGNTKPPHDEL

SEQ ID NO: 4341 - protein, 1494 aa, Phytophthora sojae
MLATRTYSVKVEMFRQLALDSGLVACSVDELEAVLKGKKQQANEQSCVAAGVNDVELQVDHKYPNSVSDVEEKPLSAILYGLVGTEKFHAFHSKLVKQAQKNKIQYMVRHYPRDSPLDTLLQGYGVALDIKNMEYKTIDDSKKTGEEEAAADEENGDEEDEEEDEIDDEEVEGFLFNHLMARHGAISGELKQFYDILVKKADGEQEQELKAWHLKDLGASAVRAIVDAKNPLKRLETLSQDFPVQAKKLAFSRKSISAELRDEMSATRMQAANRRLKNKFILNGIAVDPLERSFNVFDFMKTLKEEWSVAKQLGGLPMNQSELEEMLAHVRQTNQEQPAVRIHMRGSMGGSTPLYLNNIETDPNSASWSSDVDTLRRPAWNLIFVRKNMYECVLVLDPLSGTGRVALSHIGFLRMRGAPVQWALLVSSKELMASKTADDRRALLEMYKSFKEADKATPWHFAKLLMLSQSKDAAEAEALQKESKGSRSGDEETSETEEPEDRIIPTRIASEFLQRVGEDGSSDVAVGSLIEAYTDAAGAIGTLEENGEEAWACLKSDRFDDEILAMTEFIHLKHVPLGSFVFNGVLQKNLDIQRSMMSNFGRDQPLYVNMAHRGLLNDDMDLVEELLDSQDAYPAYLSIFEKSEGAHPGDIEVDLPKHLFADDVDGRLEAAVQRAISYLHAPDSRAVPKKETVIFPADLNDPRDAGHAYRIVKAVLEDSEQSLRVGIVPQLNSNSAEKQGSNEHLLKFVLEALNCVVKQKSVDATKDKLIGIWGKLSKEEDSEDSVSKKISALLSSKSGKWLTPKQRNALTQCNALLRSRFPPVLAEESEEESSKMVLPHLFINGRRVTLPPHSLSDEDVDTIVSFDLTYRTQPVAKALIKRSATLSVKKADSLSFDIMKTTGIVDKYVRTDRAPRMEVGENSLNTVRLEGDPSLQVAAYVDPLSEAAQVMSSMLRMLHSQLNATIELVLTPADEYTEFPLQRFYRYLFDKKPSLAATNVEFRKLPVHPILTMKIETPEAWNVQTLHAGDDLDNLRVDPDSPTDVKSTTSAVFRLESLLVYGQCRDTTFNMYSPPNGLQLVLEREVGAQLLHRDTLVMKNLGYFQLQATPGVWSLHLARGRAAEIFDIIDPDTDVPLETHPVVVYDFGSHISQLFVHDGALRSYWNSMLNAMGKREDKPEKKTQDAETEGGHADSTGDDNAVAHQKVRTGETIHVFSVASGYLYERFVKIMMSSVLKRTNNPVTFWLLENFLSPDFKKSIPALREQFGMDIRLVTYKWPNWLRQQTEKQRIIWGYKILFLDVLFPLGVQKIIYVDADQVVRADLKELWELDMEGKPYGYTPFCDSRNVGFQFWRQGYWKDHLRGKPYHISALYVVDLALFRQTAAGDMLRAVYSQLSADPNSLANLDQDLPNYAQHQIPIFSLPQEWLWCESWCSDETKGAAKTIDLCNNPKHKEPKLDMAKRVIAGELFNESWIELDQEIKDAEAQYTVEAAA

SEQ ID NO: 4342 - protein, 1269 aa, Stentor coeruleus
MFNWLFTVSTLKTALDIYLGTSWKGYTEKSLKQEICEYFSDIGELSNFLEYDLTLPFDTFIEILPKTQVEKQVILASLYNREYSARLEFYGTLEQNEKSTCKPFYIINNVHSCSLSSELASSKVSLTSEFDHIIHYGVGSLIAYVDITDSNFHDLNKQILKFCIENDLTYALRHLDLRAKTEDYLGGYGAEANMKNMEYNPTEDVNATYIPLPKWETEELSYKIVECAMSLNTITDIKTFLENLPENIEKISEITLSSSISRELDKSMYSSQSINILLINNHIVKANIFDILPVIRAELKSYQSLLSLKIPQEKALKLKNDANLNLHLYQNRPKPIKTSVSTGRVYLNDLEKDDKYAFWSKSYEEFFFAYGNELLPIGLNFFNLILICDVNFDMCWKTLKNFVELIEVYPIHFGVILVGDLQITSVLMEGLKSLRKADEDFVAEFVERIEYGMNPEELTKILNEVCIDCDIDFEYSTAGKRCEEFCETVGLCGPVQLLLNGKLLSIDPSHLIDESSIEETIFYELSSEKRNILNLAMKGILNPPLDTFFEKLTFMNTTDRVNAEISSIGTKDINLTPFLPRSPLNIIKPKSLGFFHIFLTKNDTKLASIFLDALERYSHIALSYNIYFYDMENIKQYNDIISKVCPKCSENEVYDMALKSQDQMKKLGLTKGTVIVNGRVIDGDHFKNYRDFMIAYECETARIGTQSIADNLDDYDRIEEVSYALLKSSRMIKDFDIYRYHPLPQMMQPKAITKVFKDENPMLEVSALINLASKEGITMLALCEWMKSLGASVTITFQSLFNSAKFPVYRYYKYFIKKSFEDSLVFHVESKWTYSLSLDIHSSWMVRPVKSSLDLDNLNSPDNQIIHYKLKNLLIQGHCAQTYRGFDMEPPNGLQLILKNSSTIVADTIVMKNLGYFQFQAKPGTYLIDLAGGRSEELFQISKGQKINLMDIVGDPALMAVSKYSGMENEELLETGVYSNIGDVINIFSLASGKLYERLIKIMISSVMKFTKEKVKFWLLEDFFSPGFTDDIDKLAKALGFDYELLSYKWPSWLYAQTEKQRIIWGYKILFLDVLFPLKLGRVIYIDADQVVRTDVKELWDMDLEGAPYAYTPFCDSNPLTQKFMFWKTGYWKNHLKDLPYHISALYIIDLNRFRDLGAGDILRYFYESLAQSPDSLSNLDQDLPNFTQTHLKIYSLPQEWLWCPSWCSEESKEQAKSIDLCNNPLTREHKIEAAKKYIPEWNDYDLQVKKILQVEKTAEDRKDFNKEL

SEQ ID NO: 4343 - protein, 1512 aa, Ricinus communis
MGTRFRSGFCVLIIVLCVSFCGLFSVHGENRRPKNVQVAIRAKWEGTPVLLEAGELLSKERRDLYWAFIEVWLQAENDEPDSYTAKNCLRRIIKHGNSLLSDPLASLFEFSLILRSASPRLVLYRQLAEESLSSFPFLDDSISDNARKCCWVDTGGALFFDVAEVLLWLKNPAKLAGDPFQQPELFDFDHVHFDSQTGSPVAILYGALGTDCFREFHTTLAQAAKEGKVKYIVRPVLPSGCEAKVSHCGAIGSEESLNLGGYGVELALKNMEYKAMDDSAIKKGVTLEDPRTEDLTQEVRGFIFSKLLERKPELTSEIMAFRDYLLSSTISDTLDVWELKDLGHQTAQRIVHASDPLQSMQEINQNFPSIVSYLSRMKLNDSIKDEITANQRMIPPGKSLMALNGALINVEDIDLYLLIDMVQQELLLADQFSKMKVPHSTIRKLLSTMSPPESNMFRVDFRSTHVHYLNNLEEDAMYKQWRSNINEILMPVFPGQLRYIRKNLFHAVYVLDPATSCGLEASDFFSPFTNNYPLNPFIKKIEVSGGDLHLSSIEDNSQTEEDLSSLIIRLFIYIKENYGMKTAFQFLSNVNRLRVESAESVDDAPEMHNVEGGFVEAILSKVKSPPQDILLKLEKEKEFKELSQESSVAVFKLGLYKLQCCLLMNGLVSDSREEALMIAMNDELPRIQEQVYYGHINSRTDILDKFLSESSISRYNPQIIAEGKGKPRFISLSSSVLDGESVIHDISYLHSSETVDDLKPVTQLLVVDLTSLRGIKLLHEGILYLIRGSKVARLGVLFSASRDADLPSLLIAKVFEITVSSYSHKKNVLHFLEQLCSFYEQSGVHASSLTDESSQAFIEKVYELADANELSRKAYKSALTEFSIDAMKRHLDKVAKLLYRQLGLEAGVSAIITNGRVTILNDVGTFLSHDLNLLESVEFKQRIKHIVEIIEEVHWQDIDPDMLTSKFVSDIVMTVSSAMALRDRSSESARFEILNADYSAVILENENSSVHIDAVVDPLSPVGQHVASLLKVLRQYIQPSMRIVLNPMSSLVDLPLKNFYRYVVPTMDDFSSTDHTINGPKAFFANMPLSKTLTMNLDVPEPWLVEPVIAVHDLDNILLENLGDTRTLQAIFELEALVLTGHCSEKDQEPPRGLQLILGTKGAPHLVDTIVMANLGYWQMKVSPGVWYLQLAPGRSSELYVLKEDGAESLDKLLSKRITINDFRGKVVHLEVAKKKGMEHEKLLVPSDDDNHMHRNKKGTHNSWNSNLLKWASGFIGGNGLAKKNENVLVEHAKGSRRGKPINIFSIASGHLYERFLKIMILSVLKNTQRPVKFWFIKNYLSPQFKDVIPCMAQEYGFEYELITYKWPSWLHKQKEKQRIIWAYKILFLDVIFPLSLEKVIFVDADQVVRADMGELYDMDIKGRPLAYTPFCDNNKDMDGYRFWRQGFWKEHLRGRPYHISALYVVDLVKFRETAAGDNLRVFYETLSKDPNSLANLDQLSMRMLTGIQGEN

SEQ ID NO: 4344 - protein, 1643 aa, Beta vulgaris
MGTFARSKHWVVLVLVSIAISGGFVSAQSHRPKNVQTALRAKWEGTPLLLEAGELLSSEWKDLFWEFVDSWLQNKHDDVDSSSAKGCMLKIVKHGRSFLSEHLGSMFEFSLTLRSASTRLVLYRQLAQESLSSFPFTDEAVTNGDDGRASDLHGKTNMGNKKPDPLLVGVNPASPGGKCCWVDVGASLFFDIPEMLEWLEIQKDIGGDSFQEPELFELDHVYSVSNSSSPVAILYGALGTNCFGEFHGVLVKAAKMGKVKYAVRPVLPLGCEAKTSPCGALGTKDPVNLGGYGVELALKNMEYKAMDDSMIKKSITLEDAHTEDLTQEVRGFIFSKILERKSGLSSEIMAFRDYLLSSSVSDTLEVWELKDLGHQTAQKIIHASNPLQAMQEINQNFPSVVGSLSRMKLNDSVKDEILANQRMVPPGKSLLALNSALINIEEIDLYLLIDLVHQELSLADQFSKLKIPEPTIRKLLSTLPPSESSMVRIDFRSSHVNYINNLEEDSMYKRWRSNINEILMPTFPGQLRYIRKNLFHAVYVVDPATFCGLEVIDMIANLYENQLPVRFGVILYSTTFIEKVERSGGENFADSIVSSTDEDISSLIIRLFIYIKEHHGMLRAFKFLTNVHTEAGDSGEETPERHQVEGAFIDAVLSQSKSPPQDVLLKLEKEKSFEDVAKESSMLVFNLGLSKRKCCLLMNGLVYNSNEEALLNAMNDELPRIQEQVYYGNIDSDTNVLDKFLSENGIRRYNPLIIADGKVKPKFVSLSNSILDEESALHEMSYLHSPETIDEVKPVTHLLAIDLTSTKGLKFLREGIRYLVDGSTKSRVGVLFVPNLASDSPGLLFVKIFQVTTSSYSHKKGVLKFLDQLCSLYENIFMKNPSKQTEGIKTFIEKVSDLADVNELPSKGYSSLLTEFSVDDLQKQLNKVALFLHKHLGHESSLNVVFTNGRVTVLPEESTFLSHDLHLLESFEFKQRIKHISEIFDDLKWENVDPDSLTSNFISDVIMLVSSSMAIRDRSTESARFEILQATYSAVVLTGESPLHIDAVIDPLSPSGQKLASLLQILMKHFQPSMRIILNPLSSLVDLPLKNYYRYVVPSMDDFSGSDFAVNGPKAFFANMPLSKTLTMNLDVPETWLVEPVIAIHDLDNILLENLGETRTLQAVFELEALVLTGHCFEKDHDPPRGLQMILGTKSAPHLVDTLVMANLGYWQMKVSPGIWYLMLAPGRSSELYLLKEGDGGSQKTTLSKRIIINDLRGKVVHLEVVKSKGKEHEKLLLSADDDDQSSERQKESQSSWNKNLFKWASGLIGGSQHTKKSDSTAAESKNDRHGKTINIFSIASGHLYERFLKIMILSVLKNTQRPVKFWFIKNYLSPKFKDVIPLMAREYGFDYELITYKWPTWLHKQTEKQRIIWAYKILFLDVIFPLSLDKVIFVDADQIVRADMGELYDMDIKGRPLAYTPFCDNNRDMDGYRFWRQGFWKEHLRGKPYHISALYVVDLAKFRQTAAGDTLRVVYETLSKDPNSLSNLDQDLPNYAQHTVPIFSLPQEWLWCESWCGNSTKPKAKTIDLCNNPMTKEPKLQGARRIVPEWIDLDLEAKQFTAKILGEEMDPVESTQPSPPQSEIPKVAEISPEIDMESKAEL

SEQ ID NO: 4345 - protein, 1493 aa, Suhomyces tanzawaensis
MFFSWLLLPWLFANVALGNGQTPNELSVELHSQWGPASFELNLLESITEYDPDLYIPTILELLGLNDEGDEEPLLPESTNSEKYNHIMSSKLLSLGTKTKAFINYNFVNKINYPRVQAHHDFYKSIVQPEFGERIVKECSVDSFGNKVKRGPNQPWVLYNNKLYCSSDDLYALQTDKATKFKPRPFDRVIGDNYKAPLLILYGDINAPSFADMFSNLYESAKTGKIRFIWRYTPSTNSKKSVDTLSGFGVDVSLKRNDYVVIDDRDIKNKKGTQKGKPSKPLNINKDLWKILQTSELKPVSKQNFNELSSKLTSLVLLKQYNNITEYDLLNLILSEFPKLASYIGEATNLRHLKDIEDQFVRNRNAGLSDDSYGLYINGAPLHSLELDSLNLMEKIEDELSIIHDLKSLGLTPRQAKFLIKKFALLSAVKQTQFRNGNTVMGHNENRFRVYENVFTAGGFKRKRGVVFLNDIEKDNTYEEYSKDRKEVYLGPVAQRLKPNQLPPLKENVHDLIFALNFNNKEQLKVLFTLSKMILDSGIPQQVGIIAIDGGNELDRVLAEKFYFIADTSNSQEALAFLYKYLESKDSLELSDLLETIRVPEDYGFDHAIYQNTLEKFSIVNPSIIFNGVIYELTSPNWQIAMGKQLSQDIVLLKQHISSGKADGKSLKSILYQGSKSTRNLRIIPADPADVMYKFVDSQLIDASVALKPHRHDRKGGVSGTFWLIGDFNKQIMIDQLKSILSVMKWSKETLQVRILNTGHTVKEIEKLAKQVNLHELTGNDIDWILTKLNTIQNADAKLELNLTIAKLLETKKLPVHHEFLLFNSRYFRLDRILAETDLELLVEYEYNQRFLIFNDLINAYPEEFNYKVLDELNPLLHDNLDWFDLLASVVTRSFYDDKFYVNDVGRFDFSTINMEYSLNITNQDSKMLEPELEFLLIIDPLDDYSQKVVSIINSVKDFPFVSTRILLQPREDENESVRIKRFYKGVYPRAIPEFDDKGKWISENTAQFFNLPTSEIFTVELDTPQKWITVTKDSPEGVDLDNIKFDNLDESLIHGVYELKNILIEGYARDVKTAAPSTGVALEISQGDAVADTQVMSSMGYFQLPSGPGTWRFRIKNGGVGDQFELLSATESKFVMNNVGLESVNISVFDLKGKTIYPRLQKTEKKVNRESTNNKKHADINIFTIASGHLYERFLSIMTASVRKHTDHLVKFWIIENFISANLKQLLPHLAEKYQFEYELITYKWPSFLRAQREKQRTIWGYKMLFLDVLFPQDLDKVIFVDADQIVRTDMMELVTMDLEGAPYGFTPMCDSRDEMDGFRFWKQGYWSEVLGSDLKYHISALYVVDLRRFREINAGDLLRSHYQKLSLDPNSLANLDQDLPNNLQRKIPIFSLPQDWLWCETWCSDATMATAKTIDLCNNPLTKENKLERARRLIPEWEAYDAEIAQVLAYKAQLDHDQAQLDQDLIDYISEDETEPAHDTWDEDPFEHDEL

SEQ ID NO: 4346 - protein, 1629 aa, Mucuna pruriens
MGFRSACFLFILILIPTPSLSDSRSPKNVQTALRAKWSGTPLLLEAGELLSKEDQRLFWDFIDIWLNADHNNAQSHSARDCAKIILEHSRPLLTEPLASLFEFSLVLRSASPALVLYRQLAHDSLSSFPHDGETDANAEISKLDPLLVSVSLITPGGKCCWVEAGENLTALVASNRCYTVRTMLLLLCSFVLFHFFKYLPFVIRVDDSIQSPELFDFDHVHFDSSPGSPIVILYGALGTGCFKEFHAALVGAAKQGKVNYVLRPVLPAGCETNVGHCGSVGASESVNLGGYGVELAFKNMEYKAMDDRTIKKGVTLEDPHTEDLSQEVRGFIFSKILERKPELTSEIMAFRDYLLSSTVSDTLDVWELKDLGHQTVQRIVRASDPLQSMQDINQNFPNIVSSLSRMKLDDSVRDEIMANQRMIPPGKSLMAINGALVNVEDIDLYLLIDLVHQDLLLADQFSKLKIPPSTVRKLLSTLPPSESSMFRVDFRTTHVHYLNNLEEDAKYKRWRSNLNEILMPVFPGQLRQIRKNLFHAQPFVVLRQVYFLKLNNFTLFFVTSYFHSIDMIISLYENDFPVRFGIVLYSSKYIMQLENYSAKEDGDKFEEDISDMIIRLFSYIKGNHGIQLAFDFLSNVNKLRSESDDNVDEAHLELHHVEGAFVETILPKVKSPPQEILLKLEKEPELKELSQESSMLVFKLGLSKSHCSLLMNGLVIDSTEEALLNALNDETQRIQEQVYFGQIKSHTDVLAKFLSEAGIQRYNPRIISNNKPRFISLSTVIFGEASILNDIDYLHSPGTMDDLKPVTHLLAIDITSGSGLHLLRQGLNYLREGSKDARIGLLFSANQSTDSFSLLFVKVFEITSSSYSHKKNVLDFLDQLCSFYQQKYFLTSALEVNSTQAFIDKVCKLAEANGLPSEGYRSALLEFSADEVRRHLSKVEIFLHRVLGSGSDVNAVFTNGRVTYPIDESTFLSADLLLLESIEFKQRTKHILEIIEEVKWQDVDPDILTSKFLSDIVMAVSSSMAMRERNSESARFEILSDQHSAIILHNENSSIHIDACIDPLSPISQKLSGILRVLWKYIQPSMRIVLNPLSSLADLPLKNYYRYVVPSMDDFSSADSSINGPKAFFANMPLSKTLTMNLDVPEPWLVEPVIAVHDLDNILLENLGDTRTLQAVFELEALVLTGHCSEKDHDPPQGLQLILGTKTTPHLVDTIVMANLGYWQMKVSPGVWFLQLAPGRSSELYILKEGVDGIQNKQSSKLITINNLRGKVVHMDVVKRKGKEHEKLLISDVDEDPQDKKKGSSWNSNLLKWASGFISSNEQSKNAETNALEQGRGGRRGKTINIFSIASGHLYERFLKIMILSVLKNTRRPVKFWFIKNYLSPPFKDLIPRMAQEYGFECELITYKWPTWLHKQKEKQRIIWAYKILFLDVIFPLSLEKVIFVDADQVVRADMGELYDMDIKGKPLAYTPFCDNNKEMDGYRALYVVDLKKFRETAAGDNLRVFYETLSKDPNSLANLDQDLPNYAQHVVPIFSLPQEWLWCESWCGNATKTKAKTIDLCNNPMTKEPKLQGARRIVSEWPDLDLEASGFTTRILGDDIEPMQSPNQSKDLIGEDSLEEDSESKAEL

SEQ ID NO: 4347 - protein, 1514 aa, Loxodonta africana
MAAGRTLCVVQLLLGSMPLWLSLLGATTASASKAVTARLAAKWPETPLLLEASEFMAEESNEKFWQFLETVQELAIYKQTESDYSYYNLILKKAGQFLDNLHINLLKFAFSIRAYSPTVQMFQQIAADEPPPDGCHAFVVVHKEHTCKTNDIKKLLKKATSRPRPYLFKGDHKFPTNKENLPVVILYAEMGTRIFGKFHKVLSEKARRGEILYVLRHYIQKPSSRKMYLSGYGVELAIKSTEYKALDDTQVKTVNNTVEDETEASEVQGFLFGRLKEIHSELRDNLTAFQKYLIESNKEMMPLKVWELQDLSFQAASQIMSTPVYDAIKLMKDISQNYPVKARSLTRIAVNQQMREEIQENQKDLQDRFDIHPGDTRLYVNGLHIDTDVYDPFSILDMLKLEGKMMSGLQNLGINGDDMIRFLKLNTHTWEYNYALDIRHSSIKWINDLEYDDLYVTWPASCQELLEPEFPGSIPSIRRNFHNLVMFIDPAQEYTLDFIKLGRLFYHHKIPLRIGLVFILNTDDEVDGTDDAGVALWRAFNYITEELDVSQAFISIVHMYQKVKNKKILTVDNVKSVLQTKFPHANVWDILGIHSKYDEERKAGASFYKMSGLGPLPQALYNGEPFRREEMNLKDLEMAVLHRMMDTCIYLQREVSMGTLNDQMNVINFLMDKNTVVPRMNSLILHTKPRYLNLIPTSVTADVEDFATFFFLDSQDKSAVIAENMYYLTQEGGDVVSSVTLWIIADFDKPSGRKLLFNALKHMKRSVHSRLGVIYNPTSKITEENTAISRGILAAFLTQKNEHLRSFLRKLTKEDIAAAVYSGGNIKSFLIEGMDKNAFEKKYNTIGGNIFQTHQLFCQDVLKLGPGEIGVVSNGKFLGPLRETFYAEDFYLLEKITVNSLVEKIKGVVKNMEINSKNMSDLVMKVDALVSSLPKRVSRYDVTFLKEKHSIIKINPQEDDMFFDVIAIVDPLTRETQKMAQLLIVLDKIINMKVKLFMNCKGKLSEAPLKSFYRFVLEPELMPGGNDIHSVGPVAKFLDIPESPLLTLNMITPEGWLVETVHSNCDLDNIHLKDVEKTVRAEYELEYLLLEGHCFDTRTEQPPRGLQFTLGTKNKPVVVDTIVMANLGYFQLKANPGAWILKLRQGKSEDIYQIVGHEGTDSQRDFGDVIVVLNSFKSKILQVQVQKKPDKIEEDILTDKDEKKKGMWDSIKSFTIRLHKEDKREADVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLAVNKIIFVDADQIVRHDLRELRDLDLGGAPYGYTPFCDSRTEMDGYRFWKTGYWASHLLRRKYHISALYVVDLKKFRKIAAGDRLRGQYQALSQDPNSLSNLDQDLPNNMIYQVAIKSLPQDWLWCETWCDDESKQRAKTIDLCNNPKTKEPKLKAAARIVPEWVEYDTEIRQLLENIENKKNNAILTHDEL

SEQ ID NO: 4348 - protein, 1460 aa, Ophiocordyceps unilateralis
MTAVTAVAVPSVNVGMKAAFSAGPYLLELLETAAAENDTAYFPLLDRIASGYFVSASSDAELYSKFLDLLVSDRHVAGPEALSTFNLALTLRSAAPRIEAHYQYYSTAVEPSVDHKCLNWVLLEGKQYCTPELDKAMREGLFTSGVTTLPFDRTLGSGKEAVLYADPVSETFGDYHKALSTAARALDFKYRVRYRRSEANPVRSLPVSGYGVELALKRTDYIVIDDRDAAVDRSQKPLTSGAFDEGDEVANLRPLSTSELASLGLRAASFIQNSDNPFAMLVKLTQDFPRYSASVTAHNVSEPFNAAREMVAPGGINFLWMNGVQLIERQIEPFSLVEMLRRERKLVDGFRRLGFTGKQAISLLGHSAISTAKGDDEVLRYDWTDQPENRRAIIWLNDLENDSRYKDYPKSLMALLQRTFPGQIPQIGRNVFNIIAPVDLSTTEDVAFVSQLVSIVRRGIPLRFGLVPLTSTAAAIAQAKVIFYLMENHTIETLFAYIDGLSESSASNVNDKLFTDVVAGADSLTNVEKLSLSEIIQANFSAERMKSALHWVKRLRADTAVRPLFINGVVISRDANWMQTMSMKISGDLQIIQKQFFQGSLAEDSESSKIFLEGAISRRNPYISVESDKALRMLDVSRIYSEHGKLFGRIPVLEPYSESTKENWAVVTILADLTAVSGRELVLAAMEFKRSNPGVRLELIHSPEDSSKAPRVNSALHAQVELLKDMESIDQLTKVVDSAEGESVDDDYAPALSAFLNMAKVEAGRNTIILNGRVVGPISTDEAFTADDFQLLLEYEQGHRILPVYAAIDDLGLGDKLSCAMAAAKATSITALSTISDLPEGIFESAPTTRSTMYDSWNVSHATIEVGDSETASIHIAGLLDPVSEKGQRWTPILQVLSELDGVYLKIILNPREKITELPLKRFFRYVMDAKPSFEKSGSMKALKASFESLPSEVLLTVGMDVPPAWLVAPKESVHDLDNIKLSSVKSDIDATYELEHILIEGHSREGRGAPPRGAQLTLATEKDPMITDTIIMSNLGFFQFKANPGLYKIKLKEGRTADVYMIESIGAQGWEATSGDEGTELALMDFQGTTLYPRLKRRPGMEEKDVLEASGSAFSGSIVSKGLKFAEELLGTKSKSLSVQKHAEINIFSVASGHLYERMLNIMMVSVMRNTKHSVKFWFIEQFLSPSFKEFIPHMADEYGFRYEMVTYKWPHWLRQQKEKQREIWGYKILFLDVLFPLSLDKVIFVDADQVVRTDMMDLVDLDLKGAPYGFTPMCDSRTEMEGFRFWKQGYWSNYLRGRPYHISALYVVDLRRFREVAAGDRLRQQYHALSADPASLSNLDQDLPNHMQFEIPIHSLPQEWLWCETWCSDESLAKARTIDLCNNPQTKEPKLDRARRQVPEWTVYDEEIAALVRGRRAVPVDEEVVPEHGGESSQADTNTKSRRLDGEDGRNVHTVDEL

SEQ ID NO: 4349 - protein, 1516 aa, Cynoglossus semilaevis
MRSVIVLWLLLLSIHHATSTPKGVTASLKAKWSMTPFLLETSEFVGEDGSDKFWQFVDTVKELSVYKQGESVRSYYNLIIKKAGQFLTDLQVNLLKFALALRSYSPAVHASQQLASDEPPPEACPAFVSIHGQHSCNTKDIKKLLKAAAGRPQPYLFKNDHTYPGVNKTHVPVVILYAEIGTKKFVSFHKVLSEKAQEGKLLYVLRHFVAHPKARKMLLSGYSVELAIKSTEYKAVDDTKVKDPKTNANAEDSDNDVQGFLFGTLKKSHPELKEQLGELHKHLLESTNDMAPLKVWELQDLSFQAAAKVMSVPKFDALKVMRDLSQNFPSKARSLTRVAVKQEMRKEIEENQKHLSETIGVHPGDGELFINGLHIDLDVHNPFSILDILRKEARVLEGLHNLGIKEEHQGKLLRLPVNIVDDNYALDIRHPSIMWLNDIENDPMYRSWPTGVQELLRATFPGVIRQIRRNFFNLVLFLDPIQEETVELLKLAELFYKHKIPLRIGFVFVVNTEEEIDGFSDAGVGFYRLVNYIADEYDLPQALMSMVSIYKEVEVGETLTVGELTSYLKKKFPKANAERILGAESEYDYKRKDGTLFYNKSGLGALPLALFNGVPLSPDEMDPEELETIILQRIMDTTTAFQRAVFMGQLTEGSDVVDYLMEQANVVHRMNPLILNTDRKYLDFTTTPVVDDWEDTTMFSFLDVRDKTSVVAKRMKYLTNNDENGMSTVTMWVVGDFQKPSGRKLMLNALKLMKSSRGVRVGVIDNPKGKPSQDNTVVFRAIWASLFTQKNKATVEFVQKLLKEESSQLLHHGTKMKDLLLQGMDMDAFEKKFNTLEVDFIRSQQLFCREVMNLSPGEQAVVSNGRILGPFEEQEEFTVEDFHLLRKITQSGSAEKVQVKVKQMELKPKQASDLVMKVDALLSAAPKGEVRRDVHFVKDSHSILHLSPREKEVVYEVVAIVDPLTREAQKLSSLLIVLSQVVNVKLQVFMNCRAKLSEMPLKSFYRFVLESDVTFLANDTVSPGPVARFVDLPESPLLTLNMITPESWMVQAVSSPHDLDNIHLQEVNGVVAAEYELEHLLLEGHCFDLSTGQPPRGLQFTLGMSRDPLMYDTIVMANLGYFQLKANPGAWILRLRKGRSEDIYQVLTHDGTDSPADAGDVKVVLNSFHSKIIKVRVQKKADKMNEDLLSETTENKGIWDSIASIAGGVSKKDDGEKKEDVLNIFSVASGHLYERFLRIMMLSVLRHTKTPVKFWFLKNYLSPSFKETIPHMAESYGFQYELVQYKWPRWLHQQTEKQRIIWGYKILFLDVLFPLAVEKIIFVDADQIVRADLKELRDLDLEGAPYGYTPFCDSRKEMEGYRFWKTGYWASHLAHRKYHISALYVVDLKKFRKIAAGDRLRGQYQALSQDPNSLSNLDQDLPNNMIHQVAIRSLPQEWLWCETWCDDVSKATAKTIDLCNNPKTKEPKLSAAARIVPEWVEYDSEIKQLLRRIQEEGEAVGQKQKPPSSKRIPDEL

SEQ ID NO: 4350 - protein, 576 aa, Rhizoclosmatium globosum
MLNSFITIGDVAEASLRFTVVLDPLSEAAQKISSILKVLSKIPGVSIKLLLNPVPMLEDLPIKRFYRYVFQEEVHYDSQGKRVAAQAQFKNIPTEPLLTLGLDVPRAWVVRAVDSVHDLDNLKLDALKPGQNVDAIFQLNNILVEGHARELHSSTPPRGAQFILGTPSKPHIVDTITMTNLGYLQLKANPGVWQLRLREGRSNQVYQIDSVPDKYMGKGGESKGDGYATVVVDSFEGVTIYPVVKKRVGMEAEDVLEPDPVGAVWDQLKSRVWGDSKKGVQTTASNVTINIFSVASGHLYERFMGIMMLSVMRNTKSPVKFWLIENFLSPKFMSFVPHLAKEYGFEYEFITYNWPHWLRATTRKERTIWAYKILFLDVLFPVGLDKVIFVDADQVVRTDMKELVELDLEGAVYGYTPMGDSRPEMEGFRFWKTGYWANHLQGRPYHISALYVIDLKRFRQLLAGDRLRQQYQMLSSDPNSLANLDQDLPNNMIHEIPIFSLPKEWLWCETWCADNELRTAKTIDLCNNPLTKEPKLKRAKRIIKEWTELDNEVQAVADRVEADAAKAIGQKRHDEL

SEQ ID NO: 4351 - protein, 1450 aa, Komagataella phaffii
MINHVLILLTYLCLSVFASEKFVDISLKANWFKTPFPLLLLETVASENESGFYTILDAMFDVSFESLELEDEDLQFEAVPFVKSDEELYEKWSHRAGASIEKSITDIYLANKYYAPRVQSHYQHYNEVRSSILGDKCGTNPKAWLYFNSEVYCNSDDVFALKTGGKTGPPQILPFDRVIGVRNDEVPVAIIYGDYRSPLFSQFISNLAGFVKDGRLRLAWRYISDESVLQKETLAGYGVDLTLKRTDYIVIDDRDIVLDKSLETKPIAAESDNFWDVYSKEIEPVSEKYIRALGYKLSLYIKSLEVSENEKLAILTKLIQDFPKFASFIDRQVTDTEVEEIIEDSLENSINDLPQGVYINGAVVDQSKLNYMEILNILKREYAFIDDITKFGVTGTHAQDIMRRFAAHISDRSVNNTMFKRFDIRGHGEAVFYLNDIETDPQYSGLSSSRKYYTTSVAPGEIPPVRENIHESVFVIDLADHNQVYTLLQFSSVMLSNRIPQRVGFVPLISDKLSEEITLQFLSIFQAKGINQGIKYLHDIAMNVLGQTPRDIISVESITKVPVSDKKNLLSKINEFISSFSIDHPLLITNGKFFDFVQNWQYHSAREIFLDILDLSNAISSGALSEDMRAQDYIYLGSHTSRNVLIINAICEETNLPSLVSYDDLEVFESISQNQNRIATVVIDGQPDSIPITSWLLGNCKDKRFLQQLRHLITAASELDPIKIKVYETSSNSDFSSSLQTAINKSLVDVIAFIDNELEKINVHSPDTVLNDETIDFVHNVFKIKLSKPNDMYLILNGRAIKIRDKDILLKDTDLKLLVEYEIDFKLRIAHELFCEYNISEPKSLDTFELFEYFTMGISNTYFFGDNYHPDQRVFPRYNTGLLNDAVSIEVSNSGPSIMDVTVIIDPLQEESQKLISLLSLFEKLESLKLNIILKPQEARELNIKRFYRGVFPNSVKFSSAGDAIDNEDKGLFTLVPEKTLFTLDLDVPNPWIVVIKEAATDLDNVLLENSGDVTGVYELKSLLVEGYALEKNTKYPPVALPIELVGHSDTSIMANYGYFQLQANPGLWKFVVKPHTRGSDIYRLANVTSKSNGDTLQYTIIDETAIIFVLDMNGNVILPVFDRKPGQENASLIGNTATTEKDTGLSKFLSSWRKQEQPKNADINIFTVASGHLYERFLSIMTNSVMKHTKHTVKFWLIENYMSPTFKKNLPFLAREFGFDYELVNYKWPAWLRGQREKQRTIWGYKILFLDVLFPQSLDKVIFVDADQIVRTDLKELVDLDLEGAPYGYTPMCNDREEMEGFRFWKQGYWQKLLGDTLKYHISALYVIDLKTFRQIAAGDRLRQHYQQLSQDPNSLSNLDQDLPNNLQHQIKIFSLPQEWLWCETWCSDESLKKAKTIDLCNNPLTKEPKLDRARRQIPEWTQYDDQVQQIINEASASARESITEHDEL

SEQ ID NO: 4352 - protein, 1624 aa, Dendrobium catenatum
MDICCRSRVSALCLISLLFLAFGGPSYSMEGRRPKNVQVSLRAKWPGTSLLLEAGELLSKEWKDLFWEFSELWLQPDRASNCSTARCCLEIIMNDGHSLLSDHLGSIFEFSLTLRSASPRLALYRQLAEDSLSSFPVDDEVNSITAGSPSDDLKVDHSYTTNPLKSGESCCWVDTGSVLLFNVPELLSWLDTSTDLDADTLEQPELFDFDHIYLGSRISNKITILYGALGMKCFQEFHVVLAEASKKGKIKYVTRPVLPSWCQATSNSYCTFVGASDAVNLGGYGVELALKNMEYKAMDDSTIKKGVTLEDPKTEDLSQEISGFIFSKILERRPELTGEIMSFREYLLSSTISDTLEVWELKDLGHQTAQRIVHALDPLQSMQEINQNFPSIVSSLSRMKLNDSIKEEIITNQRMVPAGKSLMALNGALINIEEVDLYLLMDMIHEELSLADQFTKLKLPQKPIQKLLSAPPPAGSNVFRIDFRSTYVHYLNNLEEDAMYRRWRSNINEILMPVFPGQLRYIRKNLFHAVYAIDPATTCGAETISMILSMVQNSVPMRFGVILYSSKLIKHIEENKSHLPGAADDNEGDDISSLIIRLFLYTKEIYGSQLAFQFLNNVCKIKDATDILDEEAIQVHQVEEAFVETVLAKAKSPPQDMLLKVEKEPKYKEEAEGTTHFVYKLGLSKLRCCLLLNGLVHEPSEDSSISAMNEELPRIQEQVYYGQITSNTDVLEKFLSENGYHRYNPQVINGGKEINKFISLVKSYIAKDSILHDISYLHSPGTLDDLKPVTHLLAVNVTSRKGIKLLREGLHYLMAESRKARVGVLMNGDGLGLSPALLLAEIFDKASSIFGDKHNVLNFLDQLCSVYESQFMQAQSSDTTSLINFIDKVCELALANELPSGDLRSHLSKFSSATRINHLEKVSYFLHEQLGLEFGSDAIITNGRVFASINGVSFSSDDLELLESVEYQYRIRHIHEIVDEAEWSNVDPDELTSNFYSDLIMLVSSAMSNRERSPDRAHFEVLNAKHSAIILNSGNSSIHIDVVIDPLSASGQKLAPLLLLLWKRIQPSMRIVLNPMSSLVDLPLKNYYRFVIPSMDDFSSIDHSVNGPKAFFANMPLSKTLTMNLDVPEPWLVEPIIAIHDLDNILLENLGDTRTLLAVFELEALLLTGHCSEKDHDPPRGLQLILGTRQMPHLVDTLVMGNLGYWQMKVSPGVWYLQLAPGRSADLYVMKKNEGEKSSLSKDIIINDLRGKLVRLEVEKQRGKEHVELLSGSDDPLKNKKDDHTGWNANLLKWASGFIAGNGLSRKRNENSSDNKKIIRHGETINIFSVASGHLYERFLKIMILSVLKNTRRPVKFWFIKNYLSPQFKDVIPHMAQEYGFEYELITYKWPTWLHKQKEKQRIIWAYKILFLDVIFPISLKKVIFVDADQIVRTDMGILYDMDLKGKPLAYTPFCDNNKDMDGYRFWRQGFWKDHLRGRPYHISALYVVDLVKFRQMAAGDTLRVYYETLSKDPNSLSNLDQDLPNYAQHTVPIFSLPQEWLWCESWCGNSTKFKAKTIDLCNNPMTKEPKLQSAKRIVPEWVDLDAEARLLTSRVLGEELEIQQIPSSTDTDKKDDLESKAEL

SEQ ID NO: 4353 - protein, 1670 aa, Pseudomicrostroma glucosiphilum
MLRLLRRSLAALALPLAFLGTAAFAASPDSSSSSPPVNIRLRAPWQSPPLLLEILEAVHTEDAAAFHPFLVELTTNEAYHAALAGGSAKDVYEAAQTALDSLGLLKDEGARQNWKMSLALHSESAKVAAFFQLAETSGSEDRWASRGGAEGDEIRSKCDSWVDWYGEVVCTAEELKVSLKSSADRIEIQKVATYPFDHVVQSREAAATIPTAVLYGNPISSNFDQLHRILRNAVTEQAPFRYVIRWKPPHPAERAAAPALTSGYLAGYGGALDLKKVDYLVIDDRKLKHASGAPSLEGSARDASSQKQLEDREWLQKQLLVNISRVANTSSLSPEEIDYLGLQAAQVVLASSDPLRALEQLTHDFPLHVQDLARGGVTLPQDLDAEFSYLTSRVFRPGASDFWVNGRPITESEVPPQSLVKLLRSERELVDSLMSGPLRLTPEEAVTILSNQTTGKAQAPGAERKSLFDSSDRIERRELLQQAKARGDADLQTIDDVRDGPITWWNDVEKDSEFRPYSPSLRTLLRQVMPGQFPQIRRNVFNIIWVFDLRSKRANRFLTDHLCPLIGTARIPLHWGFVPGGLEEGPESDATGIARLYWHLFERFGIKGGCRYFEALAGPPKPPKKPQNPYEDEVLEEEEPDVFVTITQARAAFTEVINKINPASRLGPTEISTTPDAREQPARDYIERLRLTMADDRDGHMFFNGQYYPFIGPNVFQLIMQLVSITTQSLQRAIYMGEMPESVDLGNHFYDQPGVFRGRSNLVFPPVDEQGEIIGPKAKAVDLGKVRRSLEDSTRLPLQTFLTPQGDAKINATVWIVADLDTAPTQQVLQGALSMLRTDKSFRLGFVHLPSNDGQDASGPGLRLSSFIGQAIKAQVLDKTSADEFAEVVKELASTHSNLDRAGRVYNDLDGSATPQSGQQQDDRTGAASSFNAFKARAWNLEGSKEADDFWKETGPAIARAFGVAPGEAALVVNGRLLSGVDLGTIKKTDIEALLHSEKFKRIEPVLDSLPASAVEKLSLLSRDEAATAIADIASVLGLYYYLDESKRNMFVPPVIVRVNSFEGIPAKHCLFEVGNRSTARLRFQAIVNPLAERTQRWASIFRLLSSLPDVHLEVIMNPQHTSSEMPLKRFYRFSAPKALAFDDAGQEIAPTLSFNDLPQDAVLTMGLEAPPAWLTMASEAVYDLDNILLRDVPEDGREAGVLAVYDLKQILIEGHAREVLTNNIPAGLQLLLQTPDGSQTLDTIVTANLAYFQFRARPGLYSLSIRPGKGDELYEMKSVGNLGWDSPGVEVTGDSITLDTLQGLTIYPTVKKRPGKEKENLIEPIAGAKDLKKGVKPLTAAKSFFDNLKKAASTAATPELKKSNQAELNIFTVASGHLYERMTYIMILSVLRHTNSTTKFWFIENFLSPSFKEFIPHLAKEYGFQYEMVTYAWPHWLRAQREKQRTIWGYKILFLDVLFPLDLDKVIFVDSDQVVRTDLKELTEIDLQGSPYGFPPMGDDSDDMEGYRFWKTGYWKDFLRGRPYHISALYVVDLKRFRSITAGDVLREQYHALSADPHSLSNLDQDLPQVLMDHIPIHTLDQEWLWCETWCSTDWLHKAKTIDLCSNPKTHEAKLDRARRQIPEWTELDEEVQRLARRVGGEKEGGGVVVVEEKDKEEKPASGHSHDEL

SEQ ID NO: 4354 - protein, 1472 aa, Pseudogymnoascus sp.
MVRPGSIWSLAGSALAFSVKVSASPTINVALATSFTSAPYLLELLETAGDENSTSYFPLLDRIADGYFKDARTDLELYNSFVKVLRDDGHLDSEGLASYSLALSLRTSAPRIEAQYQFYETAIEPSADGSSCPVWVLFGGKKHCSPALDEAHSTYNGRRGTEQLQFDRITGNLSAQASILYADITSPEFNQFHKKLIQRAQKQEISYRIRHKKQNVQESRPLVIGGYGVELALKRTDYIVIDDREAEAQAQEESTKTEVVLEDEELADLKPLSASELVSLGLKASGFIMQSENPFEVLTRLSQDFPRYSSAIAAHNVSSNFAEEHVYNRGQLVPAGANVVWINGLQVPTRQIDAFSMLDILRKERKLLKKFSQLGLTGSQTIGLLSHEDIAFTKAGDEPARFDWRDGGDGDVIIWLNNIEKDKRYDGWPATVRTILLRTGQLPQVRKDLFNLVFPVDFSNLQDVELVVNQLSGFVKRALPLRFGLVPLTNSDAALEQAKITYYLLDSYGLSTMVAYLNEYLTSNGTPSSRSANFEAAIEERKLFGDKVAKSLEEVLDADEVNKSIAHSKQWNSRLGANDKVPLVFVNGVAVPRDENWLQGMSHRVQTDVQLMQRAVFDNIVTDDHWAPMLYLHDAASGRNPFLMPENDKDLQLFDVNSIYSDHAEAFERLPVVKIDPSAMQDDWAHVILIVDVENEQGQRLLKAAAEVRKMSPSIELVIVPSSESPAGILSVYEYMAGRSFGPLKSDDDLDSLVEAVSISTSSEEEQEVTEKWSAIKVFLGSLGLKPGQQGLLVNGRLVGPIPSEIELGVGELQQLLGFELTKRIRPVLAAVKDLGFSEAISDPLASSKLTSLVTLSLLSNVPEGIFEQAPTLRINAFNAWKSEYTAIEIGDESTASIHIQVALDPASQESQRWIPILKVLSELDGVYLKLFLNPKDILKEIPIKRFYRYVLESKPLFNADGSLKDIKAQFASVPQEALLTMGMDVPAPWLVAPKQSVTDLDNIKLSSVNGDVNAVYELEHILIEGHSTEKETGQAPRGAQLLLGTAADAHFADTIIMANLGYFQFKANPGFYKISLQEGPSSKIFSIDTLGASGRDAAQPDATTEISLISFHGLTLFPQLSRNPGQETEDVLEPTPDLKDDIVSKGRKLAESILGFGGKKSSGALLQTTQQAEINIFSVASGHLYERMLNIMMVSVMKHTNHTVKFWFIEQFLSPSFKQSIPSLAAAYNFDYEMVTYKWPHWLRSQPEKQREIWGYKILFLDVLFPLSLDKVIFVDADQIVRTDMRELVDLDLQGAPYGFTPMCDSRVEMEGFRFWKQGYWKSYLRGLPYHISALYVVDLQRFREIAAGDRLRQQYHQLSADPGSLSNLDQDLPNHMQAVLPIFSLPQEWLWCETWCSDESLGVAKTIDLCNNPMTKEPKLDRARRQVPEWSAYDEEIKGVFRAAREGGRNEKSRTLEAETEATGRVKDEL

SEQ ID NO: 4355 - protein, 1499 aa, Hyaloscypha bicolor
MGVLRLPWGLTGALLASTYLHSLCASASPSINVGLKASFSSAPYLLELLETAADENATSYFPLLDRIADGYFSKASTDQELYDKFIQVLKDDGHMADPETLSTYKFALSMHSLAPRIEAHYQYYHTAVEPSLKGEQDTSCPVWVLFNGKQYCSPTLDEAHGEISGDSQVQELQFDRVLGNHSAPASILYADITSTAFGKFHKTLVKTAREGKSSYRVRHRKFMTAESRPLIVPGYGVELALKRTDYIVIDDREEDESKTVTATPEKEVKFEDEELADLKPLSSSELFGLGLKASSFIMQSENPFDTLVKLSQDFPKYSSAVASHNASEDFVAEHDYNRGQLVPGGFNIWWMNGVQLIERQIEALEMLNMLRKERKLINGVRDLGLSGQEAIQLLSHNEVATAKADSDAPRFDWRDEIEGGNVIIWMNDIEKDKRYADWPRVLQAMLQRTYPGQLPQIRRDCFQLVIPVDFTDAEDVLLVADTLLNFVKRKIAIRIGLVPITKTKESLEQARVVYHLANTYGLQAALVYLETSYTSKMVTGPSKSAFDTAVKSRHVRQEKVAVPMDEMLKSEDYQDQIEASKKWMRRLAADSKIPPVFVDGVAVPRDENWLQLMSNRVSTDLQSIQQGIFTDAFEADAWLPSYFLLQASQKRNPIISPEDEKTLKIFNVNKLAGENQALLDTLPRIRVDASANKTLWAHMILVANLESEVGSKLLATAAVFWEANPSVELIIVHNPVSNTIDTGLSNDLFSHMQSNSNKAFANMNDLTAILAGEKTAESALTQQGASQYWHGADSLIRSLALRPGENAVLLNGRLAGPIPADTEFDLSDFDSLLSYERSKRITPAYNAMDSLGLSDKIADPLAAAKISSIVAKSTISDTPDGIFEQASTLRMSQFNVWNSFHTVIETGDISTATIQFTILLDPASEQGQRWVPIVKVLSELDGVYMKLFLNPKERLQELPVKRFYRYVLDSKPTFDEAGALLPLGATFTGVPQEALLTVGMDVPPAWLVAPKVSVHDLDNIKLSSIKTNVEALYELEHILIEGHSREIPGGSAPRGAQLVLGTERDPHTADTIIMANLGYFQFKANPGFYKIDLQEGRSAKIFTIESIGSQGWSPVPGDESTEVVLMSFQGTTLYPRLSRKLGMELEDVLEAKTDSPMDFVSQGLKFAQGILGKGKADVAAKQEQAEINIFSVASGHLYERMLNIMMVSVMKHTKHTVKFWFIEQFLSPSFKDFIPYMAAEYGFQYEMVTYKWPHWLRHQTEKQREIWGYKILFLDVLFPLSLDKVIFVDADQIVRTDMIELVNHDLKGAPYGFTPMCDSRTEMEGFRFWKQGYWEKFLRGLPYHISALYVVDLHRFRQIAAGDRLRQQYHQLSADPQSLSNLDQDLPNHMQSVLPIHSLPQEWLWCETWCSDEALADAKTIDLCNNPQTKEPKLDRARRQVPEWTVYDDEIAAVDRRRKGLPANGNGEKNMKSRTLEDIVSTAATSEVPGETKSKKDEL

SEQ ID NO: 4356 - protein, 1483 aa, Trichoderma harzianum
MARHRCWPWNLTVGLMLALQAHGTPSVNVGMNAAFPAGPYLLELLETAAAENSSAYFPLLDRIAAGSFATASTDAALYSEVLNDLQQEGSISSSEALSTFKLALSLRSAAPRIEAHYQHYTTAVAPAVDDSECVNWVLLEGNQYCTPELDKVNRDGLLSLQAKHLPFDRTLGTGKEAILYADPTSSTFGEFHKALSKAAREGSLSYRIRYRRTEATHAAALPMSGYGVELALKRTDYIVIDDRVHDDAAHHESPSSSTSLDDSEDVADIKPLAASDLSSLGMKAASFVLQSDEPLGTLIKLTQDLPKFLTSVVAQNVSTQFEEEFRNNGIKGVPDGVNALFVNGVQVSERQIDPFALIDRLRQERKLIDGFRTLGLSGKQAVSILGHQAVSMAKGSNEPLRYDWTDRLEDGRVLIWLNDLENDEAYEDYPKTLAALLRGAYPGQLPPIAKNVFTLVAPVDFSNPEDVSFIAQLLSFISRGLTIRFGLVPLVSTPEATAKAKTVYHIFENYGIQGLTSYLERLQDAATASTNEEIFAEVTRDQKLLEDSEKMELVEVLEKEGYEQQLKLAQKWTDRLKAETPIRPVFFNGLLIPRDDNWLQGLGMLIGEDLQTVQKGVFHGILTDDDWAPGIFLSNAITRRNSYISPDDEKKSLVVLNINKIYNEHADLFEIIPVLDALAESQKEDWAVVTVIADLTTTSGKELVLAALEFKRRNPGVRVEFVHNPVAAVGAAAVNAALRANQGLLGNVQDADKLAKLLETQSEDLNANYFEALEQFLGASKILSGTQMIMLNGRVIGPISEESQFDVDDFQQFLDVERTKRILPVYAAIEELGLGDTLSTPIDAAKLTSITALSTISDLPEGIFESTTSARTTLYNTWESTHTTIEAGDEEAASIYIVGLVNPVSEQGQRWAPILKVLSELEGVHLKLFINPSAKIEELPVKRFFRYVLESEPSFNENGSVKRLEATFNSLPSEALLTTAVDVPPAWLVAPLISIHDLDNIKLSAVKTDVHATYELKHILIEGHSREGKGGAPRGTQLVLATEKNTPVTDTIIMSNLGFFQFKANPGVYTIQLKEGRSAEIYEIESIGAQGWNPVPGDNGTELALIDFQGVTLYPRLQRRSGMELEDVLQEKDPQENILVAKGRKLAEGLFGGKSKKKSLSEQEHAEINIFSVASGHLYERMLNIMMVSVMRHTKHTVKFWFIEQFLSPSFKEFIPHMAKEYGFKYEMVSYKWPHWLRQQKEKQREIWGYKILFLDVLFPLSLDKVIFVDADQIVRTDMMSLMSLDLEGAPYGFTPMCDSRTEMEGFRFWKTGYWANYLRGRPYHISALYVVDLRRFRELAAGDRLRQQYHTLSADPNSLANLDQDLPNHMQFQIPIHSLPQEWLWCETWCSDESLSEARTIDLCNNPLTKEPKLDRARRQVPEWVTYDEEIAALSKLSKGEAGSTDKEKLSDDRDSRAAESHGKNTKSRNLESEKTHTMDEL

SEQ ID NO: 4357 - protein, 1763 aa, Testicularia cyperi
MRFGTGGRGAWLPRALATLAIVPYAVAGVESPPVTVQLRAPWQKPALYNGGSPLILELLEAANAQEPSSFFALLDQLSEHHTAAALSSISDQELLETVQRLIDSNGLFSSVTAGSDSASATDLWKLSLALHDTSPRVQAFAQLYDTLNLDQRWKQRTSTAECTSWIDWNDQVLCTANEVEQALHTVSQTETRESTVRLLPFDHVRGSNVGQAPKETTFFLYADPYSENFAELHRSLSRQSNSGSDALRRASSAKTGITYVLRWRPTSHPQSASQPLLPSDSKPQSETVYLSGYGAILDLKKVDYLVIDDRKLRDDTEVGEQIGIDRPDISPQTHNKAADGASSDSHWLRAQIGASSHESDSSVAAGSLSDEEIAGLGLKAAELIIGSPDPLRALRELSQNFPSYAASLARSDKFAGHNAKELVEAVLDLGSRRIEPGGSEVWINGASTLRADFHPLKLLDVIRQERKIRRPLMHPLAGGGLNATEAIDLISSSLVGRAFSQSDLASTSATFDASDRIEKSTVEVDSKEPAPKGRNAGAIAWFNDLENDAETSSWSKSLMDLLRPMWPGQFPRLSVNLFNVVLVLDLSKRDTCRFLSETVAPSLGRVGLRWGLIPAGLEKGTDSDSAKMARLFWLVFDKAGPRVAADVLRRAAASPGGTRDRIDVTVAKKEARFALRDFDVGDNLDAELDVAISGQSNDQTYRERLVNAYVQRLRATEEESPAGHVFVNGRYHRFHPQITGILHQTVQEQIQTLAPQIYYGHVSAETANLDTYFYDAVGTLSFRSALVPDASSSTPGVAAGSGQTTTSAVRHASVDLFSALLDPSVANSDAEKVMHFIYPISVSDQSDDLVKPVNSTAWLLVDFDSPQGASLLQKGLQALSQPDAAFRLGLLHLPAKRASSDAGEPGLDIPLSALLYRLLQDGSIQKLSPLSLLEIVEYYINYTSESNLDSNGRIEERGSLQDLVQKVFALDDQDSSQSNPIKVASAKGWAIPAIVESSRFWTSIAEAVIPTLRPAERSASILVDGHLISDIDVAQIESRDITAVVQHEAAQKLPVVVEALQLLREDLFQWSPSRRQNLIFAATSVLNSVYNDDADQGMFVNKVTQRTGLPEQLGTSAHTFEIGDRDTAAIRIAMLLNPLSESAQKWSSILGMLSELSGVYVRVILNPPVKLREIPLKRFYRFSAPAQLQFDDVGKELTQELRFDGLPEDAVLTLGLDVPAPWLTMAEEAVYDLDNIRLSDVPSASRSRGVRAVYELKHILVEGHARQIDGASNSIPRGVQLLLETPDGDKRLDTIVMANLAYFQFKAQPGLWRLRIRPGRSDELYEMVSVGNEGWDSPPVEVTGNDITLDSLAGLTIYPRLRKRHGKEREELLEELDAQGRPVKRPRSAGGAASGSGVSGFASGLLSSARDTVSSLASRASSGFGTKSLSKSPHAEINIFTVASGHLYERMTYIMVLSVLKHTNSTVKFWFIENFLSPSFKEFIPHLAKEYRFEYELVTYAWPHWLRAQTEKQRTIWGYKILFLDTLFPLDLSKVIFVDADQVVRTDMKELVDLDLEGKVYGYPPMGDDSEDMDGFRFWKQGYWKDYLRGRPYHISALYVVDLQRFRRFAAGDRLRGQYQALSADPGSLSNLDQDLPNNMQASLPIHTLDKEWLWCETWCSKDWLDKAKTIDLCSNPKTKEPKLDRARRQIPEWTEYDEEVAKLAQRLVEEKRVGKNVVDPGQVVSKTPASHAFTSDAQPSTLSTPAADTGRHQDVVSSHDEL

SEQ ID NO: 4358 - protein, 329 aa, Orbicella faveolata
  MOD_RES (135)..(135): Any amino acid
MFDTIVMANLGYFQLKAYPGAWSLRVREGRSSEIYEIESVSGSVKEGDTHFTVVVDSFIGKLMKVKVKRKPGMEGKDLLSDSDSKSSGGIWDSLSSFLHTYLPSIVGSETKEDIPKDETINVFSVASGHLYERFXRIMMLTVMKNTKNPVKFWFLKNYLSPTIKLSSHLSFPCRFWNVGYWRSHLGGRPYHISAIYVVDLDRFRRLAAGDRLRGQYQGLSQDPNSLSNLDQDLPNNMIHQVPIRSLPQEWLWCETWCDDESKSGAKAIDLCNNPLTKEPKLQSAVRIVKEWTDLDNEVRSLQERVSTHAASSKSEPAKPDSPVKPKEEL

SEQ ID NO: 4359 - protein, 1540 aa, Cylindrobasidium torrendii
MAQASPPVRISLRTSWNSPPPLVEMIETVALENADAFFPLVDQLTDPDTHALHPHRSAEALHQLTLEAALENKLLNAPGAVQFVEMGFAMHTATPKIEAFYQHYAGLTGHKQCGGTWVDWYGTVVCDVETLVQLAGQDTLDARAGEPTPFVPPKLLPFDHVYAEQRETRPPRTAILYASLESDNFRDLHVFLLRHAAAGALEYVFRHIPPETHKEKSYLSGFGVGLDLKKTDYLAVDDRNLHGSTTGASASEDASSNVDSIAALIDAYPAFSAGAEALTTEEIQRLGVKAVQLISDAEDPLDTLQQLSHNFPKYAVELGRRVQVNESLAEELHENQLKVQAGNNIFWLNGQSIPANDVTPLHLLRALKKERTVMLALNKLGFERGEAIDLLTRRIGATASTTSGMEGLVDASDRSEGGDLITWWNDFDTDSRYSRWTPSIFQLLRPTYPGQMPTVKLNLFNVVLALDLSQPNALAFLSNAVPNLINRNLPFRFGLVPLIETENGAMMARLFYFLVENFGRKKTAAYFRAVHLDSDPSTRAEAIDWNVARKAFEDLLVKSESEHDASIFAGIIQGKLLPEAKFDGITSYVKRMGASLTANPEGHVFLNGRHFDMDEMVMRGLQTEVNKQLQFLQEQIYAGSITDDDVPRMATYFYDLPATSRTRNRYITSNSKDGLKVSMNAYFNTGFEPKNGAYAQSASNDLLVTMVVAADFTTEAGVELVKAALRSLDEDSHSRITFVHNPSSVSRHSVDHLLSALGMASTDTQTPITDEGTFQALAKESAYEPERSALYTASGIRFLKEFGVQPGAQSIVINGRAIGPFEGDFGQEDFKALEEYEIKRIAELSAALPEIAPWSNTLDRASRSQLLLMSSIVLSATQQPDPSEVGLFDAPLRPRFRGYSVLDKKFTGFEYGDNSTALYQISAIIDPLSETAQRWASILRWISALPDVYVEVRLNPLSTEEIPLKRFYRSNLLAAPQFDDNGDEVRAETIFNDLPLEPIYTLAMEVPSAWLVRPRESTYDLDNIQLGRIAPGDSSVDATFELDYIVIEGHARDMARNGSPRGLQLQLLDGENKTIDDTLVMANYGYFQFKTTPGVFELDIREGRGRQIYTLESVGAHGWDSPSVEEVGRGIAVTSFEGMTIYPKFRRVPGMENVDVLDPNLGDDDDDDDEGGFVDDLISGLKSFFGTAEKAKVEETGLVPVKQQADINIFTVASGLLYERFVGIMIQSVMRHTNSTVKFWFIENFLSPSFLEFIPHYAEAYGFDYELVTYKWPSFLRAQKEKQRIIWAYKILFLDVLFPLDLKKVIFVDADQIVRTDLQELVDLDLHGAVYGYTPMGDDNTDMEGFRFWKTGYWKESLRGRPYHISALYVIDLVKFRQGAAGDILRGHYQALSADPNSLANLDQDLPNNLQREVPIFSLPEDWLWCETWCSKDRLHRAKTIDLCQNPLTKEPKLARARQIPEWEEYDREIAMFTKKLADEGKIRKGAAVVDINVLAGEPVTTVGSEPEPDAGRIDNTIVRDEDSEQLGGATVDDRVKDEL

SEQ ID NO: 4360 - protein, 1563 aa, Coprinellus micaceus
MRYIPHLLAAAVAASAASPPVQVSLKSSWKAPPSLVELLETFSLEDSSLFFPLLDLLTNREVLPSTKLNPEGLHEATFEVARNGGLLEQHGSREMIEMNLAMHAATPKIEAFYNWYDTRYNASEGRKCGSWVDWYGDVVCDVESLARLAGVETIDSNIKSGIYIRPKLLTFDHIHPSSELLLERPHRTAILYASLDSRNFRELHGYLYKLSSKPNAHVEYVLRHIPPTHSAEHSSTLSGYGVGLDLKKMDYLALDDRLAKTTAARKQNSEEVQEEEVQEDSIAKLIEAYPENKTASEAQLTKEEFVAIGPQAVQLIADSNDPLETWTTLSQNFPKYAKSIPRRVVANASIVEELASNGQQVQPGMNVMWINGAMLDGKDTEPLGLLRQLRKERGVMQSLTSLGLDSEQAMELLTHANISNAQRRGGGITDGLFDASDRQEGGDLIVYWNDFNKDKRYARWNPSLYALLRPMYPGQFPSIKGNLFNVILALDLSQTSNLHFIVGPMSNILEKNIPFRFGVAPIAETEDGTKMARLFYHLVKVFGRKKTLAFLRAISQPGSTASPDAIYWPVVEETYNNFLGIELSENPDAEKVPFATILKGDDSTQSRLEKLKSYHDRLGSGLAQSKTGSAFFNGKPYVFDGQFLRYLQTDFAEFQRYYQEAVYSGALGDKDVPEIGEHFYDLPTTTKRRSLYIFPKTPVDLHLVNLPEALSKAGLVFLPGSYLYSDAEAYPLSTYVVGDFDSESGLALVKEALESLTETSNARLSFIPNPTHEAMGVLKSALGITLPASDGAQAPLSKPGAVEKISKGIDFSAENYAECLRAGRVFLKQLKIEPGQLAVIVNGRVVSPITPGTFSAGDFEALEGYELRKRTEPVAAALEEVVPALAQDKLNFADAVALASSVIAKIQQPGPSESGLFDSPPKPRHRNYNILADTYTAFEFGNNRTALYHVAAIVDPLSEDGQKWSSLFKWLANVPDVFIKVYLNPGAYTNLPLKRYYRYNLVPKLTYDVEGQEVSSKVVFQDLPVDPIYTLAMDVPSSWLVRPRESLYDLDNIQLGQLLPQDDSVKAIFSLDALILDGHAREAATQAPPRGVQLQLVTPTPQGENTPIQDTQVVANLGYFQFRVAPGVFGLEIREGRGREIYTMESVGGSGWESPTVEEDGNEVALTSFEGVTLYPRLQRRPGMEKEDVLAEPADGDSGILENIATKVFGMFKKKDEVGLVPVKQQADINIFTVASGLLYERFASIMILSVLRNTNYTVKFWFIENFLSPSFLACIIQLHLFYAEFIPHMAAEYGFDYELVTYKWPSWLRAQSEKQRIIWAYKILFLDVLFPMDLKKVIFVDADQIVRADLKELVDLDLHGAPYGYTPMGDDNTDMEGFRFWKTGYWKNFLEGRPYHISALYVIDLVKFRQMAAGDILRQQYQALSADPNSLANLDQDLPNNLQQQVPIYSLHEDWLWCETWCSKDRLHKAKTIDLCQNPLTKEPKLSRARQIPEWEEYDTEIANLTRRLAEQGKISSGLSTADTNVLAGGSSGKKENTNEKAEESTSSEGSATKEERPRDEL

SEQ ID NO: 4361 - protein, 1250 aa, Kluyveromyces marxianus
MRQFCSQVVVIILFLLHATRGLEIGVSKLWLSTSIVGRETLSDTQWMNLYHDLIFGEEDADEEYDFIDDGDENKSTDLDSSNQVQSIRDLLYVIAEHEDFAPYDEKYNETCLILNHKKYSKSDDSFYFKTSELEAQAAMGDFELLAENEITIGTNSSAPIVILYGCETDLEFDDFNRNLFNEAKFGKIRMVWRPTCAIGEKSTYAYSETIPEALWGKEVKLENKIDIAGKKLPTVAKLEFLNQQQLEKLDIKFTALLLQKYEELNDFEKFFEYFKTLVSNFPAIAPIIASKSDIDTASAEALYNKFKERQISHELLGLYVNGQQWRLTELDEVTLPKIIAEEYTKTNDLKEKLQNFGDVNLEKFLRYLTVGYSFTSFFDKNRYDFYRVPGFSEAVIFFNDFEKDKMYEKLPDQNDAFLGPSDFEPIPNIRQNWNELIFIINLDDPQSFEEHGAVNAFLEALEQMKTGYPVRLGLIPFSAQRSNHAVNQLYELKSKPGSLKKVKTYLKKLVRKPEIITKTTDEKSDQCNDFLERFKISNTVVVMNGVILPFQQKAWKIHTSRILFDDIEYLKREVRSMAKRNDLSVRQILHHRSLTIRNTKYLPNRMLDESFTRINNAALGELGERMIFYAGSKKPSPIHTVTIVDDFNAEGAIQKLEALLKNNHKGVAIRLVHMGALTKQWKIIRTEFSSGRLPNRKSYNKNCAFQSESYLNDLKSWLPDVPIDALRKPFVVINGKFFNTDQDLSSVELWHNILVQHSSKTLDTLNTLYRIGNLGSSEVDTSHIEELTASVIKYVYHSVLVFDNGIPYTTEASLPRVSLFELGDQMIKKAVEYPVVNITLLLDPAEERTQRLLYLTSLIKDLPFVKTEFALIPTSNLTMNPIYRFYNTSVETKKGRFESEIEHPHNFKADSDSIILEAHVFDENDEVSVNSVEGVPNVCIKLVDSEGNVIDKAISMTSFGYTQLSIPHFMRGMTIQSCDSEYTVTSFSTAGTSNYIESKQIDVTNTLPTKVYVKVKKTTNESAVLDDSKVNIMMVIHDGQESLAVAKIAKIKKESQDKMKFYILAKNPKLLAKMIPKSTDYELLNYAWPLWLRPQRFSEQELEAKSILLLDTILPKSIQKLVFISLKDDSLDNISLNDLSKYSEGVFYLREAKTEHDSYWKSGYWKTYLEKYDLPFYNLSASYVVNMQQLRRLDAASTLRLHYHLLSKSFTSLMNFKSDLLNSIQLKIPIISLNSVSKQGNAQGLEHDEL

SEQ ID NO: 4362 - protein, 579 aa, Leptinotarsa decemlineata
FEVSSKIESQELNLKMLRVYCQRVLKLKESDRAVVANGRVLGPLDENEEFIAEDFNLLERFSSSSYLEKINGILSKDAEDEEEITSDSMMRIISLLISRPQSRSRFEIVYAGDEHSVLKLPAAHPDQVAFDIVAILDPVSRGAQKLGPILQVLQEVLNCNIRVFLNSVEKNSDMPVKSFYRFVLEPEIQFSEDGRQLPGPLIFCSFIYFIFSHDGSDTPENSTDIKVLISSLRSHIVKLRVQKKSDKQNVDLLSDDEGGSGIWNSIASSFSGTEEEPDQKLNIFSLASGHLYERFLRIMMLSVLKHTKTPVKFWFLKNYLSPQIKDFLPYMAKEYGFEYELVQYKWPRWLHQQNEKQRIIWGYKILFLDVLFPLDVKKIIFVDADQVVRADLKELQQLDLGGAPYGYTPFCESRKEMDGFRFWKHGYWRNHLQGRRYHISALYVVDLKRFRRIAAGDRLRGQYQALSQDPNSLSNLDQDLPNNMIHQVAIKSLPQEWLWCETWCDDASKDYAKTIDLCNNPMTKEAKLTAAVRILPEWKGYDDEIRELQKRIDSGELDADPSEEKEVVDKGATDIHSEL

SEQ ID NO: 4363 - protein, 1308 aa, Eremothecium cymbalariae
MLLLGWLLPVAVVATSVQRFEVGRLWQSVVRVGIEERSLWYGAITGAEDDFTVDELWDMLDPDESTLLNLVYDMHSGWNFPVEEGGKLNWFELNNKRYWKTDDSYYLKSGELESQRKIPDLDVLFEEEGVIGVNSEAPLIVFYGDPATEEFEAFNRNLYHEAMDGKLRLVWRPTGLRSKTPENKYSKYYPYDYTLKAEAWNQEVIAEVEIPREFSSTTYRLGNVSQEELETLDLKATTLILKRFKDTKNLNDTIQYARQIIDNFPLIASQLANIEVDVESAAEVLDACIENGISYDSIGVYVNGQQWKLTALNPWSFIMAIISERKKIKGVLSTLQSQNSDIRLHDAKNFLTKYSQIGVLNLQDLQPVRYDFHRIPGFSESVIYFNNLEEDPQYKNLSSDISVFYEKSEFGEIPAYKENWNEIVFVIDFDNLRDQNFKDILAGLHRSLNVVESGYPQRIGLLPLYRGKENEYVRNIYKLKDQDLSDLKSYLKSFNANDFNITSDASVPSVKEILQKFRITDNSIIINGQIHPFKKNSWNYFVASTIKHDVTYLKRALKKSKSENVRDVLHARSFTHRDQRLIPDFFEDAIYTTTNNSIFGTLKDRVVTYNSDKTYNILHTITLVDDFNTKQAIERLINLINIELKGLRIRLIHKGELSAKWKELCGKIASNDNILYEYLTKISKRASSKAKSDPSVKNALREWLLDLPLDLISQDSFCLINGRYFHFNSSDVLTNTQWHAILQRESRRTIDVMNILNGVIPTMVNEKVDPDFIEQLSSYATYLFYVGANIFNNGVDFTSEATLPRMNVLDFFDQKMLPSVIYNGNVNAEVNITVIMDPLEERSQKFLHLVDIVQSLSFVNLNIVLLPTKSLAVMPIHRIYSTDDLFEDADDLFFVSRDIPSTISAENSSIIVQAHVFQDELISKATVEGVGGVCLEIVNPYGIPLSRAISMTTFGYAQFSLPAFERNLTIRSCDESFTVSSFSNNAKPDFVPVKSFDVVDLKPHRVVVKIESKIKNHKGQKLFEYDNEINVHVTIHDLRDEYLFKQKLLTILSNLDSNGRVHFWLSHVSELSIELKRILTFVELNTDQRVLFSRITYAWPVWLRPQRFSERRQDVSRIMFLDVMFPYNHINKLIILSLKETDTPDLAALKNLKTRAYFTMKQHRGNGYWEEGYWKKFLGENNLKFYDFSSTFVVDMARYRDTQAGHYLRIHYQRLSSDINSLLNIDGDLANSLQLILPIRTLRVNKDLNIPHPEKEFISKFDADVEAFFASLDQDNDLSTDADTGTDSDYNTGQDSDLYDPEFEHDEL

SEQ ID NO: 4364 - protein, 1580 aa, Heterocephalus glaber
MGLLIVLTGLWLYSSVKADSKAITTSLTTKWFSYPLLLEASEFLAEDSQEKFWNFVEASQNIGSSDHHGTNNYSYYHAILEAAFQFLSPLQQNLLKFCLSLRSYSATIQAFQQIAADEPPPEGCNSFFSVHGEKTCDFDDLETLLLTASGRPKPLLFKGDHRYPSSNPESTVVIFYSEIGLQEFSSFHHQLVSKSNAGKINYVFRHYISNPRKEPVHLSGYGVELAIKSTEYKAKDDTQVKGIEVNTTVIGENDPIDEVQGFLFGRLRDLHPELTGQLKELRKHLVESTNEMAPLKVWQLQDLSFQTAARILAAPAELALVVMKDLSQNFPAKASLFDVLRNEARVMEGLHRLRIEGLSLHNILKLNIQPSEAEYAIDIRSPAISWVNNLEVDSRYNSWPSSLQELLRPTFPGVIRQIRKNLHNMVFIVDPAHENTAELINTAEMFLSNHIPLRIGFIFVVNDSEDVDGMQDAGVAVLRAYNYVVQDMDEYHAFQTLTRVYNKVKTGDKVKVEHVVSVLEKKYPYLEVNSILGIDSAYDQNRKEARGYYEQTGIGPLPVVLFNGMPFAKEQLDPDELETITMHKILETTTFFQRAVYLGELSHDQDVVEYIMNQPNVVPRINSRVLTAEREYLDLTASNNFFVDDYTRFSVLDSQGKTAAIANSMNYLTKKGMSSKEVYDDSFIRPVTFWIVGDFDSASGRQLLYDAIKHQKSSNNVRISMINNPSKEISYKHTQISRAIWAALQTQTSNSAKNFITKMVKEDTAEALVAGVDIGEFSVGGMDFSLFKEVFESSKMDFILSHAVYCRDVLKLKKGQRAVISNGRIIGPLEDNELFNQDDFHLLENIVLKTSGQKIKSHIQQLRVEEDVFILDAAYSPEAIPSFPDLSFVLLVIQLHEPLASDLVMKVDALLSVQPKGDARIEYQFFEDKHSAIKLRPKEGETYFDVVAVVDPVTREAQRLAPLLLVLTQLINMNLRVFMNCQSKLSDMPLKSFYRYVLEPEISFTSDNNFAKGPIAKFLDMPQSPLFTLNLNTPESWMVESVKTPYDLDNIYLVEVDSVVAAEYELEYLLLEGHCYDITTGQPPRGLQFTLGTSANPVIVDTIVMANLGYFQLKANPGAWILRLRKGRSEDIYRIYSHDGTDSPPDADEVLVILNNFKSKIIKVKVQKKADMVNEDLLSDGTNENESGFWDSFKWGFSGGQKTEEVKQDKDDIINIFSVASGHLYERFLRIMMLSVLKNTKTPVKFWFLKNYLSPTFKEFIPYMANEYNFHYELVQYKWPRWLHQQTEKQRIIWGYKILFLDVLFPLAVDKFLFVDADQIVRTDLKELRDFNLDGAPYGYTPFCDSRREMDGYRFWKSGYWASHLAGRKYHISALYIVDLKKFRKIAAGDRLRGQYQGLSQDPNSLSNLDQDLPNNMIHQVPIKSLPQEWLWCETWCDDTSKKRAKTIDLCNNPMTKEPKLEAAVRIVPEWQDYDLEIKQLQIRFQKEKEMGTLFEKKIKEPTQEVLEDRGPPLTAGFLARGAKVGEWQHPLSFLGRSAAVAVSKEARFRCSGTLGSVGSVVPKILAAAKELAPGCGHYL

SEQ ID NO: 4365 - protein, 1602 aa, Psilocybe cyanescens
MKRVFTLLGAAIPVLQVVGSASSPPVKVGLRSSWPAPPFLAEILETVSLENPDAFFTYLDRLTDPEVLQSPHGMKPEAIHQAALQVAIDNGILHEAGSLSIVEMNLAMHAATPKLEAFYNYYADNHNGSSGTQCGSWVDWYGEVVCDVETLVQLAGVEAIDPPRDPKTDAFQPKPKILTFDHIFPPPDIILERPPRTAIFYASLTSANFRELHTYLMKLTNRLDPHVEYVFRHIPPTTQSEGSNYLSGYGVSLDLKKMDYLALDDRNTNSAANNAESKSDSNSEDKRVDPILPLILSHPENLTAPGPDVPLSEEELEEEELDGLGGKAAQIIAESSDPLDVLTHLSQNFPKYATSLARRVVMNESIAEELHNNSLKAQRGINVLWFNGLQVEPKDINPFGLLRTVKKERNVIQSLTSQGLERSQAFQLLTHSAIAIAQKESAAMEALFDASDRPEGGDVIVWWNDMEKDSRYAKWNPSLYALLRPMYPGSLPSIKANLFNIVLVLDLSQTTSLNFLAGGVTNIINRDIPLRFGLVPIVETEDGKKMARLFYHLVKNYGRKKTLQFINSISQIRLPAQLQTAELDWHTVRHTYDELVAREREENPEAAFPALDSIFKGEEEDVARLDKINVYTERLGSTLASSETGHAFFNGKHFDVNENFMRQLQTEVATQMAYLQEKVYSGSLADDEERETMGNYFYDLPTTSKRRNKYIYPSTGSKSIHIANLPEIFSKTRFRLSPSAYLYPPAEAESIFESLFVVADFDTEDALGLVKEAISSLTVESKTRISFIHNPSIAKSPDNASRSPATWLFAHLHTRELLAKAAPSSLLSALGLDGFAGPTEGMQIPIKKYGAFEELTGGVVLGDIMEEEYVDYVKTSRLVSRELHIHPGQSALVVNGRVVGPIAPNDFHIADFKALEDHEFRGRTEPIVKALQDVAPLLAEDKYKFANVVSMASSVIAATQQPDPSEAGLFDAPLRPRQRSYQLLDSEYTSFEYGDNSTALHHVAAFLDPLSETAQKWSSLLKWLSNIPDIFIEIHLNPGGYKDIPLKRFYRYNLIPQLTFDKEGHEVSAQAVFEDIPVDPIYTLAMDVPTAWLARPREALYDLDNIQLGKLFPGDTAVEAVFDLDYIVIEGHAREIANQVPRGVQLQLATGDGVPVDDTQVVANLGYFQFKAKPGVFKLEIREGRGRKIFKLDSAGNEGWDSPSVEEAGAEITVTSFEGLTLYPRLSRNPGMELAEVLEEEEKEEESKGIFEDLSSRVMSIFKSSKKELSTEVVTVKPQADINIFTVASGLLYERFVGIMILSVLRNTNSTVKFWFIENFLSPSFLEFIPHMAEKYNFQYELVTYKWPSWLRAQTEKQRIIWAYKILFLDVLFPMDLKKVIFVDADQIVRADLKELVDLDLHGAPYGYTPMGDDNTDMEGFRFWKTGYWKEFLQGKPYHISALYVIDLVRFRQLAAGDILRGSYHQLSADPNSLANLDQDLPNNLQAQVPIYSLSEDWLWCETWCSKDRLHRAKTIDLCQNPLTKEPKLARARQIPEWDEYDTEIARFTRDLAKAGKVHSRIATADASVLAGGGAADKKQDAEVVEETQDDSQTEEPTRDEL

SEQ ID NO: 4366 - protein, 1542 aa, Lepisosteus oculatus
MAAIRLGEAGFGVCHWMGPFTVALFIWLSVTSVRGDSKAVTTTLTTKWASTPLLLEASEFLAEESEEQFWDFVEVNQEIGEDDRGDSDYSYYHLILKRAAPFLSPLQLNMLKFALSLRAYSATVHSFQQIAANETPPPGCKAFFSVHGEKSCNPESLSDMLETASERPKPYLFKGDHKFPVSNPDVPVVILYAEMGSKEFPKFHQLLVSKANRGQISYVLRHFLATPSNNKVYLSGYGVELAIKNQEYKAKDDTQVQGAEVNATVIGENDPVDEVQGFLFGKLKTLYPELQEQLKELRKHLVESTNEMAPLKVWQLQDLSFQTAARILAAPSVDALMVMRDLSQNFPTKARSITKTVVNSEIRKEIEENQKFFKGTLGLQPGDSALFINGLHIDLDVQDIFSVFDMLRNEARVMEGLRSLLIETPFIHDILKLNVQPSDSDYAVDIRNSAIYWINNLETDSRYNSWMSSVQELLRPTFPGVIRQIRKNFHNFVLLVDPTHESTGELMSVAEMFLSNNIPLRIGLVFVVDDTEDIDGMHNPGVALLRAFNYIAEEEDNQHAFEAVTTMYSHIPTGEKLKVETVIHFLEKQYPYVEVSSILGADSAYDKKRKEERLYYEQTGVGPLPVALYNGVPYQRDQLEPDELETVTMHKILETTSFFQRAVYLGELSSDQDVVDFVMSQPNVVPRINSRILSTTRQYLDLSSTNNHFVDDYSRFLFLDSKEKNAAVANSMNYLSKKDDSYIRPVTFWVVGDFDHPSGRQLLYDSIKHMKTSNNVRIGMINNPTESPSNETSRVARAIWAAMQTQTSNNAKNFITKLSKEETAKALESGADIAEFAVGGMDIKLFKSMYDSPKVDFLLSHSAFCRDVLKLQKGQRAVISNGRIIGPLGDSEVFNQDDFLLLESIILKTSGERIKSKIQQLGVEEDRASDLVMKVDALLSSQPKGEARIEHAFFEDRYSAIKLRPKEEEVYFDVVAVVDPVTRDAQKLAPLLIVLKQLVNINLRVFMNCQSKLSDMPLKSFYRYVLEPEVSFMTDNSFAPGPIAKFLDMPQSPLFTLNLNTPESWMVESVRTRYDLDNIYLEEVESVVAAEYELEYLLLEGHCFDVTTGQPPRGLQFTLGTTSDPVIVDTIVMANLGYFQLKANPGAWVLKLRKGRSDDIYKIYSHEGTDSPPDADDLIVVLNNFKSKIIKVKVQKKPDKINEELLSDGSHENDSGFWESLTRGFTGGKKTEEVKQEKDDVINIFSVASGHLYERFLRIMMLSVLKHTKTPVKFWFLKNYLSPTFKEFIPYMAEEYGFQYELVQYKWPRWLHQQTEKQRIIWGYKILFLDVLFPLAVDKFLFVDADQIVRTDLKELRDFDLEGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKSAKTIDLCNNPQTKEPKLQAAVRIVGEWSSYDQEIKKIYNRFLEEKEKGTTPVTNDTTQIKKQGSVDHTEL

SEQ ID NO: 4367 - protein, 1510 aa, Urocitellus parryii
MTPAKTATAVRLLLGSVLWLWLLGAGTASASKAVTAHLAAKWPETPLLLEASEFMAEESNEKFWQFLETVQELAIYKKTESDYSYYNLILKKAGQFLDNLHINLLKFAFSIRAYSPTIQMFQQIAADESPPDGCNAFVVIHEKHTCKVNEIKKLLKVTSRPRPYLFKGDHKFPTNNENLPVIILYAEIGTKAFVEFHKVLTQKAQNGKILYVLRHYIQKPSSRKMYLSGYGVELAIKSTEYKALDDTQIKTMTSTIEDETKANEVQGFLFGKLKEIYSDLKDNLTVFQKYLIESNKEMMPLKVWELQDLSFQAASQIMSTPVYDTIKLMKDISQNFPIKARSLTRIAVNQRMKEEIQENQKDLQDRFEIQPGDAHLFINGLRVDMDVYDPFSILDMLKLEGKVMNGLRNLGINGENLSKFLKLNSHVWESAYILDIRHSSIVWINDLENDGLYVTWPTSCQELLKPVFPGTIPSIRRNFHNLVLFIDPAQEYTSDFIKVAELFYYNKIPLRIGFVFILNTDDKVDGTNDAGVALWRAFNYIAGEKGLSEAFASIVHMYQKAKDQNILTVDNVKSILQNEFPQANIWDILGIHSIYDDERKAGANFYKMTGLGPLPQALYNGESFNHEEMNIKELEMAVLHRMMDASVYLQRDVFMGTLNDQMNAVDFLMDKNNVVPRINSLILHTKPQYLNLISSSVTTAIEDFSTYFFLDSQDKSAVIAENMHYLTQEDDDVISAVTLWIIADFDTPSGRKLLFNALKHMKTSVRSRLGVIYNPTSKINEENTVISRGILVAFLTLQNSFLRSILKKLAKEETATALYSGIKIKTFLTEGIDKNAFEKKYNTIGVNIFRTHQLFCQDVLKLRPGEISIVSNGKFLGPLNEDFYVEDFYLLEKITFSNFVEKIKEFVENMEISSKNMSDLIMKADALVSSLPKQASRYDVTFLRENHSIIKINPQENDMVFDVIAIVDPLTREAQKMAQLLTVLGKIINMKIKLLMNCRGKLSEAPIESFYRFVLEPELMSGANGSPLGPVAKFLDIPESPLLTLNMITPESWLVETVHSNCDLDNIHLKDIEGAVTAEYELEYLLLEGHCFDATTEQPPRGLQFTLGTKNKPVVVDTIVMANLGYFQLKANPGAWMLKLRQGKSEDIYQIVGHRGTDSQPDIGDVIVVLNSFKSKILEVQVQKKPDKIKEDILIDNHEKKGMWDSIKSFTRRLHKDNKKEKDVLNIFSVASGHLYERFLRIMMLSVLRNTKTPVKFWFLKNYLSPTFKEIIPHMAMEYGFQYELVQYKWPRWLHQQTEKQRIIWGYKILFLDVLFPLAVDKIIFVDADQIVRHDLKELRDFDLGGAPYGYTPFCDSRTDMDGYRFWKTGYWASHLVRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLKAAARIVPEWIEYDTEIRQLLDNLENKKKSAILAHDEL

SEQ ID NO: 4368 - protein, 577 aa, Cricetulus griseus
MENAGTAPYSYHCGSVIKINPPENDLFFDVIAIVDPLTREAQKMAQLLVVLGKIVNTRIKLFMNCRSKLSEAPLGSFYRFVLEPELMSGANSSPSDGPVAKFLDIPESHLLTLNMITPEGWLVETVRSNCDLDNINLKDTGGIATAEYELEHLLLEGHCFDLTTEQPPQGLQFTLGTENNPAVVDTIVMANLGYFQLKANPGAWILKLREGKSEDIYDIVGHEGTDSETDMGDVIVVLDTFKSKILKIEVKKKSGKIMEDILADKHEDKGMWESIKSFAKSLHKDDKKENDILNIFSVASGHLYERFLRIMMLSVLQHTKTPVKFWFLKNYLSPTFKEVIPHMAKEYGFQYELVQYKWPRWLHQQTEKQRIIWGYKILFLDVLFPLAVDKIIFVDADQIVRHDLKELRDFDLGGAPYGYTPFCDSRTDMDGYRFWKTGYWASHLMKRKYHISALYVVDLKKFRRISAGDRLRGRYQALSQDPNSLSNLDQDLPNNMIYQVAIKSLPQDWLWCETWCDDESKQRAKTIDLCNNPKTKEPKLEAAARIVPEWVKYDAEIRTLLDHLENRKNAISTHDEL

SEQ ID NO: 4369 - protein, 1493 aa, Penicillium oxalicum
MKVSTRSRASWRWYAALGAILPLALAQASPAVNVALQASFDSSPYLVELLETAAEENATSYFPLLDRIAGGAFEEAVSEKELYDRFLQVIHEDGHLRTPESLSSFKLAMSIRSSAPRIQAHYQYYNTSVQQSLMAAQDAACSVWVHLEGKQYCSSLMERAQQDVEGDSDPRDLPIDRVFGDKSLPPAVLYADVSAPAFREFHEKLSDMAKQGEISYRVRYRPPQHWISRPLFVSGYGVELALKRTDYIVIDDRDAEQLSDSVKDDAGKSSDELERDATDDLRPLSASELSRLGLNTASYVLDSQDPLRTLLGISQDFPKYSTAIAAHNASDELRQEIRHNRGRMIPAGYNIMWINGMQIDARQIDAFSLLDILRRERKLAENFRHLGLTAQEAVKLLSHQALAEAQAEEQPPRYDYRDTPEGGQVVIWMNDVENDLRYESWSSALEGYIANPYPGQLPRVRRDLHNVIFPVDLSNPEDILLVVNQIQTFINRLIPIRFGLVPTPSSPNAISQLKVAHYLYDTFGLEALLHYLQESVSSGKAGKADKAAFAAATKELKPMPEKQALSFDKVLKSDLYEAAVKRSSDYQRRLGLAGPNPPLLVNGIPVPRESNWMQELSRLISKDLKLVQQGIVEETLTERTLLSEYLLADAFERRNTLIMPEDPKGVRIANLVTIFEADSTEQEFFPRIPTAEDVHGGVHVIVVGDFETDSGLKLLTDALSFRKENEEIELLLVHNSASQSEQVTSPFEGLQASLSKASDIDHLLDLLSFTETAQSPTEEVAEVIGAHRRLARALGFTPGTEGLVVNGRVVGPIPADDQLSVKDLGQLIMYERAKRIEPVIKASLSLGLDKKLTKPLDIAKLTSMAALSAISDVPEGIFENVPDFRMNVESRWNTEHSVITISNSDDPVINVGVVIDPASETAQRWLPILQVLSELAGVQLKIFLNPKDELKELPIKRFYRYVLGSEPSFTSEGALTRPSASFKGVPVDALLTLGMDVPSSWLVAPKESVYDPDNIKLSTLKPGANVDAVYALEHILIEGHSRDTTTESPPRGVQLVLGTENNPHFADTIIMANLGYFQFKAQPGVWQINLKPGRSEKIFNIDSAGGLGYRPQSGDEVTEVTLLSFQGLTLFPRLSRKPGHEDDDVLESGPQPGSTRDFFSKGLNFASGVLSSVGVGSRSEEKHADINIFSVASGHLYERMLNIMMVSVMRHTKHTVKFWFIEQFLSPSFRAFLPHLAEEYGFSYEMVTYKWPHWLRPQKEKQREIWGYKMLFLDVLFPLSLEKVIFVDADQIVRTDMYDLVTHDLEGAPYGFTPMGDSRTEMEGFRFWKQGYWSTFLRGKPYHISALYVVDLNRFRALAAGDRLRGQYQMLSADPNSLSNLDQDLPNHMQHHIPIHSLPQEWLWCETWCSDEDLASARTIDLCNNPMTKEPKLARARRQVPEWTVYDDEIAALAKRVAAEQVGFVQTGEDAGQGVVNGNKVQNGEEDTRKDEL

SEQ ID NO: 4370 - protein, 1452 aa, Ophiocordyceps camponoti-rufipedis
MTGAAVVAVPSVNVGMNAAFSAGPYLLELLETAAAENSTAYFPLIDRIASGYFATASSDAELYSKFLDLLVHDGHVAGPEALSTFNLALTLRSAAPRIEAHYQYYSTAVEPSVDPNCLNWVLLEGKQYCSPQLDKPTREGLFTSGVTTLPFDRTLGSGKEAVLYADPVSESFGDYHKALSEAARARNLQYRVRYRRNEANPHRPLPVSGYGVQLALKRTDYIVIDDREAAADRSQKPLTSGGFEDEVADLRPLSTSELASLGLKTASFIQNSKTPFATLIKLTQDFPRYSASVAAHNISEPFNVEREMVAPGGINFLWMNGVQLIERQIEPFALVEMLRRERRLVDGFRRLGFTGKQAISILGHSAISTAKGDDETLRYDWTDKLEDGRAIIWLNDLENDSRYEDYPKSLVALLQRTFPGQIPQIGQNVFNIIAPVDLSNTEDIAFLSQIISLIRRGIPLRFGLVPLTPTADALAQAKIVMYLKEILNIDAVFAYLDGLSERKESGVNDQLFSTFVADAELLTDSQRLSSSEVIESDTWADHFKSALHWVKRLKADAAVRPLFINGVFIPRDGNWMQTMSMKISGDLQNIQKQIFQGSLSEDSESSSIFLKGALSGRNPYISVESDKALRMLDVSRVYSEHGSFFGAIPILEPYSESTKENWAVVTLLADLTSVNGRELVLAALEFKRNSPGVRLELVHSPKDLSKASRVNSALLAQVELVKEMETIDQLTKVVDSVEVESVNDGYAPALSAFLDMAKVEVGKNIIILNGRIVGPISADEPFTADDFQQLLEYEQGHRMLPVYEAIDDLGLGDKLTSAMAAAKATSITALSTISDLPEGIFESAPTMRSTMYDAWDVDHATIEVGDAETASIHIAGLLDPVSEKGQRWTPILRVLSELDGVYLKIILNPREKITELPLKRFFRYVMEPKPSFDDSGSVKALRASFEGLPSDVLLTAAMDVPPAWLVAPKESVHDLDNIKLSSVKSNIDATYELEHILIEGHSREGRGAPPRGAQLTLATEKDPMVTDTIIMSNLGFFQFKANPGFYKIKLKEGRTADIYMIESIGAQGWEATSGDEGTELALMDFQGTTLYPRLKRRPGMEQKDVLETSDSASSTGSIVSKGLKLAEELLGGSKATKSASAQKHAEINIFSVASGHLYERMLNIMMVSVMRNTKHTVKFWFIEQFLSPSFKEFIPYMAREYGFKYEMVTYKWPHWLRQQKEKQREIWGYKILFLDVLFPLSLDKVIFVDADQIVRTDMMDLVNLDLKGAPYGFTPMCDSRTEMEGFRFWKQGYWSNYLRGRPYHISALYVVDLGRFRELAAGDRLRQQYHALSADPASLSNLDQDLPNHMQFEIPIHSLPQEWLWCETWCSDESLAKARTIDLCNNPQTKEPKLDRAKRQVPEWTVYDEEIAALDRRRKGGDAAQSSEPEVNTKSRRLDGEDGQSRHTVDEL

SEQ ID NO: 4371 - protein, 1480 aa, Pseudocercospora fijiensis
MARNTIYQAAALFGLLASAKAAPSVNVALRTAFDAPPYLVELLETAAEENATSYFPLLDRIADGYFDSSKTDEELYKSFRTLLEKDGHLGKEDLSSFDYALSIHSAAPRIEAHYQYYNTSIVPSLSSDAQDGCQSWVYVPFSGQRYCSAELDETTAQSFGKPEASVHQLPFDRVLGDLNSDKPSVLYADIFSESFRKFHKTLSKTARDGSTSYRVRYKASVGHERKPLTVSGYGIELALKRTDYIVIDDRNAEEEKKEETVSANDGTLSEEEVSDLRPLSQSELRRLGLRAASFVMGSEQPFDTLLRLSQDFPKHSSSIAATEISEEFMAEHSTNREVLVPAGFNVMWINGVQIMPRDVEAYALLEHLRRERKMIKSVQEIGLSGTEAVELLSHEAITASQVGQEVQRYDWRDNAEGGDVIIWMNDIEKDKRYAEWPETVTRFLQRTYPGQLPTVRKDCHNLVIPIDFADFNDALLVVESLKGFVKRRVPIRVGVVPIIKSPDSEAQAKIIHYLIDRYGLATALNYLETSLETAGRKYGPVIEKLFSTAVETGKLRPDKEELTLESVNSDAYLQSRIKGAKEWISRLGSTDVTPPVLINGAAIQRSDDWLQSMSARVSQDVRVIQQAVYLGEVTDEDYLPDLFLEKASLRRNPLLIPEDDQDIRHVKLGELPSFGDLPSLGASEDTIERELVHLTVVADLDSTEGFEQLMEALMYRREHDNVELAWLHIPRDGTTDTRLGSRIYSELYKKAARTNSPELDERVRSIWTPFRSIVSAAGITPGKKALLVNGRIVGPIPDSIGLQVSDIEVLLSYERMKRLLPAALAIEGLGLQEKASTPLSFARVSNLIAVSMVSDIPEGIFEAAPTVRTGIFKTWNSSHTAIHLGDEKTATVQIYASIDPASEVAQKWIPIMKTVSEMEGVYVRLFLNPKERLEEIPVKRFYRHVLKSKPSFEPDGSLQVNGAQFRGLPADALFNMGMDMPPAWLVAPKITVHDLDNIKLSAVKSDIEAIYELEHILIEGHTRDVTVGPPPRGAQLVLGTDAEPHFADTIIMANLGYFQFKANPGVYNLALQRGRSEEIFHIDSAGAAGYNEQAGDNTTEIGLMSFKGTTLSPRISRRPGMEDEDPLEPAKTALGFVAEGAESLLSQIGLGNQASNIAERKHADINIFSVASGHLYERMLNIMMLSVMKHTKHSVKFWFIEQFLSPSFKDFLPVMAEEYGFQYEMVTYKWPHWLRGQKEKQREIWGYKILFLDVLFPLDLDKVIFVDADQIVRTDMYKLVTHDLKGAPYGFTPMCDSRTEMEGFRFWKQGYWKNFLGGLPYHISALYVVDLKRFRQMAAGDRLRQNYHQLSADPGSLSNLDQDLPNHMQALLPIHSLPQEWLWCETWCSDESLKDAKTIDLCNNPQTKEPKLDRARRQVPEWTEYDNEIAAVAARHKEKLAGGVPAVQGRDDGGESMQERLQREDAERERKKKAHVRDEL

SEQ ID NO: 4372 - protein, 1542 aa, Erpetoichthys calabaricus
MATTRRRKAGFGMPFNMRLFASLFLGCLCVAFANGDSKAITTSLTSKWASTPLLLEASEYLAEERQEFFWDFVEVNQYIGPDDHEGTDQSYYHLILKRASQFLTALQLNLLKFALSLRSYSTTVQSFQQIAANEPPPPGCSAFFSIHGERTCDPKSLTNLLESASERPRPFLFKGDHRFTLSDPVAPVIILYAEMGTKEFSQFHQLLVSKVNRGEITYVLRHYIANPNTNKVFLSGYGVELAIKNQEYKAKDDTQVQGGEVNATMFGENDPVDEVHGFLFGKLRTQYPDLVEQLKELRKHLVESTNEMAPLKVWQLQDLSFQTAARILSAPSVDALMVMRDLSQNFPNKARSITRTVVNLELRKEIEENQKYFKGTLGLQPGDSGLFINGLHIDLEVQDIFSIFDVLQSEAHVMEGLRSLLIETSFIHDILKLNVQPSDADYAVDIRNSAIYWINNLETDTRYSSWPSSVQELLRPTFPGVIRQIRKNFHNFVLIVDPTHESTVELINVAEMFFSNHIPLRIGLVFVVDDSDEIDGMQDAGVALLRAFNYISEEMDNHQAFQVITSMYNKVQPGEKLKVEHVISILEKKYPYVEISSILGADSPYDKNRKEGRGYYEQTGVGPLPVAMYNGMPFQKEQMDADELETVTMQKILETTSFYQRAVYLGELTSDQDVVDFIMNQPNVVPRINSRILATTRQYLDLSHSNNHFIDDFSRFVFLNLKEKNAAVANSMNYLTKKDDSYIRPVTFWIVGDFDKRSGRQLLYDAIKHMKSSNNVRLGMINNPTENPSMNNSHVARAMWAAVQTQTANNAKNFITKLSKEETAEALELGADITHFSVGGMDIDLFKSAYESFKLDFLHSHASFCKDVLKFRSGQRAVISNGRVIGPLEESEVFNQDDFLLLESIILKTSGERIKSKIQQIGIEEDRASDLVMKVDALLSSQPKGDARIDYNFFDDRHSAIKLRPKEGEVYFDVVAIVDPATRDAQKLAPLLMVLKQLINMNLRVFMNCQSKLSDMPLKSFYRYVLEPEISFMVDNSFAPGPIAKFLDMPHSPLFTLNLNTPESWMVESVHTRYDLDNIYLEEVDSIVAAEYELEYLLLEGHCFDVTTGQPPRGLQFTLGTASNPLIVDTIVMANLGYFQLKANPGAWVLRLRKGRSDEIYKIYSHEGTDSPTDADDLIVVLNNFKSKIIKVKVQKKPDKINDELLNDGSHENDSGFWESLTRGLTGRAKTEEVKQERDDVINIFSVASGHLYERFLRIMMLSVLKNTNTPVKFWFLKNYLSPTFKEFIPYMAEEYGFQYELVQYKWPRWLHQQTEKQRIIWGYKILFLDVLFPLAVNKIIFVDADQIVRTDLKELRDFDLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKHAKTIDLCNNPQTKEPKLQAAVRIVSEWTDYDQEVKQLYNTFVEMKEKGSIPLTHDPAKRRKPDYNGHIEL

SEQ ID NO: 4373 - protein, 1688 aa, Sporisorium graminicola
MRALPLLSVGWAWLALALALAIPSTTVHAESPPVKVQLRASWSKIRLPSGGSSFLLELLEAARSQRPSSFFPLLELLTTKYTATELREATDEWLASTVQDLIESHKLFGASSTIADEALETWHMSLALSNSSPRIQALVQLYSTLQMDEIWKKGSKDESCISWVHFQDRVLCSGEEVRQATRDAMPATLVHDPSREVSLGHSRSSSSSSSSSSSTDSKAATQSFVLYADPFSDNFYDLFSALEEHVNQSDANLTYTLRWRPSFTNSAPLSEVEQTTLLSGYGAILDLKKVDYLVIDDRKLKDDSDIGDVGISASSQSEDGAAAKQAADEARWLRDQIGAASSAGGVALSSLSDDQIADLGIKAARLIMDSSDPMRALQELSQNFPLHAAGLAQTTKWDDADRSAALVDAVLNLASMRIEPGHSDLWLNGQSTSTRDFMPLTLLETLRKERGWNHALQHPLAGGGLNVTEASDLISSSLVGRAFLAQADTNAAAAIFDASDRIEVKDAPAGTQAGGAITWLNDLETDAATSEWSSDLMDLLRPMWPGKFPRLSLNLFNVVLVLDLSQKDTCRFLSDTVIQSLGRVGLHWGLVPGGLEDEVAGDSVRMARLLWFLLDHASAQVASDVLRKAAASSAGSAGALDVSLAVKEAKFTLKGIDADGSLSSKLDAALAGTDPTYTQREALSRAYIKRLRATRKESASGHVFINGQHQPFHPQIVHVLHQAIQEQIQVLAPQIYYGQISSSTPGLDTFFYDAVGALSFRSALVAGGGGGEDGEGAKHSAVDLFSVLVDDTVETATVEKVWNFFYPAASTGLLNSTVWVFADLDSEDGLVLLSRSFEALAKEDARFRLGVLHVPSTGLGADTRDSSVSTLLYRLLAEGYTEKFSPTEVLDVLKKAHDGPHQLEGALGLTAGGADFTQKARQFWQSIGSIVASKLDISEDGPAILVDGHLVSKLDVFSIEARDITALVEYEAGQKLPYIMQALALLRSDIDSMPIHQRQDLVFAALSVMNGVYDQGGAGQGMFTSKASSRSGLPEQLGTSDHVFEIGDRATADVRITLLLDPLSEAAQRWSSTLVMLRELRGVYLRVILNPQIKLRELPLKRFYRFSAPHALAFDSAGRAIAPELRFFDMPEDAVLTLGLDAPAPWLTMPMEAVYDLDNIRLADVPSSSRAKGVKAVYELKHILIEGHARQESPTASSAVTVPRGLQLLLETPDGSTKLDTIVMANLAYFQFKAQPGLWRLRIRGGRSDELYEMQSVGGEGWNSPPVEVTGEHLVLDTLSGLTLYPRVAKRRGKEREELLEELDAQGRPIKKQRGSAVRAEGGLAASAGQMFLSAKDKVASLARSVASGTASPSSAATTRAHADINIFTVASGHLYERMTYIMILSVLKHTTSSVKFWFIENFLSPSFKEFIPHLAAEYGFEYELVTYAWPHWLRAQTEKQRTIWGYKILFLDTLFPLDLGKVIFVDADQVVRTDMRELVELDLQGNVYGYPPMGDDSEDMDGFRFWKQGYWKDYLRGRPYHISALYVVDLHRFRLFAAGDRLRGQYQALSADPHSLSNLDQDLPNNMQASLPIFTLPKEWLWCETWCSHAWLPDAKTIDLCSNPKTKEPKLDRAKRQIPEWTVYDQEVARLAQRLVQEQKVGKSVVAPDSQVEAKAGRQQEEEQGKGNTDAHADTDTDTDAHVHDEL

SEQ ID NO: 4374 - protein, 1494 aa, Trichinella spiralis
MTVFCANFTVESLLEATVYSMWVFPLIVVCFVSPVLVSPRKAHKNVIVSVRSKWPSTSLIMEASEFMSKESNEKFWQFIEAVIDKHQNSLGNKTDREVYNGILQIGDQILKSKARLEFLKLALTVRVHSATVEMHRQIAATSLDVQNGKSVYAVVHGKQISDLQQLDTILKHAEALARPVTYQFDHIYPGSKQGSVCVLLYADIENPHFKPWHLQLKKLVQRDGISYILRHYPKMNDDMVALSGYAVELAIKSTEYKAVDDSDKQTGSESGVSSSEEEVTDLNGFNLHLLEADELTPLKVWQLQHLSFQAGQRVMLAPKEEALRVLRDISQNFPIMARKDFTLLYAMKGNDPNAEYAVDYTQWSPQIFVLRLGDRASQNLLSTAYQMYEHVLPIRIGFIFVVNNDKSVSGYDDAGVAMLNAFNFIKEDRSVSKAVMFLIKIYNTVMRETISVEDVHKLFKSSYRDEDLKSVFNSEEYNQGRSISPEHIEEAILSKVMRFTVDIQKDVYEGNLKENMDVQQHLMKKPTVLPKLNYNILQMENIFLDMTDTSMDMRIALIHNPKSEAQATKGTASLVQACIQFLPLYQSKAVIGKIFANKITTLEDLINLSPSGISWPEFKKAYNSMSDIWMQLHVHYAKFVLNLDPGVGAIVANGKLLLYSCVQIEASDPTAAQFDIVAIVDPLSPAAQKMSHLLVILSSVLNVHMKVCMNCKSKLSEIPLKNFFRMVLPRELEFADDGSLKAQPSARFSALPQKQLFTLNLIAPQSWMVESVDAVYDLDNIKMEEVKGDVVAKFQLEYILLEGRCFDERSGSPPRGLQFTLGTFHEPFMFDTIVMANLVAKKNDQLENELLAESEDAESESLWQSISKTFQSGEKYDVINIFSLASGHLYERFLRIMMLSVLKHTKTAVKFWLLKNYLSPGFKEFLPYMAAHYNFSYELVQYKWPRWLHQQTEKQRIMWGYKILFLDVLFPLDVKKIIFVDADQVVRTDMLNLMELDLEGAPYAYTPFCDSRKEMDGYRFWKQGYWENHLAGRKYHISALYVVDLKKFRQVAAGDRLRGQYHFLSRDPNSLSNLDQDLPNNMIHQVKIKSLPQEWLWCETWCDDKSKKFAKTIDLEPKLQSAMRIIEEWKDYDSEIKDLLDQRTKDKWKITEQKIVDIGFQFTAYFLVFLEESWNRAMNKENQVQDNRKAEITRRVVESCFAGLKCFPAYYSDQKMKNDSVDCSHNRDKFKNYYRKHWDTDITVEDETVVELKNRILKGDRSALASAITLVESNHPTKRAQGECLLQSMLKISKKRFDEHGPKSLIFRIAITGAPGAGKSTFIESFGLYLIRELKKKIAVLTIDPSSERTGGSIMGDVARMNELSKEPNCYIRQSATAGTLGGVRRGTHESVVLCEGAGYDVVLIETVGVGQSESAVANIADMVVLLLSPALGDELQGIKRGIMEMADLILVTKADGDLLKQARLTRAEFSSALKYSRSRFHCWRPQVCPFDSI

SEQ ID NO: 4375 - protein, 1567 aa, Diachasma alloeum
MWRIGIICLLLVSSNTASPGKKRSKYVTTLINANWRDTPIILEAAEYLNDKNPNYFWKFIDTVSRNSDANALDAHEETDKERYDRLINHTSNFLTSTENALLKLSLSLRTYSARIEMFSQMGENRRTEKVEACNNFVDVHGELTCSSDEVENLLESIENRIDGDDDDDEERTVYSLDHQYPVPLSGQSESGGKSKITGKYVILYGQIGSVGFSDFHEKLKGLADAKKIVYILRHYVRDRPEHHLRLGGYGVELHMKSTEYKATDDSDIKDNSGKEEYENEGVEEINGINFGVLRSLYPDKHAELDKFEKHLLETSDEIGALKVWQFQELSHQAAERIMKSPSQEAIKVLTDIAQNFPMQAKSLIRTKVSSEMKKEIKRNQELFFGNLHIQPTDTVLFINGLFFDLDTIDILGLLETLRAELTVMETLHKIGVSSSKMEKLLALDLSGSHSSDNNQDFAIDIRDSAVIWVNDLENDSRYNRWSPSLTSLLRPTFPGMLRNIRRNLYNLILIIDPLSPLSKPLIATAETLYAHSAPIRVGFVFNTNFDPSLTGQSDPSIAVNNAFHYLLESKSAKEAVYFLSVLLNDIEKRKSSGNNDNDSSENGVEVSDVVKALRSRDPSADVDDIFGENSDYDVGRPWADDFIRRTGFKVFPQALLNGVPLEGISSIVDGESLEDIILKMIFSQTPMLQKAVYKGEVTEGDDIVDFMMNQPNVMPRLNERVLKNDKTQWLNLVGEVPTTEDVSTWGPEDTSAWIIKNSNYLYMPRRKKSQHLYTYWIVTNLEHPDGRLLLREALEYLKSNADARLAVILNSNVDQDDSVNISVNKIVLSVLSADYPAENHNKIIRYIQEVIGEKNAALIEKGEFDRSKYHEHIGTDFDENANHEFMLKVHKHFANIVLRMDESSTTQRAVICNGRIIGPLDDGENFSNQDFALLERFSHSTYGEKLITNLEKIHASDDEEEQDISDDVIMEIASLLVPRLQTRSRYEVLSGGEDHSVVKIPASNPDQVAFNIIAIVDPVSRGAQKLGTILNTLQQALNCNIKIFLNCVDKNSDMPLKNFYRFVFEPELQFNSDGQLVGASAKFNKLPTSSLLTQNIHAPDNWMVQVVKSVYDLDNIKLDNVAIGVHSEFELEYLLLEGHCFEATMGNPPRGLQITLGTETHAMVDTIVMANLGYFQLKANPGEWILRLRHGRSAEIYNITSVDGHDVIQNGNGVRVLISSLKSHVLKLKVTKKSDKLDMDLLAEDDDKKSGIWNSISRTFGSDDAEEQEEKINIFSLASGHLYERFLKIMMLSVLKHTKSPVKFWFLKNYLSPTLKDFLPHMAKVYGFEYELIQYKWPRWLHQQTEKQRTIWGYKILFLDVLFPLDVKKIIFVDADQVVRADLKELVNLDLEGAPYAYTPFCDSRKEMDGFRFWKQGYWKTHLQGRAYHISALYVVDLKRFRRIAAGDRLRGQYQALSPDPNSLSNLDQDLPNNMIHQVAVKTLPQEWLWCETWCSDASKKYAKTIDLCNNPMTKEAKLQAAIRILPEWTGYDEEIKALQHAIENENKQTDKEEKVDSDDQTKHEEL

SEQ ID NO: 4376 - protein, 1135 aa, Rhizopus azygosporus
MGNDIISGVYDVRDTPENPFVIWWNDIEKDTRYEDWPSNIMEILKPTYPGQLHPIRKNIYNLLLVEDLASTASLSRIVNEIQTMIKRTIPIRFGLIAFVEDDNSASTLMARALYYFIKNNGKADAIQFLETILELTSSNGLDRATTEMIERAFNGHMSISHENLNSEQVIDQSQAFITATRQFMKRMGISQLKPNEGIMFMNGKLLEFDEERPWIHSLMPHLTEQTRFIQTMAYNQEFDPDLDYYEYTLSQPNVVQKRNPYILVSHTNPLRMHTFDAITASKGLKYFQNDNESLVKTNLWVVSDFDTANGLKLLLEAILFAEANPKVRVAFIHKSIHKVSTKDTNDTKFSDLLCKLIYEQDTNLTTLKEILQNTNLFAGIDGYSSQNPGEVTIQINGDGLEPVPIIPGTPITEMVAKAQREKWSNLNTALVKDGLEPDFTGIIMNGRVIGPLSLSENIQFTNQDFEILYQYENTKRIMHVEKAIVESGKDLQNNTSDAVMKLTAIIENDKAQATQDAIESREPVHRIRQYQKIPRTQYTQFIAGGYSDDTFLEIGLIIDPLSEAAQKIAPIVHTLSEIEGVSVVTYLNPVSTLQELPLKRFYRYVFDKEPHFDTITGEKQVPTAYFANLPVKPLYTLGVETTNAWHVTVKEANMDLDNILLTSIPDNQHGVSAVYELQSILVEGHCLDSINKSPPRGLEFELISPSGLDKKDTLVMANLGYFQLKASPGIWKLALREGRSSSVYSIQDVGANGKWNWNTEFNGSKGIDDTLALISFEGLTITPLVHKNPGMEDEDVLEPAQPKSKKNAGGLWSSINQKIFGTKETENASSLANKATNAEINIFSVASGKLYERFLSIMMASVMKHTKSTVKFWFIENFLSPEFKDFVPHMAKEYGFDYEMVTYKWPAWLRAQHEKQRTIWGYKILFLDVLFPLSLDKVIFVDADQIVRTDLKELIDMDLHGAPYGYTPFCSDRTEMDGFRFWKEGYWKNHLRGKPYHISALYVVDLVRFRQLAAGDRLRAQYQQLSADPNSLANLDQDLPNNMQHIVPIYSLPQEWLWCETWCSDESLKKAKTIDLCNNPLTKEPKLDRARRQVPEWETYDKEIDELRKRITAGGSSSLPKQDEPSIKKHLKDEL

SEQ ID NO: 4377 - protein, 1585 aa, Dictyocaulus viviparus
MIHVILLNERRQDVAIGADYAISCMAFFDVHGITGCEASELEHAVKIAYESFSKANVGIFQFRDAPKLLSVDHVFEFGKDAKVITIIYGEVGSKAWLRLHEKVLELAYAQQTQYVLRHYSGIISSVRKVSLSGYGVELAIKNTEYKAVDDSNEKKEVEFDEENLHGFNFKRLKELHPISTDFLDAFRMHLKEIQELAPLKQWQVQDLSFQASQSIINSGAENAIETLKQLSQDFPRHARSISRVTVDDFTRQEIEINQKQYLSGASLEPGDSALFINGINLDIDSLDAFQLVDIIKQEERLSSGFFNMGIKREYLSILVNMELSEEKTNYAVDYRDAFPFFLNNLDTDKRYKHWRNSVKLLLEPYYPGMIRPIARNLFTLIFVIEPSGESSRNLLKIAYAFYKHEIPLRQAHFILGNASGINDSGVAVLNLFNYLAVESSYHEALRLVNDMLDDYRTYETIDPVHIKTWFEANYGDALYEDIFGPKSDYDSGRTNGMEFLKRSAIGKTPKVLLNGYVLDDAGISGDKFEETVMLEVMRITPKLQDAVINGQLQDKMNVGNWIMEQKDVVPRHNLRILGAASEKRILDLAELSPCEAKTTSEFINLSVSMKTQCILSKMRYLRKTDDVSTLSLTLWIVADLESAKGRDVVYNAIKHLRHSRKTRLGIIMNPNNITNACDKNSISSLVQSAFRLLPRSQVKQLVTKLMKSEFADALRKGTKNLEDVAVGGMDLNKFDKERNFISCDDIKMESVFVREVIGFKSGQSGFVANGVIFGPFDEQSDDILESDVELIERIIESRGASVIVSFVDKRKIDVDISPSDIVMRSFALVLKHAVMRKRIRVVLGSEKHSTVTLTAEESQRGIMDIVAVIDPLSRSAQKLSSLVELLRKAVNCDLKIVLNPKAKLSEFPLKRFYRYVASPELQFDKFGDIVVNQARFANLPSRQLLTLSIHSPDAWMVENVYAECDIDNIKMEQASSDVVALFSLEHILLEGHCFDEVTGSPPRGLQFVLGTSNYPTQFDTIVMANLGYFQLKANPGAWLLQLREGKSRDIFEISSYINAERSEGEAIRVIIDSFSGRTIRVRVSKKIGMEKRSLLSDDSDDGDNFWSSISSSLTAEKHETINVFSLASGHLYERFMNIMMLSVMKHTQKPVKFWLLKNYLSPQFKVCSSLRTSTFRSSTDFQRNLPVLALEYGFHYALVEYKWPRWLHQQKEKHRVMWGYKILFLDVLFPLDVQKIIFVDADQVVRADLMELMELDLGGAPYGYVPFCDSRKEMDGFRFWKQGYWANHLAGRRYHISALYVIDLQKFRQIAAGDRLRGQYQGLSNDPNSLSNLDQDLPNNMIHQVKIKSLPQEWLWCETWCDDASKAKAKTIDLCNNPLTKEPKLDSAIRIIPEWKDYDKEIKNVLIKVGQKNRSNTLEHSELPVLLMSTRRLRIWQPGNPQNFIFLPDFWLAVVDGHNVGRNKLPKNCVKFEVDPRMTKHDIKEYLRRIYNLPVRNVRTEVKMGDISWSTPADFQYRKAMWKDNDKKFAYVYMSKDFEFTYPSIFRQDVETEELEKFKEQQEKLSVNSTIVNRDRMKVGEFFGI

SEQ ID NO: 4378 - protein, 1750 aa, Opisthorchis viverrini
MATHGQLFLCLVLLLNVVVCKNNRLSVTLQAQWSDTSIISEASEYVAEESTDSFWKFVDILEPVVSSHHWQTAITNAGTSEFLVDVDTYVQLENLVLDALGSGGKTSDQVRTKQRQLFRLFLSSRTYSPSVEMMQQLAITSASQIFNCSQQSAVDRLVSCMSGSSWAQVGAEVVCDIAELSRALEKANEGPVESGTISVTLSREKTFRSNGAKPTRTPPTVVLYGDLGKPDFYTWHKHLKSLTEKGLCSYVFRHFKKFPSKNKAVLSGYGVELALKSTEYKAMDDTKVEEKSSNKEALEAPEDAIVQGFNFTQLRLNHPDLDSQLREYQKYLLSTDEELRPLKVWQFRELNLQASQAIVDASRQAGSDTGSVLHPGLAALRDITQNLPSRAGRLVSMTVDSGLRSEVANNQLLLSAAEIQPGQTTWFINGLLLSPTVDVFALLDLLRHELKAMSRLYNLGVPAGRISELLTMTGSFSQSISDTNSAAVPGLRYSLSGRFVLDLSNSPVMYLNNLESDSAYATWPDSLQMLFIPDFSGGIRRIRRNLYNIILVLDPGSTECQEIIRLAESFLLHRIAIRFGLLWSVDSSVKSVSLILVRMFTYISSTVSHFGESPLPVGVSGLGSPGPMTALSFLTELYSEAERTKKELTIKFIQQRFEKLFPNADVEEIISPEAGASEYDSQLHLHHEFLSRSGLSTIENAPPLLLFNGIILDRVGLRKMGGFEDAVVTLCMEEMVNVQHAVYHGQMSTTDTVFSLYQKRNSVVPRFNPRILATSATATARYLEFGIESPRRSTSDGPPTSSELLTFFVDHMRYLQKGDLESAVRPVTVWIVVGDLDAIFDNPQDSPRRSQLEHDLGLVRTAVTHLRSTHASKDLRVGLVYNPPIDSWESPSSSSRWLARVLHLIGHPVRVPPGTDSPRLLEPRMKLMEQMAARNFANKLIKEALEALNSSSVLRPLSELVVSGVNIQTLETALQALDRADFLHGHSVFCQQILGFKPGERGVVINGRIIGPLNPTEEFTVDDFRLIERMTLDTGVKDLGNTLLDFAGEELGGPEAISELTWKVSAMLPIYKETSSTGITDIDTVEGILSKNRVRLKELSINHSGFFIPSDTGELAFDVLAILNPGSRDAQRLSHILAVVQQALPCNMRVVFNPVEPISELPVKNFYRFVWEPSIFPFESSISTSVLNKDPIVPRALFAHLPGQPVLTLGMDTPHGWMVAAVEAVHDLDNLRLADVHSVVEAVFELEYLLLEGHCFEQNSMKPPRGLQLTLGSASDLERHDTIVMANLGYFQLKAGPGLWHLNIRAGRSREFYTMADDEDVGTSLGSFGLLTTIDSFRSKIISVRVTKRPERMAENLLDESEKATPKKPEESWSWLYKNSQVWSTLSDYAEAFCPSWLTSLRKSLQTHVPWQKCSHKVETINVFSLASGHLYERLLRIMMLTVIRHTKSPVKFWFLKNYLSPTFKDFIPHMAAEYGFEYELVQYQWPRWLHAQTEKQRIIWGYKILFLDVLFPLSVTKIIFVDADQIVRADLQELVNLDLQGAPYGYTPFCDSRKEMDGFRFWKHGYWANHLAGRPYHISALYVVDLTRFRQLAAGDRLRGQYHGLSQDPNSLSNLDQDLPNNMIHQVPIKSLPQEWLWCETWCSDESKARAKTIDLCNNPQTKEPKLSAAMRIAPEWVGYDREIKNLWKRVYSTSGSSTESATSDKEAVVSSPSIPTEPPEVHSDCEGFFVHCIDLISFTPEIVFLCFF

SEQ ID NO: 4379 - protein, 1500 aa, Millerozyma farinosa
MIIETTRLAKIGLVILILNTFYVFSKPYDDKGERNIHVSVETWEKSPFKIRLLEGISGFNESLYLETLQFLSGIGSDEYEDESDEEALESDQSTDKQVYEGLFKKLALSKEEKSIIDFNIVYNKFSPRVKAHYDYYTQHLSPEHRIKLENRCTKDSFGSSVIQNDGRIDSWLEFDDKIYCSVDDLFALQTSKKKTEEIEPFDRVIGTNVKAPLMVLYGDIESPKFLMMLKYLLKEAENQKLRFVWRYIPPIDASKENMTGYGAFLPTSTNKNTVSNIGKKGKIDRISLKKNFDKIAKSESVKNLDQDDLKDLGTKIVSFVFDRTKSMHTRYSDLVKILQDFPKYASHLSSWTAANMKGIKEHMAVNEKLGLSKESIGLYINGSPLNKLELDVYKLADKILDELKLSKSLNRLGFSVNQTKKLLSKFALMSAVKEHQYRKGNTLLGNNENRFRVYKYRTDDNFYKGGVFFFNDIEKDKAYEKFDTDKSQAYSQESIRSLKPGHVPPLRENIHDVIFALHLSEKSQLRTFLTLARFILDEQFPMQVGIIALPGSEKDNHLAKLLYFLAAKTNPVEIYAFLYKYHEAKNQIEEDELLSKFSDFIPENVNDDIYLKTLKRFDIEGPSIVINGVINSLDDKWHLYLRNQIMQDVKFLQFYVENNMYSDESLKSIIYNNAKSKRNLQIIPRDPSEIKYKQITEKLLHHSYRLKRKGVSNDIPASLWVIGDLNTKEMKDQLIESLLFLKKAHNFPAQLRIISTAVNPQFDNYMKKMSSESLNEQAIDLLISKIESNSFDETKSKPNEEMLSVLDESNLPSSHLYLLFNSRYIRVLRTLSSAELLEVFEYEKSQRLGQIRNIVNEYSTVFSYKDLQDFVPSDQDFLDWFDLLSSHLTNSFHLDDNMFVNDVARYDFSSLDFHNSIFLQADERDGPIDVLLIIDPLDEDSQKYVSIVQSVMDFPFLSVRILLQSVDIDLKMNSRFYRGLYPRSTPYFIDNKLSVMESAIFDYVPVGETYSSSLDVPIRQIVMPSFVEPGIDINSIKPSESTNNNISIIYQLERILVEGFARNVVLDVPASGVSLSLENRVTTKNAVVMSNFGYFQLQAVPGAWKISIFSAEDAKDDFVLLSASKKRFNSNTKPISDAAVNVFSLDGELLRVRLAPDEGLQGSKKSANKDSKKSKGGISSLFKKEVPAHADINIFSIASGQLYERLMRIMMLSVSKNTDSSVKFWLLENFLSPSFKNSLPLLAKECSFEYEFITYKWPNWLRYQSEVHRAVWGYKILFLDVIFPQSLDKVIFVDADQVARGDYKELVDMNLEGAPYGFVPMCDSKREMDGFRFWKQGYWSQVLKDDLSYHISALYVVDLKKFRKISAGDRLRNHYQKLSSDPNSLANLDQDLPNNMQRSLKIYSLPQEWLWCETWCDDDDLLTAKAIDLCNNPLSKESKVDTAKRLIPEWTEYDNFVEGLLEHAKTSTYTSQYPGPSSSSTNAKGDAEDSDEIADAHDEL

SEQ ID NO: 4380 - protein, 1497 aa, Aspergillus ellipticus
MMASGTGLVASWRLTFVLIAALLASLGRASPSVNVALQASFDSGPYLIELLETAAEENSTSYFPLLDRIAGGAFDDAVSDKELYDRFLEVVHEDGHLRTPESLSSFKVSLAIRSASPRITAHYQFYNASVQHSLMAAQDAACPVWVHSDGKQYCSSTMERAQQDVVGSDDPRELPFDRIFGDTSLPPAILYADFASPMFKDFHQSLSALAKEGQISYRVRYRPPQHWRSRPLFVSGYGVELALKRTDYIVIDDRVAEQRGADKGGSKKSDDAESDDLDDLRPLSSSEVSKLGLNAASYVLGSDDPFGTLLKISQDFPKYSARIAAHDISEELLQDIKASRLRMLPPGLNALWINGIQIDPRQVDAFTLLDQIRRERKLIEKFRNLGLSAKEAVELLSHQILGQALVQDGPQRYNYRDEIEGGGVIMWLNDLEKDNRYESWSSELAGFMQRTYPGQLPAVRRDANNIVFPVDLTSAEDADIIVKTIQVFVKNKIPVRFGLIPITSTDGAAAQFKVAHYLQDTFGLASFMKYLETSAVKNKFASPDKASFQAAIQGRDVRPERQSLSLEEVLKSDELDVLVTRATAYMNRLGMKNKASHAFVNGVPVTRNDNWAQEMSTRISRDTQQIQQWIADGEVDEDTWLPSMFLSQAFDRRNPALIPEDPKEIRAVDLVKVADSQRDLFGQLPGLASDGKNVLESAHVIVIGNFDKDPGYELLTAALESHKENSEAELIFLHNSKSEAPSIGRSAAIYRSLKGEKEADVTQVLNDIANSESPSIEEAQNIAHFWETQQGLVEELGLSPGSRALIINGRVIGPIAEDITVTSNDLDQLLAFEKDKRITPVAKAAKELGFDEKLSGPLAFAQLTSLTTLSTISDVPEGINDATSDIRLYLFNRWNDSLSAITVSSSEDPAITIVASIDPTSEVTQKWLPILKVLSELASVRVRLVMNPREELKELPTKRFYRYVLDSQPSFNSDGSVSRPTASFSGVPVEALLTLGMDVPSSWLVAPKDSIHDLDNIKLSSVQDGSDVDAVYALEHILIEGHSRDMTTKAPPRGVQLILGTENNPHFSDTIIMANLGYFQFKAQPGLWNISLKPGRSERIFTLDSVGGLGYSPQPGDENTDVALLSFQGKTLFPRLSRKKGYENEDVLETGPKPGSAMDYVSKGFNFASDILSSVGVGSKDGKQADINIFSVASGHLYERMLNIMMVSVMRNSPNRTVKFWFIEQFLSPSFKSFLPHLAKEYNFSYEMVTYKWPHWLRAQKEKQRQIWGYKILFLDVLFPLDLDKVIFVDADQIVRTDMYDLVSLDLEGAPYGFTPMCDSRHEMEGFRFWKQGYWSNFLRGQPYHISALYVVDLNRFRALAAGDRLRGQYQMLSADPESLSNLDQDLPNHMQHHIPIKSLPQEWLWCETWCSDESQSQARTIDLCNNPMTKEPKLDRARRQVPEWTEYDDEIAALSNKVALEQQQQQQQQQVEQEEGEAYIDEEDEESSSGWDKDEL

SEQ ID NO: 4381 - protein, 1447 aa, Candida albicans
MSFARYIYYTIAVAVLLNFVKATENNNFKLELEASWSNIDFLPSFIEAIVGFNDSLYEQTIETIFGLGDTEVELEDDASDQEIYSTVINSLGLTDQDLDFINFDLTNKKHTPRIAAHYDHYSDVLTKFGDRLKSECAKDSFGNAVETKNGQIQTWLLYNDKIYCSANDLFALRTDLSSHSTLLFDRIIGKSKDAPLVILYGSPTEESTKDFLKILYPDAKAGKLKFVWRYIPSGIKKSDSISGYGVSLKMEKYDYSGAEGNPKYDLSRDFTRINDSQELVSVNEKHSYELGVKLTSFILSNRYKSTKYDLLDTILTNFPKFIPYIARLPKLLNHEKVKSKVLGNEDIGLSQDSYGIYINGSPINPLELDIYNLGTRIKEELQTVKDLVKLGFDTVQAKLLIAKFALLSAVKQTQFRNGNTLMGNNENRFKVYENEFKKGSSEKGGVLFFNNIELDNTFKEYTTDREEAYLGVGSHKLKPNQIPLLKENIHDLIFALNFGNKNQLRVFFTLSKVILDSGIPQQVGVLPVIGDDPMDSLLAEKFYWIAEKSSTQEALAILYKYFESNSPDEVDDLLDKVEVPEDYKVDYNHVLNKFSISTASVIFNGVIYDLRAPNWQIAMSKQISQDISLIKTFLRQGPIEGRLKDVLYSNAKSERNLRIIPLEPSDIIYKKIDKELINNSIAFKKLDKAQGVSGTFWLVSDFTKSAIITQLIDLLLLLKKKAIQIRIINTGDTDVFGKLKTKFKLTALTNGQIDEIIEILKKSNASSANNDELKKMLETKQLPAHHSFLLFNSRYFRLDGNFGYEELDQIIEFEVSQRLNLIPDIMEAYPDEFRSKKVSDFNSVLSGLDNMDWFDLVTSIVTKSFHVDEKRFIVDVNRFDFSSLDFSNSIDVTTYEENSPVDVLIILNPMDEYSQKLISLVNSITDFSFLNIRILLQPRVDSKEEIKIHKFYRGVYPQPTPKFDSNGKWIQHYSAQFESIPSNVTYSTELDVPHKWIVVPQSSSMDLNTINFSESHSVDAKYSLKNILIEGYARDIHTGKAPDGLIFRAFNKNYSTDTLVMTSLDYFQIKAYPSIFNFSTTSNDTLLSASENKYQANTEELESIEVPVFKIDGSTIYPRVMKSGNNKPMSTRKHADINIFTIAGGQLYEKLTSIMIASVRKHNPSSTIKFWILEDFVTPQFKHLVELISIKYNVEYEFISYKWPNFLRKQKTKERMIWGYKILFLDVLFPQDLNKIIFIDADQICRADLTELVNMDLEGAPYGFTPMCDSREEMEGFRFWKEGYWSDVLKDDLKYHISALFVVDLQKFRSIKAGDRLRAHYQKLSSDPNSLSNLDQDLPNNMQRSIKIFSLPQNWLWCETWCSDKSLEDAKMIDLCNNPLTRENKLDAAKRLIPEWIEYEQEIEPLVSLVQNNTAKEVVQEIEIDTDGEQEEQKQESNDDDFIHDEL

SEQ ID NO: 4382 - protein, 1600 aa, Erythranthe guttata
MGRSGFCFLILIVFCICLSGHSVSAQNRSKPKNVQVALRAKWSGTPLLLEAGELLSKEWKDFFWDFIESWLHSDNLDTESSTAKDCLKKIAKFGKSLLTEPLASIFEFSLTLRSASPRLVLYRQLAEESLSSFPLTDDVAPKTIEQNETAKTLTSESFLSGSNLKSPGNKCCWVDTGGSLFFEVVDLLTWLDTPNDVTDGAFQQPEIFEFDHVHPDSTAGSPTAILYGALGTECFKEFHKVLSEAAKKGRAKYVVRSVLPSGCESKTTSCGAIGTKEPPNLGGYGVELALKNMEYKAMDDSTVKKGVTLEDPHTEDLSQEVRGFIFSRILERKPELTSEVMAFRDYLLSATVSDTLDVWELKDLGHQTAQRIVHASDPLQSMQEINQNFPSIVSSLSRTKLNDSIKDEIIENQRMIPPGKSLLALNGALINVEDIDLHSLVDMVHLELSLADQYRKLQIPPSGVRKFLSVLPPSESYAFRVDFRSPHVHYINNLEEDAMYKRWRSNINEAIDTIISLFENNLPMRFGVILYSENLIEKIEENDGELPVAHLKDDQDDISSLVMRLFLHIKENHGALMAFQFLSNVNKLRVESAAEDSLEMHQVEGAFVETILPTATSPPQETLLKLEKDQTLSELSHESSVFAFKLGLAKMGCSLLMNGLVYEPNEEALINAMNDELPRIQEQVYYGQINSHTDVLDKFLSESGVQRYNAKIIADGKVKPKFVSLCASILAKESILNDLYYLHSLETMDDLKPVTHLVVVDMTSKKGMKLLREGIRYLISGSKIARVGVLFNANKDATLPSLVFMKAFELTASSYSHKKGVLQFLDQLCSFYEQEYILASGDTKSYQKIIDKVFQLADANGLPSNAYESSLSGFSAENLRSYLNKVAQFLFRTIGVESGASAVVTNGRVIQLLEGSTFLSHDLHLLESLEFKQRIKHIAEIIEEIKWDDVDPDVLTSKFISDVVMAISSSSSTRDRSSESARFEILSAEYSAVIMQNEHASIHIDAVIDPLSSSGQKLSALLRFLSKYVQPSMRLVLNPVSSLADLPLKNYYRYVVPTTDDFSGTDHTVNGPTAFFSNMPLSKTLTMNLDVPEPWLVQPLVAIHDLDNILLENLAETRTLQAVFELEALVLTGHCSEKDHEPPRGLQLILGTRNTPHLVDTLVMANLGYWQMKVFPGLWYLQLAPGRSNELYVMREDGEGGQDSTLSKQITIDDLRGKLVHMEVKKRKGMEREKLLVPVDDDDSHSTTKKGSQNGWNSNILKWASGFIGGKDQSKKEPNSSLEPRSGGRYGKTINIFSVASGHLYERFLKIMILSVLKNTHRPVKFWFIKNYLSPQFKDVIPHMAHEYGFEYELITYKWPTWLHKQKEKQRIIWAYKILFLDVIFPLALEKVIFVDADQIVRTDMGELYDMDLKGRPLAYTPFCDNNKDMDGYRFWKQGFWKDHLRGRPYHISALYVVDLVKFRETAAGDQLRVFYETLSKDPNSLSNLDQDLPNYAQHMVPIFSLPQEWLWCESWCGNATKSKAKTIDLCNNPMTKEPKLQGAKRIVTEWPDLDLEARRFTAKILGENIEEPQEQIAPPHQIESTNEDSSEDNESKAEL

SEQ ID NO: 4383 - protein, 1528 aa, Cutaneotrichosporon oleaginosum
MKWLAAALAAATALAAPPLSVSVETAWSAPPLLLEILEVAYDESPTSYFDVLHLLSFHLAPLSLTPQATLERATSLLDNHGLLTAERDTFRLALGLHTAAPRIAAAFSANDEDVGCASWVQFHGHVYCDAEELARAVTHGIESADYVPSPIEPGPFDRVRGAEPLSAVLYYAPTEASLPFLEFLDEFHAAHPQFSYAVRYAPQAGEERTKLSGYGVEMALKKTDYLVVDDRQVKASGSAEEYKQQDPFEDVLGADPWNEPALRKGEAGKIGIAATALIKAASNPMSAFVSLTQDIPKYAAALARKVEVPASIRKRVLRLGFKRPLGPALYINGRAVHERDLNAFSLLSIVRRERHHINSLMALGLSSKQAYELLSDKLIGEAATDVDPLEGLVDASDRAEGGGVVLYLNDLEKDIAYSRWPDSVQSFLRPLYPGQLHYVRLNAWNAISVLDFATMRGAETLAGSIAQLVQRNVPIHMGVVPMFDSPDSPSAQMARVLYYVADMQGATSVQQLCSAIVMANSGVKAKNVDLSVVRQLYGQMHAQATQEGKELLSFDEVLASPELGERLNATKAYLERLGATPADSATGHVFINGIHSPMHNQWTHQLQGVVSSQLGYLQEALQAGEGPTKETIGTFFYDLPTTSKRRNKVIIPSPDNDLRAYSVLDVFDGTAMVLAKQFIYPVDASRATPLSVWVVGDLDSKEGHALLEGALRNIDREGGATRVSFVHVPDEASKNVPGPRLSTLLFQLTAKNEHSSVQAEGLLDMMEEVSRIRTNLVDVGEIRAHSDPDAPLNSFLAEGWSSPDTALAAEFWSTVGPQVADKLGLKGLGLLINGRIINAKHFTTDDFAALEAYELRKRVQPVVNLLKTYVGADTPRDDFGDMVAVASSVIAAAYMPQGSEGIWVQQQAGRSRDYEGIDEGEISFSVGNKEDALVRVAAVLDPVSEEAQRWSALIQWLSSLDSVSTTVWLDPDIQAEEFKVKRFYRSALRTSLTFDVDGNEVLPAPTFHGLPSTPIYTLGMEVSPSWIVSPKDSPLDLDNILLSTLSAPTTVAFDLKLLVVDGHARESASAPPRGLQLQLSTNETVSDTQVMANLGYFQFKARPGVYDFAIRPGRGREVYEIESAGADGWDSPPVNVSGTKIRLDSFDGMTLYPRFTRRPGMEDADVLASPETSVSVVGGIVSKLKSLVGIQEVKPASRHADINIFTVASGLLYERFASIMILSVLKHTDSTVKFWFIENFLSPTFLRFLPAFSAKYGFEYELVTYKWPHWLRAQTEKQRIIWAYKILFLDVLFPMDLDKVIFVDADQIVRTDMKALVDLDLHGHVYAYPPMGDDRTEMEGFRFWKTGYWAKELQGRPYHISALYVVDLVRFRAQAAGDRLRGTYQALSADPNSLANLDQDLPNAMQRQLPIYTLDRDWLWCQTWCSDESLATAKTIDLCQNPLTKEPKLSRARQIPEWDSYDREIAEFAATLGDGALAANVDDLASGPGGAGAGAVGGAQPDAEQGEEQPPEAEEAQAPLGDRGKDEL

SEQ ID NO: 4384 - protein, 1499 aa, Acanthocheilonema viteae
MESLLLVIILLAFPSVINSAVSKKSVIVSLRAKWSQTSLIAEASEFMAQESDSLFWAYIDKIVEKLNVDEWHTYSDARQHDLSVRLAGSLLQEARVNLLKFALSLRAHSPTVLLFQTLGAERTKTCAAFADVHGTIICNVNDLEKVIENDVRGPAPTVYSIDHVFPATKEHNVTLIVYGELATASWRKFHLAAKALSRSGKVKYVLRHFVKDIRDDKLLLSGYGVELAIKSTEYKAVDDSSTVIDKVAMEENSEEYTDNEEDNFGFSFGTLRRLHGDLKESIEQFRLHLLERDELTPLKVWQVQELSYQAAQRIVQAGPQKALNIMMDSSQNFPLAARSLSRQIVRKEFISEVNANQEQFMEYGVSEGESVFLINGIMVDVDALDVFQVLDVLKQEEKLANGFFRMGIKNEYLPMLMDLELSNERISYALDFRPASPEYLNNLDTDKQYRQWANSVSLLLQPYFPGMLRPIARNLFTLIFIVDPSQKETRDLLQYALRFYAHEIPVRLGVVFVANDEKEITGFDDASVAMLNLYNFIKISNGIQKALNVLIEVLDGKEKSVSPKDVLSYFQMHYPNHDPNSVFGSNSEYDNGRSIGYKFLHDSGLGFTPKVLLNGVILDYSGITGDHFEETVMMEIMRVTPRLQKAVMEKKLKDQDNVMNWILSQPEVMPRINKLILDSPLSPDALYLDLTSIEKCTNISPTKYHKLPPEKHSQCMLKRMRYITRTEEMKTHFSTVWIVTDLETAEGRLLAYNAIRHLKRSYTMRVAIINNPKNIEAATISGSITMLVNIASRLLTARQMKSFITKLVKEEVVSKLLDEQVTLDDLAVNDMNMTLFYKESKQINSDEIFADAKYSRRVLGLKSGQLALVVNGLLVGPFGDDEVLDVADMELVDKLVLLRGGKVIGDYVEKWKIQTRHGESSDMVARIMSLIGSIGITKKRRFIPLSGEKESVLTVSGNKKEGLILALCIVDPLSTQAQRLGHLLTVIQKVVNVEVKLVMNPRAKLSELPLKRFYRLVLQPSVMFDDSGRIADSAYEARFTALPSKQLLTLAVVPPDAWMVQSVYAIYDLDNIRLENVAGNVIAKFELEHILLEGHCFDDMTGSPPRGLQFTLGTLANPNRYDTIVMANLGYFQLKADPGAWILNLRDGKSKDIYNIVSHVNTESEDETGVNVLIDSFSGRTIRVRVAKKKGKEKENLLNEGKSEEESEDYHSVWSSISTISGGEKHDAINIFSLASGHLYERFLRIMILSETLPQMASYYGFKYEFIDYRWPRWLHQQTEKQRVMWGYKILFLDVLFPLNVRKIIFVDADQIVRTDLMELMEFDLGGAPYGFTPFCDSRTSMDGFRFWKKGYWANHLAGRKYHISALYVIDLVKFRQVAAGDRLRGQYQGLSVDPNSLSNLDQDLPNNMIHQVRIKSLPQEWLWCETWCDDASKEKAKTIDLCNNPQTKEPKLDSAMRIIPEWKDYDAEIKALLDERSKKHTEEARRSEHEAVDEHAEL

SEQ ID NO: 4385 - protein, 1781 aa, Fasciola hepatica
MQPWFYLVVALSAASIIWAKNNRVSVVLRTNWLQTSLFSEASEYAAEEDLGSFWRLIDHVQPIVKEKNWPENLHASSSNELGLDAESYLQLEDAVIRSVVPPANVSDQTTVAFHRQLIRLFLSSRSYSPAVEMAHQVALTTASQLFNCSHNDAAQRLSECMTGTTWAQVGDRIVCQLAELPMAIRARISRPMDFGFLPREKFYPVDAEESNLKSPCVILYGSLDQPDFYDWHAQAKASTEQNNCVYVFRHYMKIRPEGKVRLGGYGVELALKSTEYKAMDDTKVDNAGDTSGNLADSPVDPVVQGFNFTTLNELHPDLKEQLKAFQKHLFATDDEIRPLKVWQFRELGIQTAQAIMNGFRLGNSSSEINTGLETLRDVSQYLPARAGRLVSLKVDPALREELSTNQYVLSNLGIQPGQTMLFINGLLISPSVDIFALLDLLRHESHLMLKLHKLCIPANRIPQLLEASSSGGQLSDGNSNDPAVPGSKYSLSGKFALDLANAPVIYFNNLEVDLAYSNWPNSLHTLFTPDFSGGIRRLRRNLYNVILLVDPASEDSRQMIRLVESFLVHQTSIRFGLLWAVDSTATNSASVALVRAFTFITSTVSSTRDSPLPLSVPNLGSPGAMSALSFLTELYSQAEKTNTELTVSLIRRTFERLFPSAHSEDVFDDEFGQGDYDSQLKKHQIFTELSGLKGIGRIPLMLFNGLVFDTTGMRQMGGFEDSVVTLCMEEMIRVQHAVYHGQMSNSDNVFVLYRKSNSQVTRFNARILSTRPQDIKYLDVVGSGSSPSARGPYDVQSFLNNMRYFQKGDTEVAIRPVTMWVVVSDLDAVFLTPKERQIHEKQLGRDLNMVRSALTHLRSAHASKGLRLGIVYNPSTVKKTAIPQTAWLTRALYLVGHPVRSPGSTEKLVKHADQMAARNFGIRLLTGALDAINASEKYATMESMLVSGIDHIVINKAIEAVDRDQFIETHAAFCHNSLGLKPGQRAIVINGKIIGPLDNNELIMEDFRLAERITLDTGARELSETINTLMGSELGGPEVVSELTWRISSILQPRLESADPIIGDADAVEGIGSKSRIQIKGLTLEHAGFELPVVTPEPAFDILAVVNPASRDAQRLSHVLVVLRQSIPNSMRVVLNPIINLPELPVKNFYQFVWEPSPFQFSRSQGSRELISSNPVIPRVEFSHLPGQPILTLGMDAPHGWMVAAAEAVHDLDNLRLADVYGSVEAVYELEHLLLEGHCFSEGSMKPPRGLQLTLGPASDLNRHDTIVMANLGYFQLKAGPGAWHLRIRDGRSRDLYTMAQGENIRQVDVNTTELITTIDSFRSKIVIMRVSQRPERAGESLIDESGLKSTTTTARSPWNWLSRQTQVLSKLSNYAENLCPSWLSELARSLQSKLPWQTCHRMEETINVFSLASGHLYERLLRIMMLTVIRHTESPVKFWFLKNYLSPTFKQFIPHMAKQYGFEYELVEYQWPRWLHSQTEKQRIIWGYKILFLDVLFPLNVTKIIYVDADQIVRADLQELADLDLEGAPYGYTPFCDSRREMDGFRFWKQGYWANHLNGRPYHISALYVVDLHRFRQLAAGDRLRGQYHGLSQDPNSLSNLDQDLPNNMIHQVPIKSLPQEWLWCETWCSEESKQYAKTIDLCNNPQTKEPKLSAAMRIAPEWVDYDREIKKLWQRVNPSTKPKASISEPSSSSSPPPPTTTTPGTPVSTGSSPEKARPFPPPGSETRDSEQCSSSTCSADTKPAAFKPPISARTPVSEPRTPEAKSEHEDKRSIHKIEL

SEQ ID NO: 4386 - protein, 1497 aa, Aspergillus sclerotiicarbonarius
MVPGIGAVASWQIASVLIAGVLANLGRASPSVNVALQASFDSPPYLIELLETAAEENSTSYFPLLDRIADGTFDDAVTDKELYDCFLDIVHEDGHLRTPESLSSFKLSLAMRSASPRITAHYQFYNASVQHSLMAAQDAACPVWVHSDGKQYCSSAMERAQQDVSGSDDPRELPFDRVFGDPSLPPAILYANVASPMFKEFHQSLSALAKEGQVSYRVRYRPPQHWSSRPLFVSGYGVELALKRTDYIVIDDRAAEERGTGGVESKKSGDAEDDLNDLRPLSSSEVSRLGLNTASYVMDSDSPFDTLVKLSQDFPKYSARVAAHNISTELLEDIRSSRLRMLPPGLNALWINGVQIEPRQVDAFTLLDHLRRERKLIEKFRNLSLSAKEAVELLAHPSLGEALARDGPQRYNYRDDIEGGGVIMWLNNLEKDARYESWSSELAGFMQRTYPGQLPAVRRDANNIVYPVDLTSSEDAEIVVKTIQVFVKNKIPVRFGLIPVTFTDGAIAQLKVAHYLQETFGLASFMDYLEASASKNKLASPDKACFQAATKDRNARPEKQPLSLDEILKNESSDVTVARTTAYLNRLGMKHEASHAFVNGIPVTRNANWAQEMSKGISRDTQLIQQRIADGELEEDTWLPELFLSQAFDRRNPAIIPEDPKEIRAVDLVKIVDAHKELFSQIPRIASEQDDALDSAHVIVIGNFDDEPGYELLSAALESRKAHGEIEALFLHNPNHETSATAISFTVYRSLTGDKGADVTQSLKAIADPDFPSAEEAQNISQFWEAQQSVVEEFGLAPGTRALVINGRVIGPIAEDIALTSEDLNQLLTYERHKRITPVAKAVKALEFGDKLSDPLAFAKLTSLTTLSTISDVPEGIYESTSDIRLFLFNRWNDLRSAITVSTSEDPAITIVASIDPTSEVAQRWLPILKVLSELASVRVRLVLNPREEIKELPTKRFYRYVLESEPSFNEDGSVSRPTASFSGVPVEALITLGMDVPSSWLVAPKDSIHDLDNIKLSSVKEGTDVEAIYALEHILIEGHSRDMTVKSPPRGAQLILGTENNPHFSDTIVMANLGYFQFKAQPGLWNINLKPGRSERIFTLDSVGGLGYNPQPGDENNEVALLSFQGRTLFPRLSRKKGYETEDVLETGPKPGSAMDYVSKGFNFASDILSSVGVSTKGASGKQADINIFSVASGHLYERMLNIMMVSVMRNTNHSVKFWFIEQFLSPSFKSFLPQLAQEYNFSYEMVTYKWPHWLRAQQEKQREIWGYKILFLDVLFPLDLDKVIFVDADQIVRTDMYDLVSLDLEGAPYGFTPMCDSRHEMEGFRFWKQGYWKNFLRGQPYHISALYVVDLNRFRTLAAGDRLRGQYQMLSADPESLSNLDQDLPNHMQHYIPIKSLPQEWLWCETWCSDESQSQARTIDLCNNPMTKEPKLDRARRQVPEWTEYDDEIAAVSKKFALQQQQQQQQQQQAEEEEMERQSYSDEEEDEKTWDKDEL

SEQ ID NO: 4387 - protein, 1541 aa, Aphanomyces astaci
MMSLMWMGVATVVAAACSSVAESRQVQVNLTTSFLASPLHPVLETSEYLSQDNPALFFTYVAAVDVRYNAIKDKNNANYTKVALEAAADVLPADSSVSRLLPFVLQTRAHSPSIELFNQLAIESAYKACPNQTVSAWAIIYRDAGCADVVLCDIQDFQPSMLHVDEDTSPSSDDSERTCAASGQHDFQLPVDHVYPSPNAAAAATAPHVIVYGALISPSFRAFHSTFVPLAVAGNVHYIVRHAPTDNTLPVLVHGYGVTLHVKNMEYKSFDDSKATSSHNSTATEDDIDADQDEFVVSVLMKKNDEVAQALREYLDGFEGGQGTDDDDEDAKDVTTPAPWQLTQLGYLATQYIMAAEDPLKRLQLLSQNFPKYASSLVLASKPVPQQTIDDINHARSQVATQRLYNRIVVNGLPVDFNEYGFNAFDFLKSLNGELRLADTLAKLDPTGSIKAAMGSLSSAPSDVRISLRGPVDGHAPLYLNSIETDEETAEWPTDLGSLRGPSWSLIYLRKAMYELILVVDPTTKQGINAMNELIFLRNRQAPVQFGVLWTSPELLALSAEERATYAPSVEDKDVATVFHVSKMFLAARANGKSARDKYLREVLSLNDLTVKEVLQIYSQAVGERYTNDDWLQSAKAILTDGDNDGVWAMTNLVAEKNLPINSQVFNGVVRNHVNVQEDIMTHFARDQPLYQTLVRANQITDDSDMLSELLGNEETYAVFCPWFDPEYKPPTTVVQLNWNDPVWKQVGSFHASGTVTKPKRQNVLLLANLDTSVGATSAYHALKRVADFPELRLSVVHTGSPLKDSLGNRIAYILTQLGHTDSTTATAVVLEVLRLMSKKPEADAISHARLFVQSRVDASSSTSDDEQVLSQLSTWLFSAVAPPFSATLPSLSSLQVIPDQHVIYVNGRPLELVAPVTPSLFDGLVAYESATRSKAVSKAYVSQFKHNVLTAEDAADKTLQLNVVLSMVDSYLKTPRVAAVLPDDVQRPTYSYVTPSGSSSLDVVAYLDPLSDTAQRASGILRMLHSVLHAKITLVLVPPPSYDEFPLKRFYRFLWGGTSSSLVEFDRLPRHPVLTLNIETPELWNVQMVQSDVDIDNIQQNASATFTIKDVLVYGQCVDKTNAQYPTLPNGLQLVLERSVAKLHSHKDTVVMKNLGYFQLQAAPGVWQLGLAKGRHSTIYELISNDARVDTVPVIVYDFLSKTLQLEVKKQPGQEGVRLLDDGPEAPKAPAQPEETSVWTSLVQWGAGSSKLETRKGDTIHVFSLATGHLYERMLKLMMLSVLKRTNNPVTFWLLENFLSPDFKNSVAALQAEFGMDIRLVTYKWPNWLRRQTDKQRIIWGYKILFLDVLFPLGVDKIIYVDADQVVRADLKELWTMDLHGKAYGYTPFCDSRNVGFQFWRKGYWKDHLRGKPYHISALYVVDLVKFKRMAAGDSLRAIYDQLSADPNSLSNLDQDLPNYAQHQIPIFSLPQEWLWCESWCSDESKAEAKTIDLCNNPKHKEPKLDMAKRVISGDLFPESWLQLDAEVKAAEAAYELASD

SEQ ID NO: 4388 - protein, 1555 aa, Bactrocera dorsalis
MLTEVVYRTLILVYIIFTTVTGNIASDLPSSHSQSYSVTTLINAKWQQTPLYLEIAEYLADENPALFWDYVNEIVAQQKPIKEYASESNQYLAAINIARNRLNVLQLPLLKLVVSLHSLTPRIQTHLQISNDIYSKSKCNQDTFVQIDTEVICSIDELREKLNSQKEDLEELVTYSFDHVYPGSENNSRTVILHGDFASNSFSAYHKILSKEARSGNIRYIVRHYLVNNSNNNPVRLSGYGVELHLKSTEYKSQDDAPKTHEDTFKNGTDDETEIKGFDFKVLKNRFPTLSASLDQFRYNLLKGNEEITQLKAWEFQDLGLQATRAITEVQGDESLQVLQFIAHNFPMQAHTLLHHKISDALRTEIKHNIEVFGRSLNIIPPDGALFINGLFFDADTLDLGAIVETVRAEIHVLESLHKNNIRGPLAAALLALDLSGASSKEFAIDIRDTAVMWINDIETDPQYRRWPSSVMDLLRPAFPGMLRNIRKNIFNLVLVVDPLNPASRNLIKLAESFVIHQAPVRLGLVFDIRSAEKDTAKDYNSIICAYNYVTQNKDGRSALSFLTDVFAAADATEKVRHTHIRSQFKKTFSSLSGGKIDDILGEDSDYDYGKQLSQEFIERLGFANSPQALLNGVPMQQNLLTSDSEFEEAIFSEIIQQTSTFQKAVYKGDLTDTDSVIDYLMNQDHVMPRLNQRILNTDTSKFLDFSGIEYKDLTNIQDLAQLSNRDMTATLLSNIKYFGAKHATEHIGNYELNFLTIWVIADIEQPEGRELLANALNYLKSGSSVRIGFLPNVEGSSISNKNNLNRLAWSATQTLPPVEATDLVLKWLNNPNTISEIPNAVNEILSSTELHMKMLRVYVQRIFGLPKSLRLVVGNGKIFGPLSKGEKFNVEDFGLIDRFNAFQYADKIRKILKQSVENEADTADDTVINSDTVLKLYASLVPRQSKTRFKIPDDIKKHNSVVSLAPKQSLMPHFDISAVVDPASRSAQKLAPILILLRNILNCEMNIYLTPVGQHSDMPVKNFYRYVVEPEVQFQTNGKLAEGPISKFTGLPVNSLLTQNLQVPENWLVEAVHSVYDLDNIKLSEIGGPVHSEYELEYLLLEGHCFDSNSGAPPRGLQVTLGTEKSPAIVDTIVMANLGYFQLKANPGVWELRLREGKSADIYDIGHAEGPNTIHQNQLTKVVINSLRSHVIKLRVAKKPGKQNADLLGDDEDDSKSGIWNSIASSFGGGSSPTASDKHGAEDSETINIFSVASGHLYERLLRIMMLSVLKQTKSPVKFWFLKNYLSPQFTDFLPHMAREYGFQYELVQYKWPRWLHQQTEKQRTIWGYKILFLDVLFPLNVRKIIFVDADAIVRTDIKELYDMDLGGAPYAYTPFCDSRKEMEGFRFWKQGYWRSHLMGRRYHISALYVVDLKRFRKIAAGDRLRGQYQALSQDPNSLANLDQDLPNNMIHQVAIKSLPDEWLWCQTWCSDSSFKKAKVIDLCNNPMTKEAKLTAAQRIVPEWKDYDVEIKNLMMKIEDHENTDHYAQASASNGSPKSSNENNDDKNMKHEEL

SEQ ID NO: 4389 - protein, 1642 aa, Populus euphratica
METRFRSGSCVLVILFCVVGFCGFGSVSCGENRRPKNVQVAVRAKWEGTPILLEAGELLSKERKDIYWEFIDSWLHSKKEDNDSYTAKDCLKKIMKHGHGLLSDTLASLFDFSLILRSASPRLVLYRQLAEESLSSFPLLDDSFSNSASGGLAKTNDTNEIKRSDPLLVGRNPEIPGGKCCWVDTGAALFYDVADLLLWLHSPSGMEGDSFQQPELFDFDHVHFESLSGSPVTILYGALGTDCFKEFHSALMEAAKQGKVKYVVRPVLPSGCESKVGRCVAVGASDSLNLGGYGVELAMKNMEYKAMDDSAIKKGVTLEDPRTEDLSQEVRGFIFSKILERKPELTSEIMAFRDYLLSSTISDTLDVWELKDLGHQTAQRIVHASDPLQSMQEINQNFPSVVSSLSRMKLKDSVKDEITANQRMIPPGKSLMALNGALINIEDIDLYLLVDMVQQALSLADQFSKLKVPHSTIRKLLSTASPPESSMIRVDFRSSHVHYLNNLEEDAMYKRWRNNINEILMPVFPGQLRYIRKNLFHAVYVLDPATSCGLESVDMILSLYENNFPMRFGLILYSSKFIKKATSCGLHLSAEENDGETEDISSLIIRLFIYIKESYGTPTAFQFLSNVKRLSMESDSADDVPETHHVDGAFVDTILPKVKTPPQDILLKLAKEQTYKELSQESSMFVFKLGLNKLQCCLLMNGLVFDSSEEVLMNAMNDELPRIQEQVYYGQINSRTDVLDKFLSESGISRYNPQIIAEGKAKPRFISLTSGVLGGKSVVNDINFLHSPGTVDDVKPVTHLLAVDITSKKGINLLHEGIRYLIEGSKGARVGVLFSSSQDSDLPGLLLVKVFEITTASYSHKKNVLNFLEHLCSFYEQKYILASSVAAESTQTFIDKVYDLADANELPQKAYKSILSEFSADKVKKQLNKVSQFFYLLLGLESGVNAVITNGRVMFPGDEGTFLSHDLHLLETMEFKQRVKHIGEIIEEVQWQDVDPDMLTSKFVSDIIMYVSSAMAMRERSSESARFEILNAEHSAVIIDNENSSVHIDAVVDPLSAAGQKVSSLLRVLRKYVQPSMRIVLNPMSSLVDLPLKNYYRYVVPTMDDFSSTDLTVNGPKAFFANMPLSKTLTMNLDVPEPWLVEPVIAVHDLDNILLENLGDTRTLQAVFELEALVLTGHCSEKDHEPPRGLQLILGTKSNPHLVDTLVMANLGYWQMKVSPGVWYLQLAPGRSSELYTFREGGDGSQEKHLSKLITINDLRGKVVHLEVVKKKGMEHEKLLISSDDDNNSQRKGTHDRWNSNLFKWASGFIGGGGLSKKNESALMEHEKRGRHGKTINIFSIASGHLYERFLKIMILSVWKNTQRPVKFWFIKNYLSPQFKDVIPHMAQEYGFEYELVTYKWPSWLHKQTEKQRIIWAYKILFLDVIFPLSLERVIFVDADQVVRADMGELYDMDIKGRPLAYTPFCDNNRDMDGYRFWRQGFWKEHLRGRPYHISALYVVDLVKFRETAAGDNLRVFYETLSKDPNSLSNLDQDLPNYAQHTVPIFSLPQEWLWCESWCGNATKSRAKTIDLCNNPMTKEPKLQGAKRIVSEWVNLDSEARQFTAKILGDEVNPQELVSPNQSQDSLTDNSLEEDAESKSEL

SEQ ID NO: 4390 - protein, 1221 aa, Fundulus heteroclitus
  MOD_RES (1191)..(1201): Any amino acid
MAPLKVWQMQDLSFQTAARILAAPAVDALNVMKDLSQNFPTKARSITKTVVNSEIRKEIEENQKFFKGTLGLQPGDSALFINGLHIDLDTQDIFSVLDVLRSEARVMEGLRSLLIETPYIHDILKLNVQPSDSDYAVDIRNSAICWINNLETDHRYSSWPHNVQELLRPTFPGVIRQIRKNFHNLVIILDPTQENAAELLSVAEMFYANNIPLRIGLVFVVSDEDDVDGMQDAGVALVRAYNYITDEVDSHSAFEAVVSMFNRVVIGGKLSVGDVVKVLEKRFPYVEVSSVLGADSSYDSNRKEGRAYYEQTGVGPLPVVMYNGIPYQREQLDPDELETTTMQKILETTSFYQRAVYLGELATDHDVVDFIMNQPNVVPRINSRVLSTSRTYLDLSSTNNYFIDDYARFSTLETKQKSTAVANSMNYMTKKDDGYIRPVTFWVVGDFDKPSGRQLLYDAIRHMKTSNNVRLGMINNPSSDLSAETSRVARAIWSAMQTQSANNAKNFITKMSKEETAEALEKGADIGEFAVGGMDLPLFRSAYEGPKFDFLLSHAAYCRDVLKLKKGQRAVISNGRVIGPLEENEVFNQDDFLLLENIILKTSGERIKSKVQQFEMEEDRASDLVMKVDALLSSQPKGESRIEYGFADDRYSAVKIRPKEGDVYFDVVAVVDPVTRDAQKLAPLLSVLKQLVNVNLRVFMNCQSKLSDMPLKSFYRYVLEPEVAFQADGTFSPGPMAKFLDMPQSPLFTLNLNTPESWMVESVRTRYDLDNIYLQEVENIVAAEYELEHLLLEGHCFDVSSGQPPRGLQFTLGTASEPVIMDTIVMANLGYFQLKANPGAWMLKLRKGRSDDIYKIYSHDGTDSPSDSDDIIVVLNNFKSRIIKVKVQKKPDKFNEELLSDGTEEDDDGFWKSLTRGFTGGGKAEEPKQEKDDVINIFSVASGHLYERFLRIMMLSVIKNTKTPVKFWFLKNYLSPTFKDFIPHMAKQYGFQYELVQYKWPRWLHQQTEKQRIIWGYKILFLDVIFPLAVDKILFVDADQIVRTDLKDLRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKRTAKTIDLCNNPMTKEPKLQAAVRIVAXXXXXXXXXXXPTRFQQPVGVPAATRGRTWV

SEQ ID NO: 4391 - protein, 1487 aa, Trichoderma reesei
MTQHRWWPWNLICALLLALQAHSTPTVNVGMIAAFPAGPYLLELLETAAAENSSSYFPLLDRIAAGHFASASTDAALYAQVLDALQEDGSLSSPEALSTFKLALSLRSAAPRIEAHYQYYATAVASAVDDAAEPGCTNWVLLEGKQYCTPELDKVHREGLSSLRQAKDLPFDRTLGLGKEAILYADPTSSSFGDFHEALSKAARQGSLTYRLRYRRSETTHASNLPISGYGVELALKRTDYIVLDDRSHDEEAHADTLASATSLDDDEDVADIKPLASSDLSSLGLKAASFILQSDRPLDTLIKLTQDLPRFLTSVVAHNISSQIEEELQSNGALGVPEGMNVLLVNGVQLIERQIEPFALIERLRQERKLIDGFRALGLSGKQAVSILGHQSVSLAKDSDEPLRYDWTDRLEDGRVLIWLNDLENDDAYEHYPNSIASLLQRAYPGQLPPIAKNIFTLVAPVDFTSAEDVSFVAQLLSFVSRGISVRFGLVPLTSTPEAAAKAKIAYHILENYGIRGLVSYLGRLQQAASTLSNEELFAEITADHELLEDSEKMTLGEVLEADTYQQQLKLAQQWASRLKVDTPIRPTFFNGLSIPRDESWMQRLGMQIGEDLQTVQKGVFHGLLTDDDWAPGLFLSRAITRRNSYITPDDEKKSLRVLNIDKVYKEHANLFEAVPVLEAAAESQREDWAVVTVIADLTTTSGKELLLSALEFKRRNPSIRMDIVHNPLAATGAASANAALQASQGLLGDIQNIDELTNLLQTHSEDSINDGYFEALEQFLGASKIPSGARMIILNGRVIGPISEDSQFDADDFQQFLEVERMRRILPVYGAIEELGLSDKLATPLDAARLTSITALSTISELPEGIFESTSSVRTTLYDKWQSTHTAIERGDEETASIFIVGLLNPVSEQGQRWAPILKVLSELEGVHLKLFINPMSKVDELPVKRFFRYVLESQPSFDEEGGVRGLVATFKNLPSEALLTAAVDVPPAWLVAPLISVHDLDNIKLSAVKTAVHATYVLKHILIEGHSREGKGSAPRGAQLVLATEKDPLLTDTIVMSNLGFFQFKANPGVYSIRLKEGRNTEVYEIESIGAQGWNPVAGDNGTDLALIDFQGVTLYPRLKRRAGMEMEDVLQEKGPSNNIVAKGLKLAEGLFGGKSNKKSVSAQEHAEINIFSVASGHLYERMLNIMIVSVMRHTKHTVKFWFIEQFLSPSFKEFIPRMAQEYGFKYEMVSYKWPHWLRQQKEKQREIWGYKILFLDVLFPLSLDKVIFVDADQVVRTDMIELMNLDLEGAPYGFTPMCDSRTEMEGFRFWKQGYWANYLRGRPYHISALYVVDLRRFRELAAGDRLRQQYHSLSADPNSLANLDQDLPNHMQFHIPIHSLPQEWLWCETWCSDESLSQARTIDLCNNPLTKEPKLDRARRQIPEWTAYDEEIAALRQLFKQETGIAGKEKLADNGDSRAAESGAKNTKSRNLEGDRPHTKDEL

SEQ ID NO: 4392 - protein, 1492 aa, Colletotrichum sublineola
MLRLSRMPTGLALTLLASVNVLAVPSVTVDMKAAFPSGPYLLELLETAAGENTTAYFPLLDRIASGYFGEAKTDKDVYDKFLHVLNEDGHINFPDSLSTFKLALSLRTAAPRIEAHYQYYRTAVEPKLGSDAQDGCEVWVQLGGKQYCAPTLDTPKESVSTLDSSKVLPFDRVLGSGSEAILYADPTSPSFGPFHSTLAEKARKGEIEYRLRYTKPAGIYEEALPVSGYGVELALKRTDYIVIDDREAQSDDSQKVANAGEVLDATEDVADLKPLAKSELQELGLKAASFIMQSQDPFEALLRLTQDFPKFSTSIAAHNVSANFLAEHQLNRQQLVPSGMNVLWMNGVQLIERQIEAFTIIDLLRRERKLIDGVRALGFTGGQAVSLLGHPKVAESKSDEEPPRFDWTDDEEKEEVIMFLNDLEKDERYKDYPSQLMSLLQRVYPGQLPPIKRDIFNLIVPVDFSKIEDLNVVAQLNSFIQRRLPIRFGLVPLTPTEDAAKISKVLYYLLDNYGLEVFIEYLDAAMQVSKTDKPDQSVFEKAIKDREPLPTAKLLDFDDVLQSQELDNVVELSRSWVKRLKANTPIPPVFINGIPVPREKGWLQAMSMKATSDLQAIQRAVYLGMINEDFWVPDFFLEKAVKRRNTYIYPEDDKSIKILDVNKIYTEHDSLFSNVPVIEAYADSSKENWAVLTVVGDFVSDQGASLLLTALAFRRSNPGVRLDIVHNPPASASASAVNTALKNSGDKLAEVESLSDLKAIFDSAADESDGMFTAALSEFLSFAAIKPGSNVLILNGRVIGPFTEDQPFQGDDFQFLLEFEQKARIFPVYAAVDELGLTDKISGPLAAAKITSVTALSTISDLPADIFESAPSLRVSAHDTWNSTYTAIEIGNPETSSIHIVGVLNPASEQAQRWAPILKVISKLDGVYLKLFLNPQEKIDELPVKRFFRYVLEPEPSFDEAGKVRGLEASFKGLPSEALLNAGMDVPPSWLVAPKVSVHDPDNIKLSSIKSNVYASYELESILIEGHSREGGQSQPPRGAQLVLGTEKEPHFADTIIMANLGYFQFKANPGFYNIQLKQGRSSEIYTIDSIGAKGWTPVPGDEGTEVVLMDFQGTTLYPRLSRKPGQEEADVLAEPEDNSIVGRGLKFAEGILGKKKSASDEEHAEINIFSVASGHLYERMLNIMMVSVMKNTKHTVKFWFIEQFLSPSFKDFIPHMAKEYGFKYEMVTFKWPHWLRQQKEKQREIWGYKILFLDVLFPLSLDKVIFVDADQIVRTDMISLVNHDLEGKPYGFTPMCDSRTEMEGFRFWKQGYWANYLRGNPYHISALYVVDLRRFRELAAGDRLRQTYHSLSADPNSLANLDQDLPNHMQFQIPIHSLPQEWLWCETWCSDESQKDAKTIDLCNNPQTKEPKLDRARRQVPEWSVYDNEIAALDRKRKGLPVEAPKKEETKVGGGVESEQQKPVVAEEDKNTKSRNWEEPPAEKTHVIDEL

SEQ ID NO: 4393 - protein, 1625 aa, Helianthus annuus
METRVGSGFRVMILIVVCAMVCGCLVDAEIQRPKNVQVALRAKWPGTSVLLEAGELLSKEWKDHFWEFVEVWLNNESGNTDPYTAKDCLQKIYNYGKTLVTGQLTSVFELSLTLRSASPRLVLYQQLAEESLSSFPLSDDMHTNFNDGGVSDANEGEEAKKADSLLVGVNPRSPGGKCCWVDTGAALFFDVSELQLWLRNPHKDGDVFQQPELFEFDHVYFDSSPGSPIAILYGALGTECFKEFHRTLVEASKEGKVKYVVRPVLPSGCESKSGYCGAVGTRDPVNLGGYGVELALKNMEYKAMDDSEIKKGVTLEDPHTEDLSQEVRGFIFSKILERKPELTSEIMAFRDSLLSSTVSDTLNVWELKDLGHQTVQKIVHASDPLHSMQEINQNFPSVVSYLSRMKLDDSIKDEILANQRMIPPGKSLMALNGALIDIEDIDLFLLIDMVHQELSLADQYAKLKVPSSTIRKLLSTLPPPESNSFRVDFRSDHVQYINNLEVDARYKQWRSNLNELLMPVFPGQLRYIRKNLFHAVYVLDPATICGLETVDNIVTLFENSLPIRFGVILYSTKMIETLQANGGEFPHLESEINEDLSSLTIRLFFHIKESHGMLKAFEFLSNVNKLRMDSGEEDAPALHHVEGAFVETLLQKAKTPPQDTLLKLEKDQSFRESSQASSLFVFKLGLAKLECSLLMNGLVHNYDEEALMNAMNDELPRIQEHVYYGQINSRTDVLDKFLSESGIQRYNPQIVGDKAKSKFVSLTASIVGDESLLNNVEYFHSTGTIDDLKPVTHLLAVDVTSRKGVKLLHEGIRYLMVGSANARVGLLFNSDFDADSYSFIFMKAFEIAASSYSHKKQVLNFLDQLCTFYGNEYILESSQNSQALLDKISQLADANGIQSKGFMSALSEFSVAKFTSHMKKVGQFLYGQVGIEKGTNAVVTNGRVVPVPDSVTFLSQDLHLLESVEFKQRIKHVADIIEEVTWENVDPDTLMSKFMSDILMSVTSSLSTRDRSSESARFEMLSAEHSAVVLGSENSTIHIDAVLDPLSSSGQKLSSLLRILSKCSQPSMRLVFNPMSSLVDLPLKNYYRFVTPTMDDFSNTDLTVHGPKAFFANMPLSKTLTMNLDVPESWLVEPVIAVHDLDNILLENLGDTRTLQAVFELEALILTGHCSEKDHEPPRGLQMILGTKRNPHLVDTLVMANLGYWQMKVSPGVWYLQLAPGRSSDLYVLQDGPEKHSMKRITIDYLRGKPVHLGVAKKKGKEHEKLLIPSDDDDSSRKQGDKEGWNSNILKWASSLIGGNGHTKNSGSTKLDNVSNGRKGKTINIFSIASGHLYERFLKIMILSVLKNTQRPVKFWFIKNYLSPQFKDVIPHMAQEYGFEYELVTYKWPSWLHKQKEKQRIIWAYKILFLDVIFPLSLEKVIFVDADQIVRADMGELYDMNLKGRPLAYTPFCDNNRDMDGFRFWKQGFWKEHLRGRPYHISALYVVDLIKFRETAAGDNLRVFYETLSKDPNSLSNLDQDLPNYAQHTVPIFSLPQEWLWCESWCGNSTKARAKTIDLCNNPMTKEPKLQGARRIVAEWPDLDQEARHFTSKILGEDASPVEKVVSPPVQPQVVEEDLETKDEL

SEQ ID NO: 4394 - protein, 1462 aa, Nectria haematococca
MFRLSQLPWGLAMALVASLATASPAVNVGMNAAFPRGPYLLELLETAAGENSTSYFPLLDKIASGHFASASSDAELYDQFLEVLQQDGHIASPDALSTFKLALSLRSAAPRIEAHYQYYSTAVDPTTKEDVDEKCQSWALVENEKYCSPTLDTAAESDLSSKQTNVLPFDRVLGIGKDAVLYADPTSASFGPFHETLSKAAKQGDISYRLRYRRSTAQSSPLPVSGYGVELALKRTDYIVIDDREAGKDATQKPVAADVVLDEEEEVTDLKPLSTSELASLGLKTASFILKSENPFETLVKATQDFPKFSRSIIAHEVSKEFKEEQEKNVAAGVPTGINFLWMNGVQLIERQIEPFNLIDMIRRERKLINGVRALGFNGQQAVSLLGHSEIANAKADDEPTRFDWTDRSEDGKVFIWLNDLEKDDQYAELPKELKALLRRTYPGQLPQVALNLFHIIAPVDFTNLQDVRAFSQLAQFMQRGLTIRFGIAPLTSTPAAAAAGKIAYHLMETYGLESLVAYLSECEEGSKTGVDKKAFVKAVEGREPLPETTKMTLDEVLEAESYTQKIKAAQSWASRLNADTTVRPVFVDGFAIPREKNWVQTMGQRLTEDTQVIQKAVYLGEIDEESWVPGVFLNKALAKRNTYIFPDDDKSLRVLDVNKLYADHADLFSKVAVLEANTESTKETWAVLTVVTDLNTEDGQDLLVSALQFKRANPGLRLELVHNPSSPTDAHAVNGAFKTNTAKLAEIESKDELKGILEASWTGEDDGFGNSLAGFLNTAKILPGTKALLLNGRVVGPLPSNVLFKEDDLQQLLDFEQRNRILPVYAAIEDLGFADKLSDPVAAAKLTSITALSTISDLPQGIFESAPSVRTTLYSTWDSTHTAIEIGNPETASIHIAGLLNPTSEQGQKWAPILKVLSELDGVYLKLIINPKEVVSELPIKRFFRYVLNSAPSFDKDGHVEGPKAVFKGLPSEALLTAGMDVPPAWLVAPKASVHDLDNIKLSSVKADVDATYELENILIEGHSRDGKRGAPRGAQLVLATEKDPLVTDTIIMANLGYFQFKANPGYYNIQLKEGRSADIFTIESVGAQGYSAVPGDEGTEVALMDFKGTTLYPRLERKPGMGEADVLATTDDEDKGIVAKGLKFAESLLGASKTHKEISAQEHAEINIFSVASGHLYERMLNIMMVSVMRNTKHTVKFWFIEQFLSPSFKDFIPHMAAEYGFKYEMVTYKWPHWLRQQKEKQREIWGYKILFLDVLFPLSLDKVIFVDADQIVRTDMIDLVNHDLKGAPYGFTPMCDSRTEMEGFRFWKQGYWANYLRGLPYHISALYVVDLHRFRQLAAGDRLRQQYHTLSADPNSLSNLDQDLPNNMQFTIPIHSLPQEWLWCETWCSDESLSSARTIDLCNNPQTKEPKLDRARRQVPEWTVYDDEIAALDQRRKGTEEKNTKSRKLEEEMHTKDEL

SEQ ID NO: 4395 - protein, 1681 aa, Dictyostelium discoideum
MARIFKFFVFLLIVFISNVLLLVESNEGDNSFSSKSIQLSLVSNWGETPSYLEAAEFLHNQDKSLFWKFIEEFNKIDFSTNYSDKIYYESTISLMKSVLSSNTQFLSEFLSIDLAMRTYSPRVETYRQLAISNMKLNNIEHSITTADNKTITLFNSGGWVQIKNKIITDVNEINESLFKDVAVVDDEENEFIRLYDFDHIFPTLANTVSSSSSSPSSIPIVILYVDIKSEFFKLVHPKLKQFSQMGKIKYCLRYVVQESNQKLNLQGYGYELSIKNLEYKVMDDSAIKKDIIIDGVKSKTIINIPNEDVQGFNFHKLQKRKPELTSKLSTFRSYLMAKSQEAKELKVWELKDLGIQSAQKIIQSGDPLRSLEYISQKFPTLSNSLSKITLNESLKSVIESNQKIIPSTTDQTLLLNGRLIDTNELSPIELSRIILEEYEHSTTIQQQGPLSSKTVQDIISAQLPIRIQLLPTKEELELNGGNEPFVSLNNLELDYIYRQWEPKLQSSVLDKPVTSPQDIFIRKNLLTTVIVLDWNNINTFEIIPEIQEMVQGNSLIPTRIQLLFNTKSNNNNNNNNNNNDQNSQTSNFIQGKDLAKVFLTIKNSNLGNRGAFFFITALNYFKKMYIPNELGITRSVLSSSFQAVLQQMGGSVRSLQHALTNTDFDNLLESSNQLIERLELLDTTTSQSTTTTTTTKILPKVFVNGVQVKYSNIDQLSFDLLVSLYDEFDNLKPLFKESILSTTTAQYYETILTSSYWKDNNLPFLKKLNSMISNEKYSHLITNSKNRNQEVDAQNVLKNLLYFRNNENKDEQNLLNLIVIGDFDHYNTRDISLELLRQLEKGELKNCKLTFISNPIDINSVVNTAGNENQILGKLITILKHYGKILTPQLVIGLFEKVQSDPTIIDSFKTMKQIIELSGFDIAANDIWVAQSVNLFKQSSKVCKQYLGIQSTNKSPLSILVNGRIITPPLSYDDAASFIQSDFKLLLEIEMIKAKKTFELLNSDPILKDKSNLKISDLLNKVQSLVGYYYNGNNQLDSNIKRKRIPNSLSISFSHKPPTLSSSSSSSSSNSNDVPLKFLMIINPFNKVSQKLVPMVREFSNKLNIPVDVILNPPVSLSELPLKTYYTYVIKLSSEFNNENVLYNQPLGIATDIPEDRVVTLALDIPSSWLVQPIIAKYDLDNIRLKDLGDEQVLTAVYELENIVIEGSANDMTTDNAPAGLELLLNPISTQTNKTQDTIVMNNFGYYQLKSNPGIWKLTIAPGRSSDIMDMVDHPNQKEKETFVIVPHRLVVIDSLYQSLSSLSVVRKAGQELRPILQPIDEYEKQKEQEKEQKLKQNSSGFFSNLFSSKNDATDSVATHQKKSNLDTIHIFSVASGHLYERFLKIMMLSVVKNTESPIKFWFLKNYLSPAFKEFIPEMAKEYGFQYELVTYKWPWWLRKQTEKQRIIWSYKILFLDVLFPLDVPKIIFVDADQVVRTDLKELWDMDLHGASLGYTPFCDSNKDTEGFRFWKSGYWRQHLAGRSYHISALYVVDLVRFRRLAAGDQLRATYDQLSRDPNSLANLDQDLPNYLQHYVRIHSLPQEWLWCETWCDQESKSKAKTIDLCNNPLTKTPKLENAVRIIDEWTTLDNEAKEFELKIDQSKHHRQIELDHQNQLPNSKPIENIDDILLNLAESQKDLF

SEQ ID NO: 4396 - protein, 1539 aa, Fistulina hepatica
MRTRAALQWLSAVGLSFAASPTINVALRSSWPAAPALVELLETVALEVPEAFFPLADLLTDPGVHLLNQELRPEAVYGAALSVAADRGILTGESPAMVQTNLGLHSASPKVEAFYQYYETYTSRSHTSDCGSWVEWYGEVVCDIESLVQLAGHDTIDSPSSVPPKVLPFDHVYPPPERTLISPRRTAILYANMYSSNFRELHGYLLQAASERNPRLEYVFRHVPPSALGSLPAQYLTGYGVALDLKKTDYLAIDDRHVVERCACFSAESSEDQVVNVPDMIFDLIHAYPKNSTVSDPSVPLTEEEILELGFKASQLIADSVDPLATLKQLSQNAPVYASALARRVPVNESIAGELKHNTQLSNEGLNLMWLNGAILYESDINPWGLLRLMRKERKIMESLTLLGLSSGQAIELLTHRALAAAQNRPPVLEGIFDASDRLEGGDVIQWWNNIEKDQRYARWRPSLRMLLNPVYPGQFHNIRLNLFNVVLVLDLSDTVALNFMTGPMSNLIERGLPLRFGVVPSTETKAGEEMARLFYHMIKSYGRAKAMTFFKSISQYRRPVVYQTPTVSWKLVQAEYDKFVSEHGAPTKPADQEPTNAPTLPSIFLGELPVDLLPPVDAVSSYIERLCATRANGHNGHVFVNGKHFVMDDSVLKNIQNEVNRQLQYLQELVYEGVLDEPDGMRIATYFYDLPEANLRRNPYIYPSSPGDLLIVNVPQLVEQSGFTRFSTPHSYLYSDSSNHSVTLYVVADLDSEEGKKLMQEGVKHSQAKDSGIRLSFIHNPTDRDVSPSPAFHENDTEAFGNEFQTTWSPQNYDHAVYETYVYACGLFVKGLGIQPGASALLVNGRVVGPITEGGFVSEDFAELEKYELKRVQPLLTALGDIVPLSELDKFEFADLVGMSSSIVGSLQISDPSEAVIRETAQKPRRRNYRKLHSNYTAFEAGDNTTALYHIAAVIDPLSESAQRWSSLIEACSSWLLHLPDVFIEVHLNPGHSSEMPLKRFYRYNVRPSLSFDDAGFEVHAHTHFDRLPAEPIYTLAMDVPASWIVRPREALCDLDNIQLNKHGRVDALFDLTHLVIDGYARESPTNVAPRGLQLQLSNGLEPSIVVDDTLVMANLGYLQFKARPGVFRLDIRPGRGREIYQLETAGNLGWNSPLAVGNRDVTLTSFEALTLHPHLARLPGMETEEVLAVREGRVSIIDSIKTSVLALFSDSSAMAVPKPADINIFTVASGLLYERFASIMILSVLKHTKSTVKFWFIENFLSPSFLEFIPHFAEEYGFQYELVTYKWPSWLRPQKEKQRIIWAYKILFLDVLFPLDLKKVIFVDADQIVRTDLKELVDLDLHGAPYGYTPMGDDNVEMEGFRFWKTGYWKDFLRGLPYHISALYVVDLVRFRQMAAGDILRGHYQQLSADPNSLSNLDQDLPNNLQHEIPIFSLPEDWLWCETWCSKDRFERAKTIDLCQNPLTKEPKLSRARQIPEWEVYDAEIAKFTNSLAQSGRITGSMAVADTSVLANEAASAPASSPEIPVDDAQSEHRDEL

SEQ ID NO: 4397 - protein, 1296 aa, Microtus ochrogaster
MQEIKKPSSRKMLLSGYGVELAIKDTEYKALDDIQVKTVSDATIEQTDADEVQGFLFGKLKEIYSDLKDNLTVFQKYLIESSKAMMPLKVWELQDLSFQAASQIMSTPVYDAIKLMKDIAQNFPIKARSLTRIAVNELMRKEIQENQKDLRDRFDIKPGDARLFINGLLIDVDVYDPFSILDILKSEGKLMSGLKNLGLSEKDMSKFLKLNLPVWKHDYVLDIRHSSIVWINDLETDGLYSAWPASVWEFLKPVLHGTVPSIRRNFHNLVLFIDPAQEYTLDFISLAEFFYYNEIPLRIGFVFILNTENEVDGTADAGVALWRAFNYIEERHGTSEAFTSMIHMFQKVKGHRVLTVDDVKSVLQNKCPNADILDILGTHSKYDRRRAAGTSFYNMTGLGPLPQALYNGEPFDLKEMSPEDLRGAVLEKMTDAFVSLQRDVFMGTLNDEINAVDFLMDKNNVVPRLNSLILHTKPQYLNLLSSSVTADVEDFSTFSFLDSQDKSAVIAKSLQYLTQEDNVLSAVTLWIVADFDVPSGRKLLFSALEHMETSAHSRLGIIYNPTSKINEENTVISRGILAAFLTHKNSLLRRFLRKLAKEETAEAVYSGGKIKTFLTMEMDNNAFEKKYNTIGVNIFRTHQLFCQDVLKLQPGEIGIVSNGKFFGPLHEDLYLEDFHLIEKITFSNLVEKIKDIVENMEIDSKDMSDLVMKIDALVSPLPVRASRYDVTLLKENHSVIKLSPPEKDLFYDIVAIVDPLTRGAQKMAQLLVVLGKIVNARMKLFMNCRSKLSEAPIGSFYRFVLEPELISGANNGPSHGPVAKFLDIPESHLLTLNMITPEGWLVETVRSNCDLDNINLKDTERTVSAEYELEYLLLEGHCFDMTTEQPPQGLQFTLGTKSNPAVVDTIVMANLGYFQLKANPGAWILKLREGKSEDIYEIVGHEGTDSESDAGNIVIMLNTFKTKILRVQVKKKSGKIKEDILADKHENRGMWDSIKSFTKSLHKDDRKENDILNIFSVASGHLYERFLRIMMLSVLRNTKTPVKFWFLKNYLSPTFKEVIPHMAKEYGFQYELVQYKWPRWLHQQTEKQRIIWGYKILFLDVLFPLAVDKIIFVDADQIVRHDLKELRDFDLGGAPYGYTPFCDSRTEMDGYRFWKTGYWASHLVKRKYHISALYVVDLKKFRRISAGDRLRGQYQALSQDPNSLSNLDQDLPNNMIYQVAIKSLPQDWLWCETWCDDESKQRAKTIDLCNNPKTKEPKLEAAARIVPEWVKYDTEIRKLLDHLANKKSTMSVHDEL

SEQ ID NO: 4398 - protein, 1412 aa, Meyerozyma sp.
MHYVSWTLVWLVAWFGFACGQLGSLEFEIKAAWKHTPFSANLIESVAAHNESWYESAVAASIGLDDDSSYDSPQLSDKAIYENIMSQLPAESKDFISFDSVYKTHSPRIAAHYRQFEEVYGGNNLKKLEKTCATDSFGAKVPFINGHPHSFLVFNDKIYCSPEDIYALQTQGSSDYTPLEIDRVVGQHTKAPVVVLYGVPGSPSTIGFLRHLMADSQAGKLRFVWRYLPATNIGDSMVGYGVQLGLSNYTAPKHTSDEISVSVLAEKSANESYYHLRDILRSPLSKLNTAAEKVKQSFYDAKDKNARLGLTKASNGIYINGAIIPKAELSVFSLVAQIKSELTRMKDLKSLGFTTTQARTLLQKFALLSAVKDAQYRKGNTIMGGNENRFRVYQEDGVIFFNDIESDKNYVDYTTDAHEAYLEQSKGLKVGQIPALRQNVHDLIFAVNPSDRRQLEVFFTLAKIILDRGIPQQIGLLPLITSEIDEAVAKAVHFLFKKGSPQESLGFLYKCLQAEKGHEEIAQLAGTIPVPPEYRVPHFAESTSRYSIDQPSVVVNGVIYELQSPGWQTAMVNQLSQDVMVLKRHLGTSSETNMKQVLYENASKLRNLRISPQDPSTIIYKQITADLVSHSITLKMKAESTTDLPGTVWLIGDYTTSRVLEQLEVLLKFIKRERRFQINMIHTGKNEGFLENLLSGIKDAQNLDTKGHKLLLENIKLASSGSSYGLISSAAQHLLERNNLPSSYPYILFNSRFFRLDTNFDLKEISLLASYDSKQRMSILKDLVGAYKDIFDSKSLMEFAPEKDKGAWFDLLSSLVTTSYYNSEYITTGDANRFDFSGLAYESSIILHSNEDEVEIVLIIDPTDPYSRKLVETVHAVKEFKSVNIKILMHASEDGAETTECVYSSIIPSARPQFNQKGMYITESPIHISGPAKVCTSLSIDAPFSWHVVPSLSSRDLDLQKFNLSEEKWAVYELKSLITDGYAKNILTGSGPTGAVLQIYDTNFHQDTAVLGSLGYFQFRTPPGIFNLQTKCLADSENCFDLLSAGSDFNSSRDVVSSVQVPVFSLNGLQITPRLQISEKKQEKSGSKLNFWSSKSVENTGEDINIFTIASGEVYEHLLSIMLASATSHTKRSVKLWLLEDFLSPKFKSALPTLASTYGFSYEYISYKWPIWLRSQQSVSRTVWGYKILFLDALFPQDLRRVIFIDADQVLRADLMELMETDLQGAPYGFVPMCESKEEMKGYQFWKEGYWAQMLQDDLKYHISALFVVDLFEFKKRRVGDRLRAHYQKLSADPKSLSNLDQDLPNNLQRHVPIYSLPSEWLWCDTWCAKEELGRAKAIDLCNDPTSTEDKIVRAKRVISEWADYNDEISRVLNERRMDYSQRPEELGDLQLTLEDDDQIEDDESDYFHDEL

SEQ ID NO: 4399 - protein, 1599 aa, Acytostelium subglobosum
MYAQATLANEDQGSADTSKVVHLSMLSNWQSTPLYLEAFSFFKEKLDVDSYKQYIEEVNQRYVKKQAENGDTLLTDEESFQVIVDSSASILDSDQSQSQSYMTLFLKAVLALRTYSPRVEMLRQLYLQDLSNINNNDNDNNNDNNINNKRERTQVIVLGGVEGSFSAWAKSIDFTYHFADSINLEIPVRRPVVYQQDTIYAQNTLFKYDAQVLVPLQSVPVAVYYSDVTSATFAEVHRQLKKLAEGGKIIYALRFVVPSSKRKAHIQGYGYSLSIKNLEYKVMDDSVIEKDELQSQLAATAQNEDISGFNFKVLHTRHPELSSKLSTFRKYLLANQQTTELKVWQVKDLGVQAAQKIVGSSDPIRSLSYISSTFPSLQASLARISLNETLKQQIEAIHKHVTEGENQLFLNDRVIQVGDSVEDEFELNPLGLTDIVLDEVKFGAQLQQIGLSNDQILNVNKLILKPSSIRFDMLPDDQSIILYMNNLNSDYTYQRWDKSFSALSGNLDSSSVYFGKNLFTALFVLDMGSEEVFTQLAMVSSLINNNSPCRFGIIFNTESLPTDKKPPSDLVRPEVVARLFWTFKERMGHRAAFFFMNALNYFRSVYEADYNSYGIVQSAFQTVIGQMGNRMPNLIGLMESTELAPQLIGASQYINAKGITQFPQLFINGMLVEISEKRPLLDAVHSFCMDELHVIKALWQEDVLNDNTDDIYKTIMENFRTKGQLLSSFNPTVIPSSQSTVKLPGDIFGSKAAERVYQSLVWHLASGRDASAIDKVSVIVVADFNTAPGVKAALSALNSVFHSESNTQARYAMLPLADSPVSRVLAHPQIKTQSAIDLLNKQLNKLESDQTLSLEQALAAAGLSNDNDMTQRIGDQLQYVNSGLDLHSGVEKTYLLANGRLIAIDDNDLFNDFAYLERFESSRVEGAVAALGDATITSDLLMRVVSALASKMQSNAQHKELPTQMVPSFVYNPATTGARQLPLRFKMVVNPLSKTAQKMIPIVAELSRHFGIPCDVFLNVQLSLSELPLKTYYSYVVNLDTKFSATGASISEPAGTLVNLPDKKVLTLAIDVPSSWIVKPIIAKYDLDNIRLKDLGQEQVMRAVYELEHLLVQGHAVDVKDKSSLSGMELKLVPSKKQQQVETPEIDTIIMGSIGYFQLQGNPGVWYLETMGRGNQIMDILDMVTLKDKADHVIPRRLIIADSFKGSPIYLGVQHKPGKQHEPILPPVSNDDTGAVAEQQEEESTGFLSSLWGGGAKKKQPQVKASNNGTLDTIHVFSVASGHLYERFLKIMMLSVKKNTQNPVKFWFLKNYLSPKFVDFIPHYAEKYGFEYELVTYKWPYFLRQQTEKQRIIWAYKILFLDVLFPLSVKKIIFVDADQVVRTDLRELWDMDLQGASLGYTPFCDSNRETEGFRFWKKGFWHDHLRGRPYHISALYVVDLQRFRRIMAGDHMRMTYEQLSRDPNSLANLDQDLPNYLQHTVRIFSLPQEWLWCETWCSQESKTKAKTIDLCNNPMTKTPKLENAVRIIGEWTDLDNEAKRAEQDYNEQQQQQQQQQQQRVISQTTAGDQHQHHQQTVDQTTPDVELAQNALEEAQTYFN

SEQ ID NO: 4400 - protein, 1479 aa, Heterocephalus glaber
MAPAKATAPAKATNAVRLLLGSAALWLSLLGARKACASKAVTARLAAKWPETPLLLEASEFMADESNEKFWQFLETVRELEIYKQRGLTGQLRPEWIVLERNLKVKGLTVFEHFVLCFHFRPRPYLLKGDHKFPTDKENLPVIILYAEVGTRAFSEFHKVLSEKAQSGKILYVLRHYIQKPSSRKMYLSGYGVELVIKNTEYKALDDTQVKTVTDTTMEDETEADEVQGFLFGKLKEIYSDLRDNLTVFQKYLIESNKEMAPLKVWELQDLSFQAASQIMSTPVYDAIKLMKDISQNFPIKARSLTRIAVNQQMKKEIQENQKHLKDRFKIQPGDAHLFINGLQINMDIYDPFSILDILKLEGKFMNGLRNLGIDQEDMSKFLKLNSNDEKYILDIRHSSIVWINDLESDHLYATWPASCHELLKPVFPGSISVIKRNFHNLVLFIDPTQEYTLNFIQVAELFYFHNFPLRIGFVFILNADDEVDGRNDAGVALWRAFNYISEERSVSEAFISIVHMYQKVKDQNILSVENVKSILQNEFPHADIWDILGAHSIYDNERKAGASFYKMSGLGPLPQALYNGEPFKREEINEELDAAILHRMEATSVYLQRDVLMGTLNDHMNAIDFLMDRNNVVPRINSLILHAKHQYLNLISSTVSADIGDFSTFSFLESRDKSAMIAKNMHYLTHEDNNIISAVTLWIIADFDTSSGRKLLFNALAHMKTSVHSRLGVIYNPTSKINEENTAISRGILAAFLTQKNNLLWSFLRKLSKEETAAAIYSGNKIKTFLIEGMDKNAFEKKYNTVGVNIFRTHQLFCQDVLKLRPGEISIVSNGKFLGPLPEDFYVEDFYLLEKITLSNLAEKIKSIVESTKINSKDMSDLVMKVDAFVSSLPEHTSRYTVTFLKEKHSIIKISPQENNTFFDVIAIVDPLTREAQKMAQLLVVLGKIINMKVNLFMNCKSPLSEAPLESFYRFVLEPELMSGANDSPSLGPVAKFMDIPESPLLTLNVITPEGWLVETVQSNCDLDNIHLKDIERAVTAEYELEYLLLEGHCLDTVTKQPPRSLQFTLGTKNKPVVVDTIVMANLGYFQLKANPGAWILKLRQGKSEDIYQIIGHEGTDSPSDIEDVIVVFNSFKSKILEVEVQKKPDKINEDILTDSDGKKGMWDSIRRKFHKDDDKKEKDVLNIFSVASGHLYERFLRIMMLSVLRNTKTPVKFWFLKTYLSPSFKEVIPHMAKEYEFQYELVQYKWPHWLHQQTEKQRIIWSYKILFLDVLFPLAVDKIIFVDADQIVRHDLKELRDFDLGGAPYGYTPFCDSRTEMDGYRFWKKGYWASHLSGRKYHISALYVVDFKKFRRIAAGDRLRGRYQALSQDPNSLSNLDQDLPNDMIYQVPIKSLPQDWLWCETWCDDESKQRAKTIDLCNNPKTKEPKLEAAARIIPEWVEYDTEIRQLLDHLENKKKSTNIQFSRHHLLKRLSFPET

SEQ ID NO: 4401 - protein, 1550 aa, Drosophila busckii
MLWQSTLCVLLAIAVAPTRAESSQSYPITTLINAKWMQTPLYLEIAEYLADEQAGLFWDYVKAATELDTPLNEYDTESKQYNAALKLVRAHLSEPQLPLLKLVVSMHSLTPRIQTHFQLGDELRAAGSCKSDIYAQVGTELACSYTELSKKLKLPNAADSLDASVDSYSFDHIYPGSDNNTRTVVLYADLGSAGFRTYHKLLEHAANAGKVRYLLRHQLAKRSEKPVRLSGYGVELHLKSTEYKSQDDAPKPEAGAGSNTDNEEQANETDVQGLDFKVLKAKHPMLKRALDQLRQRLLQGNDDIAPLKAWEFQDLGLQAAAAIAEIQGDEALQLLQYTAHNFPMLARTLLAHKVTEDLRAEIKHNSEALGRSLNVAPPDGALFVNGLFFDADTMDLYSLVETLRAETRVLESLHANDVRGSLASALLALDLNSASKREFAIDIRDTAVQWINDIEQDAQYRRWPASVMDLLRPTFPGMLRNIRKNVFNLVLVVDPLQPEARSVIKLAESFVIHQAPIRLGLVFDARAQEANTADDYVALACAFNYISQKKDARAALSFLTDVYAAVGETSAVTKAHIVKQLGKEFSSLSSSKIREMLAEDSDYDYGRKLAEEFVQRLGFAAVRQPQALLNGAPMPSNIVGSDSDFEEAIFTEIMSQTTALQKAVYRGELSDAENMMDYLMNQPHVMPRLNQRILSQEDAKFLDINGVPSMQLGNAAALNKLSNRDMTATLMNNLRYFGGKQSTERIGKAELQFLTIWVFADLETTEGRALLLHALDYVKGGQSVRVAFIPNTEGASDKRSLNRLVWAAMQTLEPAQATDQVLKWLRLQPSKRIDDIPKQLEDILGSTELHMKMMRVYAQRVLGLAKSQRLIIGNGRLYGPLRSDESFDSADFALLARYSDLQYGDKVREVLKQSASEVGDSFTSDTLLKLYASLLPRQTKTRFKLPTDLKTAHSVVTLPAKQQQLPHFDIVAVLDPASRAAQKLTPLLILLRQTLNCQLQLYLTPVPQHSDMPVKNFYRYVIEPEVQFEASGVRAEGPLAKFSGLPANPLLTQQLQVPENWLVEAVHAVYDLDNIKLHDIGGPVHSEFDLEYLLLEGHCFDAASGAPPRGLQLVLGTKSQPTLVDTIVMANLGYFQLKANPGAWSLRLREGKSNDIYAISHAEGPNTQHQPQTDAVQVLITSLRSHVTKLRVSKRPGMQQAELLSDDATPAQAGIWNSITSSFGGSSGGTAADEDAETINIFSVASGHLYERLLRIMMVSLLKHTKSPVKFWFLKNYLSPQFTDFLPHMAKEYNFQYELVQYKWPRWLHQQTEKQRTIWGYKILFLDVLFPLNVRKIIFVDADAIVRTDIKELYDLDLGGAPYAYTPFCDSRKEMEGFRFWKQGYWRSHLMGRRYHISALYVVDLRRFRKIAAGDRLRGQYQALSQDPNSLSNLDQDLPNNMIHQVAIKSLPDDWLWCQTWCSDTSFKSAKVIDLCNNPQTKEAKLTAAQRIVPEWKDYDGELKALMSRIEDHENHSSSSSSTQKADDEDAEETVVFTEPPLPEHVHGEL

SEQ ID NO: 4402 - protein, 1484 aa, Lachnellula suecica
MGTFNLPWGLTGALLATTYFHSLCASASPSINVGLKASFSSAPYLLELLETAADENATSYYPLLDRIADGHFSKATTDKQLYEQFIELLKEDGHMPDPETLSSYQFALSMRSSAPRIEAHYQYYHTAAEPSLQAEQDTSCPVWVLFNGKQYCSPALDAPHGDISGDSQIQELQFDRILGNPTAPPSILYADITSPDFGKFHKTLVKTAREGKTSYRVRHRKALSAIDSKPLLVPGYGVELALKRTDYIVIDDREDGDSKPVEEKTEKKEVKFEDEEFADLKPLSTSELFSLGVKASSFIMQSDNPFETLVKLSQDFPKYSSAIASHNASKEFVAEHDYNRAQLVPGGYNIWWLNGVQMIEREIEALRILDLLRAERKLVNGVRELGFTGNEAIKLLSHQEIAEVQAEGEPQRFDWRDDTEGGNVIVWMNDIDKDKRYAEWPTTLQALLQRTYPGQLPSVRRDCFYAVLPVDFANPQDVLMIAETLQSFVKRKLTIRVGLVPITSTIHSLEQARVIYYLLDTFGISTALSYLERSYNSGKVTAPSKTVFDAAVEGRYPRGEKVSRPVDEVLKSEDYKDQIEASQKWIKRLSADSKIPPMFIDGAALPRDESWLQAMSQRVTADLQAIQQGIFKETFTEETWLPTYFLFSAAKKRNSLVVPEDEKNLRVFNVNKVVEENRELFNTLPRIEADSTSDKADWAHMVLITDLESEAGAKLLTSAVVFREANPAVELVIAHHPTSDSTATGLSSDLFAHTKANAGKPFTVKELTTLLSSEKSENADSEQDALSYWHGTNSLAKSVSLASGQTAILLNGRLVGPIPDPAAFDLKDFAQLLSYERTKRIVPAFTAVEALGLSDKLTDPLAAAKISSIVAISTINETPAGIFEQASTLRMNQFDVWNSSHTAIEVGDASTASIHMIILVDPASEHGQKWVPLLKALSELDGVYMKLYLNPKERLQELPVKRFYRYVIDSKPTFDDAGALQSLSATFTGVPQEALLNLGMDVPPAWLVAPKVSIHDLDNIKLSSIKTDVDALYELENILIEGHSREIPGGAAPRGAQLVLGTERDPHFADTIIMANLGYFQFKANPGFYKIDLQQGRSSEIFNIDSVGAKGWSPVPGDESTEVVLMSFQGTTLYPRISRKPGMATEDVLEAKPDSKLDFVSQGFKFAQGILGKGKPAVEVEAQADINIFSVASGHLYERMLNIMMVSVMKHTKHTVKFWFIEQFLSPSFKDFIPYLAAEYGFKYEMVTYKWPHWLRSQTEKQREIWGYKILFLDVLFPLSLDKVIFVDADQIVRTDMMELVNHDLKGAPYGFTPMCDSRTEMEGFRFWKQGYWERFLKGLPYHISALYVVDLHRFRQIAAGDRLRQQYHQLSADPGSLSNLDQDLPNHMQNILPIHSLPQEWLWCETWCSDESLKDAKTIDLCNNPQTKEPKLDRARRQVPEWTVYDDAIAAVDRRRKAPKNEALKNEKSRTLEEPVTSKKDEL

SEQ ID NO: 4403 - protein, 1496 aa, Betta splendens
MMSIGSKSEFIGEDGNEKFWQFIDTVKELTVYKQGESVRSYYNLIIKKAGQFLTDLQVNLLKFSLALRSYSPSVHASQQIASDEPPPEACPAFVSIHGQHSCSTKDMKKLLKTAAGRPKPYLYKNDHTYPRVIKTDVPVVILYAEIGTKKFTSFHKVLSEQAEGGKIVYVLRHYVADPKPQKMLLSGYAVELAIKSTEYKAVDDTKVKDSKTVINDEDDDNDEVQGFFFGALKKSHPELQEQLSELRKHLLESTNDMAPLKVWEMQDLSFQAAAKIMSVPKFDALKVMRDLSQNFPSKARSLTRVAVKQEMRKEIEANQKHLTETIGVHPGDGELFINGLHIDLDVHNPFSILDILRAEARVLEGLHNLGIRGEHQGNLMRLPVNAVDDSYALDIRHPAIMWINDIENDSTYRSWPAGVQELLRATFPGVIRQIRRNFFNLVLFLDPVQEESVELVKLAELFYKHKIPLRIGFVFVVNTKDEIDGFLDAGVGFYRLLNYIADEYDLYQALMSMVSLYNKVDVGETLSVDTLTAFLKRKFPKANAERILGTESEYDENRKDGALYYKKSGLGALPLALFNGVPLSPDEMDPEELETIILQRIMDTTTVFQRAVFMNQLTESSNVVDYLMEQPNVVPRMNSLILSSDRKYLDFTASPAVDDWEDTTMFSYLDSRDKTAVVSKRMKYFTNSDEDGISAVTMWIAGDFEKVSGRKLLLSALKHVQKASPGVRVGVIDNPSGKPSDDNTVLYRAIWASLLTQKNKASAEFVQKVLKEESKKLLQQGTKMKDLLMQGMNVDAFEKKFNTLEVDFIRSQQLFCRDVLKLSPGQRAVISNGRILGPFEEQEEFTVEDFYLLEKITLRGSAEKVKAKVKQMGMKPKHASDLIMKVDALLTAAPKGEVRRDVHFIKDSHSVLRLAPRENEVFYDVVAIVDPLTREAQKMSALLIVLSQVVNVRLQVFMNCRTMLSEMPLKSFYRFVMEPDVGFLANDTVSPGPVARFVDLPETPLLTLIMITPESWMVQAVRSPHDLDNIHLQEVSGIVTAEYELEHLLLEGHCFDLSTGQPPRGLQFTLGMSRDPLMYDTIVMANLGYFQLKANPGAWNLRLREGRSADIYQILSHDGTDSPADAGDVIAVLNSFHSKIIKVRVQKKAEKMNEDLLSETSESKGIWDSIASVWSTFEKSITGGGFKKDDEEKKEDVLNIFSVASGHLYERFLRIMMLSVLRHTKTPVKFWFLKNYLSPSFKETISHMAETYSFQYELVQYKWPRWLHQQTEKQRIIWGYKILFLDVLFPLAVDKIIFVDADQIVLADLKELRDLDLEGAPYGYTPFCDSRREMEGYRFWKTGYWASHLGHRKYHISALYVVDLKKFRKIAAGDRLRGQYQALSQDPNSLSNLDQDLPNNMIHQVAIKSLPQEWLWCETWCDDASKVTAKTIDLCNNPKTKEPKLTAAARIVPEWVEYDNQIKQLLRSVQEQGDAAAEKQTSSSSQHKKDNQRDEL

SEQ ID NO: 4404 - protein, 1653 aa, Melanopsichium pennsylvanicum
MRARQLLGFGWAWLALSTLIHLSSADESPPVKVQLRPSWASFTLPSGGSPFLLELLEAAHSQRPSSFFPLLKLLTTKHTPQQLHNATDEWLANRIENLIRDYHLFGKDDQAVAERLDLWRMGLALKHAGPRIEAHKQAYQSLELEDIWNKGNAGDSSCVSWVHHQDLVLCSAEDVKRALLERTAPLAPQQQEDQVVFGHPRTATATQRFVLYADPYSVNFQELLSTLDEHTSVPSFNLSYTLRWRPQLTDTQSSSADHPSLLSGYGAILDLKKVDYLVIDDRKLKDDSEIGDVGLPATSSDESSASQAAFAEAKWLRDQIGADPDATTAPLSKLSEDEIADLGIKAAQLIMQSSDRLRALRELSQNFPLHASALASSTKFEDDSAAALIESVLGLASMRIEPGHSDLWLNGQSTSTRDFIPLKLLDTLRRERRWFRALQHRLAGGGLNTTEAGDLISSSLVGRTFIAQTEGGGGNAIFDASDRIEKKQAPQGSQEGAITWLNDLENDEATRDWSSDLMDLLRPMWPGKFPRLRLNLFNVVLVLDLTQRESCRFLSETVIQSLGRVGLHWGLVPGGLEQGEGDSLKMARLFWFLLEEASPQILSDVLRKAAGSRAGTAESLDVPLAIREAKFSLKSIDSDNSLAAKLDLILSGSNPAYNQREELAKAYICRLRATNSESPTGHVFTNGQRQPFHPQIVHMLHQSIQEQIQVLAPQIYYGQLKGSDAGLSTWFYDAVGALSFRSALVGGTAENANGAQHSNVDLFSALVDESVPEGSVKQVFQFYYPINEPERLLNSTVWVFANVDTEEGLGLVRKAFEALTEERAQFRLGVLHIPSKASRNITVSTLLYRLLNDNHLNHVTPIQMLDALNQSDSFHASLGLSSSSTDAIESAAHQFWTSLTSISTSLALTGPAIIVDGHLVSNFGTSTISHRDITALVEYEAGQKLPYLTQALQLLRENFDSINSRQRQDLIFASLCVMNGIYDESGSGKGVFTAKATSRSGLPEQIGTSDHVFEIGDKNTANIRITLLLDPLSEAAQRWSSILVMLQELEGVWIRVILNPQIKVRELPLKRFYRFSAPNRLHFDEIGKPMEEELRFFTMPQDAVLTLGLDAPAPWLTMPTEAVYDLDNIRLSDVPSTSRDKGVKAVYELKHILIEGHAREESRSGSGLSASVPRGLQLILETPKARDEGKRLDTIVMANLAYFQFKAQPGLWKLGIRQGGRSGELYEMVSVGGLGWDSPKIEETGQSIILDTLSGLTVYPRVAKRAGKENEELLEELDAQGRPLKEPRTHAQGLNHGVAASASQLIFSAMDKLASFSNKVTGSTSSNAIVTTRNHADINIFTVASGHLYERMTYIMILSVLKHTNSTVKFWFIENFLSPSFKEFIPHLAQEYGFEYELVTYAWPHWLRSQKEKQRTIWGYKILFLDTLFPLNLGKVIFVDADQVVRTDMKELVDLDLEGKVYGYPPMGDDSEDMDGFRFWKQGYWKDYLRGRPYHISALYVVDLNKFRLFAAGDRLRGQYQALSADPNSLSNLDQDLPNNMQASLPIFTLPKQWLWCETWCSHDWLDQAKTIDLCSNPKTKEPKLDRAKRQIPEWTVYDQEVARLAQRLVEEKRVGMSVVAPHSQVETGREQEALKKERHQPKLDTDHPHDEL

SEQ ID NO: 4405 - protein, 1335 aa, Hippocampus comes
MKMRNIILLSPLLLMIMQHTASASKGVIASLKAKWHATPFLLETSEFIGEDGNEKFWQFVDTVKELTVYKQGESVRSYYSLIIKKANQFLTELQVNLLKFALALRFYSPAVHAFQQIASDEPPPEACPAFVSIHGQHSCSTKNIKKLLKAAAGRPHPYLYKNDHIYPGANKTDVPVVILYAEIGTKKFTTFHTVLSEKAEAGALTYILRHFVATPKQQKMLLSGYGVELAIKSTEYKAVDDTQVKDAKTIIKAEEEDNDEVQGFYFGTLKKSHPELQEQLGELRKHLLDSTNELAPLKVWELQDLSFQAAARVLSVPKFGALKLMRDLSQNFPNKARSLTRVAVKSEMRKEIEENQKHLSETIGVQPGDGELFINGLHIDLDLHDPFSLLEILRGEARVLEGLHNLGVKGEHQYTLLRLPVNHVADSYALDIRHPAIMWMNDIENDPMYSSWPAGVEELLRTTFPGVIRQIRRNFFNLVLFLDPEEEKSVELVKLAGLFYKHKIPLRIGYVFVVNTKDEIDGFSNAGVGFYRLVNYIADEYDLSQALISMASLYNRVNEGETLTADTIIAFLKSKFPKANTERILGAKSEYDGRRTDGTLFYKKSGLGALPLALFNGVPLSPDEMEPAELESIILQHIMDSTTAFQKAVFMGHLTEGTNVMDYLMEQANVVPRMNPFILSTDRKYLDFTSSPVVSDWEDATMFSFLDSRDKTAVMANRMKYLTKNDEDGMSAVTMWIVGDFQKASGRKLLLAALKHLSTSPGVRVGVMDNPSGRPSEDNTAVYRAIWASILTQKNKSAVEFVQKLAREESYQLLLQGTKMKDLLLQGMNTDAFEKKFNTLEVDFIRSQQLFCRDVLKLSPGQRAVISNGRILGPLDEQEEFTAEDFQLLDKITRSSSAEKVKAQVKLMGMKPKHGSNLVMKVDALLAAAPKAEIRRDVKFLKESHSVLQLSPRENEVFFDVVAIVDPLTRAAQKMSPLLIVLSQVVNLRLRLFMNCRAKLSEMPLKSFYSYVLESDVTFLANDTMSAGPMARFTELAETPLLTLNMITPEGWMVQALRSPHDLDNIHLQEVSGTVTAEYELEHLLLEGHCFDLSTGQPPRGLQFTLGMSRDPIMYDTIVMANLGYFQLKANPGAWLLKLRNGRSEDIYQILSHDGTDSPANNGDVVVLLNSFHSKIIKVRVQKKAEKMNEDLLSETSESKGLWDSITSIAGRGPKKDEGEKKEDVLNIFSVASGHLYERFLRIMMLSLLRHTKTPVKFWFLKNYLSPSFKETISHMAEAYGFQYELVQYKWPRWLHQQTEKQRIIWGYKILFLDVLFPLAVDKIIFVDADQFEQI

SEQ ID NO: 4406 - protein, 1539 aa, Otolemur garnettii
MKAANAVRRLLGFSALWLSLLGAGTVSASKAVTARLAAKWPETPLLLEASEFMAEESNEKFWQFLETVQELAIYKQTESDYSYYSLILKKAGQFLDNLHINLLKFALSIRAYSPAIQMFQQIAADEPPPDGCNAFVVIHKKHTCKINEIRKLLKKATSRPRPYLFKEDHKFPTNKENIPVIILYAEMGTRAFSAFHKVLSEKAQNGEILYVFRHYIQKPSSRKMYLSGYGVELAIKSTEYKALDDSQVKTVMNATAEDDTEANEVQGFLFGKLKEIYPALKDNLTAFQKYLIESNKEMIPLKVWELQDLSFQAASQIMSTPVYDAIKLMKDISQNFPIKARSLTRIAVNQHMRKEIHENQKDLRDRFEIQPGNARLFINGLHVDMDVYDPFSIVGMLKLEGKIMSGLHSLGINGEDTSKFLKLSPPVWENNYILDIRHSSIMWINDLENDELYVTWPASCHELLKPIYPGSIPNIRRNFHNLVLFIDPAQEYTLDFIQLAELFYFHKIPLRIGFVFILNTDDEVNGASDAGVALWRAFNYIAEEYDELEAFISIVHMYENVKDQNILTVDDVKNVLQNKFPHANIWDILGIYSKYDREREAGANFYKMTGLGPLPQALYNGEPFSNEELNIKGLEMAVLHRMMDTSVDLQREVFMGTLNDLTNTIDFLMNKNNVVPRINSLILHTTHQYLNLISTSVTSDIEDFSTFFFLDSQDKSAVIAKNMYYLTPKDDSVISAVTLWIIADFDKPSGRKLLFYALKHMKTSIHCRLGVIYNPTSKINEENTAISRGILAAFLTQKNSFLRSLLMKLAKEETAKAIYSGEKIQTFLTEGMDKNTFEKKYNTIGVNVFRTHQLFCQDVLKLRPGELGIVSNGKFLGPLDKEFYVEDFYLLEKMTFSNSLEKIKGIVENMDINSKNMSDLIMKVDALICSLPKRASRYDVTFLKENHSIIKINPQENDMVFDVIAIVDPLTREAQKMAQLLVVLGKIINMKIKLFMNCKGKLSEAPLKSFYRFVLEPELISGANDIPSLGPVAKFLDIPESPLLTLNMITPEGWLVETVHSNCDLDNIHLKDTERTVMAEYELEYLLLEGHCFDTMTEQPPQGLQFTLGTKNKPVMVDTIVMANLGYFQLKANPGAWILKLRQGKSEDIYEIVGHDGTDSQPELEDVLVVLNSFKSKILQVQVQKKPDKIKEDILTDKDEKQKGMWDSIKSFTISLHKEDKKEKDVLNIFSVASGHLYERFLRIMMLSVLRNTKTPVKFWFLKNYLSPTFKEIIPYMAKEYGFQYELVQYKWPRWLHPQTEKQRIIWGYKILFLDVLFPLAVDKIIFVDADQIVRHDLKELRDFNLDGAPYGYTPFCDSRTEMDGYRFWKKGYWASHLLRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLKAAARIVPEWVEYDAEIKQLLDHLENKKENEGIYNLYTNSLDNEIVQDQDVRKILYLDQARKSQK

SEQ ID NO: 4407 - protein, 1483 aa, Cyphellophora europaea
MRPQKVPWRGALILSLACLLESHAAWASHSVNVALQTSFNAAPFLVELLETAAAESPASYFPLLDRIAQRTFAEAQTEKELYERFIQVLQDDGHFTDGESLASFKFALSLHEAAPRIEAHFQYYNATVQPHMMAAQDAVCPVWVHFDGQQYCSPALERAQQPVAFETSENVLPFDRVLGPAEAPASIIYADITHPLFADFHNTISETARDGTTSYRIRYRPSETRSEPVPLSGYGVELNLKRTDYIVIDDREAGSADEVKQDAAKEPDANDELQIKSLTTSELYSLGLNAASWVASNPNPMQALLQVSTDFPKYSSFLASQDANEDFLKEHLSNREILLPSGFNALWINGLQIENRQVNAYSLLEHLRRERKLIGQMKDIGLTPTEAVNILAHEVIAESARNAADHRFDWRDDLEGGEVIIFMNDLEQDKRYTGWPTSLTGLFQRTYPGQLPAVARDIHNIIVPFEVDNLKDLELVTTALQSLIKRKVPIRIGLVPIGASKAAQTYGKLSYHLLDTYGLATFLSFYQETVKSGKLAAQPEKLFAATIKERKLRQDKTALSYTEVLESEELEQRLRHRDAYVDRLELRGSTAPFIVNGVVLARTESWFETMSQRVYMDLQVIMQAVYEGSLPEDASARDHLIAEAITRRNELVIPHDLKDIKVVDVAALTADHADAFAKMPRIVGAEAVLMADRAHMLVVADLNTEDGRSLASAAVEFQTKVPEIEVMLVHSAGDPSEPGISTLMYHWQRETGPKLSAEQQAKVQAFLGGSDAKIRMPQEVQQEAAQYWALANGLIRDLGLKAGENGLWLNGRMLGPLRRSLGVEDLQLLLDFERSARLAPVTMAVAATGLEDKFKEPLDVAKITAVVARSQKSELPEGMRDSAPLLRLDRYRLWNDTHTAITVGTSDDPTLQVVAVLDPVSEVSQPWISILHTLSELEGVNLKIFLNPRGQLTELPSKRFYRQVLGSAPSFDADGIRVSPKASFNKLPEDTLFNLDLILPPSWLVAPKTSVDDLDNIKFSGTEHDVHAVYELEHILIEGHARDVTVNPPPRGVQLLLGTAEDPHFTDTIIMANLGYFQFKANPGYWQISLKPGRSSKIYNLDSVGPDGYLAVPGDETSSVALMSFQGTTLFPRLSRKPGMEEAEVLESTTPGSAMDYLNKGASFASSALSSLGIKTSSTTNADINIFSVASGHLYERMLNIMMVSVMKHTKHSVKFWFIEQFLSPAFKSTLPSLAEHYGFEYEMVTYKWPHWLRAQTEKQREIWGYKILFLDVLFPVDLDKVIFVDADQIVRTDMMELNKVNLKGAPYGFTPMCDSRTEMEGFRFWKQGYWETYLRGKPYHISALYVVDLKKFREVAAGDRLRQQYHSLSADPASLSNLDQDLPNHMQHNLPIFSLPQEWLWCETWCSDESLKDAKTIDLCNNPQTKEPKLDRARRQVPEWTEYDNEIREVIAKARGDVPAMQQAGDSVAQADAQTPLKKDEL

SEQ ID NO: 4408 - protein, 1424 aa, Candida auris
MLAHIWLCILVVSASSVSVKLHADWPEAPFALQLIEAVSSYNESLYAQAVRALYQRETEADDWDEDDEEGFEANQEDEGEQAALTDKSYYEAVTGNLSPVAKGMVDLNLVNKIYTPRIVAHYKHYEREVEPSLGSIEKQCAKDSFGNEITDPSASWVKYGNKIYCSDADLYALQLSKVSEKTLEFDRVVGEASKKPLLVLYGAPESPRFQSMFETLYQFSSSDKLRFTWRYVPSEGYKDRASIPGYGAVITPKEALNGTKKNSKVKYNGDLSKFLADVKQEGKPLRALDSDEYHDLSVKITALILEQPGSARYGLLEEILNNFPLYAPYLKLINNPVNFETVKSVAKSNEKKGASEDSVGLYLNGASVHKLEMDLPHVVKKLKTEVELIHKMNMLGFTTEQSKLLFSKYALMSAFKEVQYRSGDRENRYAIYKHEYDASDPSSGGLVYFNNIEKDDPYDLYDINRKEAYLGREASMLQFGQVPPLRENVHELVFAIHFSSSIQVKVFFTFAKIILDRNLPQQVGVIPLVESDEDEKVAEKFYHILSVSDAKEAFALLYQYYEAGTEAEKQAVLDKVEVSEESKGKFKNFKRTVREFSLDAPSVIVNGVIHDMKSPWQTAMTKQMGNDVRLLQQRIRNGDDTGKSLKAVLFQDSKDSRNSRVSPKDLSNIRYKEISSNLLENSYSFKKINKPNDAPGTFWLIGDFNSKIILSQFAKLLDVLETYEDKSLEIRVFSISEDNSLLINFFNKYGKAPLTDHSIEKLRAETLKAKSKVYTKISPSQAKLLEQHQIQLHQAGMLFNSRYFKLTEVFEPKELIELIEFEQRRRLSIFKDLTDAYPDIFRWKGIMHFKKSGYDDFAWFDLVSSVVARSFFLEDSQFQADVDRFDFSSLDFSNALNITDQNPMKFVDVLAFVNPFTGASQKIVSIVKSLKDLSFVNVQILMQPLEAVPESKSVDRFYSSAFETSLPRFNDQGAFVGSCHAAGFDALVSSTKYSSELDTPSRWLHVKDSIGDLDHDEFEPGSVHELNYTLDSLIVEGYAKDVKTAQSIATLTLEVTNGEAVFDAIVMHTLGYVQFQLKPDVWNLEIQKGSKGRQIYNLLSASDNKYDTNDLPLEHTELGVFSLHGSVIHPRLQEKSEKEIARAKKEVLVAKNADVNVFSLASGKLYERFLSTMMVSVKKHTKSTVKFWLLRNFLSAEFVNRLPILADNYGFEYEFVSYKWPLWLRQQKKKISPEKVIFVDADQIARVDLQELVDTDLKGKVYGFPPMCDSREETEGYRFWKQGYWKNVLKNDLVYHISALFVVDLKQFRMHYAGDRLRTHYQKLSSDKDSLANLDQDLPNNMQRSIPIHTLHQDWLWCETWCSDETKDRAKMIDLCSDPFRKEGKLERVQRSIPEWVHYDAEIQRLQKNGLENGSTANVPHDEL

SEQ ID NO: 4409 - protein, 1440 aa, Metschnikowia pulcherrima
MHLLQLLAIFATFSCHVLAAALTVNLHANWTDLPFEVQLVEAISSYDEALYILSMKLLFGNENEAGSEWDDDSDDDVEKNEHFALDLMGISPHNQIHTGIGPVTHGNLYSKLVMTLTKTQFGFLNLNLVNSLYSPRIRAHYDHYNTEIGPIFEHKVRKQCAKDSFGEPIADPLAVWVKYGSRIYCSEQDLYALQLDRTSEHLLPFDRPIGSDANAPILVLYGDPSSERFSGILSTLLLLAEAGNLQFVWRYVPPTESAPMELSGYGTTLTVLEKKQALPKANTPYTSLYDFYSQHANSPVHDVPEDRLPQISAKIASLVLDLPPKQRFEELCFILQNLPKYAAHLADLVPPSNFKAVSASARANEQKGASRDLIGLSINGAMVHRLETDLPNIVNKLRDEVKFIEDMELLGFTIAQAKKMFSKFALLSAYKENEYRTGSANNRFTLYQDTFRADDTSSGGVVFFNDLGLDENYNLYSTDRYKVYIEEASQFRHGQIPPLKENVHDIIFVVNFSSKSQLKVFFAMSKMILDKGIPQQLGILPLVETEKDARITQMFYHILEVGELKEALAFLYKYLDAKTEDEEQLFSLVANPGEKSYLQYENTLSKYSITEPSVVINGVIMNMRSTKWQAQMGQQIVHDVKLLQNAIRQGNDKNTPLKEVLYSGSKGFRNLRVTPKDPGNIRYKRITRDLIDASVAFKKDVDLSRASITFWLIGDFNTQVILDQFKQILGFMRQYNGRSTQARVFNTAKNSDILNGLVAEYANQLLTSSMFRKMTKAVGDMRIQTFSEPDPAKVKILERNQIQLHQSSLLFNSRQFRLDTVFSVQELQQIVQYEFPQRLDTIDEILRAYPEDFAYQSITDFKPDLFDDMDWFDLLTSLITMSFNMEDSMVRTDVARFDFSSLNFDNAISLRKYDSNKPLDILIVIDPIDEFSQKLVSMVQSLRDLPFVNIKVLLQPLSLAEGPTALNRFYASAFSPLVPNFDITERFEKASPGVFSNVPESRYRVKVDTPNRWLVVKNESRAGLDMENLELSKEIECVDFVLKGLAVEAFVRDVKTGAAVPGLAIEAKNNKHVTHEGLTMETMGYNQLRLEPGVWLLQVKAGDYDLLSADANRYISNDQKMTSLPLSVFSLAGDLIHVRTRENKALMDHSSRVTSKHADINVFSIASGLNYERLMAIMMLSVKAHTKSLVKFWLLEDFLSNQFRAQLPDLAATYKFEYELISYKWPLWLRQQTEAHRIVWAYKILFLDVLFPADLDKVIFVDADQIARTDLIELVNHDLEGKPYGFTPMCDSREDMQAFRFWDQGYWKTVLKDDLKYHISALFVVDLNVFRENAVGDKLRSHYQKLSSDPNSLSNLDQDLPNNMQRQVPIHSLPQEWLWCETWCSQALKKDAKMIDLCNDPASSESKLERAKRLIPEWTTYNQQLQKLGTGKLAIDHDEL

SEQ ID NO: 4410 - protein, 1534 aa, Gekko japonicus
MGTLIALIGIWVSCSLVNADSKAVTTSLTTKWFSTPLLLEASEFLAEESQEKFWSFVETCQDFGSSNRDGTEYSYHNAVLKAASQNLSPLQQNLLKFALSLRSYSATVQAFQQIAADEPSLKGCNAFFVVHGEKTCEFDKLGILLQTASERPKPFMFKGDHKYPVSNPESPVVIMYAEIGSEELSRYHRLLVSQAKAGEITYILRHYIANPSKEKVYLSGYGVELAIKSTEYKAKDDTQVKGADTNATVIGENDPIDEVLGFLFGKLRQLYPTLQEELKEFRKYLVESTNEMAPLKVWQLQDLSFQTAARILTAPTVDALMVMKDLSQNFPTKARAITKTVVSSELRSEAEGNQKYFKGTLGLQPGDSALFINGLQIDLDTQDIFSLFDVLRNEARVMEGLHSLGIVGHSMHSVLKLNIQPSDSDYAVDIRSPAIYWINNLEVDSKYSSWPSSVQELLRPTFPGVIRQIRKNFHNFVLIVDPSHENTVELLSLAEMFLSNHIPLRIGLVFVVDDSEDVDGLQDAGVALLRAYNYVAQEVDHNYAFQTVISIYNKVSTGERLKVEHVVSVLEKQYPYVEVTSILGVDSAYDQNRKEGHGYYKQTGVGPLPIVLFNGMPFQKEQLDPDELETVTMHKILETTSFFQRAVYLGELSNDQDVVEYIMNQPNVVPRINSRILMADREYLDLTATNNFYVDDFARFTVLDSKDKTAAIANSMTYLSKKGMSSKEIYDDSFVRPVTFWIVGDLDKPSGRQLLYDAIKHQKSSNHVRIGMINNPTEDPARENTVIARAIWAALQTQTSNIAKNFITKLAKEENAKELKAGAAITEFAVGGMDMDTFEDAFQSPKVDFILSHAMYSRDVLKLRKGQRAVISNGRIIGPLEDGELFNQDDFHLLENIMLKTSGQKIKSHVQELGVEEDLASDLVMKVDALLSAQPKGEARMENLFFEDRHSAIKLRPKEGETYFDIVAIVDPATREAQRLAPLLMVLNKVINMNLVVFMNCQSRLSDMPLKSFYRYVLEPEITFTPDKLFIPGPVATFLDMPQSPLFTLNLNTPESWMVESVRTTYDLDNIYLEEVESVVAAEYELEHLLLEGHCYDITTGQPPRGLQFTLGTSTSPVVVDTIVMANLGYFQLKANPGARILRLRKGRSEDIYRIYSHDGTDSPPDASEVVVVINSFKSKIIKVKVQKKLDMINEDLLSDGTSENESGFWESLKWGFTGGQKKEELKQDKDDVINIFSVASGHLYERFLRIMMLSVLKHTKTPVKFWFLKNYLSPTFKEFIPYMAEKYSFQYELVQYKWPRWLHQQTEKQRIIWGYKILFLDVLFPLAVDKFLFVDADQIVRTDLKELRDFNLDGAPYGYTPFCDSRREMDGYRFWQSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLEAAVRIVPEWQDYDQEIKQLYSRFQQEKATGALSKTNETEQPSQEGVSAHIEL

SEQ ID NO: 4411 - protein, 1655 aa, Hydnomerulius pinastri
MALPCTLLTFTGAVLSALGAYGASPPVTVSLRSSFAASDPLLEAIETVAMEDSSVLFPLLSAFSLPGKPLTPQEAHTIVFDLASTHLDWSALASARARLGLHVASPRLAASAEYYDIHIANLTDSHKLHSPGCASWVDWYGQVVCDADTLLQLANSGNNDISATKPKHLPLDHVHKLPPSLEGPQYTAIHFAEPTAPSFAPLHSALLSLEPKVEYVLRWAKGTGERKDGDLSSHLSGYGVALDLKKMDYLVLDDRNQHQGDSDARETSHGDKVEGTEKLLSEEEILTCVFDSLPYIDEEAEARAKAGEPLSPEEIADLGVKAVQFIMSFSDRPRGGPLYIHPCWNNHHMAPFPSVILSRTLSTSFPLYATSLARKIKISPKLGDEVYDNWAKAAPGINMAWVNGRVISENEGSAANIFGLLRTMQRERNLVKYLVDLGLTSEQAIELLMHPAHSATSQPSSSTPPATSRKGMMRGSAKSFVVQDDGDDMNDAELETKTFNVSPKFAGFLEGLVDASDRQEGGGVVLYWNDIEKDQRYARFSPSIQGLLRVHMMSLFSPMNQIRLNLVNVIFVLDLSQTRSLSLLGSLSDGFVARGFPIRWGFVPEGEGDGLRMARLVYYVEHKYGRDRMEEFIQRLSQAHDELRLTSLSWQLVHEIFNSLHAEDDFAAVAGGDIPILDEATGEDIMTRAQKYARRLGVVTQSETGKGHAFVNGRYIPVSDTLMRQLAGEATTQLQILQEMVYMGDITDADAHLMSTFFYDLPSTLSRRNPYIFAKSTASGGHSLDGTGLQMFNLAELFSNAGFEQKDGSFAVPRDSDALPVTMYIIADFDSSEGVQLAEEALRFITNPAQTRVTFIHNPEGMTTSDISTLLSTLVHTGSLHDVPPSRLLEALSGGEGDAETQKAFSDEFVAGKGLGNADTFGVLQTSRLVTRQLGLEPGQRAILINGRLVGPFDSGSEFVAEDFEMLEAFEIKQRVGRVTEAIDAVLDGGDALDIHKHANLVSTASSIIYADQQPDPSEAGLFDTVPRPRTRNYRLLSDDYTKLEFGDRSTAQSHIALLLDPLSEAAQKWSTVLEHCFELFPEIFVELYFNPTQLSEIPLKRFYRYNAIPQLTYDANGQEIPAQVTFTGLPIEPIYTLSMDVPPSWLVRPREALYDLDNIQLGKLPSEERSSGIQALFALDYLVVEGHARELKTSNPPRGVQLQLISSKDGSAIDDTQVVANLGYLQFKARPGTFRLEIREGRGREIYDLESVGSEGWNSLSVVQAGDELTVMSFDGLTLYPRLARKPGMERVDVLDGLQAPVEESASMMESFVSRMASLFKSKDEGKDTQAVVAQGDGQADINIFTVASGLLYERFASIMIVSVLRNTNSSVKFWFIENFLSPSFLEFIPHMAEEYGFQYELVTYKWPSWLRAQKEKQRIIWAYKILFLDVLFPMDLKKVIFVDADQIVRADLQELVDLNLHGAPYGYTPMGDDNYEMEGFRFWKTGYWHDFLDGRPYHISALYVVDLVRFRQMAAGDILRGQYQMLSADPNSLANLDQDLPNNLQKDVPIYSLNEDWLWCETWCSKDRLSRAKTIDLCQNPMTKEPKLSRARQIPEWEEYDTEIAQFARKLAAQGKIHASVATADSNLLAGGNAPSSSGETPKEDASHPHDEL

SEQ ID NO: 4412 - protein, 1162 aa, Camelus dromedarius
MLRLEGKLMHGLHNLGVDKEDVSELLKLSSHNWDDIYALDIRHSSIMWINDLESDDLYVSWPANCREVLKPVFPGSIPSIRRNFHNLVLFIDPAQEYTLEFIKLAEHFYFYKVPLRIGFVFIVNIDDEVDGTADAGVALWRAFQYIAEEYDTTQAFISIVNMYKKVENRNILTVDNVKSVLQSTFPHANIWDILGTYSKYDGKREAGANFYKMTGLGPLPQSLYNGEPLQDEDFVKLEVAILQRMVDTTVELQKYVLTGILNDQTDTVDFLMVMNNAVPRINPLILHTEWQYLNLISTSVTADIEDFSTFFFLDSQDKSAVIAENMHYLTPEDDRLSPVTFWIIADFDKPSGRKLLFKALKHMKTSVHSRLGVIYNPTSKIDEENTAISRGILAAFLTQEKRFLRKFLRKLTKEETATAIYSGVKIKTFLAEGMDKNAFEKKYNTIGLNIFQTHQLFCQDVLKLLPGEIGVVNNGRFLGPLDENFYAEDFYLLEKITLTSLGEEIEDFAQSTKTIDLKVMSDFVMKFDALVSSLPQSASRYDITFLKENHSIIKINSLEDDMVFDVIAIVDPLTREAQKMAQLLIIFTDLLPVQSFYRFVLEPELMLTANGIVGPAAKFLGIPEAPLLTLNMITPEGWLVEIVRSNCDLDNIHLKDVEGAVTAEYELEYLLLEGHCFDVTTEQAPRGLQFTLGTKNRPVMVDTIVMANLGYFQLKANPGAWILKLRQGKSEDIYQIIGHKGTDSEPDLGDVIVVLNSFKSKILDVQVQKKPDKIKEDILSSKNEEKKKGMWDSIKSFTRRLHTKRDTQETDVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLAVDKIIFVDADQIVRHDLRELRDFDLGGAPYGYTPFCDSRKEMDGYRFWKRGYWASHLLRRKYHISALYVVDLKKFRRIAAGDRLRGQYQTLSKDPHSLSNLDQDLPNYMIYQVAIKSLPQDWLWCETWCDDESKQRAKTIDLCNNPKTKEPKLKAAARIVPEWVEYDAEIRQLLDHLDNKKTTARSGCSARTRTSPASLPHKPIKSKMALLAAAQLQSPLLSDAAAPVPHKLRGQSPSEALLTEGTTSMHPPVLQ

SEQ ID NO: 4413 - protein, 874 aa, Trichophyton rubrum
MHFLIDRLFKDVQGLQRRIYEGEYKEDVWLPSFYLEEASPKFNAFIIPDDPSDITLKSINDAYSKYKEAFETIPRIPGERGSGIEEWAQLALVIDLDDEHGAKQLANVVAFHKANPGVEVLILHKPSMPENGQGLSTELHKLLDDGRDLEIDALDALLDKETKSERTSTDAQRFYSTIQPVITELGADGNGMHIILNGRLIGPLNQTTVLDTQDLELVLQYERSKRLTPVVSALESLEETDKIRDHLAFARLTSMVALSTISDIPEGTFQRPPMIRTEIFNSWVTKHSAITVSKSEAPLIKIVATLDPATEVAQRWIPILKVLSQLHGVSLQIFLTPLEAIKELPVKRFYRHVLEPAPSFYDDGSLNRPGASFHGVPQEALLNLGMDVPPSWLVAPKDSVHDLDNIKLSSLKEGTNVDAIYELEHILIEGHSRDISRNKPPRGVQLLLGTERDPHFTDTIIMANLGYFQFKAQPGHWQITLKPGRSDNIFNLDSVGGMGYSPKPGDDNNEVSLLSFQGKTLFPRLSRKPGHESDDVLEDGSKKQGSAKNLLSQGLDFASGVFSGVSKTRKEKHADINIFSVASGHLYERMLNIMMLSVTKHTKHSVKFWFIEQFLSPSFKTFVPHLAEKYGFSYEMVTYKWPHWLRPQREKQREIWGYKILFLDVLFPLSLDKVIFVDADQIVRTDMYDLVSLDLEGAPYGFTPMCDSRTEIEGFRFWNQGYWKRFLRGRPYHISALYVVDLNRFRAIAAGDRLRGQYQSLSADPESLSNLDQDLPNHMQHSIPIKSLPQDWLWCETWCSDESLKTAKTIDLCNNPMTKEPKLDRARRQVPEWTVYDEEIAQLARTVGAKDTESDHTQKEAEKTEPEDMNKDEL

SEQ ID NO: 4414 - protein, 1532 aa, Oryzias melastigma
MKYAVLLTLLLLLNVHQVKSASKGVTASLKAKWNMTPFLLETSEFIGEDGNEKFWQFVDTVKELTVYKQGESVRSYYNLIIKKAGQFLTDLQAHLLKFALALRSYSPAIHSSQQIASDEPPPEGCSAFVSVHGQQSCSTKDIKKLLKAAAGRPKPYLYKNDHTYPGVNKSDLSVVILYAEIGTKKFSSFHKVLSEKAEEGKLVYVLRHFLVDPKPAKMLLSGYGVELAVKSTEYKAVDDTKVKDSKSVTNAGEDDNDEVQGFFFGTLKKSHPELQEHLGELRKHLLESTNDMAPLKVWEMQDLSFQAAARIMSVPKFDSLKVMKDLSQNFPSRARSLTRVAVTREMRKEIEENQKYLSESLGVHPGDGELFINGLHIDLDVHNPFSILEILRGEAKILEGLHNLEIKGEHQGKLLSLPVNTVDDSYALDIRHPAIMWMNDIENDHIYQNWPSSLQELLRATFPGVIRQIRRNFFNMVLFLDPLQEESVELLKLAELFYKHKIPLRIGFVFVVNPKDDIDGFSDAGVGFYRLLNYIADEYDVPQAVMSMISLYNKMDVGETLSADAISAYLKRKYPKADPENVLGTESEYDYKRKDGALFYKKSGLDALPLALFNGIPLNPDEMDPEELETIILQRIMDSTTTFQRAVFMGQLAEGMDVVDHLMEQANVVPRMNPLILSTDRKYLDFTGRPVVDDWSDTSMFSFLDSRDRTAVMAKRMKYFTKSDEDGMTAVNMWIVGDFEKVPGRKLLLNALKHVRASPGVRLGVIDNPSGKPSEDNTVLYRAVWASLLTQKNKAAAEFVQKLLKEESIQLLQQKTKIKDLLMQGMDVDAFEKKFNTLEVDFIRSQQLFCQDVLKLLPGQRAVISNGRIIGPLEEQEEFTEEDFHLLQKITLRGSAEKVKAQVKQMGMKSKLASDLVMKVDALLAASPKREVRRDVHFRKDTHSVLHLSQRENEVFFDVVVIVDPLTREAQKISQLLIVLSQVANVKLQVFMNCKAKLSELPLKSFYRYVLEPDVTFLANETVSPGPVARFMELPESPLLTLNMITPESWMVQAVSSPYDLDNIHLQEVNGVVTAEFELEHLLLEGHCFDLSTGQPPRGLQFTLGMSRDPLMYDTIVMANLGYFQLKANPGAWILRLRKGRSEDIYQILTHDGTDSPADAGDVIVVLNSFHSKIIKVRVQKKAEKINEDLLSETTEGKGIWDSIVSVWSAFKRSIAGGGGSKKDDGEKKKEDDLNIFSVASGHLYERFLRIMMVSVLRHTRTPVKFWFLKNYLSPSFKETISHMAEKYGFQYELVQYKWPRWLHQQTEKQRIIWGYKILFLDVLFPLAVDKIIFVDADQIVRADLKELRDLDLEGAPYGYTPFCDSRREMDGYRFWKSGYWASHLGHRKYHISALYVVDLKKFRKIAAGDRLRGQYQALSQDPNSLSNLDQDLPNNMIHQVAIKSLPQEWLWCETWCDDSSKQTAKTIDLCNNPKTKEPKLTAAARIVPEWVEYDSEIKELLGKVQDQEEMAAQRQTPSSSKGKEQNRRDEL

SEQ ID NO: 4415 - protein, 1518 aa, Parasteatoda tepidariorum
MMLNQVRWKPIYFLIVLILPTIAQNLHKSVSVVLDSKWIYTSLHLEASEFLAEEKPELFWRFVDDCSNLENNFFQTKSHKLQYDAITDIASNYLSSTKIALLKFALALRAYSPIVEMFHQIAYDQTFPSNCEAIVDVAGEHTCDVAHLKSLLDSSNRNASSLYEVDHVYPFSSSTASAILYGQIGSTSFNTLNRILKSYADQNKISYAVRHFVLKRQLKKVRLSGYGVELAVKSTEYKAQDDTKVKEEKGPVQEEVDKYEELEGFIFSKLNELHPSKKDKLEQLKKHIVESSKEIPSLKVWELQELSLQAGQRIIDSPIEETLRVMRDIAQNFPTQARSLIHVSVSNDMKREIERNQQTFMHHHNIGPADAGLFLNGIFFDMETTDIFTLLQYLKQETRVLEALHKLKISDKLLTNLLKMDFTEDKEEYAVDIRDLSIQYINDIENDRQYRTWPSSVQDLLRPTYPGMLRSIKKNIYHLVIVADPSKEDSRDIFKLAESFYVHKAPVRIGLLFSVNSSADGLHDGGVAFLNAFNFISQDKSPYDGLSFITEVYANVEDKDITSEKVISQFKTMYPSEDYELIFGPDSDYDTGKKAAWEFISKTGLSKPPQVLLNGVMLKQKQLTADMFEEAILTEVMRQTPFLQKSVYKGELSDSQNILDFIMEQKNVMPRLNQRVLSSDSKFVDLIGENAETVPVKDMKYFMKRDDDEFRPLTVWVVGDVDTSEGRALVSSAFAHLKATPHMRIGLIHNPKDENVNGNFRKAVDVALETLDLHTSKLFITKLFKTGNAQQIIDGEKSITDFSISNMDVESFLKNMDTFQDKHIALHKTFCKSVLKLLPGQRAVVINGRIVGPFDEDEEFIQEDFHLLEVYSKSLYSDKLVSELEKGVEKSRKNSDLVMKVASILLSQPQMKVRHELKFHGNKHSVVKIPAADTEEPAHEVVVIVDPVSKGAAKLSSILMVLQRVINAHFTIFLNCVDKHSAMPLQSFYRFVLNEEPVFGSDGNFGLAPFAKFSGLPSTPLFTLGMITPENWLVEVVKSPYDLDNIHLEQVESNVHADFELEHLLIEGHCFEQSSGNPPRGLQFTLGTKKKPEVVDTIVMANLGYFQLKANPGAWDLRLREGRSAEIYEISGSENTETLSDSSNVAVLISDFRSHIIKVKVSKKPGKQYEELLQDDTETDSGIWGTITSMPIIGGIVEEWRNIWLAMKSTFTGNKSEQEKGDDKINIFSLASGHLYERLLRIMMLSVLKNTKTPVKFWFLKNFLSPTFKDFLPFMSKKYGFEYELVQYKWPRWLNQQSEKQRIIWGYKILFLDVLFPLDVKKIIFVDADQVVRADMKELVDLDLQGAPYGYTPFCDSRRDMDGYRFWKSGYWASHLGSRKYHISALYVVDLKKFRRIAAGDRLRGQYQGLSQDPNSLSNLDQDLPNNMIHQVSIVSLPQEWLWCETWCSDDTKKYAKTIDLCNNPKTKESKLASAMRIIPEWKDYDTEIKEFHKEYEKSKTISQSTKEDKDTDTHDEL

SEQ ID NO: 4416 - protein, 1652 aa, Trypanosoma rangeli
MLTTVCRRDWGKGIRLLDATLTLLLLLGVSSVLFGALAVEGKGVQVTVTAPWTETPLLQEGCEMVAARGALVGDFYHCLQEVWQRVQAMNNVGGALGLTQKSQNDVLLDMMVKDKWSSIQVDLARMKLAARLYSPAVEAHWQLARTARKLAGGCSIEGRPFVLVAGKVVCSEDLLEDVLAAPGFADKPWKDEGDETFALFTGLDHIHPGSMGRRVIILYGVVGEEQTMRLLQVAERHLHAVRLAFRHLPVVGRMWEEALHVQGYGVTVDLKNVEYKVINEKKNDGAETDTDDADTINEAESLGPVGGFNIALLAQRYPQLRPQLTTFAGHLADMIDRDEVRVDFQMWETQHMGIAAAQQVMDAANEKRLGVLMNFMTKFPLYASKLSKMGASANKKMNTTMQEELSAFAGVLHLGTPQIFLNGRRVSSADFNLFSLLEKLEADEEVYEGVQRVLTSYRVPSANDDGFVSVNKDGLNQVVKLLTRNANQHIASSGLERDDTAPRVWLSKQKIVWLNNLEQDVRFVYMPSALRSILRMGFNGAPTIPRKNLIHVVSVVDPTTPGGAQDIGTILRLEQSSQPIRVGIVFADRKWTPQISSFTEEGSVHVQPSLSSVTAFIAATVWELMNGEEHLQEVLEFLSEITFTLVQHGSIKEEEVLGFSSNVLTLSGKRGVMDIITDPSFVEHYQATQENLRKLKLDKFPLTLINGNIFQENVMQSLRQGFLTELLHVRDLVENGALTDADNVDFYEVILRLSGARERYNDALYKDKTYMDWTLKPVLDFLHHRPFLLPPGKSKRTPLVSSVLVIQSPVGATALGALVKATSNLLQCVDETEKCMHVRLTYATCDVATEAKHRTLVGDLERLLLSRKERGDGNQRLQLVQEFLLKIIAQNKTRQLHDSEAYESWVSNVEFSAELQKLLDVFDADLSAQLQTQRGVLNGFCAQVKAEASSTVLSWSDEALAGEQKKDEETVYYYVNGRRFVYDDSFAEEDFKEADKHELSLAVAMSEALGEIDFTTLSHELQQSDLDSPFYASKVAALTELWRRSAARGSPTEEERSLPSTSGLTSFVVQPVNAGTEPRHTLTIVIDPVAQQSQLPVSLCDYVTRSPLGVSCIVHMGTPQRAVKPMRNFYQFVSELEIRFDAVGRVIPPTAVFHRLPSQHLLTLGVEEPESWTVFPLDAKYDLDNIILDKLPSSSQYVHATYRINSILLTGSAREAGRSAPARGLPLLIRSTNTNPSAGIARDTIAMAILGYFQLQSTPGVWYLTVQPGDYAETFYISQVNGIRVNDAPNNRHSDGFNYTAGQNISVVVSSFTGKFLTLDVSKAPGRERITMEDIEAAYPEHADWPPAGPRTKKPRRPTLNIFSVASGHLYERFLRMMIHSVMQTSSDIHGANTTRIKFWFIENFLSPQFKTLIPLLAKHYGFDVALVTYRWPWWLHKQTEKQRIIWAYKVLFLDVLFPLDVERVIFVDADQTVQADLHGLYNMNIGDAPTAYTPFCRKHPNPATKNFRFWDQGFWVKHLRGRPYHISAIYLVNLRRLRAIAGGDKYRMVYSQLSPDPNSLANLDQDLPNFMQEEVPIYSLPEEWLWCETWCGAESKSRAKTIDLCNNPLTKMPKLDNAKLIIPNWEETDTELEALSEKLLKQHGQQEREAN

SEQ ID NO: 4417 - protein, 1530 aa, Scleropages formosus
MIGTEHIDRMRILTVFLVWVSVVHAGTDSKAVTTSLTAKWPSTPLLLEASEFLAEESQEKFWDFVELNQELKNIDEGSDQFYYELVVERASQLLSPVQLNMLRFALSLRAYSPTVHAFQQIAFNEPPPTGCKAFYSVHGMTSCNTESLKALLETALERPKPYLFKGDHTFPSSAPNSPVVILYAKIGSKDFPRFHQLMVSKANKGEITYVLRHFLSSPKNSKVFLSGYGVELAIKNQEYKAKDDTQVQGADLNATVIGESDSVDEVQGFLFGKLKTLYPELKDQLRELRKHLVESTNEMAPLKVWQMQDLSFQTAARILAAPPTDALAVMRDLSQNFPTKARFITRTVVNSEIRKEIEENQKYFKGTLGLQPGDSALFINGLHIDLDLQDIFSVFDTLRNEARVMEGLRNLLNDMPFIHDMLSLSLQPLDSDYAVDIRSPAIYWINNLETDSRYASWPSNVQELLRPTFPGVIRQIRKNFHNFVIIVDPTHQNTAELLSVAEMFLSNNIPLRIGLVFVVSDNEEVDGMDDAGVALLRAFNYIADEVDNQQAFDAVISMFNIVPRGESLKVEHVTNVLEKRYPYVEASKILGKNSVYDQNRKEGRAYYEQTGVGPLPVVLYNGMPYQRDQLEPDELETITMHKILETTSFFQRAIYLGELGSDQDVVDFIMDQPNVVPRINSRILSTSRPYLDLSSTNNHFIDDYARFLFLDTRGKNTAVANSMNYMTKKDDGIIRPVTFWVVGDFDQPTGRQLLYDAIKHMKTSNNVRLGMINNPSEGVSNITSRIARAIWAAMQTQTANNAKNLITKLCKEETAAALASGVDIAEFAVGGMDVPLFKSSYESPKVDFLLSHAAYCQDVLKLKKGQRAIISNGRIIGPLGEGEVFNQDDFLLLESIILKTSGEKIKSKVQNLGLEEDRASDLVMKVDALLSSQPKGEARVKYTFFEDRYSAVKIRPRENEMYFDVVTVVDPVTRDAQKLAPLLLVLKQLVNVNLRVFMNCQSKLSDMPLKSFYRYVLEPEISFTSDGSLAPGPVATFLDMPHSPLFTLNLNTPESWMVESVRTRYDLDNIYLEEVDSVVAAEYELEYLLLEGHCFDVTTGQPPRGLQFTLGTASDPLIVDTIVMANLGYFQLKANPGSWILKLRKGRSDDIYKIYSHEGTDSLPEADDLIVVLNNFKSKIIKVKVQKKPEKLNEELLSDGTEEEDSGLWSSLKRTFTGAEKVEDNKVEKDDVINIFSVASGHLYERFLRIMMLSVLKHTKTPVKFWFLKNYLSPTFKAKEYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKKAKTIDLCNNPQTKEPKLQAAVRIVAEWSEYDQELKRIYNKFLEEKERGSTADNSKISQGSKTGRFAPVTSTSQ

SEQ ID NO: 4418 - protein, 1522 aa, Boleophthalmus pectinirostris
MRNRVVSLLLLLLLLSPQHATSSKGVSASLKAKWSMTPFLLETCEFVGEDGNEKFWQFVDTVKELTVYKQGESVRSYFNLIVKKAGQFLTDLQVNLLKFALSLRTYSPAVHASQQIASDEPPPDDCTAFVSVHSQHTCSPKDIKKLLKAAAGRPKPYLYKDDHIYPGGNKTEVPIVVLYAEIGTKKFTSFHKVLSEKAEEGTLLYVLRHYIEKSQPKPMLLSGYGVELAIKSTEYKAVDDTQVKDSRAPLAGDDDGNDEVQGFLFGTLKKAHPELKEELGELRKHLLESMNDLAPLKVWELQDLSFQAATKILSAPKFDTLKIMQDLSQNFPSKARSLTRVAVKQEMRKEIEENQKHLSETVGVHPGDGELFINGLHIDLDVHNPFSILDILRGEAKVLEGLHNLGIKGEHQAKLLRLPVSHVDDSYALDIRDPAIMWFNDIENDPMYRSWPSGVQELLRATFPGVIRQIRRNFFNLVLFLDPVQEESVELMKLAELFYKHKIPLRIGFVFVVNTKEEIDGFSDAGVGFYRLLNYIAEEYDLSQALLSTVSLYNKVDAGEQLSVDTISAYLKRKFPKANAERILGPDSEYDERRKEGALFYKKSGLGALPLALFNGVPLSPDEMDPDELETVLLQRIMDTTNVFQRAVFMGQLTEGTDVVDYLMEQANVVPRMNSIILSNDRKYLDFTANPIVHDWEDTTMFSYLDSRDKTAVVAKKMKYFSTSDSNEVNAVTMWVVGDFDKVSGRKLLINALKHVKVSRGVRVGVIDNPKGKLTEDNTVLYRAIWAALLTQKKKAAVEFGLKLLKEESNQLSQKGSKMKEFLLKGMDDDAFEKKFNTMEVDFIQSQQLFCQEVLKLGPGERAVISNGRILVPFNEEEEFTVDDFHLLEKITLSGSAEKVLAKVQEMGIKPKQAIDLVMKVDALLNTAPKGEVRRDIRFLKDTHSVLHLSPREHEVFYDVVAIVDPLTRAAQKLSSLLNVLGQVVNMRLQLFMNCKSKLSEMPLKSFYRFVLDPDVKFLANDTVSAGPVARFLDLPESPLLTLNMITPESWMVQAVNSPHDLDNIHLLEVSGIVSAEYELEHLLLEGHCFDLSTGQPPRGLQFTLGMSQNPLMYDTIVMANLGYFQLKTNPGAWILRLRKGRSEDIYQIVAHDGTDSPADAGDVIVVLNSFHSKIIKVRVQKKPDKINEDLLSESTESGGIWDSIASITGGGSKKEDADKKKEDVLNIFSVASGHLYERFLRIMMLSVLRHTQTPVKFWFLKNYLSPSFKETIHHMAQAYGFQYELVQYKWPRWLHQQTEKQRIIWGYKILFLDVLFPLAVDKIIFVDADQIVRADLKELRDLDLEGAPYGYTPFCDSRKEMDGYRFWKSGYWASHLGHRKYHISALYVVDLKKFRKIAAGDRLRGQYQALSQDPNSLSNLDQDLPNNMIHQVAIKSLPQEWLWCETWCDDKSKTTAKTIDLCNNPKTKEPKLTAAARIVPEWVEYDNEIKRLLRGVQEKQETVLERQGSSSRTKDIHKDEL

SEQ ID NO: 4419 - protein, 1622 aa, Fragaria vesca
MGTRLAYAFIILICLIGSVSAQNRRPKNVQVAVRAKWSATPLLLEAGELLSREHKDNFWEFIDIWHHSDKDDLDSYNAKGCLKTILKHGRSILSEPLASLFEFSLTLRSASPRLVLYRQLAEESLSSFPLVDETNSRSTSGNSETNEHVEIRKSDHLDVGLNPKSPNGKCCWVDTGGALFFDAAELKSWLHSPKDCSRDSFQQPELFEFDHIHFDSTVGSPVAVLYGALGTGCFREFHVTLVEAAKEGHVKYVVRPVLPSGCEAEIDRCGAVGAKDSLNLGGYGVELALKNMEYKAMDDSTIKKGVTLEDPRTEDLSQEVRGFIFSKFLERRPELTSEIMAFRDYLLSSIISDTLDVWELKDLGHQTAQRIVQATDPLQAMQEINQNFPTVVSSLSRMKLNDSVKDEITANQRMIPPGKSLMAMNGALINIEDVDLYLLVDLVHQDLLLADHFSKLKIPHSTARKLLSTLPPPESNMFRVDFRSNHVHYLNNLEEDAMYKRWRSNLNEILMPVFPGQLRYIRKNLFHAVSVIDPSTVCGLQSIDMLISLYENNFPMRFGVVLYSSKLIKHIETSSDDSQIEEDISTSIIRLFIYIKENHGIQTAFHFLSNIKKLRGESDGSADDLEMHHVEGAFVETVLPKVKSPPQGILLKLEREQTYKERAHESTIFVFKLGLAKLQCCLLMNGLVLDSNEEALTNSMNDEMPRIQEQVYYGHINSQTDVLNKFLSESGTTRYNPQIIAGGKPRFTSLCTSVLGGEGVFNDISYLHSPETVDDLKPVTHLLVVDVSSKKGMKLIHEALQYLIEGSDRARVGVLFSVNQGADLSTLLFVEVFQITASLHSHKKDVLHFLDQVCSFFEQNHMLAPSEGAEITQAFIDKVSELAEKNGLSSKAYKSALSDFSAEELRKRLNKVAQFLYRQLGLDSGVNGVITNGRVTVVNEESSLLSHDLSLLESVEFTQRIKHIVEIIEEVKWQDVDPDTLTSKFISDTIMFVSSSMAMRDRSSEGARFEVLNADYSAIVLNNENSSIHIDAVIDPLSPSGQKLSSILRVLWKYVQPSMRIVLNPLSSLVDLPLKNYYRYVVPTVDDFSTTDYTVNGPKAFFANMPLSKTLTMNLDVPDPWLVEPVIAVHDLDNILLENLGETRTLQAVFELEALVLTGHCSEKDHDPPRGLQLIIGTKSAPHLVDTLVMANLGYWQMKVSPGVWYLQLAPGRSSELYVLKDEGDGSQSKTLSKRITINDLRGTVVHLEVVKKKGKEHEKLLLSDVNEKTQDATEGNSWNSNFIKWASGLIGGSEHSKQSENTSWEKGKGGRHGKTINIFSIASGHLYERFLKIMILSVLKNTRRPVKFWFIKNYLSPQFKDVIPRMADEYGFEYQLITYKWPTWLHKQKEKQRIIWAYKILFLDVIFPLSLEKVIFVDADQIIRADMGELYDMDIKGRPLAYTPFCDNNKDMDGYRFWRQGFWKEHLRGRSYHISALYVVDLKKFRETAAGDNLRVFYETLSKDPNSLSNLDQDLPNYAQHTVPIFSLPQEWLWCESWCGNATKSKAKTIDLCNNPMTKEPKLQGARRIVSEWPDLDLEARQFTAKILGDEVAIQEPPPDPNQPGSVMDSPPEDLESKAEL

SEQ ID NO: 4420 - protein, 1485 aa, Helobdella robusta
MILSKSVIVNLNAKWPTTSLIAEMSEFFATRNAELYWTFVEGTTKFEFNQKTYNSFDSYKTALSVAENLLTSKQVSLLKFYLSLRYFSPMVQMHQEIADEKLSSSGHCEVFVEVENFITCELMAFKAFIRAINSSHPLVLKNDHIYPTNLKDGIHVILYGQLGTKSFNFWHDVLKQMSNDEKIIYVHRHFLKTAASTKCSLSGFGVELAIKSTEYKAKDDSKILEQSDKKNEMKKDDVIEGFNFSKLREIHPDSEKDLTEFQQFLIDGLNDMAPLKVWQLQDLSLQLAQVVLNAKENAMHVLVDLCQNFPSKTRELIKVTVKDDLRKEIKENQKYLEQALNLYPGDSAFYINGLNVGTDIIDIFNILDVVDTEMKLLDGLHQVSLQFNTTFQKLSALLHVDFKEADLSYGLDIRHPSIWYINNLESDEQYRSWPGSVQDLLRPSFPGMLRHIKKNMFHLVIFCDPVDKKSLEILKMIENFYFHSAPVRIGLMLVSLQEDEAKRNLSNSIIQMFAAIHKSRSPIDALQFLTNFDEKLGEEENLTFDAAVEYFKTKYSNEWSEVQSADHALYDLQESEDYFWRTGLMKLPQVLLNGVPFTEDEVNNEFDENVVRKLLKQTNDFQKAVFNVAGPSGLTNDIIKHLVLQKNIMPRINSQIFSENNVYIDLTQSNNNVAVASDFSYLFKNGLFRVDMLYELIYRPLTIWIVADLRFPEGRSLFNSALKHLKHTNKLRLGLIHNIDSWDSAEDVELVLAVQLAISTLKLNVAKNFINKILKEENVEMLKNREKSLSNFAVGNMEMDLFVENLNSVIPTVHSHRQFCHQVLKFGPSASGVIANGKVFGPLSKTFSFVEQDFDLLEKFSYSSFGEKISNHLKNLNIDELKSSELAMRLETLFGLNGMKEGRKQVQLPKQSASVLKMAANEEGPSFNLIAIIDPTSRIAQKLSQIIMVLCQFINCQTQIFFNSKEKLSELPLKSYYKFVLDRELYFDDDGELLSNSAIFTNLPEKSLLTLNMDTPESWFVESIYSPHDLDNIFMHEVVENNVEAVFELEKLLLEGHCYDVVSGNPPRGLQFVLGTNSTPALVDTIVMANLGYFQLKASPGLWYLRLREGKSKDLYDIVKQNPEEAKDIMVVMDSFKSKIIRVKVSKKPGKEFEDLLSGDDDDDGSEDYFGLWGSISKGSSATPKTSDEEDKTINIFSLASGHLYERFLRIMVLSVMKNTKSKVKFWFLKNYLSPSFKDFIPKMAEEYSFEYELVQYKWPRWLHQQTEKQRIIWGYKILFLDVLFPLNINKIIFVDADQVIIFNLYSLTDALVKNLTFAFAPSTFCIFLTTNMFLRFWKTGYWSSHLGHRKYHISALYVVDLKRFRRIAAGDRLRGQYQGLSQDPNSLSNLDQDLPNNMIHQVAIKSLPQEWLWCETWCSNEEKSKAKTIDLCNNPKTKEPKLEAAMRIVDEWKSYDDEIKRLWDSVYSQNETDSEQKHEGHVEL

SEQ ID NO: 4421 - protein, 1320 aa, Candida inconspicua
MIYFACVVSLILVWTSSIVNCQNISFSLQANWSKTPFKLNVLEAVSDVDNSLYEPLVLKLLGIDFDIDNNEYNIIEEFNELDDAAFYLYAKDLLNSDYKKFVVDMKIANVLNSPRIQAQVDYYNSNIKSGHKCNQDAFIVEPIGTNVYCDKDAAFMLQNHDNNMLFTDFKLSFDRMLGSHVTNKTYFIYGDFRDEYFRVMFFNMYQFVHSGKINLVWRYVDAHPSLAPEILSGYSVDVIAAEHHFTAAEDVRRHVINQLLENKFSILRNVPAETLQHYAETGIFNTADNQTEFNVEKGIYINDAKLEGYDFLNLIEIIGKEILVQEVFRKVNIDLKDSLKSLKSFTGNLSNDIEQYEQRYQIFKSPAIAFLNDIEKEPRYSKLENDDSVYRERFVIDDLPKMKQNIHQVIFIIDITQPEQINKLLEFYDVVFNNYLPIQVGVVPVVDSNRNGNMEGISKLYGTRDNLGRSKTHSYLLMLQRFLYSYRKVYERIFDEIMFPDATEDSLNSMILELKQLSESYELNVEHPLINVNGVFFELNDYESIFRQINRDSFYLHSSLMDGKIPHSIKMKSFLRRDSISLRNENVFPSNFEIVKSQILLPPNLEDFGVWIQSGLLGITKPQHDHETPITFNLIGSFENADFVQQVKEALTLVKHCSGIRLNIFDGSFSENFKYLMTISQLEEQIEYLQNEKVEKPEIRRIVENKPFSQYVKAFNIKDEDINSYIVISGRKIKLNRILNSNQLISLACYERLHRLRPIWQHYRAFLTLSKDVDIYTNFELFSWAISYSSYNMNNRNNLPFIDKADIHIDSDTELINIKLVTDLSTTSQEWFHVIELMKELDFVSVDIYFMTSTKFEESPLTWSKHHMGINPLGPKNVIEFDDLPQAYEVDVKTPSSWIISTLSSNSTHITYELRNLVVDAYLKDSEGNPMMNIPVGLLSDDQEIIEAYYSIPEDGYVQLKTSPGQWKIELEHGSDASILFDLRRKVFETIGFEREARYVSLKRKKHFVNISFNSLQPNASILERVYFKAQHLLHRRQETITADVNIFSIPTGTCEQKRLLYMIASVMKHTSSVVKFWIYDELLSAETKNHIEVLSKKLDFRYEYVYYQWPSWLPRPENKKQRAWGIQHLFLDTIFPTHVEKIVIISPIQIIKDNVMNLNKHTGDGNAIALSSISPSDIPESVNRDNILKQVFGSRKRVYVGNVAVVDLNTFRIEGIGAQLRQYFVGSYTDIMNSTNIVNTNQLYENIEAHQVPSSWLWCNGMSEFNLLDYLKDQEFGSDSINDFQFADEIMERQTLQEEIDKILNSNLLDDDVINHDEL

SEQ ID NO: 4422 - protein, 1526 aa, Bos indicus
  MOD_RES (758)..(758): Any amino acid
  MOD_RES (995)..(995): Any amino acid
MAKAAGVVRLLLGFMALWLSLLGARTASASKAVTHLRERKGRLGGGLWRLVQALQLMEAVLVFRNREFIAEESNEKFWQFLETVQELAIYKQTESDYSYNNLILKKAGQFLDNLHINLLKFAFSIRAYSPTIQMFQQIAADEPPPEGCAAFVVIHKKYTCKINEIKKLLKKATSRPRPYLFKGDHKFPTDKENLPVIILYAEMGTRAFRKFHAVLSEKAQNGEILYVLRHYIQKPSSQKMYLSGYGVELAIKSTEYKALDDTQVKTVTNTTAEDVTETNEVQGFLFGKLKERYSDLRDNLTIFQKYLIESNKEMMPLKVWELQDLSFQAASQIMSTPVYDAIKLMKDISQNFPIKARYLTRIAVNQLMREEIQENQKHLQDKFDIQPGDAGLYINGLRVDMDSYDPFSLLDMLKLEGKMMNGLHSLGLKGEDMSKFLKLSTRSWDHTYALDIRHSSIMWVNNLETDEMYLTWPSSYQELLKPVFPGSIPFIRRNFHNLVLFIDPAQEYTMDFIKVAELFYHHKIPLRIGFVFIVNTDDEVDGKNDVGVALWRAFNYIAEENGVSQAFMFIVHMYQEVENHKILTVNNVKRVLQNKFPHANIWDILGIDSKYDGERKAGTNFYKMTGLGPLPQALYNGESFDREELNFKELEMAVLHRMMDTTAYLQKEVFMGALNDRINAVDFLMGKNNVVPRINPLILHNKWQYLNLIPTSVTADVEDFSTFLFLDTQDKSAVIAENMHYVTERDDDVISSVTFWIXADFDKPSGRKLLFNALNHMKTSGHSRLGVIYNPTSKIDEENTTISRGILAAFLTLKNSFLRNFLRKLAEEKTAAAIYSGNKIKTLLTEGMDKNAFEKKYNTIGVNIFRTHHLFCRDVLKLSPGEKGVVSNGRFLGPLGEDFYAEDFYLLEKITFTKFVANIEDIVKNTEINSKNLSDLVMKIDALVSSLPKRASRYDITFLKESRSIIKINSVENDMSFDVIAIVDPLTREAQKMAXLLIVLGKIINMKLKLFMNCRSKLSEAPLKSFYRFVLEPELMLANDITGPVAKFLDIPESPLLTLNMITPEGWLVEIVHSNCDLDNIHLKDIEKAVTAEYELEYLLLEGHCFDLTTDQPPRGLQFTLGTKNKPVVVDTIVMANLGYFQLKANPGAWILKLRQGRSEDIYQIVGHEGTDSPPDLEDVIVVLNSFKSKILEVQVRKKPDKIKEDILSDKGEKKRGMWDSIKSFTRSLHKQEDNKEKDVLNIFSVASGHLYERFLRIMMLSVLRNTKTPVKFWFLKNYLSPTFKEVIPHMAEKYGFQYELVQYRWPRWLHQQTEKQRIIWGYKILFLDVLFPLAVDKIIFVDADQIVRHDLKELRDFDLGGAPYGYTPFCDSRTEMDGYRFWKTGYWASHLLRRKYHISALYVVDLKKFRRIAAGDRLRGQYQTLSQDPNSLSNLDQDLPNNMIYQVAIKSLPQEWLWCETWCDDESKKRAKTIDLCNNPKTKEPKLKAAARIVPEWVEYDTEIRQLLDHLENKKKNAVLTHDEL

SEQ ID NO: 4423 - protein, 1564 aa, Amyelois transitella
MQVTGCRIFFVCLACVFVTSATNNPTKRDERKSKSVTSFVSAKWEATPIVLELAEYLADENPDLFWSFVDGINSLKTSLESLENDKQVYDAIIGVASTLLAPAQLRMAKLALSMHMTSPTVHMFDQIATRDGAKDASCDVFVSIAKRKVCDNDVLRDILKEYDQYNPDINKQETYLLDHSYPSSDNRSLSAILYGELGFKEFATKHKILAAYADRGAINYVVRWNVKPRAKPKLRLSGYGVELQLKSTEYKSQDDSTPKESEGGEAPTPSEEEDENDPQNQIDGFNFARLKNIFPALRTPLERFRRHLSESSEELAPLKVWQMQALSMQAAVAVADAHDAGGDEALKVLTSIAQNFPMQTKSLIHINVPRSFREEVLYNQDVWASALGLRPAEPLLLVSGAQYDAEEVDVMALLAALREDIGPMNTLHALGLPKKLINTLMSLELGESYTWEEYGLDIRDSAITWLNDIEADERYRRWPSSYMELLRPTYPGMLRNLRRNIYNYVIVVDPTSFASGPPIQLGETLLRHATPVRVGLVLAPGTNALNAAVRSAFNYVAQEKNSNKEAFYFLSQLLNLKEETLTLDLVKSQLKKYASSSANINEIVAEDSEYNFGHQLAEEFVSKIGVNKYPQVLINGVPLWEEGATSMTSVELLEEALVSALSRHTARFQRAVFRGELSDSDDAVDYLMKQPHVMPRLNRRILGSETAQHLDLNGVPSSSELFAEDKIHRLMHLTGRDALATALPVLRYFTKPGKPDKVTQTIWVAGDLNHKRSRELLRNAITFMRETGGVRVAFIPNVEGTGADQSMNKVVLAAVTTLEPSKATKYVAQLLEDEGCHERQDCDILPELVPALNKYEWVLKASRVLCARSFKLRASQRAVVHNARIVGPFDDDEQFTLDDFLLLERYSNQVYGDKISEVLDKKKTSKNDVVQDDDDDSEEEIGPMNVETRLKVVSVLSGRKPRSRTAIPPGLRTEHSVVTLPPTNANEAAVEIVAVLEPASVAAQRLAPLLLVLRKVINCRIKLFLNPQDKNSDMPLKSFYRYVLEPELTFTPSGAMSGGALARFSRLPHAPLLSMELRTPPNWLVECVKSVYDLDNIRLADVDTVVHSEFELEYLLLEGHAWDTTLGTPPRGLQLILGTRENPELMDTIVMANLGYFQLKANPGAWILRLRPGRSDEIYEIVGHENTDTPAGSEDIQVLMSSFRSHVIKLRVQKRPDKQHVELLAEGDDNSGGIWNSIASSFGGGEEQEVQDETINVFSVASGHLYERFLRIMMLSVLKNTKSPVKFWFLKNYLSPSLKDILPYMAQEYGFEYELVQYQWPRWLQRQRDRQRTIWGYKILFLDVLFPLHVKKIIFVDADQIVRADLKELVELDLGGAPYGYTPFCDSRKEMEGFRFWKQGYWRNHLQGRSYHISALYVVDLKRFRRIAAGDRLRGQYQALSQDPNSLSNLDQDLPNNMIHQVAIKSLPQEWLWCETWCDENSKKYAKTIDLCNNPMTKEAKLSAAMRIVPEWKTYDEEIRALQARVRRGLYHTTDAEQEIDSAHHDDIPHESKIEKDHDQHTEL

SEQ ID NO: 4424 - protein, 1491 aa, Botrytis cinerea
MGGFTLPWGLSGALLASTYLHSICATASPAINVGLQTSFPSAPYLIELLETAATENVSSYFPLLDRIADGYFAKASTDKDLYDNFIKVLTEDGHMDAEALSSYKLALSMRVAAPRIEAQFQYYHTAAEASIKTEQSSSCPTWVLFDGHQYCSPTLDEPHGTVTGNSQTQELPFDYVLGNPTGPHSILYADITSPTFGLFHKTLVKTAREGKTSYRLRHRRAIDAGSNKPLMIPGYGVELALKRTDYIVIDDRKDDDEGTTKSKTEAKVKFEDEEVADLKPLSTSELSSLGLKASSFIMQSERPFDSLIKLSQDFPKHSSAIASHNVSSDFFAEHNYNRGKLVPAGVNVWWMNGVQMIDRQIDAIAILDILRKERRLINGVRDLGLTGPEAVQLLSHSSISEAKSDGDVQRFDWRDEIEGGSVIMWLNDIEKDKRYQEFPETLGALLQRTYPGQLPSVRKEIFNLVIPVDFSAIEDVALVAETLASFVKRKLVLHIGLVPITTSPAAVEQTRVLYHLLDVYGLSGAIAYLEASVMNGVAGPTEKSFQAATEGREVRAEKIAIPLVDLLKSDHYNDRIDAASRWTTRLSADGEFPPIFVDGVALSRDENWLQAMVQRLTADLQVIQQGVFNNLFTQESYIPDFFLSEATPRRNSLIVPESDKNLKIIDITTLSKQHGDVLSKLPKIGSDSASPKEDWAHMILVADLSSASGLELLFSAVKFRESVPALEITILHNSPGEMKTSDFSTHLFSHVQKKSDKPLVDAQVLPSLVSPEGPELDLTTQDSARTYWKEAGPLVRAAGLSPGENVILLNGRLVGPIPAGSKLNQEDFEQLISYERAKRITPVYAAMQSLGLSDKIADPLAGAKISSMVALSSVSDTPDGIFEQAPTNRISAFDVWNSSYTSIETGDSSTATIHMTVTIDPASEQGQKWVPIVKAISELEGVYLKMFLNPKERLQELPVKRFYRYVLESKPNFDDEGALIEPGASFTGVPQEALLTVKLDIPPAWLVAPKVSIHDPDNIKLSSIKADVDALYELEHILIEGHSRDMPSGSPPRGAQLILGTERDPHFADTIIMSNLGYFQFKANPGFYKIDLQSGRSSEIFKIDSIGSKGWAPGPGDDTSEVVLMSFQGATLYPRLSRKPGMEGEDVLEAKVESAMDYVSRGLNFAQGILGSKTKAAAAVEEQAEINIFSVASGHLYERMLNIMMVSVMKNTKHTVKFWFIEQFLSPSFKDFIPHLAAEYGFKYEMVTYKWPHWLRGQTEKQREIWGYKILFLDVLFPLSLDKVIFVDADQIVRTDMIELVNHDLQGAPYGFTPMCDSRTEMEGFRFWKQGYWEKFLRGLPYHISALYVVDLRRFRQIAAGDRLRQQYQSLSADPNSLSNLDQDLPNHMQQVLPIHSLPQEWLWCETWCSDESLKEARTIDLCNNPLTKEPKLDRARRQVPEWTLYDDEITAVDKKRKGINGDRNESAEGRNTKSRTLEEIVDTKTKKDEL

SEQ ID NO: 4425 - protein, 1298 aa, Rasamsonia emersonii
MFAQDRPSMWLYKLPLTLDRISWSFFYRAGANSVHTSIRETAAGENSTAYFPLLDRISEGVFEDAVTEKQLYDRFLKVVREDGHLADEESLSSFKFALAIRSAAPRIEAHYQYYNTSVQYSLGTAQDAACQVWVHMDGKQYCSSALERAQQDVAGELNPRELPFDRTFGDLSAPPAVLYADVASPVFGEFHQKLSALAKEGQVSYRVRYRPPQHEDPRPVFVTGYGVELALKRTDYIVIDDRQAEAKDEKDPKRTKVTTPDTDDLEDDSPADLKPLSSSEVDRLGLNSASFVMDSAEPFDTLLKLTRDFPKYSSSIADYNATDKFLKEYHGNRAAGFPAGRKIFWINGIQIDPRQIDAYSLLEHLRRERKLIADFKKLGLSASEAVDLLSHRALAEVQANNEPQRYDWRDDIEGGVVIIWMNNLEKDKRYEDWPTSIMALLQRTFPGQLPSVRRDIFNVIVPIDLASEADVLLLVNYIQTFIKRGVPVRFGLVPIVHSHDSTSQAKVAHHLHETYGLATLLKYFEEALSKKKIASADKSAFQAAVADRPVRSGRQSLTFEEVLQSKELDDVVLRTAKYLKRLDMEGPSPPSLVNGVVLTRNENWLQEMPMRLNRDLQLLQQGVLEEVFQEDTWLPSYFLFQAAESRNEWIIPEDASNVRIVDLPQVADSRQDVMNNLLRVASGEGHATNNVHLVVIGDFNTERGLELLTTALKLHQSHGEVEVIPLHNPDVEKPSSGISSLLYQVLTRADRTDISELLTEIESLKSSESTAEEPAYWTEAKPIVEDFGFVPGSRGVVLNGRAVGPLPSNVSLSEKDFEQLLSYERSKRLEPVSEALKALKLESKIPDTLSFAKLTSLVALSTIPDVPEGLFESTSKLRQNIFKNWNDTHSAITVSNSDDPTISIVATVDPTAELSQRWVPILKTLSKLAGVNVKIFLSPRDHIQELPIKRFYRHVLEPEPSFDEEGSLIRPGASFSGLPKEALFTLGMDVPSSWLVAPKESIHDLDNIKLSSLKEGTNIDAIYALEHILIEGHSRDTTTNSPPRGVQLLLGTDKDPHFADTIIMANLGYFQFKAQPGFWKIELKPGRSQRIFNLDSVGGMGYIPQPGDENNEVALLSFQGKTLFPRLSRKPGHENEDVLETGAKPGSAMDYVSKGLNFASGILSNVGIGPKSGTAEKHADINIFSVASGHLYERMLNIMMVSVMKHTKHTVKFWFIEQFLSPSFKSFLPHLAKEYGFSYEMVTYKWPHWLRGQKEKQREIWGYKILFLDVLFPLSLDKVIFVDADQIVRTDMYDLVSL

SEQ ID NO: 4426 - protein, 1504 aa, Trichoplax sp.
MASKGYDRFLSFLLCSLLILPISSFDDNVKSVNVALVSKWPSTPLLLEVSEFMSKQGGQTFWSFVNSINKLPDNSSDLDTYNFVMKKGQDLLQPLTLDVLKLSLSLRSYSPRVEMFLQISRHFKDKPKCAAFAQLNGKFICTTKELEAELKSSGLHSEPELYTFDHIYPTSAQASDLPVAILYGQLGENRCRELHSFLYKRAKDGQIKYVFRHFVVNEDQERLSLSGYGVELDIKSTEYKAEDDTKVDEANVDNLGSTQESSDDEVDGFLFHTLRKKYPQKLKELGQFKKHLLDDRNEVAPLKVWQLQNLGFQAAQRVLSAGNDALTTLRDISQNLPTFARPTIKFQVRNEVRKEIKANQKIFSAELGLDAGQSAMYFNGVPFALGEMTIYDLLEIIEEDSNVVSNLQKLGIAKEDQQHFIKLAAKSTFSSRVIDMRDNSVIYINNIETDQDYFRWPSSVQELLRPAFPGMLRYVRKNLYHVVFCIDPVESQSVEVIQMLDLFHRNYVPMRLGILFVSANKNKNVDGTVDASVGIVRAFSYIQESKGAQAALRWLTQLYGNSIPSAKQVVEKFKSWFGGTLVNKVLKNGGTYDNLRLESSSFFDSIGIRKLPQVIVNGVQLTDLHDIEGGIVGEYHNQMPKLQEYVQAGKISDSTNIYDYLMSQPHVIPRYSYQVFRDNLHYIKGLSRYTEESKADEVEGTSAAASIIKSVNYVISSKDSLKVRPLTFWVVVDLFTSSGKQLLLQALQYLSSSEKARVGVIHNTKSSSVLDGKRHSLIELYEALVQVDNFAEISSVKSLLSHFVEKQIDSISSLDEIRNVNVNDLKSALSEEAFQKSVYRKVQKGLEFCQSFINLEAGQNAIIANGKVYGPVSDDDPFVASDFRLVETLDWRHHLKKISKLLTKYQPGDTLDSIRMVSDMNMAISGLISDNSNYVRTQMPSLKHAHSAVTFSNSGSELGHEIVAIINPLSKDAQVMTPIIMNLLKATKVDITVLMNPASMLSEMPLNSFFRYVLEPELKFSKEGRLISKPVAQFTKIPESLLLTLNMKTPESWMVESMISVYDLDNIRLDQLNQGVKALYALEYILLEGHCFDSVTSEPPRGLQFVMGTDTDPAMVDTIVMANLGYFQMKANPGLWKLQLRPGRSENLYKIDSHDGEIGKSTDSIAISIENFKGKIIQVKVGKKPGKERESLLSDVPAGREQPGIWDSISNFVGSGTSQEGIETEFNETINIFTVASGHLYERFLRIMMLSVLKHTKNPVKFWFLKNFLSPNFKDSIPVMAKNYNFGYEYVQYKWPRWLRQQTEKQRVIWGYKILFLDVLFPLGIKKIIFVDADQIVRTDLKELMDLDLEGAPYAYTPFCDSRKEMDGFSALYVVDLKRFRLLAAGDRLRGQYQGLSADPNSLANLDQDLPNNMIHQVPIKSLPQDWLWCETWCSDGSKATAKTIDMCNNPLTKEPKLDRAIRIAEEWKDYDKEIKSVLEEYKNAESKSSSARDDHKSKRKDEL

SEQ ID NO: 4427 - protein, 1409 aa, Cyberlindnera fabianii
MLPLLPLFWTLVACQINIQLQAQWENPPFSLRLLETVSSENESYYLPALSKIAGFSVYIDDDDDAEGIQELTTDESLYHAVFDLLTPAERALFDIPLANKYHSPRIISHYKHYTDSVVPVFEKKVTSKCGNHSNTWLKFNDVVYCNPDDVYALMTDSSSTEELVSFDRLIGSSGPILVLYSNVEDVNFRPFVRNLYEAAQAGKLRFVVRYIPQGLDEKEVLSGYGIDLTLKRTDYIVIDDRDILREAQEPLGQGAKSNGALLNVHDEDIKAVGKEDIKNLGLQLSSYVMDLEDDETKLNTLVSIMEELPKYTSHLVKKEITQSFLDQVNYNQKLGISSTGTGIFINGRLLDEDEQTVFGLYDVIKDELQTVQSLGENGLNSTRSRQVIEKFALLSLYKSRSRPSTRYKLPANDSSPIVFFNDIENEQLYSSYSTDVASYIGRFQMGQIPEARTNLQTLIFMFDLSDSDHLSILNSVVQAVRSNGIAQRVGVIPLPLTEHGTTLANNLIHISKTGGMASSRKFIKSLQRSGAVPEEVTDMDYVSSHVRPFMERFDVNGPVLSVNGAFHDFDNNWVYSMTRQVGEDVNFVFGMAYQKAADTFEEVSEMFYEDALDFRNTILFPNDKSEIKYRLYDTTKKLGNVFEFTAGSKGNHLATLTLAGDYGSEFTLTQLREILTLALDSNWDLKVRMIHTSDGVSFLGRLHQALNKSVDHGLAVLDEILHEKQFSEAPPSPLVLQALSSMGVESSSFLLLNGRYVELKDRLIKAIYLKSFVQTEIDQRLSVIQDLLRTDLPASDNIHDWFENVSSLVTLSYYGESQFGAGSIPRFDLSRVRTEHSISFGERSQSLLHILAVIDPAQELSQRLISLIKAIKGLEMISVDIVLTPQQDMDALPVKRFYKGNVKGRVEFKDGSLWEEPFVTFENVPSKTLFTLDMDVPASWIVIPKKSRSDLDNVLLSQSGPVTGVYELESITIEGNAFDAVTNDPPTGLALQIDGSDTSVMTNLGYFQLKANPGIWNLSIKEGRSSDLYDLVSESELSLFTLKGLHIRSSMKKKSGREGESLLSADEDAVIAKDRGSKLTSWFSRDQKKKKQADINIFSVASGHLYERLLSIMTVSVMRHTSHTVKFWLIDNYMSPSFREFLPYLAEKYGFEYELITYKWPSWLRSQREKQRTIWGYKILFLDVLFPQDLEKVIFVDADQIVRTDMIELVEMDLEGAPYGYTPMGDSRKEMEGFRFWKQGYWKKFLGDNLKYHISALYVIDLKKFRSIAAGDLLRQHYQALSRDPESLSNLDQDLPNNLQQQLKIFSLPQDWLWCETWCDDESLKTAKTIDLCNNPLTKEPKLDRARRQIPEWTVYDDEISALMKETVYLGQGIGDNEKESKAEEEVVRSEVKLNDYLKDEPDLEHDEL

SEQ ID NO: 4428 - protein, 1547 aa, Lentinula edodes
MLLLLPFPAPPFLVEIIETVSLENSKAFFPFLDRVTDPDVVIITPNEAPEAIYSSSLEVAKNMGLFSESGALAFVEMSLALHAATPKIEAFYHHYTETVEQSARRKECGSWVDWYGSVVCDVESLAQLAGLDTIDSMENYSSNYTRPKILPFDHIYPPPDSRLETPPRTAILYASLASPNFRELHTYLMRLTGHAEHRIEYILRHVPPENLDTSKRSYLSGYSVALDLKKMDYLALDDRHLGTQRDDPSLSDDQEVEAPVVDPIFSLLDGYPENSTAPDANTPPTEDELHTIGFQASQLIMDSSNPLLTLMHLSQNFPKYVTTLARRVSVNEDLAQEVHENQLRVQGGANAMWINGVSVAEKDLNAFGLSRLLKKERGIMMQLIGLDLERGEAIELLTHPILSAAQDSKDVLDGLVDASDRAEGGDVIIWWNDLEKDKRYNQWGASITGLLRPLYPGQFHMLKLNLFNVVLVLDLSRPANLVFVAGTMHSIIERGFPFHFGVVPIVETEDGARMARLVYFLLNNFGRKITMNFLKRVAHPFTMPGAQGSLQWSNVRHEYDGLMVAEANAGATTDQTSVDFESVVSGTNSIFKSLDGVQAYTNRLSATLSVFPSGHGFINGKHFAFDESFLRNMQTEISRQLMHLQEEIYEGHLTEEDNGRISSYFFDLPTTARRRNKYIVPSKENLDIISLPELQKDSSSIFAPSSFVYPTEAEVIPMTLFVLADLNAKDGLDFVKEALLSMEKNSTARLGFVHNPATEGVSQGVSISSIFAHLVDHKQLSKTSPEELLQALNGGQHASEVDESNTQVPFSTVRALKNALKLDHLDNHKPNEQSGFLDACQWFVRSIGVEPGQNGIVINGRIVEPIIPNEFLAADFQALQEYELLKRIQPVLSALEDIRPGFKSLDRATITHIVSMASSIISAIQVPDPSEVGLFDAPRRPRNRNYQTLETKHTLFEVGDNSTALYQWISHIPDTYLEIRLNPTQYGEVPLKRFFRYNLRSSLSFDETGQEVSSQTVFENLPLEPIYTLAMDVPSSWLVRPREAMYDLDNIQLGSLAPEDFSVDTIFDLDYIVVEGHARDTTTQSPPRGVQIQLVSGSMPIDDTQVVANLGYFQFKTKPGVFKLEIREGRGRDIFVTESVGNEGWNSPSVDEVGNEITVTSFEGQTLYPRFSRLPGMEREDVLAEEEEEESSSVFESMFASVKSLFGTSEETGIVETADEQADINIFTVASGLLYERFVGIMILSVLRNTKSTVKFWFIENFLSPSFLEFIPHLAEAYNFKYELVTYKWPSWLRAQKEKQRIIWAYKILFLDVLFPMDLKKVIFVDADQIVRADLQELVDLDLHGAPYGYTPMGDDNEAMEGFRFWKTGYWADFLQGRPYHISALYVVDLVRFRQIAAGDILRGSYQQLSMDPNSLANLDQDLPNNLQREVPIFSLDEDWLWCETWCSKDRLHRAKTIDLCQNPLTKEPKLARARQIPEWEEYDSEIAKFARKLSEEGKIRSRIAAADANALARTASGAASLSPESDGLDDAEKEADEKKPDLRDEL

SEQ ID NO: 4429 - protein, 725 aa, Nilaparvata lugens
  MOD_RES (57)..(62): Any amino acid
NVDWPSVDRKVEEHRSFAKQVAWLEGGQLGIITNGRLLGPLADDEEFTVDDYGLLEXXXXXXFSLSAHVEKIHKTLNEGVELGEDMVSSDVLMKTVSLLVARPQTKSRFQVKAAGEKHSVIHLPAAVAEQPAFDITVIVDPVSRGAQKMAPILTVLRHVVNCHIRIFLNCLEKNSDMPLKSFYRYVLEPEVQFTADGHLASGPYAKFTNMPGAPLLTQNMHVPENWLVESIVSPYDLDNIRLEEVESAVHSQFELEHLLLEGHCFEATMGNPPRGLQMTLGTETQPVVVDTIVMANLGYFQLKANPGAWLLRLRQGRSAEIFDITSHEGSDTPVNSTDIKVLISSFRSHVLKLRVTKKPDKIGMDLLGEDDDSQPGLWNSITSTFGSTKEEQVEAETINIFSVASGHLYERFLRIMMLSVLKNTKSPVKFWFLKNYLSPTFKDFLPRMSKEYGFQYELVQYKWPRWLHQQTEKQRIIWGYKILFLDVLFPLDVKKIIFVDADQMLIRFWKHGYWRNHLQGRRYHISALYVVDLRRFRKIAAGDRLRGQYQALSQDPNSLSNLDQDLPNNMIHQVAIKSLPQEWLWCETWCDDESKKSAKTIDLCNNPLTKEAKLTAAMRIVDEWKDYDAEIKALQLKLGATEEHEEEDHSDQQTHDKNQVGKGVVVFLDRRHWLGHVFRHNEFTLRKLEGIIIGLRARGRPRLQYRKQTLETQGARAATAKRHDW

SEQ ID NO: 4430 - protein, 1488 aa, Talaromyces cellulolyticus
MMRAPLLGLATSLLVLLQPQSVVASPSVNVALRASFDAAPYLVELLETAAQENATAYFPLLDRIASGFFEDATNDKDLYESFLQVLIQDKHLANKESLDSFKFALAIRSAAPRIQAHYQYYNTSVTSTLGTAQDAACPVWVHWDGKQYCSSTLERAQQDISGDKDPRKLPFDRTLGDTSATPAVLYADIASPMFADYHRTLKRLADEGQIAYRVRYRPVHDGGSKPLFVSGYGVELTLKRTDYIVIDDRQAEERETSKSNAKAPSAQDLEAEEDEAPPDLKPLSSSEVAKLGMSAASFVLDSSDPFTTLVKISQDFPKYSSSVAAYNASEEFLEEYRKNRQAGLPAGRNAMWINGLQIDPRQVDAYSLLDYLRRERQLLAQFQKIGLSASEAIDLLSYPALAEVQGSSEVQRYDWRDEIEGGGVVVWLNDLEKDKRYANFPTTLQMLLQPTYPGQFPSVRRDIQNVVVPVDLANVEDVQFVVKYLYAFIKRLIPVRFGLVLTANTEESKAQAKIAHYLHQAYGLASLLQYLETSLSSEISRAHKPSFAAAIAERSLRPDQEAISFEEVLQSEGLDVIVASTERYLRRLDLKGPSPPTLVNGIPMSRGETYMQELPMQLSRDLQIIQQGLMQGVFSDDDYIPDYFLSQAAQSRNEWIVPERDSDILIADIRSAAEAHNDFADILRFPADAKHPGANVQLIVTGDFNTEHNFALLISALKFRQTHPEIEIVPLHNPDAEEKVGDNSSRLYELLLHPEPVDLDHVLARIQSGNSEQATQKEEEQAYWTQVQQLITDIGLPAGATSLIVNGRVVGPLPSSVEFTEADFELLFSYETSQRLGPLSAALKDLDIETKVAGPLNFAKLTSLVMLSSDAPEGVFEQRSKYRVNVWKRWNSTHSAIDASTNTKDASINIAAAVDPTSEMAQKWLPILKTLSKLAGVNVRIYLAPNGQLSELPIKRFYRHVLESEPTFDENRALERPEASFTGLPQDALLTLGMDVPSSWLVAPKYSIHDLDNIKLSAIKDGSDVDAIYELEHILIEGHSSDTTLRSPPRGVQLLLETEKGSFFADTLIMANLGYFQFKAQPGFWKIELKEGRSRDIFELDTIGGGQQSTGTNEVALLSFQGKTLFPRLSRRPGQEQEEVLETGPKPGSAMDYVSKGLNFAQGVLSSVGVKHTGKSESAEKHAEINIFSVASGHLYERMLNIMMVSVMKNTNHSVKFWFIEQFLSPSFKSLLPHLAEEYGFTYEMVTYKWPHWLRGQREKQREIWGYKILFLDVLFPLSLDKVIFVDADQIVRTDMYDLVTLDLEGAPYGFTPMCDSREEMEGFRFWKQGYWKSYLRDLKYHISALYVVDLQRFRELAAGDRLRGQYHTLSADPESLANLDQDLPNNMQTLIPIKSLPQDWLWCETWCSDEALKTAKTIDLCNNPLTKEPKLERARRQVPEWTEYDDEIAELARRVASSASASASASKEDGDDDDGKEEEEYERKDEL

SEQ ID NO: 4431 - protein, 1323 aa, Lachancea lanzarotensis
MFGSIFLILLGVFHVSGLTTITFPHSSSGQTLRAWNTLVKLVDDRNVLQQLYFEIAGVADDSDDWDGADDSAQFSDRIVDVLYSYNSDLAGLFPLHFASEPGFSSNTSNENFFILNDKKFQSPDDLFYLKSSDLAAQKLTIESEITSPEDVILGSNENAPLIQFYGCDRVSSWESFNRNLLTECQSGKIRFLWRSTCPNDQILDFVPSAVALTVKNSQWDKPVELPLEVPESFRDNEYYAQQVNDAKLSDLDKKVTSAICDLYEETKDFSKTLKYMKQVVDNFPALAQKLTKLQVSDTKLVEALNKTTENGIDHTMLGFYINGQYHKLSNLDKVSVVEAVTAELTRIDLIRKLLQDYEGLNDKESTTVAKDLVQKFSTHSLATLQNSQPAKYDLHRVPGFSESVIYFNDIENGAVYKEKLSDNIGEFFKQSEFGHIPAYRENWNEVVFVINLSELESKDTLEALQGLLRAVSVVENGHPQRIGFLPMVTSCQDNGLLRRIYELKSKSLKRLTNYLQELSVGTGVRSSEYKNLPPVLDILHAKLKLKNSSIIINGEIYPFKSNLWNYMIAKVIKKDVSYIKDELRRINAAGVLTAREILHRRSFTERNLKLAPDYFEDATYFVTNTTVLKKLGTRLLEFTKSRDHNVLHTISIVDDFNTPLALRRLLNASKVGLLGVRIRAIHTGVETKQWNKVRQLVENYSFTNIEKIISTIKAKSAINVIDHAVFNAWIFELPYDKSVRNSFMTINGRFVQFEEDEVPSTNEYEMILQREALRVLDATQALQDIFPHFLDTSIDSDLIEMVSSVLTKLFYDGQRFYNNGIDYTAEGSLSRIDLEEFVNFAAYNSFQHSSDVKKVDITLIVDPLEERTQKLLTLVSELQGLDFINIRLHFLPTMDLKLFPIHRFWFEISDLTPEIEEPGKYYVDIERPLHWHLGPLKEGSAEFEYAILEINAFDDAAVPSKGLVEGKGNVCLQLVNRENKVIDKTFTSTTFGYGQLRIHNLGGHYRIESCSENLKVTSFSFDAHSNYAPAKSFDVTSFSPLRAYVKIKDEENFQTTESLDVVRSSVDIFSIVENQDEENALKGLIASILNSNLENGIRLWVLTGEPPSIDLLQFLNDVSRKFGSRIKFEFIKYDWPRWLRPQRFTEDELVAVKVLMLDYVFPGEVDKLMYMEPGTRLEDLKALWEFKFDTTFCLPRAYHSDGIPYWKEGYWQTFLSKHNLKFHAIDPVFIVNLTKYRNDHVGEKMRIHYQRLSAGINFLAKIDQDLINDMQPKVPISTMRRSLVAQKVTQRDWDDENIESLYRQLIEDDAAPVNQNDFDHDEL

SEQ ID NO: 4432 - protein, 1436 aa, Myotis lucifugus
MGLLIVFTGLWLFSLVKADSKAITTSLTTKWFSAPLLLEASEFLAEDSQEKFWNFVEASQNIGSSDHHGTDYSYYHAILGAAFPFLSPLQQNLLKFSLSLHSYSATIQAFQQIAADEPPPEGCSSFFSVHGRKACDVDALETLLLTAPERPKPLLFKGDHRYPSSSPESPVVIFYSEIGYEAFYNFHRQLVSKSNAGKINYIFRHYVSRPRREPVYLSGYGVELAIKSTEYKAKDDTQVKGTEVNTTVIGENDPIDEVQGFLFGKLRDLHPDLKGQLKELRKHLVESTNEMAPLKVWQLQDLSFQTAARILAAPVELALVVMKDLSQNFPTKARAITKTAVSSELRTEVEENQKYFKGTLGLQPGDSALFINGLHIDLDTQDIFSLFDVLRNEARVMEGLHRLGIEGLSLHNVLKLNTQPSEADYAVDIRSPAIAWINNLEVDARYNSWPSSLQELLRPTFPGVIRQIRKNLHNMVFMVDPAHETTAELMSIAEMFLSNHIPLRLGLIFVVNDSEDVDGMQDAGVAIMRAYNYAAQEVDHYHAFQTLTQIYNKVRTGEKVKVEHVVSVLEKKYPYVEVNSILGIDSAYDQNRKEARGYYEQTGVGLLPVVLFNGMPLEKAQLDPDELETITMHKILETTSFFQRAVYLGELSHDQDVVEYIMNQPNVVPRINARILTAEREYLDLTATNNFFVDDYARFTALDSQGKTAAIANSMNYLTKKGMSSKEIYDDSFIRPVTFWIVGDFDSPSGRQLLYDAIKHQKSSNNVRISMINNPKEDINYENTRISRAIWAALQTQTSSTAKNFITKMAKEGTAEALAAGADVGEFAVGGMDFSLFKEVFESSKMDFILSHAMYCRDVLKLKKGQRAVISNGRIIGPLEDNELFNQDDFHLLENIILKTSGQKIKSHIQQLRVEEDVASDLVMKVDALLSAQPKGDTRIEYQFFEDRHSAIKLRPKEGVTYFDVVAILDPVTRESQRLAPLLLVLTQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSASPVVMDTIVMANLGYFQLKANPGAWILRLRKGRSEDIYRIYSHDGTDSPPDAGEVVVVLNNFKSKIIKVKVQKKADMVNEDLLSDGTNENESGFWDSFKWGFTGGQKTEEVKQDKDDIINIFSVASGHLYERFLRIMMLSVLKNTKTPVKFWFLKNYLSPTFKEFIPYMADKYSFHYELVQYKWPRWLHQQTEKQRTIWGYKILFLDVLFPLVVDKVLFVDADQDLPNNMIHQVPIKSLPQEWLWCETWCDDTSKKRAKTIDLCNNPMTKEPKLEAAVRIVPEWQDYDQEVKQLQIRFQEEKAAAARGKEPLADGPQTHEEL

SEQ ID NO: 4433 - protein, 1382 aa, Komagataella phaffii
MIGHALILISQCLTAVASEKSVDISLRANWFKTPFPLLLLETVASENESGFHTILDAMFHVSFQSLEFEDADLQFDAIPFAKSDKELYEAWSQKAGATAEKSITDVYLANKYYAPRVQAHYQHYEEVRSSILGDRCGTNSKAWLYFNNEVYCSSNDVFSLKTGNETGQRQILPFDRVIGAKDNDVPVAIIYGDYKSPLFSQFLSNLAGFIKDGRLRLVWRYIPDESIWQKETLAGYGVDLTLKNTEYIDIDDRDVVANKPVEAKPTVAESNDFWDVYSKEIETVSKKDISLLGYKLTHYVKNLEVSESEKLSILIKLIQDLPKYASFINRQVTDTDATESIVDGWENSFDHIPQGLYINGAVVAQSNLNYMDILNILKREYAFVDDLTRFGVAKVHAQDIMKSFAAHVPDRSVNNTELKRFDIRVHADAIIYLNDIETDPLYSNLSSSREPYTRQPLSTGEFPPVRENIHELVFVIDLEDRDQVKILLTFFYSMSESRPLRIGLVPFTSDYSVDENFLHVVETQGIHEVIAFLRHVATTVLKNDEEGRLSVLDLGCLYDICYTDLGPKVDDFIDGFSITHPVVIANGKFFDFGKDWWNNPTNKIHLAQELFKDILDLGKAISNGALSADMRAQDFLYNGSQTYRNPIFSALNKKEPLYGFPDSMKADIPFFAPFDSLEVFKIIEQNEISIATLVIDDQPDSIPITIWLIGNSWDLVFLSQLRYLMSVASDLNPVKIRVYDTSLNPEFSSWLQAEMDKSLADLIILIGARRFDRRDGKYPECPEEAKDFVLKTFNLDISKAGDPYLILNGRAIKIDGILSDTRLKQLVRSETDSKLQTTYQLLSEHNISTPIVLDRFELFEYFTMSVSKTYYFSDGYQPDQKLFPRYNTNLLNDTFSIEMAKSNAEGSTMEVTLFIDPLQEESQKLVSLLSLFEELNRVRIKVILNPQKANELDVKRFYRGVFPNSVKFSSAGFALDNEDKALFALVPEKNLFTVDLDVPNRWVVVIKEAVTDLDNVLLEYSGEARGVYELKSLLVEGYSYATTKQDQITGFNVFHAVLRGHSETTVMPDYGYFQLQANPGLWKFSMNAAGAEVLQLVKFVGKSNYNRIQYTVLNETAIIPVLNLNGNFIEPLFDRTPGQKNASLIGNTTTTKKESSRGRWISWNNQEESKNAGINIFTVTSGHLDERFLSIMANSVMKHTEHTVKFWLIENYMSPAFKENLPFLSQRFGFEYELINYKWPAFLEGQRKRQRAILRYKILFLDVFLPQSLDKVVVVDADQIVRTDLKELVNLDLEGAPYGYVPMCDGREEMTEFKFWKQGCWLKDLGDTFKYHSSGLYVIDLKTFRNIGAGFYLRQLYHLSRDSKCKLEIDDLPNNLQCQVPN

SEQ ID NO: 4434 - protein, 1488 aa, Lachnellula arida
MGAFSLPWGLTGALLATTYLHSICASAGPSVNVGLKASFSSAPYLLELLETAADENATSYYPLLDRIADGHFSKASTDKQLYEQFIEVLKDDGHITDLETLSSYKFALSMRTSAPRIEAHYQYYHTAAEPSLQAEEETSCPTWVLFNGKQYCSPALDAPHGDINGDLQTQELQFDRILGNPTAPPSILYADITSPTFGQFHKTLVKTAREGKTSYRVRHRKALSAESKPLLVPGYGVELALKRTDYIVIDDREDGDSKAIEQLSEKEVKFEDEELADLKPLSSSELFSLGLKASSFIMQSENPFETLVKLSQDFPKYSSAIASHNATKEFVTEHDYNRAQLVPGGYNVWWMNGVQVIEREIEALSILELLRAERKLINGVRELGLTGQEAIQLLSHQDIATVQAEGELQRFDWGDDIEGGNVIIWMNDIEKDKRYREWPTSAQAMLQRTYPGQLPSVRKDCFYLVLPVDFSNPEDVLMVVETLQSFVKRKLTIRIGLVPISSTIQSLEQARVVYHLLDTYSLSTAISYLERSYTAGKVTAPSRSVFEAAVEGKPPKGKKVSREIYEVLKSNDYQDQVEASKKWIHRLSAGSKIPPMFVDGVALPRDENWLQSMSKRVTADLQSIQQGIFEGSLSDETWLPTFFLSQAAKKRNSLVIPEDEKSLRVFNVNKIVGEHQDLFDTLPHVKADPASEKADWAHMILFTDLEAEEGAKFLAAAAVFREANPGVELVIVHNSASDSVESGLSADLFARTQNGVEKGSLSVNDLTKLLSSEDSAQVTNKDDVLRYWHGADLLAKSFALTSGQTAILLNGRLVGPIPSPAEFDLEDFEQLLSYERNNRIVPAYTALEALGLSDKIADPLAAAKVSSIVAISTIDDKPAGMFEQASTLRMSKFDVWNSSHTAIEVGDASTASIQMTVLVDPASEHGQKWVPLLKAISELDGVYLKLFLNPKERLQELPVKRFYRYVIDSKPTFDDAGALKDLSATFTGVPQEALLNLGMDVPPAWLVAPKVSVHDLDNIKLSSIKANVDALYELEHILIEGHSREIPGGAAPRGAQLVLGTERDPHFADTIIMANLGYFQFKANPGFYKIDLQQGRSSEIFKIDSVGAQGWTPVPGDNTTEVVLMSFQGTTLYPRISRKPGMKTEDVLEAKSESKLNIVSQGFKFAQGVLGKGKPVVEMEAQADINIFSVASGHLYERMLNIMMVSVMKHTKHTVKFWFIEQFLSPSFKDFIPYLAAEYGFKYEMVTYKWPHWLRSQTEKQREIWGYKILFLDVLFPLSLDKVIFVDADQIVRTDMIELVNHDLKGAPYGFTPMCDSRTEMEGFRFWKQGYWERFLAGLPYHISALYVVDLHRFRQIAAGDRLRQQYHQLSADPNSLSNLDQDLPNHMQNILKIHSLPQEWLWCETWCSDESLKDAKTIDLCNNPQTKEPKLDRARRQVPEWTVYDDEIAAVDRRRKGLNGNGNGEKKNEKSRTLEEEPVATSKKDEL

SEQ ID NO: 4435 - protein, 1523 aa, Thermothielavioides terrestris
MLQLSRLPWGLAAAVLAATWLPSARVAASPSVNVALKAAFPSPPYLVELLETAAADNATVYFALLDRIAKGHFSDAATDKALYEKFVEVLRDDGHMDAESLSTFKLGLSMRTAAPRVEAHYQYYATAVEPSLSGDQDGCVHWFLVDGKQYCKPTLDAAHGDVKGHSQARTLPFDRKLGSGSRDVILYADITSKDFGAYHETAVNLARQGEGSYRLRYRRSPAHPVEALSVSGYGVELTLKRTDYIVIDDRDTGAAGAPADEAQKPITSSDIVLDEEEEITDIKPLEKSELSLLGVKAASFIMQSESPFDTLLKLTQDFPKYSNSLGAHNVSAKFAAEYEENQKMLGPDGRNILWMNGVQLVDRQIQPFGLVDVLKRERKLIKGVLDLGLTGQQAVSLLGHTEVAQAKSGDEEPRRFDWRDRLEDGRVIIWLNNLEKDKRYADFSPHLWALIQHFGHGLPQVRKDIFNLVVPVDFSDPEDLKLITTQLLTFMKRLVPIRFGLVPLTPTEKAIDQAKVVYYLLENHGLAATVSYLEKSLENDKAARPDERIFNEAIKDRPLRPNATPLPFQDIFTSEAHEKQIHLAKRWVERLRADGDVPSIFFDGFPIPKDEHWLRGMNQKLMVDLQAVQQAAYFGAINETTWIPGYLLENAVSRRNTLIFPEDARDLTVLNVNKLYTEHRDVFDQVPVVEAEKQSTKEDWAALTVIADLDSAEGQKLLLYAIQFRKAHPGIRMEIVHNPGDVSRDASELTQRLKARVDKLLGADRLSDLEAILESGESKADPTYDAALAGFLAAANLKAGQNALMLNGRLVGPIPSAEHFKKEDFEQFLEAERSSRIIPVYKALEDLNLGDRVSGPVAAAKLTSATALSGMSDLPQGIFDSASPIRMTVFKELNSTYTSFEVGDASTATIFFAAVINPASEIGQKWAAMFKVLSELEGVHLQIFLNPAAELAELPVKRFYRYVLQSSPSFDEDGKVKALSANFASVPEDTLLVAGMDVPPAWLVTSKVSVDDLDNLRIKDIKARRGTAHVEAVYELENILIEGHSREVPSGQPPRGVQLVLSTEKDSHFADTIIMANIGYFQFKANPGVYSIRLKEGRSSDIFTLESVGPQGWHPVPGDETSEIALMDFQGATLYPRLKRKPGMEQEEVLGESKANATTAGAAMDFVSKGLRFAEGILGRGKAAAETKSASDTEHAEINIFSVASGHLYERMLNIMMVSVMRHTNHTVKFWFIEQFLSPSFKDFIPTLAAEYNFKYEMVTYKWPHWLRQQKEKQREIWGYKILFLDVLFPLSLDKVIFVDADQIVRTDMYDLVTLDLQGAPYGFTPMCDSRTEMEGFRFWKTGYWASYLKGRPYHISALYVVDLRRFRALAAGDRLRQQYHTLSADPQSLANLDQDLPNHMQFHIPIHSLPQEWLWCETWCSDETLAAARTIDLCNNPQTKEPKLDRARRQVPEWTEYDEEIAALARRRREELYQQQQQQREEQVVEKQEGRKKEEETVERNPKSRRFEDEEAAAGGRVRDEL

SEQ ID NO: 4436 - protein, 1624 aa, Cucurbita moschata
MGTSCFRSGCRPLIVVLLLAIYGGSGVFAEIRRPKNVQVAVQAKWSGTSILLEAGELLAKERKDLYWDFIEVWLREEGNGADADASTAKACLKKILKHGRFLLNEPLASLFEFSLILRSASPRLVLYRQLADESLSSFPLPEENNCNIVGEGNEGIERRKSDTSLVGQNPKSPRGKCCWVDTGGSLFFDVPELLTWLENPAESVGDSIQPPDLYDFDHIHFGSSSESRVAILYGALGTDCFKQFHVTLVKAAKEGKVKYVVRPVIPSGCEVKINSCGAVGARGSMNLGGYGVELALKNMEYKAMDDSAIKKGVTLEDPRTEDLSQEVRGFIFSKILERKPELTSEIMAFRDYLLSSTVSDTLNVWELKDLGHQTAQRIVQASDPLQSMQEINQNFPTIVSSLSRMKLNDSVKDEITANQRMVPPGKSLMALNGALINIEDVDLYLLIDMIHQDLLLADQFTKLKIPHHTIRKLLSSLPPADSDMLRVDFRSSHVHFLNNLEEDAMYKRWRSNINEILMPVFPGQVRYIRKNLFHAVYAIDPATVCGLQTIDMILSFYENNLPIRFGVLLYSSKFIKQTESGDDELTKSEADTSCLMIQLFIYLKENHGVQAAFQFLSNVNKLRLEADGLADDAPEMHHVEGAFVETLLPKSKSPPQDVLLKLEKEQTYKDLAEESSMFTFSLGLSKLECSLLMNGLVFDSSEESLINAMNEELPRIQEQVYYGHISPHTDVLENFLSESGLSRFNPQIVAEGKPRIVSMFASTHGGESLLNGFKYLHSPGTMDDLKPVTHLLVIDAASKKGIKLMKEGLHYLIRGSKSARVGFLFTTSNHTSESSLLLAKVFEISASLHSHKKNVLDFLDRVCSIYSQKFIPESSVAVDSPQEFIEKICELAEAYELPPKAYRIAFSDSFVDEMRKYLSQLGLESIVNAVITNGRVTLLTDESSFLSHDLSLLEVVEFKRRIKHIVEIVEEVKWHDFDPDRLTSNFLSDVIMFVSSSMAQRERSSESARFEILNAEFSAIVVDNENSSMHIDAVIDPLSPSGQKLSSILRVLSKYIQPSMKIILNPLSSLVDLPLKNYYRYVLPSMDDFSSTDVTVNGPKAFFANMPLSKTLTMNLDVPEPWLVEPVIAVHDLDNILLENIGDTRTLQAVFELEALVLTGHCSEKNQEPPRGLQLILGTNSTPHLVDTLVMENLGYWQMKISPGVWYLQLAPGRSSELYLLKQGGDRSQDKTLSKRIIIDDLRGKVVHMEVEKKNGKEHEKLLVPDGDDDLLENKKEGHTNWNTNFLKWATGLIGSNDQSKKSKSTTLEKRKGGRHGKTINIFSIASGHLYERFLKIMILSVLKNTRRPVKFWFIKNYLSPQFKDVIPHMAEEYGFDFELITYKWPTWLHKQKEKQRIIWAYKILFLDVIFPLSLEKVIFVDADQVVRTDMGELYDMNIKGKPLAYTPFCDNNKDMDGYRFWRQGFWKEHLRGKPYHISALYVVDLKKFRETAAGDHLRVFYESLSKDPNSLSNLDQDLPNYAQHTVPIFSLPQEWLWCESWCGNTTKSKAKTIDLCNNPMTKEPKLQGARRIVPEWPDLDSEATTFTAKILGDVTPQTPVSSIAEISVSKKSIDEDVESKAEL

SEQ ID NO: 4437 - protein, 982 aa, Diversispora epigaea
MKFKYNIITFVIWIINIIIAIDSLSSYAETPPVQIWLKASWNAPQLVLEILESVAAENSKAYFPLVEEFLRQGLFSSKLTNYEIYKSALDIIEKKKFLSTPTTKSLFEFGLSLHTTAPTIQSYYHYYNSTIIPTRKFSNDEFNPECNVWADWYGNQACNVETLTKFIDTKLDISKATPKLLSFDHIRKSKIYSTQRQSRIIIFIRIWSRIGFKNTEYNLFDDRKVEEETDNVDKESINNSESSDDYLFDQNISEIKPAGEIESLGVKTAQVILESQDPLKTLTQLSQDFPKYSHYISQVPISYSLGQEIEMNQQNLRLEPNSFWLNGLVMDPLSVDPFSLLKLLCRERRTVSSLLNLGLNSNQAIGILSSPIIAKAQSPQDSSRGIFDVRDISPNNNVVVCLNDLEKDSKYSSWPNRIYGLLRPAYPGQLRMIRKNIFSILFILDLSSPENLEIIAEHINAFILRDTPLRFGLVPLFSKDQHDSIAISRIFYYIVDQFGPSTVKKFFKTIYSEIRKPLTIEFLQIVEQEFNKLIYKEVPRIEKLVNSFKEIINGNNTLVEEQIYESSNFIKRLKINTHDKGVLFVNGKFFDLDESHQRNVIQTVNEHLQLKAYVGEIDDTNIYEYLLTLPNIPNRRNPYIFTSELQPLQVINLADDNNNDYDDDNGFSLINNLKYIYSEIDEKVPVTIILISDTIVMTNFGYFQLKANPGVWTLNLREGKSTDIFDIQSVGSEGWLSRNISEIDNEIILNGFEGLTIYPRMIRKSGKENDDVLKTENSNDSEHMFTPKMDEKKGAEINIFSVISGHLYERFLYVMILSVLQHTNSTVKFWFIENFLSPSFKDFIPYMTKEYNFEYELVAYKWPHWLRAQTEKQRNIWGYKILFLDVLFPLDLDKVIFVDADQIVRTDLKELVDMDLQGAPYGYTPFCDNRPEMDDFRFWNHGHLKDHLRGKPYHFGLLFFIINIQFITINNTSYCCHYCHFL

SEQ ID NO: 4438 - protein, 1498 aa, Halyomorpha halys
MELLKIVLLLLVASLDYVLCKKKPKSVTTVIDAKWDSTPLVLEMAEFLADENESFFWDYVNSITSLDPPLIEAATDKEYYDRALNVSKTFLSSTQVSLLEFALSLHVYSPRVEMFNQIAKEKEISCQTAVDIGGTLICDCDKIIENINEAKAASEVKSGEVLRVDHKYSNSEGVVVILYGELGTSEFSRFHKILKEEAEKGHITYLIRHWIKKSSNKKLRLSGYGVELQMKSTEYKVQDDTKVEGTAAEESEEEEEEVEGLNFHRLKQLYPDRIENLDKLRQNLLETSSELAPLKVWQFQELSLQAAQRIMSAPKEEVLHVLTYISSNFPTQARSLVKTVVSQELKTEMRQNQDKFSTSLHLQPSDTALFINGMYFDLETQDIFTILEYIREELRVMEGLHIIGLTDKKLSKSLLALDLNGGGVDFALDIRDSAVVWINDIELDKQYRRWSSSLLDLLRPTFPGMLRSVRKNLYNLVVIGDPSKKEVVPLIKLLQSFLIHNAPLHLGIVFSVDETKNGYEDSGVAMLNAFNYVSEIKDVSQALNFITDVYATVSNNDIAPADIHNLLKSKFPGFKQDEVFGPDSDYNTGIKLSVDFISKSGLRNLPQVLLNGVALPEKSLNADEFEEAVLSEIMVQTPNLQKAVYKGELTDKDNVIDYIMSQPNVMPRLNERVLSSTRSHYLPLPKFTNKLTLDMIDSGISYLSSKSSKQGIHLLTNWIVCDLRDEDGRSVLQNAIEQMEGSGKIRIGLIVNEKETESSSSDINRIALAVLRQLPPDAALEKVKEILQDFPAIEAGVRTFTDYDVLPDQEEIETVIQLHRQFSKEILNFDGGVRGIVNNGRLIGPLQSGEDFTVDDFSLLERFSLSTYVDKIYTAIAANSVDLDTVTSDMLMKSVSLLASRPESKSRFEIIPAGEEHSVVKLMANDDGPAFDLVAIIDPVSSGAHIVGYLLSTLQQVVRADIRIFLNCVEKNSDMPLKSFYRYVLEPTLQFTPSGSLGPGPVARFSNMPGTPLLTQNMLVPDNWMVENIASPHDLDNIKLDQVDSNVHSQFELEYLIVEGHCFDSVLGSPPRGLQITLGTDRSPTEFDTIVMANLGYFQLKANPGLWKLRLRHGRSEALYDITGYSFAGVDYPVNSSEIKVILSSFRAHTVKLKVTKKPDKSGIDLLGEETEEQSSLWGSITNTFGGGSKTDATEGEQEPINIFSLASGHLYERFLRIMMLSVLKNTKSPVKFWFLKNYLSPTLKDFLPRMAKHYGFQYELVQYKWPRWLHQQTEKQRIIWGYKILFLDVLFPLDVKKIIFVDADQVVRADMKELVDLDLGGAPYGYTPFCESRTEMDGFRFWKSGYWRNHLQGRKYHISALYVVDLKRFRRIAAGDRLRGQYQALSQDPNSLSNLDQDLPNNMIHQVAIKSLPQEWLWCETWCDDGSKKRAKTIDLCNNPMTKEAKLTAAMRIVEEWKDYDNEIKRLQLQLGETEGHEEEPILPQVPVPEVHEHSEL

SEQ ID NO: 4439 - protein, 1637 aa, Camellia sinensis
MWTHFRSGCWVLFVFVGFLSLSGNLVSVESRRPKNVQVALQAKWSGTPLLLEAGELLSKEWKDYFWEFIEVWHHNEDADSQTAKDCLKKIVKYGQSLLSEPLASLFEFSLTLRSTSPRLVLYRQLAVESLSSFPLYDDINSQSVNGGIPETNENVESKKVEPLLVGMNPRSPGGECCWVDTGGAFFFDVSEFQTWLHSPKESARDSFQQPELYEFDHIHFDSSIGSPVAILYGALGTDCFREFHVALVAAAKEGKVKYVARPVLPSGCQSKSGHCAAVGTNDPVNLGGYGVELALKNMEYKAMDDSAIKKGVTLEDPHTEDLSQEVRGFIFSRILERKPELTSEIMAFRDYLLSSTVSDTLDVWELKDLGHQTAQRIVHASDPLQSMQEINQNFPTVVSSLSRMKLNDSIKDEIAANQRMIPPGKSLMALNGALINIEDIDLYLLVDMVHQELSLADQYSRLKIPPSIVRKLLSTLPPAESNTFRVDFRSTHVHYLNNLEEDAMYKRWRSNINEILMPVFPGQLRYIRKNLFHAVFVLDPGSACGLESIDMIISLYENNLPMRFGVILFSTKFIKMIEMNDGEIPAAPMSNDDVSSLIIRLFIYIKEHHGIHMAFQFLSSINKLRIESADPTEDAPEMHHVEGAFVETLLPKAKSPPQDALLKLEKEQTFTELSQESSMFVFKLGLVKLQCCLLMNGLVVDANEDALTNAMNDELPRIQEQVYYGHINSHTDVLDKFLSESGVPRYNPKIIADGKVKPKFLSLSTAILGNDFGLNDVSYLHSPETVDELKPVTHLLAIDITSKKGIKLLREGIRYLIEGSKNSRLGMLFNANPGASFPSLLFVKASEVAASSYSHKAKVLDFLDQLCAFYEQEYVHASSVVAESNQAFIDKVCDLADANALSSKRLRTALSEFSVDELKGRLNKVGQFLYRQLGLESGDNAVITNGRVIHLDGSTFLSHDLHLLESVEFKHRIKHIVEVIEEVKWEDIDPDMLTSKFISDIIMFVSSSIATRDRSSESARFEVLNAKYSAVVLNNKNSSVHIDAVIDPLSATGQKLSSLLRVLWKSVQPSMRLVLNPLSSMVDLPLKNYYRYVVPTVDDFSSTDYTVYGPKAFFANMPLSKTLTMNLDVPEPWLVEPVIAVHDLDNILLENLGDLRTLQAVFELEALVLTGHCSEKDHDPPQGLQLILGTLSTPHLVDTIVMANLGYWQMKVSPGVWYLQLAPGRSSELYVLKDGDGSQGMTSSKRITINDLRGKLVHLEVVKKKGKEREKLLVSSDDDSHSQGKKKGNQKGWNSNILKWASGFIGGSEDSKKSESTSEHGNSVRRGKRINIFSIASGHLYERFLKIMILSVLKNTNRPVKFWFIKNYLSPQFKDVIPHMAREYGFEYELVTYKWPTWLNKQKEKQRIIWAYKILFLDVIFPLSLEKVIFVDADQVVRADMGELYDMDIKGRPLAYTPFCDNNRDMDGYRFWRQGFWKDHLRGRPYHISALYVVDLVKFRETASGDNLRVFYENLSKDPNSLSNLDQDLPNYAQHTVPIFSLPQEWLWCESWCGNATKSKAKTIDLCNNPMTKEPKLQGARRIVSEWLDLDSEARRFTSRILGEDVDPQEQVISPSQTQNSVSDFVSEEDIESKSEL

SEQ ID NO: 4440 - protein, 1793 aa, Violaceomyces palustris
MSTTTHRPAYLGLATSSLLLLLLLLLLLLSSTTATIAKIKRSESPPVKVQLKTPWPRLTSPTRGSPLLLEILESANSQDPDSFFPLLDRITSPTLHIDATSQVLLRDGPSNNLSQLSSHQLQSVAERLISQNHLFTNAGENRSTPAILEDWKLSLALHTETPKIEAFSQLYKTLGMQQVWETSMAHRSDQERQACGSWIYWYGEVLCTPEQVENAVLLYYNGNQGERKPHEAPPLYPFDHLQQPPLWTGHQPTTHPNRDVPEVSPPPPLAVLYADPFSSNFWQLHKVLYQHANQLDPHQRGTVLRYALRWRPSSEQDGAGHPPSSDQIHLSGYGAILDLKKVDYLVIDDRKVSSESSSKSTGAKENDRQSDRDQAAKLESHRNRQWLDGQINDLGREGGGSEILSAEEEDREPFLGSISSLTREELTDLGLRATRVIASSSDPLRALQQLSQDFPSHAVRLAKATMDNETLIESLVKMQARRLMPGGSDMWINGRGLSEREISSLHLLENLRFERKLSDSLASQFVGLTPRQAVDLLSNSAVGRSFLEASSEGQQGSSSTFFDASDRIEKRKSKTGSKVISWWNDLESDQATSTWSKDLMSLLRPLWPGNFPQVGKNLFNVVLVLDLGKKESCRFLSESVGPSVGRVGLRWGVVPGGLDDKGNVAALQVARLYWEVMDKGGPELATKFLKRLSIPKPGRKGAALDLAVDVKSAKSEFANILRSHVQPSPSADDSSAQVDDDWVEKVVAGEAAPGQAEREEATRSYLERLRLDMSESPRGHVLVNGQYLPFGSQLISQVHEAVQNQIQILAPSIYYGKIKASDELENHFYDLPGSMAYRSALVFPPPPRAARRDGLEERSKGAEGESRRSGVRFSHINLPEAFGSCAHDHEEARLLTTQYVYPNSDSMINATVWLVGDLDSDQGSSLIKKSLEAMKLGAFRLGFVHVPGSANQGWAGARNESDSKAPPISAFLHQMMVSGKLDELSAEKLREALDLFEVQGDNLDPLGPIGEAEQNVFSGVGGRGEGRGGSWMDPLGSAKQKGYTIPGTMQAANFWEKVGPSLSREFGLQDRSSLGLIVNGRMALGLELDSIRAEDIASLVTYEEGKRINAVTETLKLQKHDLDSMPRSRRTDLISMATSVLGKAYERNEAEEGVLVTQKRSRTSVAEQLGSADHVFEVGDRESANVRVSVVLDPLSEEAQKWSSILALLSRKKGFHVRVVLNPKLSYDELPLKRYYRYSFPDEIRFDEEGEEVGDSILFSGLGEDSVLTLGIDAPPSWLTMAKEAIYDLDNIRLRDVTEEQGVKAVYELKHILIEGHARDVKGPIPRGLELVLETPDGSERLDTIVMANLAYFQFKVSRPGLYNLRIRGGGRSQEIYEMVSVGNNGWDSPSVDATGEAITLSSFTGLTIYPRVAKRRGKEEEGLLLEEELEEVGGRGGGRSSKHATVGFRGALTRMAKGMLESIKARALAGGRGEAKGKEVESAVEVKRHADINIFTVASGHLYERMTYIMILSVLKHTKSSVKFWFIENFLSPSFKELIPHLAREYGFEYELVTYAWPHWLRRQKEKQRTIWGYKILFLDTLFPLDLSKVIFVDADQIVRTDMKELVELDLGGAPYGYPPMGDDSEDMEGFRFWKQGYWKDFLKGRTYHISALYVVDLNLLRKVAGGDTLRGRYQALSADPNSLSNLDQDLPNNLQDSLPIHTLDEDWLWCETWCSTDRLERAKTIDLCSNPKTKEPKLERARRQIPEWNEYDAEVERLRRRLEEEKERGGGGGGGGERGETRIQTHRRDEL

SEQ ID NO: 4441 - protein, 596 aa, Sphaerobolus stellatus
MEPFDFASQDSVYVQIFLNPPASLKELPLKQFYRLNLPHRLKFDKKGSEIIPTAEFRNLPPDPIYTLGMDVPQAWLVRPHVSHHDLDNIHLASFTGLDKIEGVEAIFDLDYIVVEGHARDPLTGLPPRGLQLQLSTSNSTPIADTQVVANLGYIQFKVKPGVFQLGIREGYGRDVFEMESVGNEGWNSPPVTKAGTEITVTSLEGLTLYPRFKRKPGMETADVLIAPVKDKGTVVDQVMGKKDVEVMQQDQAEINIFTVASGLLYERFVGIMILSVLRNTKSTVKFWFIENFLSPSFLEFIPHLAKAYNFQYELVTYKWPSWLRAQKEKQRVIWGYKILFLDVLFPMDLKKVIFVDADQIVRADLKELVDLDLQGAPYGYTPMGDDNEEMEGFRFWKTGYWHDFLKGRPYHISALYVIDLVRFRQLAAGDRLRGSYQALSADPNSLANLDQDLPNNLQYEVPIFSLPEDWLWCETWCSKDRLHRAKTIDLCQNPMTKEPKLSRARQIPEWDEYDREIANFAKKLADEGIIRSAAYATGVDDLANVGSAKAEKKGEETQPHHKADEAADSGSPSTAELSSQEAKQEGAEPVAPRDEL

SEQ ID NO: 4442 - protein, 1618 aa, Absidia repens
MVKSLPIIFTICSAAALVAGSKHISPPVELSLVAPWFAPDPFLEILELVKKESPFSYIECLDELTSVDRTTSPRQQYEEALTIATKHLDGSDDTDIFKLNLATHSSAPIIQAHHQYYNQTVVPSIKNYDPSCEVWAQVDSHQACSVKELDTYLQMASMAVADANLSPNGLEHLICNPCKNVPQVNLYTSSLNPAFTDFHRYLIKKVGSQGDGTLVYSLRYKPVSQQPQGGSSPLYLTGYGVELALKNTDYLVIDDRASTRGKDDQEKGDNSGSGSAGFIKQQLGNMGKKVNQVLFETNGKSTIEPLTSDEIKLLGLKATQFIMTSKDPLATLTQLSQDFPKYAQKISTVSLKDDLTNEITSNQRRFVKAGANALWINGRKLEDSEINPFSIARDLHREMQLVKSLVKLGGTRQQAIRLISSKLLSAETSKPMDGALQDVYDVRVPTDQSVVIWWNDLESDSRYKGWRGDLSALLQPTYPGQMRAIGRNIYNVLMVENLSSRASLLRLTNEVQNMIHHGAPLRFGIVPYLGEVDSPASLAAKTLQYLTKRFGKRTGMVFLTQLQAELAKHNIDYATEDNIFSALEKTSDHNDTPLIHTKTAWPEIKNQSQNTGIVQFLKRMGINQLEDDQGVLFMNGQYMEHSSERPWTRLLMGLMNIQTQMLTRSVYLGDINDDDNVYDFFLNQPYVSSTRNAYVAVSDNHPLLVSGAPAIRNSIDKVVYLDNGSGETVTTNILAVGNMNSPAGIKLALNAIQYVENNNQTRCSILHVPSLVDPTNDDVTEFSDVLYHELYDNNINLENTKKLLETSLLNKLKSHWNWDGKHWKENEHDDGKPSERVIKSKFITPGSPVVDFTIRKNAFSKWLTLALMYMHEQNGSSSYHFTNAQDQHLGLIVNGRIIGPLADEDDFTVDDFDALWQFENTQRITPMVNALQQVEWPMDVDGMSSADLITLITALLSDDKSKTTRNILLSEEDAPVREMYYAQMDNDHSGIYINRNDKNGKDSVYAEIGVLLDPVSEDAQKWSTILEVLSKLEGVAIDIHWNPIPHLEELPLKRFYRYVLDSAWHFNDNDNKNDENERHQQQMVNPSAYFDDLPVDALYTLGVDTIDAWHVTVKDANVDLDNIQLATLAASSEEGEREGVHAVYELERILVDGHCLDSTDQRPPRGLQFVLGTESQPAMTDTIVMANLGYFQLKAQPGIYQLRVRPGRSSQVYGIESIGSNGNWIKKPSSSTSSSSQQDNSATTPLILTSFEGLRLFPTVKKHAGMETADVLDDESTGNVPQENEGILSSLSNKLFGKKDDTGKVAVTMQKQADINIFSVASGHLYERFLAIMMASVMENTNSTVKFWFIENFLSPSFKDFVPELSKQYGFDYEMVTYKWPSWLNAQKEKQRTIWGYKILFLDVLFPLDLDKVIFVDADQIVRADLQELVDLNLHGAPYGYTPFCSDRHEMDGFRFWSQGYWRDHLRGRPYHISALYVVDLVRFRQMAAGDRLRAQYQQLSADPNSLANLDQDLPNNMIHSVPIFSLPQEWLWCETWCSDESLKKAKTIDLCNNPLTKEPKLDRARRQVPEWETYDKQIESIRQSFLQQKTTGKHTTILDDKRDPTAKIEMNHIKDEL

SEQ ID NO: 4443 - protein, 1414 aa, Pseudogymnoascus destructans
MVQFGNIWSLTGNALAFSCLQSIKVSASPTINVALATSFTSAPYLLELLETAGDENSTSYFPLLDRIAEGYFKDARTDLEQYNSFVKVLRDDGHLDSEGLASYSLALSLRTSAPRIEAQYQFYDTAIEPSGDDSSCPVWVLFGGKKHCSPALDGAHGYNGRRGTEQLQFDRITGNLSAPPSILYADITSSEFNQFHKKLIQKAQNQEISYRIRHKKPNAKESKPLVIGGYGVELALKRTDYIVIDDREAEAQVQEESIKMEVVLEDEELADLKPLSASELASLGLKASSFIMQSENPFEVLTRLSQDFPRYSSAIAAHNVSSDFAEEHLYNRGQLVPAGANVVWINGLQVPTRQMDSFSMLDILRKERKLLNKFSQLGLTGSQTISLLSHKDIAFTKADDEPARFDWRDDGDGDVIIWLNNIEKDKRYDGWPATVRTLLQGGYPGQLPQVRKDLFNLVFPVDLSNIEDVELVVTQLSGFVKRALPLRFGLVPLTNSNAALEQAMIVYYLLDSYGLSTMVAYLNGYFASKGTKSSRNANFEAAIEERKLLGYKVAKSLEEVLDANEANGSIAHSKQWNFRLGANEKVPSVFVNGAAVPRDENWMQGMSQRVQMDLRLMQRAVFENTVTDDHWPPMLYLHDAASGRNPFLMPENDKDLQLFDVNAIYSDHAEALDGLPVVKNDPSAVQDDWAQMILIADVKSTQGKHLLTAAAEFTKRNPSVELVIVPSSETPAGILSVYEYMTARLFQPLKSDGDLDRLVETVSITAGDEERQITTQMSEKWSAIEGFLGSLGLRPGQQGLLLNGRLVGPILSEIEMAVSELEQLLGFERTKRIRPVLAAVKALGISEAISDPLASSKLTSLVTLSFISNVPEGIFEQASTLRIDSFKAWKSEYTAIEIGDESTASIHIQVALDPASQESQRWIPILKVLSELNGVYLKLFLNPKDILMEIPIKRFYRYVLESKPLFNADGSLKDIKAQFASVPQEALLTVGMDVPAPWLVAPKQSVTDLDNIKLSSVNGDVNAVYELQHILIEGHSSDKETGQAPRGAQLLLGTAADAHFADTIIMANLGYFQFKANPGFYKINLQEGPSSKIYSIDTLGASLRDATKPDETTEISLISFQGLTLFPQLSRNPGQETEDVLEPTTDLKDDILSKGRKLAQNILGLGKKSTAVQTTPQAEINIFSVASGHLYERMLNIMMVSVMKHTNHTVKFWFIEQFLSPSFKQSIPSLAAAYNFDYEMVTYKWPHWLRSQSEKQREIWGYKILFLDVLFPLSLDKVIFVDADQIVRTDMRELVDIDLQGAPYGFTPMCDSRAEMEGFRFWKQGYWKSFLRGLPYHISALYVVDLRRFREIAAGDRLRQQYHQLSADPASLANLDQDLPNHMQAHLPIYSLPQEWLWCETWCSDESLGGGKDD

SEQ ID NO: 4444 - protein, 1625 aa, Collichthys lucidus
MKKSLNHWLIRDLTIFGRSVLSKAEGSCYVEPEIMRKVIVLSLSLLLLLNIHHVISAPKGVTASLKAKWNMTPFLLETSEFIGEDGNEKFWQFVDTVKELTVYKQGESVRSYYNLILKKAGQFLTDLQVNLLKFALSLRSYSPAVYASQQIASDEPPPEACPAFVSIHGQHSCSTKEIKKLLKAAAGRPKPYLYKNDHTYPGVNKTDVPVVILYAEIGTKKFTNFHKVLAEKAGEGKLVYVLRHYVANPKPQKMLLSGYGVELAIKSTEYKAVDDTKVKDSKTAINAEDDNNDEVQGFIFGALKKSHPEIQEQLNEFRRHLLDSTNDMVPLKVWEMQDLSFQAAARIMSVPKFDALKLMRDLSQNFPSKARSLTRVAVKQEMRKEIEENQKHLSETIGLHPGDGELFINGLHIDLDIHNPFSILDILRGEARVLEGLHNLGIKGEHQGKLLRLPVNAVDDSYALDIRHPAIMWINDIENDPVYRSWPTGVQELLRATFPGVIRQIRRNFFNLVLFLDPVREETVELVKLAELFYKHKIPLRIGFVFVVNTEDEIDGSSDAGVGFYRLLNYIADEYDLSQALMSMLSLYNRIGVGETLSVDTVTDYLKKKFPKANAERILSAESEYDYKRQDGALFYKKSGLGDLPLALFNGVPLSSDEMDPDELETIILQRIMDTTTAFQRAVFMGQLTEGSDVVDYLMEQANVVPRMNPLILNTERQYLDFTAKPVVDEWEDTTMFSFLDSRDKTAIMAKRMKYFTHSGIKSYRCFGLDPDGMTAVALWIVGDFEKVPGRKLLLNALKHEKANPGVRVGVIDNPSGKPSEDNTVLYRAIWASLLTQKNKVSAEFVQKLLKEESSQLLQQGAKMKDLLIQGMDDDAFEKKFNTLEVDFIRSQQLFCRDVLKLSPGQRAVISNGRILGPFEEQEEFTVEDFHLLEKITLSGSAEKVKAKVKQMGMKPKHASDLVMKVDALLTAAPKGEVRRDVRFVKDSHSVLHLSPRENEVFYDVVAIVDPLTREAQKMSPLLIVLSQVVNVRLQVFMNCRAKLSEMPLKSFYRFVLESDVAFMANDTVSPGPVARFMELPESPLLTLNMITPESWMVQAVRSPHDLDNIHLQEVSGVVTAEYELEHLLLEGHCFDLSTGQPPRGLQFTLGMSRDPLMYDTIVMANLGYFQLKANPGAWTLRLRKGRSEDIYQVLTHDGTDSPADAGDVIVVLNSFHSKIIKVRVQKKADKINEDLLSENSESKGIWDSIASLIHKTAPDVFDRRTATRKLPVSNTTAQQENITGGGSKKDDAEKKKEDVLNIFSVASGHLYERFLRWVAFTSPSLTHDTVQVLTRYIHLSPDPQTDPSVRFRIMMLSVLRHTKTPVKFWFLKNYLSPSFKETISHMAESYGFQYELVQYKWPRWLHQQTEKQRIIWGYKILFLDVLFPLAVDKIIFVDADQIVRADLKELRDLNLEGAPYGYTPFCDSRREMDGYRFWKTGYWASHLGHRKYHISALYVVDLKKFRKIAAGDRLRGQYQALSQDPNSLSNLDQDLPNNMIHQVAIKSLPQEWLWCETWCDDTSKVTAKTIDLCNNPKTKEPKLTAAARNRARVGRIRQRDKAVTEAGPGTGGRGGSETDSLFTT

SEQ ID NO: 4445 - protein, 1524 aa, Dendroctonus ponderosae
MRFRMRIGAFLQLLLVGLVVVEKCTAKQKSKSVTTLLEAKWSRTPLVLEVSEFLADENPDLYWSFIDSISLQSPALNQIENERKRYNVLLEHAARLLSPSQLAVLKLSLSLHIYSPKVQMFQQISTELSLPKCQCVADVGGQFSCDLKEIEKLIEQPSNVVSNAELFNVDTHYPGSENRSLVAVLYGELGTQCFSHFHALLKTQAVKGGIDYVIRHYHQGKSEPRLRLSGYGVELQMKSTEYKSQDDSEVQDSEGSAEASQEDEELEIDGFDFAKLKQLFPDLRNNLDKFKQHLEDSSNELAALKVWEFQELSLQAAERIMNAPKDEALKVFTNIAQNFPMQAKALVKTVVNPDLKMEMKINADIFGSTLNLQPSDTALFINGMFYDIDVIDIYSILDVLRQELKTMEGLHALGLSNGKLRAVLHLDFSESSGSPEFAIDIRDSAINWLNDIEQDTKFRYWATSLMDLLRPTFPGMLRQIRKNLYNLVGRVLIIDPTDTSLRPLLKIVESFVVHATPIRTGLVFRVNSSKSVSGLDDAGVAMLCAFNYVQQSKGPIAAFSFLRSMLGSTERPQVSVEDVKRELSAQFSEDPADILDEDSDYIFGRQLSSDFIDRTGLNLFPQALLNGIPLPQAKITAEDFEEVVLQEVMSQTVNFQKAVYKGKLTDSMEVIDYLMDQPNVMPRLNDRVLNRERSFYLDMSGKATSTHKLEELLQLSRQDMTATAIDNLRYFTVPKRGNQYRSLTYWVVGDLDCPKGRKLLLDALEHLKSESDIRVSFLPNVNGNKANIFNKVVLAALETLSSGAALSLVLSLLRSEDTPEQLQSGHKLNIPSEVWSKVSAQELNLKMLRVYSQRVLDLKEEQRAIVANGRVLGPLDDGELFTNEDFSLLERFTSASYLDKISKAFEGTLDEDDDDKPITSDTILKLEPLLLSKTASKSRFDITYGSDEYSAVKIPARRPDLVAFDLVAVVDPVSRGAQKLGPILQVLHELLNCNIKLFLNSVEKNSDMPVKSFYRFVLEPEIQFSEDGKQLPGPIARFNNMPTSPLLTQNYHVPENWLVEVVRSVYDLDNIRLENVESNVHSEYELEYLLLEGHCFEQSSGSPPRGLQITLGTVREPVIVDTIVMANLGYFQLKANPGSWLLKLRQGRSADIYDIVSHDGHDMPPNSTDIKVLISQLRSNIVKLRVQKKPDKFHMDLLSDDDEHGGIWNSITSSFASKEEESEEKLNIFSVASGHLYERFLKIMMLSVLKQTKTPVKFWFLKNYLSPQIKDFLPYMAKEYGFEYELVQYKWPRWLTPQTEKQRIIWGYKILFLDVLFPLDVKKIIFVDADQVVRTDLKELRDFDLNGAPYGYTPFCDSRREMDGFRFWKQGYWRNHLQGRKYHISALYVVDLKKFRRIAAGDRLRGQYQALSQDPNSLSNLDQDLPNNMIHQVAIKSLPAEWLWCETWCDDASKAKAKTIDLCNNPLTKEAKLSAAMRILPEWKGYDDEVRELQKKIDSGVLDEDPAADSGSAGRDTTDRHTEL

SEQ ID NO: 4446 - protein, 1584 aa, Batrachochytrium salamandrivorans
MVQMLAPTRFLWTDPLYKAVTTNSNMGNAKTTLLWIIAACAAVVSISGTSASTSQSHPDAAILSPPIKVWLKTQDSWPAPPFVLEIIEFSAEEIGGSAVPFLSMLSADGLLSSDVKPKQIYEALFIGDTTKDAIQGVDSFVETPGPKILQFLSSPASLGLAKLSLAIHSTAPRIQAHYRFYMQTVVPLQKKTRFDPSCPVWANWAGRQICSVDEIRQLLSLPIKPSTSAPPLLPFDHIYQSPIHVLGTPLFTVIFYVDVLAPEFKDMFTTLRDAVATLPLQLVLRYKPPHSFLENSAKAGNPLYLSGYGVELAIKSTEYKVEDDREIKSDIADVYTPDTISNINKEEDEFLFQAIPTIKSLSKEKLNDISFKTASYIAQSASPLDTLVLVTQNFPKYAHILSTFPVDKNIRDTAALIRQPSAASNQLYLNGHSVELTRIDAFKLLRLVRKESKIINGLHQLSWTTSQAIELLSTSLSKSLRHSWGECFDTRFDRVIWLNDVEKDSRYTQFSRSLKDLLRPSYPGQLKYIRRNLFTSILLLDLTNAQHIAVASTSFSIIEASAPLRFGIVPLVDLETEAHPANIAAKSLYWIKENGRIKHIKQIIDLFSAAASTTDGVTAEVIKESFLKVTGKEYDSVFNEREAQTKELLKGLSDYSERLGINQLSGAVFSNGKYIEVSASWQKSIVETYSEMVEYLTADIYTNQVTNNEDLYEYFLNMNNVYSKRNSHIFPTSNKPATLINWMDGPVAGIVDGLPWLYGTDSPDFAELSLVVFGDFSTAEGVKFALAAAQATTMSSRPVRISFLHNGAQESSDTSIFVDEAAFHILAKPTEGSLPIEMLKSAIKEDTTKFDGFNPSDEFRLLRRDAMMAIRAAAYVKAGEYGVIANSRFISPLMSSELFDLRDFESLISFELHNRASEMATLISTLKDDMDARSEISDLHFKTQSLVISANVATDAFLSEGPPPKRISSSQFSGARNKTGYIYTGDFKTAAIHFTALIDPTSNLGQKTASILETLSKVQGVAIEVFLNPQGQGDSDQLPLKRFYRYVLGSEPIFDSHGDIAPVGAHFKRIPTAPLLTLGMDVVGAWLVRPTRSLHDLDNIKLSSLPADASMSGVEADFELQSILVEGHASDAATAGPPRGLQFVLGSDSEPNMVDTITMANLGYLQLKANPGVWHLRIREGRSRLIYNMESLRYMSSNGTLIASSKLGDDGATVIVDSFEGVIVFPNVAKRPGMMKEDVLLPLDKGAGGIWDIIKKSTLDAFGSGSSTSETINVFSVASGHLYERFLSIMMLSVKQQTKNPVKFWLIEDFLSPSFMEFLPHLAKAYKFDYELVTYKWPKWLREQTEKQRIIWGYKILFLDVLFPLKIDKVIFVDADQVVRANLKELVDIDLQGAVYGYTPFCSDRTDMDGFRFWKQGFWQSHLQGRPYHISALYVIDLVKFREVAAGDRLRQQYHMLSADPNSLANLDQDLPNSMIHQIPMFSLPQEWLWCETWCSDASLKQAKTIDLCNNPLTKEPKLARARRILPEWEGLDKQVQDERLKFEALHRKTSVIVKPTAVASATPSAVISTAPPSEPNDEAHSEL

SEQ ID NO: 4447 - protein, 1493 aa, Sclerotinia borealis
MGGFNLPWGLSGALLASTYLHSICVTASPSINVGLQTSFPSAPYLLELLETAATENASSYFPLLDRIADDYFSKATTDKDLYDRFMQILNEDGHMDAEALSSYQLALSMRVAAPRIEAQFQYYHTAVEASVKSEKDSSCPTWVLFDGYQYCSPSLDEPHGVVTGDSQTQELPFDYVLGNPTGPHSILYADITSSTFGQFHKTLAKTARESKTSYRLRHRRAIDSDPKKPLMIPGYGVELALKRTDYIVIDDRKDDDEKAPPSNTETKVKFEDEEVADLKPLSTSELSSLGLKASSFIMQSDKPFDSLIKLSQDFPKHSSAIASHNVSSDFLAEHNYNRGKLVPAGFNIWWMNGVQMIDRQIDAISMLDILRKERRLINGVRDLGFTGPEAVQLLSHSDISGAKSDGDVQRFDWRDEIEGGSVIMWLNDIEKDKRYADFPATLGALLQRTYPGQLPSVRKEIFNLVIPIDFSVLEDITLVAETLANFVKRKLVLHIGLVPITTSPAASEQAKVLYHLLDVYGLSGAIAYLEASVTNGAASPAEKVFEAANEGREVRAGKVAIPLKDLLKSDHSNDRIDASSRWTSRLSANGDFPPIFVNGVALSRDENWLQAMVQRLTADLQIIQQGVFNEIFTQDSYIPEFFLSQATARRNALIVPESDKNLKIIDITTISKKHGDVLIRLPKIGVDLTSPKEDWAHMVLIADLSSVSGLDLLLSAAKFRESVPALEITIIHNPSSEKETSDFSTHLFSHINKRSDEASVDAQDLFSLVSPEGLELDHTTKESAQTYWKMAIPLIRSVALSPGENGILLNGRFVGPIPVGSELNQEDFQQLLSYERTKRIAPVYAALKVLGLSDNIADPLAGAKISSIVALSSVSDTPDGIFEQAPTNRISTFDIWNSSYTVIEAGDALTATIHMTVVIDPVSEQGQKWVPIVKAISELEGVYLKMFLNPKERLQELPIKRFYRYVLESKPTFDDEGALVAPGASFTGVPQEALLTVKLDIPPAWLVAPKVSIQDPDNIKLSSIKSDVDALYELEHILIEGHSRDMPSGSPPRGAQLILGTEKDSHFADTIIMSNLGYFQFKANPGFYKIDLQRGRSSEIFKIDSIGSKGWAPVPGDESTEVVLMSFQGATLYPRLSRKPGMEGEDVLEAKIDSPMDYVSRGLNFAQGILGSKAKADTGVEEQADINIFSVASGHLYERMLNIMMVSVMKNTKHTVKFWFIEQFLSPSFKDFIPHLATEYGFKYEMVTYKWPHWLRGQTEKQREIWGYKILFLDVLFPLSLDKVIFVDADQIVRTDMIELVNHDLQGAPYGFTPMCDSRTEMEGFRFWKQGYWEKFLRGLPYHISALYVVDLRRFRQIAAGDRLRQQYQSLSADPNSLSNLDQDLPNHMQQVLPIHSLPQEWLWCETWCSDESLKEARTIDLCNNPLTKEPKLDRARRQVPEWTVYDDEIAAVDRKRKGANGYGTDDGNGDAKNTKSRTLEEMVNTKTKKDEL

SEQ ID NO: 4448 - protein, 1546 aa, Cynoglossus semilaevis
MEVGSFRTGFIGIGVRMWLLWALLFSLVSASSAGADSKAVTTTLTTKWADTPLLLEASEFLAEESQEKFWDFVESNQNIEGEHDDTDQAYYELIVKKASALLSSVQLNMLKFALSLRAYSATVHSFQQIASNEPPPSGCSAFFNVHGEKTCDADGLDALLKMAPERPKPYLFKGDHKYSGSNPDAPVVILYAEFGKPHFRDLHEVVASKAREGLVTYVLRHYLANSNERKVYLSGYGVELAIKSQEYKAKDDTQVQGTEVNATVIGENDPVDEVQGFLFGKLKTIYPELKEQLKELRKHLVESTNEMAPLKVWQMQDLSFQTAARILAAPAVEALNVMKDLSQNFPTKARSITKTVVNSEIRKEIGDNQKFFKGTLGLQPGDSALFINGLHIDMDTQDIFSVFEILRSEARVMEGLRSLLIDTPFIHDILKLNVQPSDSDYAVDIRNSAINWINNLEADHRYSSWPSNVQELLRPTFPGVIRQIRKNFHNLVMILDPSQESASELLSVAEMFYANNIPLRIGLVFVVSDEDDIDGMQDPGVALVRAYNYISDEVNSQSAFEAVISMFNRVPVGAKLSVGDVVKVLEKRFPYVEVSSVLGADSSYDSNRKEGRAYYEQTGVGPLPVVMYNGIPYQREQLDSDELETVTMQKILETTSFYQRAVYLGELVSDQDVVDFIMNQPNVVPRINPRVLSTSRTYLDLSDTNNYFVDDYARFSTLDTKEKSTAVANSMNYMTKKGMTTNNRHDDGYIRPVTFWVVGDFDRPSGRKLLYDAIRHMKTSNNIRLAMINNPSTDPSAETTRVARAIWAAMQTQSANNAKNFITKMAKEETAATLQEDTDIGDFAVGGMDVVLFKSAYDSPQFDVLRSHATYCRDVLKLKKGQRAVISNGRIIGPLEDEEVFNQDDFLLLESIILKTSGERIKNKVQHFEIEEDRASDLVMKVDALLSSQPKGEARVEYDFADDRYSAVKIRPKEGDMYFDVVAVVDPVTRDAQKLAPLLTVLKQLVNVNMRVFMNCQSKLSEIPLKSFYRYVLEPEVMFQSDGSYSPGPLAKFLDMPQSPLFTLNLNTPESWMVESVHTRYDLDNIYLEEVDNIVAAEYELEHLLLEGHCFDVSSGQPPRGLQFTLGTASEPVIVDTIVMANLGYFQLKANPGAWILKLRKGRSDEIYKIYSHDGTDSPADSDDVIVVLNNFKSRIIKVKVQKKADKLNEELLSDGTEENDTGFWESLTSLFLSFRGFTGGGKVEEVKQDKDDVINIFSVASGHLYERFLRIMMLSVRKHTNTPVKFWFLKNYLSPTFKEFIPHMAKEYGFQYELVQYKWPRWLHQQTEKQRIIWGYKILFLDVLFPLAVDKILFVDADQIVRTDLKELRDLDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQDWLWCETWCDNSSKKNAKTIDLCNNPMTKEPKLQAAVRIVAEWTDYDQEIKRLQTRVQEGATLRPQEQQGTDSHTEL

SEQ ID NO: 4449 - protein, 1495 aa, Caenorhabditis briggsae
MNLFGSLLIICQAALVVAAEKKGVQTSLKAMSSLPKRAISSFGNLWKLSIMMLLRSNGRLVRNHHPTWIQFIPFSVTDEQKYDYTIKTAAKVISSSSADLLKFALALRQYSPRVQAFQQMAAEYGENCPVFAVVGEQVSCDYDKFEHLIRDAKKASHVLESDHFVGDKKSKKVVILYGELGTTSFAKAWQKLTKSQKTGLIFRHFSKHVEQNAVSLSGYGVELAIKNTEYKAVDESNEKKSVEEDETDLFGFNIKLLKELHQDSVEAIESFRVNLKESDELTPLKRWELQDLSYQAAQKIVNAGPAEALGTLEEYSQNFPTHARALAKTTVNEKLRKEVLLNRKILEESGIDVGETSLYINGINQDINSLDLFKLADMLKQENKLAEGFHSMGINREYLSVLVGMDTSDEEKASYAVDHREGYPFFINNLDTDKKYKQWGNSVKLMLQPYYPGMIRPIARNLFSLVFVVDPSTSDGRKFLRIGQTFNSHDIAMRIGYIFAVNQDSKASGENDLGVALLNLFNFVAIDSSNAEALKVLNNFLDGYRSQEPTVADLKEFFEAKYGDANFKEVFGADSDYDKGRKHGYEFLQKTGLNSAPKVLLNGFILDEEGVRGDNIEETIMMEVMKISPKIQRAIMEGKLTDRMNVGNWVLDQKEVMPRINKRILSAPSKKVYVDLLGSKNCKTLKGWETFSDADKAACLLQTTKYLQKAATDAILPVTLWTVADAESVEGRRFIYNSLQILKNSVKARVGIVLNPENVEKSCGANSISSYIRAALEHLPMDQAKRLILKLSNEEYAADFLSGKMTFDDLSVGGMDTAKFLADKKKTDCERTRVEAALVQNLLSISAGDRVVVGNALQVGPLDKDEHFDAADFKLLESMLLNRGAEVISSHLNKWEFASANGAGSNVAFSIGGLVGKHASSQKRTWVSIKGDEHSVVTLPADEVEKPAVDVFAVVDPLTLEAQKLGTILQLIKKVTNCDIKLIMNPKDKHSELPLKRFYRYAAASELSFDHTGKLNTNVVRFDNLPSKQLLTLSLQAPDSWIVEAVSAKYDLDNIKMEQASGDVVAVFALQHLLLEGQCFDEVSGQPPRGLQFVLGTDKNPKQFDTIVMANLGYFQLKANPGAWKLEIREGKSSEIYRIGSHVGAEKIGDDTLQVVIDSFTGKSVRVRVEKREGMEERNLLADDEEGVWSSLSNLVSSKEKPQEVINVFSLASGHLYERFMRIMIVSVMKNTKHPVKFWLLKNYLSPQFKETLPTLAKHYDFEYELVEYKWPRWLHQQKEKQRIMWGFKILFLDVLFPLDVGKVIFVDADQVVRADLMELMKFDLGNAPYGYVPFCESRKEMDGFRFWKQGYWANHLAGRRYHISALYVIDLQKFRQIAAGDRLRGQYQGLSGDPNSLANLDQDLPNNMIHQVKIKSLPQEWLWCETWCDDASKKNAKTIDLCNNPLTKEPKLDSATRIIGEWKTYDDEIREVISGNSRSENVISDPEEDTHTEL

SEQ ID NO: 4450 - protein, 1500 aa, Golovinomyces cichoracearum
MIEISKSGFYFRNMEGRKLSWSFPLIFLFTLYQASIHASASPSVTVDLITAFPAPPFLLELLETAADENANSYFPMLDRISEGFFSTASTDKELYERFLQALKDDGHLPNSECVSSYQLALSMRLSTPRIEAHYQYYHTAVEPSLNIEQGSSCSSWVFFKGNKYCSPSLDQALVPVISGLRSGELQFDRVLGNRSAPASILYADITSPEFAEFHKVLAKNARNGKSSYRLRHIKSKSREYRSLAISGWGVELALKKTDYIVIDDRTDDESGTDTSVAENEILLDDDELENLRPLSSSELSSLAVKASSFILQSTSPLDSLVKLSQDFPKYSRVILSHNATQEFVSEHQYNRAQLIQDGNNIFWINGIQLLERQVEIVELIDLLRKEREIVNGLRELGLSALESIQLLSHSKLWSTQTLDGVNRYDWRDNDEGGHVIIWMNNLEKDKRYANWPYAITAMLQRGYPGQIPFVRRDAFNLVVPVDLSDPSDVSLIIGTLLSFVNRLIPIRIGLVPITNKPHAADQAKIVYHLIDTYGLQASIAYLRESSESKKLNVPNLSIFDRIIRERKVKVGRSRLSIEEILKRDEAQNQIISAQSWLERICADDALPPILIDGVIIARDDTWLQKVSQQINSDLQSIQETIALRQGQGKHNDFWLPSLFLDQAVRHRNPLIIPEDQKKLRIFDLNLLVKQHPDAFQKLPRVLASTSNKSEWALMVLIVDLDTEAGKKLLSAATDFCITAPSIELFIVHNPASSSHVKLSANFYLQLKDIGFRDLERTNDFTAKLLSQEAVHVKTILDESKNFWRQFLPIIESLGLKPGQNSILINGRSVGPIPDTDSLKISDFEILLAYENKKRITPVYNALKDLEIEDKILNPLQAAMIYSIVAATTTQKQNSMFDQESTLRMGQFDIWKSSHTVIESGDKNTASIHIFVLIDPASHLGQRWAPILKVLSELEGIYLKLYLNPKERLTELPVKRFYRYVLGSKPEFDENGVIKSPSGSFKGIPQEALLTVGLDIPPAWLVAPKVSIHDLDNIKLSTIKTNVKVTYELEYILIEGHSREAKGGRAPQGAQLVLGTKRNSLAGDTIIMANLGYFQFKANPGYYYISLKGERSSEIFNIDSLGQDGWSSLEVGQKNAVVLMSFKGTTLYPRLSRKPGMENEDVLAHSSSKKGIVFQSLELAKQILGKGVSVPQNQADINIFSVASGHLYERMLNIMMVSVMKHTKHSVKFWFIKQFLSPSFKDFIPHLAEEYGFTYEMVTYKWPHWLRAQSEKQREIWGYKILFLDVLFPLSLDKVIFVDADQIVRTDMIELVQLDLHGAPYGFTPMCDSRTEMEGFRFWKKGYWERFLRGLPYHISALYVVDLRHFRQIAAGDRLRQQYHALSADPASLSNLDQDLPNHMQNVLPIFSLPQEWLWCETWCSDESLKDAKTIDLCNNPLTKEPKLDRAKRQVPEWIVYDTEISELDKKRRMSDPDHAREKNPKSRSFDEIPETKPFGKKDEL

SEQ ID NO: 4451 - protein, 1638 aa, Phaseolus vulgaris
MGLRSESPLLLLILILLLAIASAHTPTPKNVQTSLRAKWFGTPLLLEAGELLFKEEPRLFWNFIHAWLHADDHGDAHSHSARSCVNEILHHSRPLLREPLASLFEFSLILRSASPALVLYRQLAHDSLSSHSYAPITKLDPLHLGVSLQSPGGKCCWVDTGDTLFFDVSELLLWLQTPLEKVGGSIPGPQLFDFDHVHFDSSVGSPVAVLYGALGTVCFKEFHDALVGAAKQGKVNYILRPVLPAGCETNFGHCGSVGASESINLGGYGVELAFKNMEYKAMDDSTIKKGVTLEDPRTEDLSQEVRGFIFSKILERKPELTYEIMTFRDYLLSSTVSDTLDVWELKDLGHQTVQRIVRASDPLQSMQDINQNFPNIVSSLSRMKLDDSVRDEIMANQRMIPPGKSLMAINGALVNVEDVDLYLLIDLVHQDLLLADQFSKLKIPPSIVRKLLSTLPPSESSMFRVDFRTTQVHYLNNLEEDAKYKRWRSNLNEILMPVFPGQLRHIRKNLFHAVFVLDPATISGLEASLFSKANTLFFVNSFSKRNLSFLELLLGTLQSIDMIISLYESDFPVRFGVVLYSSKYITQLENLSAKEDRDKFEEDISDMIIRLFSYIKGHHDTQLAFEFLSNVNKLRTESDDGHLELHHVEGAFVETILPKVKSPPQEILLKLEKESELKELSQESSMLAFKLGLSKTHCSLLMNGLVIDPTEDALLNALNDETQRIQEQVYFGQIKPHTDVLAKFLSEAGIQRYNPRIISDSKPRFVSLSAFLFGEESILNDIEYLHSPGTMDELKPVTHLLAVDITSRSGLHLLRQGLNYLREGSKDARIGLLFSANWSTDSLSVLFVKVFEITSSSYSHKKNVLDFLDQLCLLYQQKYFPTSAVEVEGTQTFIDKVCELAEANGLPSEGYRPALLKFSADEVRRHLNKVGIFLHRLLGSESGVNAVFTNGRVTYPIDESTFLSADLLLLESIEFKQRTKHILEIIEEVKWQHVDPDMLTSKFISDIVMAVSSSMAVRERSSESARFEILNDQHSAIILHNENSSIHIDACLDPLSATSQKLSGILRVLWKYIQPSMRIVLNPLSSLADLPLKNYYRYVVPSMDDFSIADSSINGPKAFFANMPLSKTLTMNLDVPEPWLVEPVIAVHDLDNILLENLGDTRTLQAVFELEALVLTGHCSEKDHDPPRGLQLILGTKTTPHLVDTIVMANLGYWQMKVSPGVWFLQLAPGRSSELYILKEGADGIQSKQLSKLITISDLRGKVVHMDVVKKKGRENEKLLVSDDEEDPQETKKGSGWNSNLLKWASGFISSNEQPKISETNAEKVKGGRSGKTINIFSIASGHLYERFLKIMILTVLKNTQRPVKFWFIKNYLSPPFKDLIPRMAQEYGFECELITYKWPTWLHKQNEKQRIIWAYKILFLDVIFPLSLEKVIFVDADQIVRTDMGELYDMDIKGKPLAYTPFCDNNKEMDGYRFWRQGFWKDHLRGKPYHISALYVVDLKKFRETAAGDNLRVFYETLSKDPNSLANLDQDLPNYAQHVVPIFSLPQEWLWCESWCGNATKSRAKTIDLCNNPMTKEPKLQGARRIVPEWPDLDLEASKFTAQILGDDLEPFPSPNQSKDLISEDALKEDLESKAEL

SEQ ID NO: 4452 - protein, 1096 aa, Coffea canephora
MQTIEMVISLFENNLPMRFGVILYSANIIQKIEANGDELQRSLEDDLKSEEDVSSLVIRLFLHIKENHGNLMAFQFLSNVNKLRIESAPEEAPEIHHVEGAFVETLLPSAKTPPQDILLKLEKEKTYHELSQESSMFVFKLGLAKLQCCLLMNGLVYDSNEEALFNAMNDELPRIQEQVYYGLINSNTDVLDKFLAESGIQRYNPQIIAGGKVKPKFVSLSASILRNGSWINEISYLHSSDTVDDIKPVSHLLAVDFTSKKGIKMLREGLSYLMGGSKIARLGVLFNSNEEANSLSYIFVKVFEIAASSHSHKKGVLEFLDQVCSLYEREYMTSTSPDNEKSQEFIDKVVDLAVASGLPSKGYESPLSTFSVGKLKNHLIKVAQFLYRQLGFHSGVNAVITNGRVVPVGGGVFLSHDLSLLESIEFKQRIKQIADIIEELKWEDMDPDLLTSKFISDIILSISSSMAMRERSSESARFEILSSTCSAVVLDNEDSSIHIDAVIDPLSSSGQKLSSLLRFLSKYIQPSMRLLLNPVSSLVDLPLKNYYRYVVPTLDDFSSIDDTVYGPKAFFANMPLSKTLTMNLDVPEPWLVEPVIAIHDLDNILLENLGDARTLQAVFELEALVLTGHCSEKDHEHPRGLQLILGTKSTPHLVDTLVMANLGYWQMKVFPGVWYLQLAPGRSSELYVMKEDGDGSPYTTLSKQITINDLRGKLVHLEVLKKKGKENEKLLLASDSDESHSRQNRNGDQKSWNSNLLKWASGFIGGSDRSKKIESTSVEHGNTGRRGKTINIFSVASGHLYERFLKIMMLSVLKNTRRPVKFWFIKNYLSPQFKDVIPHMAQEYGFEYELVTYKWPTWLHKQKEKQRIIWAYKILFLDVIFPLALEKVIFVDADQIVRADMGELYDMNLKGRPLAYTPFCDNNKEMDGYRFWKQGFWKEHLRGRPYHISALYVVDLVKFRETAAGDQLRVFYETLSKDPNSLSNLDQDLPNYAQHLVPIFSLPQEWLWCESWCGNATKSKAKTIDLCNNPMTKEPKLQGAKRIVAEWPDLDLEARQFTAKISGEPIDLKEQVALPLESQSSTIHDSSEDWESKSEL

SEQ ID NO: 4453 - protein, 1644 aa, Amborella trichopoda
MVKNTGIRVSGCLLIILTLSFLSGIAPSLADPRRPKNVQVSLRAKWSGTPLLLEAGELLSKEWKDLYWEFVEAWLGKETDSNSLTARGCLQEIVHHGRNLLNEPLASLFESSLTLRSASPRLVLYRQLAKESLSSFPLGEETNTKDINESIPEEVTSSKNKKLNQLLVSQNPKSLGGKCCWVDTGNSILFDVSELRLWLDSPSRLSEDLSEQPELFDFDHIYFESSIGSHVVILYGAVGTNCFKEFHVALVEASKKGEVKYVVRPVLPSGCESKAGSCGAIGAGDALNLGGYGVELALKNMEYKAMDDSAVRKGVTLEDPRTEDLSQDVRGFIFSKILERRPDLTTEVMAFREFLLSSTVSDSDTLDVWELKDLGHQTAQRIVHASDPLQSMQEISQNFPSIVSSLSRMKLNASVKDEILANQRMVPPGKSLMALNGALINVEDVDLYLLMDLIHKELSLADQFLNIKVPRSSIRKLLSSPPHSESNGFRVDFRSSHVHYLNNLEEDAMYKRWRSNLNELLMPVFPGQMRYIRKNLFHAVYVVDPSTIKGIESINLIFSMYESHIPMRFGVILFSSKLSTKIEDNEGELPICSGEKCQSDMKEDIGSLIIRLFLYIEENYGTTLAFEFLRNVYKLWSDSEALTDETLEIHQVEGAFIETLVSKVKSPPNDVLLKLEKETVFMDKVEESTLSVFKLGLSKLGSCLLMNGLVYESNEDAAINAMNEELPRIQEQVYYGHIDSRRDVLDKLLSENGYNRYNPEITGEGKEQKRFVQLTPAVIRGEKLILDVCYMHSPETMDDLKPVTHLLVVDITSRKGVKLLRQGLHYLIEGSKRARVGVLFNVNSTSLSKRSPSLLLIKAYEVTASLFGHHQNALQFLNQLFSIYESEIPFLDAEGFELLIEKISDLAMANGLRPEAYRSSLTEDSLDSMKSHLEKVAHFLYKLGLEYGTNAVITNGRVVLSTDGGALLSEDLGLLESLEYEQRIKSVASIIEETDWGDLDPDHLTSKFLSDLVMLISSSMALRSRSPDVARFEILNAKYSAVILNNENSSIHIDAVIDPLSPLGQKLSSLLRILWKCIRPSMRIVLNPLSSLVDLPLKNYYRFVVPSMDDFSSADYSINGPKAFFANMPLSKTLTMNLDVPEPWLVEPVIAVHDLDNILLENLGDVRTLQAVFELEAFVLTGHCSEKDHEPPRGLQLILGTKSVPHLVDTLVMANLGYWQLKVSPGVWYLQLAPGRSSDLYMFKGHGEGSMSKKITIDELRGKVVYMEVVKKKGKEHEQLLANVDDKNHMHENKGNLNTWNMNILRWASGLIGGNEQSKKQAAHVEEYGKIGRRGKQVNIFSVASGHLYERFLKIMILSVLKNTNRPVKFWFIKNYLSPQFKDVIPHMAEHYGFEYELITYKWPTWLHKQTEKQRIIWAYKILFLDVIFPLSLEKVIFVDADQVVRADMGELYDMDIKGRPLAYTPFCDNNKDMDGYRFWRQGFWRDHLRGKPYHISALYVVDLLRFRQTAAGDHLRVFYETLSKDPNSLSNLDQDLPNYAQHNVPIFSLPQEWLWCESWCGNSTKSKAKTIDLCNNPMTKEPKLQGARRIISEWVDLDGEARAFTAKILGEETETPSEPVSGPRTEAIATDYAEEDRESMAEL

SEQ ID NO: 4454 - protein, 1594 aa, Dentipellis fragilis
MGVISVLASGLAVAAALSSAVASPPVKVALRSSWPSPPLLLELIETVTLEEPDAFFPLLDTLTDPANLPSKEPLAPEALHQLALEAATSLGYLSSPGAFESVEMQLALHAATPKIEAFYQHYADTSKSVLESNGTGDCGSWVDWYGEVVCDLDRLQHLVGAESIESQEQISHHAEFFPRPKILPFDHIYPSPSRVLETPPRTAIFHASMTSENFRELHAYLMRMSELSPAKVEYVYRPIPSSNAGKSRVSLSGYGAFLDLKKMDYLALDDRHSHEQDSDVENPDATDGSVSSNEADHIVTLLSPYALNDTLGLNEPLVEHELAVIGHQTTQLVKDSETPFATFKQLIEDFPKYMTAIARRVTVSQELTHEVRVNSMKTQAGMSLAWLNGGAVSDADMNPFGLLRLLRKERGLMTSLTALGIEPSAARDLLAHPAISSASSNELLDGIFDASDRPEGGDLIVWWNDIEKDSRYARWPSSLYTLMRPTYPGQINVVRLNFYNAIVVVDLSRTSSLDYLLGIVSNMIERGFPIRFGIVPIADTESGSKMAKLFYYLVDTHGRKRTMAFFKKLLLSDGVDAIPEYVDMAKARSVFEYLANTEEPVEGKIALDFPTIIEGAGEDELARLAKARAYTKRLGADPASDGHIFANGKYHPLDERLAQVIQFEITQMVQYLQERIYEGTLSDESSSEISTLFYDLPTAQKRRNKHIVPAGGAKDVRAVNVPQLFRTTGFQASSACFIYPTADSVPLTIFVIADLDSEAGLSLVEAALHYVKSSKARVSFIHNPSSNSRTYDRHRASSVLSRLQFHGLLSEKAPERLAEALELYTTVQADGGDQTVLNPEAALEEITEGIAFDEDLADFAAYLKAGRLLAREFGIKAGDAALLVNGRIVGPIGTGEMTTEDFTALQEYELFRRVQPVAEALEKIVPGFVDLNKTASAELISMASSVVTHVLTPDPSQSGLFNQPSISRNPTYEVLLGEQTKFDVGNKSTSMFHFAVVLDPLSEHSQRYMNLLHWLSQSPHVSVEVHLHPAPYHDVPLKRFYRYNLLPRPSFDESGQEIPSSVVFKNLPIEPIYTLGLDEPSSWLVRPREALYDLDNIQLGVLSREEARRGVEATYELDYLIMGGHAREMPANAPARGVQLQLTTSKSEPVDDTLVLANLGYFQFKATPGVYRLEIREGRGREIYDLQSVGNEGWDSPTVEKVGDQITLTSFEGVTLYPRLVRLPGMELADVLQVDEEDQLSGLGSVVSRVKSFFQPKTTDVATTLQKHADINIFTVASGLLYERFASIMILSVLRNTNHTVKFWFIENFLSPTFLEFIPHFAEEYGFQYELVTYKWPTWLRQQREKQRIIWAYKILFLDILFPMDLDKVIFVDADQIVRTDLKELIDLDLHGAPYGYTPMGDDNTDMEGFRFWKTGYWQKVLQGKPYHISALYVVDLNRFRQLAAGDILRTHYQQLSADPNSLANLDQDLPNNLQMHVPIYSLPEDWLWCETWCSKDRLDRAKTIDLCQNPLTKEPKLARARQIPEWEVYDSEIARFTRRLAAEGRIQSSVAAADVNELANAGAAKAAAPSSSADEPLVDEASDSPEAPVRDEL

SEQ ID NO: 4455 - protein, 1637 aa, Puma concolor
MPDEESESPRSTSAQLNKTEYFDLMNHLPCAVTGGRIADPPEHQPRRRRFRHRPHLRGSRIQPRGAPGTAPERDAHALRARQAPAPSNGLELPPPEVGGRGQRSRLCRGGCGLWAPGTRGSRFSLPAMAKATDVVRLLLGSTALCFSLLDARTALASKSVTAHLAAKWPETPLLLEASEFMAEESNEKFWQFLETVQELAIYKQTESAYSYYNLILKKAGQFLDNLHINLLKFAFSIRAYSPTIQMFQQIAADEPPPDGCDAFVVIHKKHTCKINEIKKLLKKATSRPRPYLFKGDHKFPTNKENLPVIILYAEMGTRAFGKFHPVLSEKAKNGEILYVLRHYIQKPVSQKMYLSGYGVELAIKSTEYKALDDTQVKTVTNATVEDGTETNEVQGFLFGKLKERYSDLRDNLTAFQKYLIESSKEMMPLKVWELQDLSFQAASQIMSTPVYDAIKLMKDISQNFPIKARSLTRIAVNHLMREEIQGNQKGLHARFEIQPGDACLFINGLRVDMSAYDPFRILDMLKLEGKMMNGLHNLGISQEDMSKFLKLKSHVWDHTYALDIRHSSIMWINDLENDDLYVTWPTSCQELLKPVFPGTVPSIRRNFHNLVLFIDPAQEYTLDFIKLAELLYYHKIPLRIGFVFVVNTDDEVDGADDVGVALWRAFNYIAEEQDVSQAFLSVVHMYQKVKNDNILTVDNVKSVLLNVFPDANIWDILGIHSKYDNDRKVGASFYKMTGLGPLPQALYNGESFKLEELNMKELEMALLRRMMDATVYLQRDVFMGRLNDRTNAVDFLMDKNNVVPRINPLILHAKWQYLNLISTSVTADVEDFSTFFFLDSQDKSAVIAKNMYYLTQEDDDVISSVTLWIIADFDKPSGRKLLFNALKHMKTSVHSRLGVIYNPTSKINEENTAISRGILAAFLTQKNSFLKNFLRKLAKEETATAIYSGKKIHTFLTEGMDKNAFQKKYNTIGVNIFRTHQLFCQDVLKIRPGEIGVVSNGKFLGPLDENFYTEDFYFLEKITFTNLVEKIKGVVENMKISSKNMSDLVMKADALISSLPKRESRYDITFLRENHSIIKIKPQENGMFFDVIAIVDPLTREAQKMAQLLIVLGKIINMKIKLFMNCRGKLSEAPLTSFYRFVLEPELRLVGNDITGPVAKFLDIPEAPLLTLNMITPEGWLVETVHSNCDLDNIHLKDIERTVTAEYELEYLLLEGHCFDTVTEQPPRGLQFTLGTKSKPVVVDTIVMANLGYFQLKANPGAWILKLRQGKSEDIYQIVGHEGTDSQPDLGDVIVVINSFKSKILEVQVQKKPDKIKEDLLTDKDEKKKGMWDSIKSFTRSLYKEKDEADVLNIFSVASGHLYERFLRIMMLSVLRNTKTPVKFWFLKNYLSPTFKEVIPHMAEEYGFQYELVQYQWPRWLHQQTEKQRIIWGYKILFLDVLFPLAVDKIIFVDADQIVRHDLKELRDFDLDGAPYGYTPFCDSRTEMDGYRFWKKGYWASHLLRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLKAAARIVPEWVEYDTEIRQLLEHLENKKKNAILTHDEL

SEQ ID NO: 4456 - protein, 1522 aa, Pyronema omphalodes
MRIQAASLLLLASLFSRALAASPAVNVGLKASWNSAPLILELLETAALENEAAYFPLLDRISAGALDEKKTDKELYDEFLRLANDEGFLKNPEELSSFNLALSIHAAAPRIEAHYHFYDNNMGRWDPDCNVWVQLGLRQICSPKGELDEIIKTVTNDEKKLQFDRTLGTQEGKPTAILYADIMTPQFKRHHDRLKRYADQGKISYRLRYRRPYESEDRPIMLSGYGVSLVLKKTDYIVMDDRDVGDAENAKAPAADSAQQPLIKLENKESQDIKPISKEDMAGLGYKAASFIMASEDPFGTLQQLVQDFPKHSATIAAGEVNESVAKELDDNFAMMIGGGKNLFWVNGLLLDHSQVNAFALLDHLRGERKHIKSLQSFGLESSEAIKLLSHPVLAASKEEDKALRFDYRDDIEGGDVLIWMNDIEKDSRYSQWSDNPMTMLRRIFPGQLHPMRINMHHLVVPIDLTSKADLSFINNEIRQFIERKIAIRFGLVPLLTNDNAKDQSKIFYYLRDTYGLETALKYFETALEKNDFSKPSEEIFDEVIKGGKLRKDKTALPFELALAGEVISGRLTKLEAWSERMGFNIPAPPVLINGQPVAKEDDWMSSMSDKLQMDVQLVQRYVYETGGQDPEMDLRTHLLQGAAKRRNSYIFPEKEADVKMLDVTQIIESNKDIFEKLPSIDSDKPEVTSEASIWVVGDFDQNDGYDLLNAAAELQKEEQAVNLVLINNPESATEKSTLSSLLFQLHQSKSLTHDLLRKVLDEAHPAKTEDLLGAVKQNGWALPDTIEAGKFWKQSRVVLEKAGVKPGEKAIIITGRVVGPIPKDSTFVTADFQALLDYELTKRIKPVLESAQELGVIEKVKNSGPHSLSSLTSAIALATVPEVPNGLFSPPESTRSDVPGKMLSGDHTAISLGDASTSSIHIVATIDPASELAQKWVPLISALSSMSGVYTQILLNPVKQIGELPVKRFYRHVLSSKPSFDEAGRLESPVARFENIPEGPLLSLSMDVPPAWLVSPKESIHDLDNLKLSTLKERLRGSSVEATYELESILIQGHSMEANGNPPRGAQLVLGTPNTPNFADTIIMANLGYFQFKANPGIWEMSLKRGRSDEIFTIDSFGTAGPSKPTGVDEDIAVLSFQGTTLFPRVSRKAGMEEADVLESAVAGPPSVVDTAKQWLSSLGVLKYVPIPPALQDNAQAEINIFSVASGHLYERFLGIMIASVMRHTDKTVKFWFISNFLSPSFKDFLPVLAEKYKFKYELVTYKWPHWLRPQSEKQREIWGYKILFLDVLFPLDLDKVIFVDADQIVRTDMSELVNLDLEGAPYGFTPMCDSRTSMEGYRFWKTGYWASFLQGRPYHISALYVVDLKEFRAIAAGDRLRQQYHQLSADKDSLANLDQDLPNHMQSLIRIKSLPMEWLWCETWCSDEGLSKAKTIDLCNNPMTKEPKLDRARRQVKEWVEYDEEIAALAKSVKGAGHLSEAKEEKKAEEVKEETHEKAQEKIGEQKTEVMDNIEDKIEIKDEL

SEQ ID NO: 4457 - protein, 1559 aa, Alligator sinensis
  MOD_RES (166)..(176): Any amino acid
MAAKSALPVPLLLLLLPLPPWPGGAAASRKAVTARLAAKWAAAPLLLEASEFIAEESNEKFWQFLETVQEITIYKQGDSDHSYYNLILKKAGQFLSNLQINLLKFALSIRAYSPTVHMFQQIAVDEPPPEGCSAFVVIHEKHTCKTNEIKKLLKKAAKRPRPYLFXXXXXXXXXXXPTLKENVPVVILYAEMGTKDFVKFHKVLSEKAQKEEIIYVLRHYVQNNIFKQKSGSRKTYLSGYGVELAIKSTEYKAVDDTQVKATNDTTEEEGDEENEVQGFIFGKLRQMYPNLKDNLKEFRKHLIESTNNMELLKVWELQDLSFQAASQIKSTPVYDALKVMKDIAQNFPVKARSLTRVPVNQQMKNEIEENQKHFYETLGIQPGEARLLLNGLHIDLDFHDPFSILETLKMEGKVMHGLHELGIKEEALSKLRNLDIHPANDGYALDIRHSSITWVNNIEKDHIYSTWPTSFQELLKPTFPGVIKQIRRNLYNLVLFIDPVQENAADFMKLAELTYHHNMPLRKQFIAVTKHNCMGADSFKNGSLDENCMRVGVVFILNTNEEIDGNEDAGVALWRAFNYIAEESDISQAFISIINMFHEVKEGDFLTVNHVKNVLRNEFPRANVPSILGIHSEYDEERKAGATFYKKIGLGPLPQALFNGVPFNSEEMNAAELETIILQKIIDATGFFQRAVFMGLLNDQMDTADFLMEQYNVISRINPTIFSTERRYINFISTSVPVDTEDFSTFSFLDSQDKSAVISENMKYLTRKDEDVIYAVTIWIIADFDKPAGRRLLSNALKHLKTSSHTRLGLVNNAGSKITEDNTAIARGILTAFLTQKNSSLRSFLSKLVKEETAEALAIGTKIKEFFVLGIDDNIFEKKYNTLGVNVIKTHQMFCQEVLKLLPGQMAVVSNGRILGPLDENEFYTEDFQLLEKITFSTSGEKIKAIVKEMKISNKRASDLIMKVDALLSSLTKKEMRQAVQFLKEHHSIVKIDPQQNEPFYDVVAILDPLTREAQKMAHLLIVLRDIVNMKLKLFMNCRSKLSEVPLKSFYRFVLEPELTAGANNLFPSEPVAKFLEMPESPLLTLNMITPESWLVEAVNSSYDLDNIHLEDIEGIVTAEYELEYLLLEGHCFDITTGQPPQGLQFTLGMKNNPVMVDTIVMANLGYFQLKANPGAWTLRLRKGRSDDVYHILYHEGTDSPAGLKDVVVVLNNFRSKIIKIQVQKKANKINEDLFNDGVTEEKGIWESVTSFSGGIQTEEKKRKNYSLNIFSVASGHLYERFLRIMMVSVLRHTKTPVKFWFLKNYLSPTFKEVIPYLAKEYGFQYELVQYKWPRWLYQQTEKQRIIWGYKILFLDVLFPLAVDKIIFVDADLIVRDDLRELRDLDLNGAPYGYTPFCDSRTEMDGYRFWKSGYWASHLGKRKYHISALYVVDLKKFRRIAAGDRLRGQYQALSQDPNSLSNLDQDLPNNMIHQVAIKSLPQEWLWCETWCDDESKKKAKTIDLCNNPQTKEPKLKAAVRIIPEWVEYDSEVQKLIKQIEREKKSLTQSSQKIFKRDEL

SEQ ID NO: 4458 - protein, 1389 aa, Naumovozyma dairenensis
MILINILLVLLTLAFRTFSIGLDVSSFGVHEAVVAWSILTHLSSSSLFSNEPTFHELEGLYSIITGLDESVDYEEIDLIPYIEQLLTEKYNNPDIASLFSLYTELYPMGIINNDLQKQLRHYAIEENENCFILNGKKYTKPDDIFYLKSNDLKQQALLPDSQIVLSNEYIISDAAAPATTTAENGNSPILTFYGCPNNNDLFNEFNRNLFSEITSKSGKFRFIWRSTCSIGSNNEEYKEIQFPLALTIKENSDFNSLSNKKTNEFKIPLDIPKRFQNDQYEHYNPSETELEELDMKVTYLISKYYKQTSNLTSTSKFAKGIINNFPLLMSQLIQVELPPTALKKIKKSNSDLEKFGVDYKMLGLYVNGQYIKLSSLNEFSLLNMIVKEHSHVSKLLFLFENMFPNTMKPTLSSVKKIINYFSSISLDNLNTLQPIKYNLHMIPGFSESVIYFNDIEIDSQYDELSNDISAFFQESKFGELPEYRQNWNELIFVIDFNNLQDESTIHALKGLITAINVITQGYPQRIGLLPLDTSQGTNLLVQRMIRKVYELKNFDLIELQSFLQELSEINEDVDLDMEDENYPSPNVNKLLKNLQIFETSIIIDGEIYPFKKNTWHYLIAKVIKKDVSYLKNELRQIANKIQNNAANPVKDVRSLLHMKSGNARHSKYTPDYFSDAVYTTMNNTVLFEIQERIVEYVASEEYNLLHTITLFDDFNTLSSLKRLQNLLENTYSGIRVRIIHNGSMKGKTWTKLKKVLEKKKNVKSQLSALIQQTKNNEYEGTSSINPNMLARWLPDISVPFVPGLSSFMIINGRFIHFEPTEIPTTTNFEAIIKREAQRTLQTTFSLIKEFPTLEDAKFNPDLIEMTSALLTKEFYHSTNVFDNGIEYSTENYFPRLNLDELLKFNSYTTLQSNSHNSIKPVDILLLIDPLEERSQKILSLISKLKNLSFINLQIILLPTEKLKIVPIERIYIDNPIEETYPLPNILMENFEVDIDIPSQFSSNNFQELKKISIEVHTFPTNSYPSQSQVDGIGGVCLELINSQGDVVDTTTTMATFGYGTLHANDINTKYQVRSCGDDFIIGSFSVNTYSDYIPVDSFSIADFTPIKLYVQVMKNPNFHEKVKKVDDNNYHVFTLLKDDPDEETIYQDMVFSLLKNPERKQDSILHFWIIDQPFFSQEFREFIRLINEETENLRGIIHLFSYDWPSWLRPQRFRSRTLDVSKILFLDTLFPQNISKVLYMNPVAQNIVDPAKVIDQYNVDNAFSMLKMNGKGYWNEGYWSKMLDENNLEFYSVNPFFLINLENVRKNEVCEKLRVHYQRLTTNINSLQVIDQDLLNDIQLLVPISALPDKLRTISVHSTETNFLQWKQNKEQKYSQIKTTQEQISHDEL

SEQ ID NO: 4459 - protein, 1260 aa, Chaetomium thermophilum
ETGQVAASPSINVALKAAFPSPPYLVELLETAASDNTTIYYSLLDRIAKGHFAEATTDKALYEKFLEVLRDDGHMDPEALSAFKLALSLRTATPRVEAHYQYYTATVEPSLSGTQEGCDQWFLIDGEQYCSPTLDTSHGKVKGEDQLRTLPFDRKFGVGSRDVILYADITSKSFAPFHEVAMDLAKKGKASYRVRYRRSPSHSRESLSVNGYGVELVLKRTDYIVIDDRDTGAAAKPAEENDQKPLVGHETVLDDGEEIADIKPLEKSELAALGMKAASFVMQSEKPFEALLKLTQDFPKYSNSLGSQNVSAEFEAEHRGNREVFLPEGSNVLWLNGLHLIDRQIQPFGLVDLLTRERKLIKSVLDLGLTGQQAVDLLGHAEVAHAKSGDDEPRRFALSRRNTLIFPEDKNELTVLNVNKIYIENHDLMSKVPVIEASKESTRDDWAALTVVADLDDIEGQELVYYALRFRKSNDGVRLDIVHNPKDTSRSPSVLAQRLKSREDKLLDFTRFLDLETALETGEFEPDVAYDASLANFLASSNMKAGDNFVILNGRVLGPITSADDFKKEDFEVFLQAERRTRILPVYKALEDLGLDDKVSGPLSAAKLTSVTALSTISDLPQGIFDNAPTVRTTLFKQWNSTYTSFEVGDASTATIFFVAVINPASEIGQRWVAVLKVLSELEGVHLRVFLNPTVMIEELPVKRFYRYVLSSSPSFDESGKVKALSARFTGVPRETLLVVGMDVPPAWLVTSKVAVDDLDNLRIKDIKAKRGTEHVEAIYELEHILIEGHSREIPGAHAPRGVQLVLETENNPHFADTIIMANLGYFQFKANPGVYNIRLKEGRSSEIFTLESVGAKGWGPIPGDDNTEVVLMDFQGTTLYPRLRRKPGMEEEDVLEPSTKSGEESGSGARNLVSRGIKFAEGLLGRGNKAAEATKSVSKTEHAEINIFSVASGHLYERMLNIMMASVMHHTNHTVKFWFIEQFLSPSFKDFIPHMAAEYGFKYEMVTYKWPHWLRQQKEKQREIWGYKILFLDVLFPLSLDKVIFVDADQIVRTDMYDLVEHPLDGAPYGFAPMCDSRVEMEGYRFWKTGYWANYLKGKPYHISALYVVDLQRFRELAAGDRLRQQYHALSADPNSLANLDQDLPNHMQFTIPIATLPQEWLWCETWCSDETLKDARTIDLCNNPMTKEPKLDRARRQVPEWTKYDEEIAELARRVREEKPKKKEEEKVQKNPKSRRLDGDEEEVKTVREGTKHHHHHH

SEQ ID NO: 4460 - protein, 1488 aa, Ophiocordyceps sinensis
MARPRSLPWALCAAIMAALPAMAAPSVNVGMNAAFSAGPYLLELLETAAAENETAYFPLLDRVASGCFASASSDADLYNEFVAVLKNDGHMPGSETLSTFNLALSLRSAAPRIEAHYQYYATAMEPLVTDSQCENWVLLEGQQFCTPALDSSVKEGLTSSRETALPFDRTLGSGREAILYADPTSDSFGEFHRALCKAARAMRLNYRLRYRPDKTSAVQPLPVSGFGVELALKRTDYIVIDDREDASDSVQQPLGSGDILDGQEEVADLKPLSSSELASLGLKAASFIQKSDSPFETLVRLTQDFPRFSAFIATHSVSETFSNAREQSLANAAHGGANFLWMNGVQLIDRQIEPFALLEMLRRERKLINSVRDLGLSGKQAVSLLGHSTISTAKGEEESPRYDWTDRLEDGRVIVWLNDLETESRYDDYPKTLISLLQRTFPGQMPPIGLNVFNLVVPVDLSNSDDVKVVNQIASIMSRGIPIRFGLVPLTSTAEATAQAKVMYHLLENHGVQALLAYTERSERDTQTAVDERHFAKVAAAGDPLPGSQRMSLSEVLEAETFEKQIELARHWAERLKVDTATRSLLINGVIIARDQNWMQTMSVKIGEDLQTIQKGIFQGALDEGTWIPGIFLEGAATRRNVYIALDNEKTLRMLDVSRLYTEHATLFGTIPVLESYAESTKENWATANIVADMTTQDGLKLVLAALEFKRNNPGVRLELIHNPENSSSASQMNWALKSNEGILKDIETIDELSALPKATESAAADDNYALGLSAFLKMGKIEPGKKVIILNGRVIGPISAGDPFTADDFQQLLEFEQKRRILPVYAAFDDLGLSDKLSSAVTAAKATSIIALSMNSDLPEGIFETAPAVRSTLYDSWNSSHAAIEIGDSEKASIHITGLLDPVSEKGQRWAPILKVLSELNGVYLKLILNPHEKIAELPLKRFFRYVMDSKPSFDERGKVRALKATFGGLPSEALLTVGMDVPPAWLVAPKESVHDLDNIKLSSVRSDVDATYELEHILIEGHSREGRGKPPRGAQLVLATERNPMVTDTVVMANLGFFQFKANPGFYNIRLKEGRTAEIYAIESIGAQGYEAAPDDEGTELALMDFQGTTLYPRLKRRPGMEQQDVLETADGSSASSIVSKGIKFAEELFGGSKSKSVSAQEINIFSVASGHLYERMLNIMMVSTMRNTKHSVKFWFIEQFLSPSFKEFIPFLAKEYGFKYEMVTYKWPHWLRQQKEKQREIWGYKILFLDVLFPLSLDKVIFVDADQVVRTDMMDLVNLDLNGAPYGFTPMCDSRTEMEGFRFWKQGYWATYLRGRPYHISALYVVDLRRFRELAAGDRLRQQYHALSTDPGSLSNLDQDLPNHMQFEIPIHSLPQEWLWCETWCSDESLAQARTIDLCNNPQTKEPKLDRARRQVPEWTVYDDEIAKVVKKWRQGPRGNERPGDTTPIDKGVRQPDAIGEEKQREVNIKSRKWDKGEVHPKDEL

SEQ ID NO: 4461 - protein, 1681 aa, Trypanosoma theileri
MSYHTIQANIGSRLTAVVALLLCFGTVLQLWGISIAEAKGVHVTVAAPWTETPFLQEGCEWAAVRESNRDGFYECLQDVWHHVGALNNNNNNHNNNNNSISSIAGGALTLTQKSQYEMLFDIMERKNRSSYQMALLKMKLAARVYSPAVEAHWALARIAMRLADGCSIEGKPFVMIFGNAICNEHTLEKMLKDLSLSYSKDTNKRENNKEVEKETMMLFPKLDHIHPESKGQHVVILYGLVGEQQTMRLFKIIQSYLHIVRFAFRHLPVTGGMWENPLFVQGYGVTVDLKNVEYKVMDKKSSETETEQQENKSEGEGRDIEPVGGFDLNILKRRYPNLTKQLNSFGDYLAEMIDREEVKVDFHMWETQHMGGAAVKQVMNAAKEERLNVLLNILTNFPLHASKLSKMGSATGGAIDGEMQQVMMQLLSLVQAGSSLAFLNGQRINTPEMDLFSILEKIEAEDKLLESLTQILTSYHLPSPETDNGFLSVESTKMTGLLNDITETVQNRIALKGLDLKRATTRIWFPQKSILWINDIEKDSNYEHLSLDLNTIFETSYSGIPQIPKRNLLNIVGIVDPTTPEGHQAIITLMKIVAQGQPLRAGIVIVNPHWLPEIHVSIDKKEDDVEIPEKSSPSKAIMMIAATLWELLRENTGNAREAIQFMVYLREYVINGQTISDSDINVVAESILSMANKRSLLEIMGDKDFNKYYHETQETIYNLHFKEFPTILINGNMFSGDVLAALEKGLMMELSHIRDLVGEEKIKNTDVDMYESIMESSGAIHRYFRDLYEDQVYVNWASKSIIDFLQYRSFLFPLSNTKEVPLLSTVLRVQAPLKSRDLQAILKITEELYECKDRSEKCRFIRHTFAICGMLKDNKRRTLAVDLERLLINENINGNNKDGSRRLEFMREFLLKVIPKSDKIDMNNPDVYEKFLSTVHFSSDMEKVLANTSPKSDILLKEEEQEKLVDGFCKDMRNSHTLLTGEVEDIKSIYYYVNGRRFTYSDDYTLKDLEDAALRELSFAEIVGEVIKDIHFEKIHTYLQKNKPNNAFYASKISAVSALLKEYYIRVDLPKEYQHLPPAPGPISFVVNPISGKQPRHRFTIILDPISQKSQLLVSLCDYIVHSPIDASCTVYLNPSQHSGKPMRNFYQFVGDVNVNFDNTGRVIPPAAIFRRLPSKHLLTLGVVEPEGWTVFPMKAQYDLDNIILSSLPQASQYLYAIYRINSILITGSAKESGGSTPPRGLPLLIRSLRNNTNTNRNSVNSANSNSGSLTRDTLVMANLGYFQLQSTPGVWYLTVQPGAFAKSFYISKVKGVRTNYVEKIEYNGVFNFSKGQSIPIVVSSFTGEFIKLEVAKVPGEGNVQIGDLVEASAIHMEWPPRGPQKTRPVRPTLNIFSVASGHLYERFLRMMIHSVMKTSSDVHGANTTRIKFWLIENFLSPQFKELVPLLAEHYGFDVGFVTYRWPWWLNKQTEKQRTIWAYKILFLDVLFPLEVERIIFVDADQTVQADLHELYNMNIGNAPTAYTPFCRKHPNEATKNFRFWDQGFWLRHLNGKPYHISAIYLVDVRRLRAIAGGDKYRLMYSQLSRDPNSLANLDQDLPNFMQEEVPIYSLPEEWLWCETWCGAESKAQAKTIDLCNNPLTKIPKLENAKLIIKGWEEMDAELETLSEKLRQEHHAKQQRK

SEQ ID NO: 4462 - protein, 1524 aa, Thamnocephalis sphaerospora
MRKHCPPFAALVALLLGAAELASAGTPPVRAGLRTPWAAPNILLEVGEYIAAENASAYFPYIGAVTKSLPEARTPAALHQHAFSIIKDNGFLAGDLALPLLNMSLALHTGAPAVEADYQYYRVEVAPHAEARDACDVWADWQGQRACSPDELVKLANLHKGATPRLHEHDRTLGPKGEEKGTVVLYGDIASPQLPAFHQFLIKLSESAGVRYVLRWKPSDADDATQASTEKLWLAGYGVELALKSTEYMVLDDRNKKDGDADKNAESGDEAADAAEDDDSDGNEKLVDDDVDAELGMNAAQMIVAARNPLAALRKLSGNFPKYAPHLAGRKPSKELQDEIGRLQALSTKPGVTGLWVNGVPLNLQFTGVFQLLRLLRSEYAGVTALQQLGLSANQAVELLYHAHRLNEKSRKMAWFGEAYDVRDHVEGGRAVVFMNDIEKDARYRSWPRDLFEILRPTRPGQLIRLAKNAVTVQIMLDLSSVQSLIAISKDVLDIIQANVPMRFAVVPIVGDDEDANGTKMAKLFYYFSQQYGRKGFIQFFDKERADKKKKKAKKAEEGENTDADDAAATPVKLSLEEVLQADSEATALTAAARAMCRRLRLRAGKDEAMYVNGKYYKFSPVDYRRHLADIYNSIIQYLQQRLFDGGVEEKTDIYEHFLTLPEVRTRMNPHVYEETPRSINWLDTKTISPAALRDILYINGGESSCLDADQHHHARTLTLPILPQATTSQLRIAALHNPGQKTVQPLVPASFFYQLARKPLSKEHLQAAIAELDRVIAGKVLLDEGDDESAAAVAAHNAAAATIVAAVGAQSADRYIVINSRIVGPVPTEDRFESDDFELLIGYERENRITRPHQYLSALSVRPEYSDTLLYASSILGRLAQSSFVGDAFDKPGVIQRENTMDRIGARHALFTVGTPFKSTIRVQAILDPLSEMTQKWASILEVLGGISGVSVQVYLNPNTLMQELPLKRFYQFLMPSRLEYDEQTGATLATRATFTDLPEDMLLTMGLDTISAWLAMPTVSEHDLDNLKLDSSSRFSSVDAVFELEHLLVEGHVRDLTPDNPRGLQLNFGTTANPAQEDTSVMANVGYFQLKANPGVFHLTIREGRSSEFYRLQGIDRVMWNNEDEAEGSAASDEQEETKVDTRITINSFEGVVLFPTVRKRPGYETRELLGEDGEQDHTLLGSIKDKMTGWMGGKKADGVAPGKAEINIFSVASGHLYERFLSVMITSVMRHTKSTVKFWFIENFLSPSFKDFLPHLAKELNFDFELITYQWPHWLRKQSEKQRKIWGYKILFLDVLFPLDLEKVVFVDADQIVRADLKELVDLDLQGAPYGYTPFCADREEMDGFRFWREGYWKTHLRGKPYHISALYVVDLVRFRAMAAGDMLRGQYQALSADPNSLANLDQDLPNNMQDDVPIFSLPQEWLWCETWCSDASLKQAKTIDLCNNPLTKEPKLDRARRQIPEWSEYDAEVAALAARVAAAKEQQSTEQPTEAETPTSSNSDEEYEADADVDAEEDAEHDEL

SEQ ID NO: 4463 - protein, 1620 aa, Sus scrofa
MGQKPSSVSRLCVLSVQEGRGITGASRTFRIPAPPAPTWLGVRPGGSWAGSERSAHAPGTRQGPARVTDSGSPHRKWEAARREEPAVAWRLRAGLWASGPRGLRFSLRAMAEAADAVRLLLSSTALWLLLLGAGTASASKAVTAHLTAKWPETPLLLEASEFMAEESNEKFWQFLETVQELAIYKKTESDYSYYNLILKKAGQFLDNLHINLLKFAFSIRAYSPTVQMFQQIAADEPPPDGCDAFVVIHKKHTCKINQIKKLLKKATSRPRPYLFKGDHKFPTNRENLPVIILYAEMGTRAFRQFHTVLSEKAQNGEILYVLRHYIQKPASQKMYLSGYGVELAIKSTEYKALDDTQVKTVTNTSVEDKTETNEVQGFLFGKLKERYSDLRDNLTTFQKYLIESNKEMMPLKVWELQDLSFQAASQIKSTPVYDAIKLMKDISQNFPVKARSLTRIAVNQHMREEIQENQKYLLDEFEIQPGDAYLYINGLHIDIDSYDPFSLLDMLKLEGKLMNGLHSLGINGEDMSTFLKLSSRGWEDTYALDIRHSSIMWINDLENDDLYASWPASCQELLKPVFPGSIPLIRRNFHNLVLFIDPAQEYTLDFIKLAELFYYHKIPLRIGFVFIVNTDDEVDGTNDAGVALWRAFNYIAEEHGVSQAFISIVHMYEKVKNKNILTVDNVKSVLQDKFPHANIWDILGVYSKYDDERKAGANFYKMTGLGPLPQALYNGESFDGEELNVNELEVAVLHRIMNVTKYLQKEVFMGTLNDETNAIDFLMDKDNVVPRINPLILQSKWQYLNLISTSVTADVEDFSTFLFLDSQDKSAVIAENMYYLTHEDGDVISLVTFWIIADFDKPSGRKVLFNALEHMETSVYSRLGIIYNPTSKIDEESTAISRGILAAFLTQRNNFLRNFLMKLTEEETATAIYSGAKIKTFLTEGMDKNAFEKKYNTIGVNIFRTHQLFCQEVLKLNPGEIGVVSNGKFLGPLDDNFYAEDFYLLEKITATNLIDAIEDIVETTEIDSEDLSDLIMKIDALVSSLPNHASRYDVTFLKENHSIIKINSQEEDMVFDVIAIVDPLTREAQKMAQLLIVLGKIINMKIKLFMNCRGKLSEAPLKSFYRFVLEPELTLTANDVAGPVAKFLDIPESPLLTLNMITPEGWLVETVHSNCDLDNIHLKDIERTVIAEYELEYLLLEGHCFDITTEQPPRGLQFTLGTKNKPVMVDTIVMANLGYFQLKANPGAWVLKLRQGKSEDIYQIVGHKGTDSQQERGDVVVVLNSFKSKILQVQVQKNPDRIKEDILSDKDGTKKGMWDSIKSFTKSLRKKDEKETDILNIFSVASGHLYERFLRIMMLSVLRNTKTPVKFWFLKNYLSPKFKEVIPHMAEEYGFQYELVQYRWPRWLHQQTEKQRIIWGYKILFLDVLFPLAVDKIIFVDADQIVRHDLKELRDFDLGGAPYGYTPFCDSRREMDGYRFWKTGYWASHLLRRKYHISALYVVDLKKFRKIAAGDRLRGQYQTLSQDPNSLSNLDQDLPNNMIYQVAIKSLPQDWLWCETWCDDESKQRAKTIDLCNNPKTKEPKLKAAARIVPEWVEYDTEIRRLLDHLENKKKNAILTHDEL

SEQ ID NO: 4464 - protein, 1538 aa, Rhizoclosmatium globosum
MQLSGLLQGLVIVGSTATTVLGAPTITVHLNATFGAPSFVVEAVETASLLTPVFPLLTLLTSNHNNNFNTNTTTHSPNVLASIQSIPPFSNDPISAKLLSLSLAAHVAAPRINAHFNFYNNVVNQNYPENNEVASKRDCASWVAFNSKKYCKLDLDALEQTVYSETSFSETEDDEPLSLDHVYSFSDSAPRAILYADLTSTDFKLFHLTLSKWADAGHIQYVLRYKPSSFSEKEASKTGTLDPLFLSGYGVELAIKSSEYKVIDDRATSQKVHDDATVPKEDAILNEQSDEEASLFDFGADQEASMQSLSAEDIKEIGVKAASIILAAESPIEALIQISQDFPKLSHLIAKRQVTSSMRQEIRKNQRTIVAAGTNAVLLNGVQLNLKELNVFSLLSAMRNELALIQSLKTLSLSSTQAIQILTLPPSANSKSSSDLGWGDAFDVRDPSVVWWNDLEKDARYKKLPNSFTELLQPSYPGQLKYIARNIFHVLFVFDLTNIEHLMIQLDVFKYIEHSVPLRFGVLPLIGDGKENSGALLAARAFLHIIKAHGRKEAKEFIVQLHGLIKTNLNHQDPVDSAKLVGIAFEKVVSKGFLELMQKHEDAEVLVSYKKLLNRLGLLGDVGAVFMNGKYIDLDEGWQQNMLAPYPKMLQFLQLKVYEGKVSEKDNLYDVFMTQPNVHQRRNPYIYASEEHPLKFVDFLAPNVDQTVLRDMPYLSERDAPIMSIQVIADFESASGLQLAVSALEFASNSPNSRIAFLHNPSTNKITTLQTRTPLHKAVHLLVKQGKAQGAASLLVDAIKALGKGDFDFAGEGKLFDQSVVDSMDGNGKFEVWAAKAKIFVKKVVGFEAGESGVVVNGRVVGPFESPARFTEEDFELLAVNEYRDRVERIDDALNGMELSGVEDRESWTPDALMKISSTISASQSGSKLDSGDAASKNRAVTDWGENLYSLTVGDVAEASLRFTVVLDPLSETAQKISSMLKVLSKIPGVSIKLLLNPVPMLEDLPIKRFYRYVFQEEVHYDSQGKRVAAQAQFKNIPTEPLLTLGLDVPRAWVVRAVDSVHDLDNLKLDALKPGQNVDAIFQLNNILVEGHARELHSSTPPRGAQFILGTPSKPHIVDTITMTNLGYLQLKANPGVWQLRLREGRSNQVYQIDSVPDKYMGKGGESKGDGYATVVVDSFEGVTIYPVVKKRVGMEAEDVLEPVDNVPVTSPSSAAKTKKDPVGAVWDQLKSRVWGDSKKGVQTTASNVTINIFSVASGHLYERFMGIMMLSVMRNTKSPVKFWLIENFLSPKFMSFVPHLAKEYGFEYEFITYNWPHWLRATTRKERTIWAYKILFLDVLFPVGLDKVIFVDADQVVRTDMKELVELDLEGAVYGYTPMGDSRPEMEGFRFWKTGYWANHLQGRPYHISALYVIDLKRFRQLLAGDRLRQQYQMLSSDPNSLANLDQDLPNNMIHEIPIFSLPKDWLWCETWCADNELRTAKTIDLCNNPLTKEPKLKRAKRIIKEWTELDNEVQAVADRVEAEAAKTIGQKRHDEL

SEQ ID NO: 4465 - protein, 1347 aa, Tetrapisispora blattae
MLFSISFLLVFWLKITVLAAAAQTPESFKIWSILCYLIGDTDPKLLTSLFPIVTQLEESSLNENNGDLNLVDYISYVLEMDFDRAELSSLLPIFAKYYPLGLSISQHNISSKTYFELNGQKYNNPDDVFYLKSSDLKKQKQLDDLDDAFYKYPIIGEKLEAPIVKLYGCPIDNSNFEDFNRNLYSEASTTGKFRYIWIPTCIPEGNFSPDTFFMSATPIKVTDKKFSRLEWNNEEINIPDDLKEASYTVFNPTPEDLKDLDIKVASLITDRFQKRKNIKDIIMYTKELVNNFILLGERLLKLNINEKILAANEEWKSLGVDYNLLGLYINGQNIKLTSLNEYTLLNGIVAEYKRMIFLKNSLLNYGKNLKDDLVKKLLNNFSQLSLSNIQESQPIKIDLHKIPGFSESIIYFNDIEIDAQYNELSSDIGVFFDKTKYGEIPELRQNWNEVVFAINFNRLEDDITKEALLGMLRAIEVTLQGYPQRIGLLPICDDEKILSKIYKLKNRNLENLTKFLEGLLEGKKPKSLTTDIDIPNVKAITEDLQIRDNYIIVNGEIYPFLANTWRYLITRVTKKDIDAIRRGLKKYHNMNDKNINVRGILHLASTDTRHFKYTPDYFVDADYTPINNFALSSITDRVLEYINNDNYNTLHTISLVGDIDEEDFIRNINNALSIGFDGVRIRIIHTGSISSRNWKLLKSSKKSDLVNILTDLKGATNKSKTKDELQRNIFKDWLLEINADRLLSSSFITLNGRFIHLNKNEIISSIQFKSLVMREARRTLDCIKALDTIIPDYSEQRVDADFIESITSILSKLFYQGTDYFHNGIEFTAETQLSRVDFSGLLSKKIITNLNDKSKSDELIDLLLVLDPLEERTQKILSLVNEISSLPFVNIQLLILPTKELTINPINRFYGNNMKSIVNEKQSFFDIEYDIPSMVILNEENNKFEGLEIIVHTFNFEEPIISSNVDGLSGICLELVDSDGNVESQTTTMSTFGYGRFEVHNLLNNYTIRSCDPRYEVDSFSMDCRSDYIPQTHISIASFSPKKVFVKLKETGEEVISNGNTNNNYLNIYTVLKTEEDEELYKEMVIKLMSSLKEDQRLRFWVIKDKFSNNMETFRKTLDVIDKDHSQIELNFIKFNWPYWLRPQRFKNRRLDVSKMIFNDILFKPDVNHVVYMDPQQEPFDPFQLYESEKMKKGPFVITRMRGKGYWNEGYWDKMLKEKKLRFHNIHPGFLINLNTLRETHGSDKLRVHYQRLSGDVVSLNNIDQDLINDIQSEVGISPLRRTLLAPMALDDTKYSHLKSKFESSAKSLNIQETTLETLNPYPDDLLDDDLEDNGSEDNGFFEQDEL

SEQ ID NO: 4466 - protein, 1447 aa, Cricetulus griseus
MGNLRPKVSHLDAEGGIGSVVPGFCYNMGLLIVLASLCLFSLVEANSKAITTSLTTKWFSAPLLLEASEFLAEDSQEKFWSFVEASQNIGSSDHHDSEHSYYNAILEAAFQFLSPLQQNLLKFCLSLRSYSASIQAFQQIAVDEPPPEGCKSFFSVHGQQTCDFDSLETLVLTAPDRPKPLLFKGDHRYPSSNPESPVVIFYSEIGHEEFSNIHYQLKSKSKEGKINYVFRHYISNPRKEPVYLSGYGVELAIKSTEYKAKDDTQVKGTDVNTTVIGENDPIDEVQGFLFGKLRELYPNLEGQLKEFRKHLVESTNEMAPLKVWQLQDLSFQTAARILAAPVELALVVMKDISQNFPTKARAITKTAVSSQLRTEVEENQKYFKGTIGLQPGDSALFINGLHIDLDTQDIFSLFDTLRNEARVMEGLHRLGIEGLSLHNILKLNIQPSETDYAVDIRSPAISWVNNLEVDSRYNSWPSSLQELLRPTFPGVIRQIRKNLHNMVFIVDPVHETTAELISIAEMFLSNHIPLRIGFIFVVNDSEDVDGLQDAGVAVLRAYNYVVQEVDGYHAFQTLTHIYNKVRTGEKVKVEHVVSILEKKYPYVEVNSILGIDSAYDQNRKDARGYYEQTGVGPLPVVLFNGMPFEKEQLDPDELETITMHKILETTSFFQRAVYLGELPHDQDVVEYIMNQPNVVPRINSRILTAKREYLDLTASTDGHLGVLHNSDLKSYGEPMRSLFQTFNGISPNTWKYDNFFVDDFARFSSLDSRGKTAAIANSMNYLTKKGMSSKEIYVRGNGCHLKLYQDLKLQNKVIENNCQGMDVSLFKEAFESSKMDSILSHALYCRDVLKLKKGQRVVISNGRIIGPLEESELFNQDDFHLLENIILKTSGQKIKSHIQQLQVEEDVASDLVMKVDSLLSAQPKGEARIDYQFFEDKHSAIKLKPNEGDTYYDVVAVVDPVTREAQRLAPLLLVLTQLINMNLRVFMNCQSKLSDMPLKSFYRYVLEPEISFTADNSFAKGPIAKFLDMPQSPLFTLNLNTPESWMVESVRTPYDLDNIYLEEVDNVVTAEYELEYLLLEGHCYDITTGQPPRGLQFTLGTSANPTIVDTIVMANLGYFQLKANPGAWILRLRKGRSDDIYRIYRNCRTNTAVVWVFTAFGDCDLYSVLLFSLSHDGTDSPPDANEVVVILNNFKSKIIKVKEFIPYMASKYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQILFQKEKEQERTQRPQKHEEL

SEQ ID NO: 4467 - protein, 1494 aa, Glomus cerebriforme
MLIILFLISRESVSVENSTAYYPLIDEFISQELFSSELTDQEVYNEALGVIKSKQYLSTPTSVSILEFSLSLHTTAPAIQAYYHYYNATVVPSKQEFDDNFNPECDVWVDWYGHQACNVEDFEKLSGFGNSGQHPKLLPFDHILSSNAETSTPLVILYADVISPSFVTFHQFITELVDNGEAEYVLRYKPPKKSQDTLYLAGYGVELALKKTDYIVIDDRKVETGRILISNSESYNDSRSEKLSDHLFEEDISDIKPLTTRAIKELGVKAAQFITASQSPLSTLAHLSQNLPKYSYHIAQLNLNSSLQQEIRINQNYVGLKSNSFWLNGLIVDPSSIDPFSLLKMLRRERQNVLSLMSLGMNSQQAIDLLASPIISELKSSQDLIKGIFDVRDKSDKKNILIWLNDLEKDERYSSWPTRIFDILRPVYPGQMRYIRKNLFNVLFVIDLSSTENLNIITEIKLFIERNVPIRFGLIPLVDKEKNESLIMAKLFYYLVGQYPKSLTMQFFSQNKSVNKVKIAEKQFNKVISDQTPKDKTSVRSFYEIIKSDGESLLEEQIFGATEFINKFRINTDGKGAIFVNGKYFDMDDNYQRDMVQTINEHTAFIQQKIYVGEISDHTDVSEYFMTLPNIPSRRNPYVFISDLQILNVINLADEKNGNSEKLNNLRYIYSMKQDDNEVPISLLLVTNFDSEYGAKQGLEALKYLDESPNVRLAFIHNPSTQTSAHKIKMPFVEQIGESQEISISDSEKINSARSFGWQSVDKVKSQTYWRGWNSFTRKTLKLNENDTAIIVNGRVVGPFINEDLFVLEDFKLLIDIEVSERIDPVINATKAVNLTMYLSNYSDFVTKATSIIAASMISDVPVGLFDGQELKRDLSFKKLKSKHSKVVIGDIEAALYKISVVIDPLSETAQKWSTILEILSQVDGVAIELYLNPRMGLNEIPIKRFYRYVLEPRLNFNSTTGNLIAPSAYFSNLPEDPLLTLGMDVIQAWLVTPKVSIHDLDNIRLANLDSRSRIKGVESVFELKNILIEGHARDMTLNAPPSGLQIILGTKNYPSMVDTIVMANLGYLQLKANPGIWIFSLREGKSTEIFDIQSVGSEGWYSRNVETIGNEIVLNNFEGLIIYPRFTRKPGKENEDVLKFEGKDGIWDYIFNGILTVSFRRFSNKDVSKQNKAEINIFSVASGHLYERFLSIMILSVLRHTKSSVKFWFIENFLSPSFKDFIPYMAKEYNFEYELVTYKWPHWLRAQKEKQRTIWGYKILFLDVLFPLDLDKVIFVDADQIVRADLKELVDMDLQGAPYGYTPFCDNRPEMDGFRFWKHGYWKDHLRGKPYHISALYVIDLQRFRHMAAGDQIRGQYQSLSADPNSLANLDQDLPNNMQHIVPIFSLPLEWLWCETWCSDESLVGAKTIDLCNNPLTKEPKLDRARRQVPEWESYDKEVATLAARIFQSLKTLITESNSQSGSAIEESSESQIPAETTTTMPDKSSTLVHEEL

SEQ ID NO: 4468 - protein, 1487 aa, Microdochium bolleyi
MKASFPTPPYLLELLETAAGEDANAYFPLLDEIAAGAFVGAETDKALYERFLEVLAKKNLVRGPEGLSTFKLALALRASAPRIEAHYQYYTTTVAPSVLEGGLDCDNWILFSGHAHCSSSLDRAGPGVKDDSQLHQLPFDRELGVGPQAILYADPSHVEFPELHRQLVAKARNGEVTYRLRYRSYTRASALPLPVSGYGVELQLKRTDYIVIDDREANAADTAGKEETVAPVVLDEEEEVSDLKPLSSSDLASLGHKASSFVLKSESPLNTLVKLTQDFPKFSSSIASQNVSDEFFNEHQDNRGVLVPAGMNVLWMNGLQMTDRQIDPFTLVESIRRERRFIQGVTDIGLTGQQAVALLGHHEVAAVSSAEESERFDWTDRSEDGRVIIWLNNLEKDSRYADFPSNIMALLQRSYGGQISPIRKDVFNLVVPVDFSSPDDVHLVADQLMGFIKRTLPVRFGLVPLTPTRDATDQAKVAYYLLENYGLAAFMTYLQTSVAGAKMSKSKSADDFAKVIEGRQLRDDESVTLSLDEVLDSESYNSQVELARQWVRRLGADSKVPPVFFNGFALPRDQAWLQTMSRRLGTDMQMVQQGIFMGTINDDMWVPSIFLENAASRRNPYVLVGSDNPLVVLNINKLCAEHKDMFQQLTVIEADEEAGKDDLAALTVVADVETVEGKNLLLSALAFRRNNAGVRLEIVPNPSRLITSDSIIKALKGQSQELLEATTIEQLTTVLDRPVIAMYNGFDKLLEPFLKAINMEPGMQGVLLNGRVVGPFAQDAPFGEDDFQQLLDYERISRIAPVYRAAESLGLLDKISNPIAAAKLTSITALSTISDVPEGIFESAPTVRTSTYNSFKSDHTMFEVGNADTATIQFVATLNPVSEQCQKWASILKVLAELDGVHLRVFLNPLDRLNELPIKRFYRQVFESAPSFTEDGKVAPILARFAGLPSEALLNLGTNVPPAWLVSAKETVHDPDNLKLANIKGDVDIIYELEHILIQGHSRDNNNSPPRGAQLVLGTKQDAHSADTLIMANIGYFQFKANPGYYNIELKDGRSSEIFEIESVGTQGHAAVPGDEGTDMALMSFEGATLYPRLKIKPGKEGEDVLDEGGSAGGDDLLSRGLKFAEGLLGKSKTKSIDKVKHADINIFSVASGHLYERMLNIMMVSVMKNTKHTVKFWFIEQFLSPSFKEFIPHLAAEYGFQYEMVTYKWPHWLRQQKEKQREIWGYKILFLDVLFPLSLDKVIFVDADQVVRTDMIDLVRHDLQGAPYGFTPMCDSRTEMEGFRFWKQGYWANYLRGLPYHISALYVVDLKRFRELAAGDRLRQTYHSLSADPGSLANLDQDLPNHMQFNIPIHSLPQEWLWCETWCSDDSLKEARTIDLCNNPQTKEPKLDRARRQVPEWTVYDDEIAAVDRKRKGLPPVSQSSPATGGQPDKKDAQEPVRVIPGAGDHSQKVLRGDDTTASNAGKNTKSRTLQEEPTSSVKDEL

SEQ ID NO: 4469 - protein, 1090 aa, Notothenia coriiceps
MRNVIVLSLLLLLNIHHVTSAPKGVTASLRAKWSMTPFLLETSEFIAEDGNEKFWQFVDTVKELTVYKQGESVRSYYNLIIKKAGQFLTDLQVNLLKFAMSLRSYSPAVHASQQIASDEPPPEACPAFVSIHGQHSCSTKDIKKLLKAAAGRPKPHLYKNDHTYPGVNTTEVPVVILYAEIGTKKFTLFHKVLSERAAEGTLVYVLRHFVANPKPQKMLLSGYAVELAIKSTEYKAVDDTKVKDSLVNAEDDNTDEVQGFVFGTLKKAHPELQENLVELRKHLLESTNDMVPLKVWEMQDLSVQAAARILSVPKYDALKLMRDLSQNFPSKARSLTRVAVKQEMRKEIEENQKRLAETVGVHPGDGELFINGLHIDLDVHNPFSILDILRGEARVLEGLHNLGIKGEHQGKLLRLPVNAVDDSYALDIRDPAIMWINDIENDPPYHSWPRGVQELLRATFPGVIRQIRRNFFNLVLFLDPVREESVELVKLAELFYKHKIPLRIGFVFVVNTEDEIDGASDAGVGFYRLLNYIADEYDLSQALISMVSLYNKVDVGETLSVDTISDYLKRKFPKTDAERILSVESEYDDKRKEGAFFYKRSGLGALPLALFNGVPLSPEEMDPEELETIILQRIMDTTNAFQRAVFMGQLTEGSDVVDYLMEQANVVPRMNPLILSTERKYLDFTAKPVVDEWEDTTMFSYYDSRDKTAVVAKRMKYFTNNDEDGMSAVTMWIVGDFEEISGRKLLLNALKHMQKASPGVRVGVIDNPSGKPSEDNSVLYRAIWASLLTQKNKAAAEFVQQLVKDESSQLLQQGTKIKDLLTQGMDVDAFEKKFNTLEVDFIRSQQLFCRDVLKLSPGQGAVISNGRILHPSPPTCLSPLCSEQNSLHSSKPSAATLSAALYVTIVMGFIATGMKWRVIICFMKSFLRALPSGNGFLTPAFYVSPSYIPTSALYVVDLKKFRKIAAGDRLRGQYQALSQDPNSLSNLDQDLPNNMIHQVAIKSLPQEWLWCETWCDETSKVSAKTIDLCNNPRTKEPKLTAAARIVPEWVEYDNEIKQLLRRVQGQEDTPAPKHTPTASQHEKDNQRDEL

SEQ ID NO: 4470 - protein, 1717 aa, Citrus unshiu
MEYRFRSGFCVLIILVCVSLCGFASVCAQIQKPKNVQVAVRAKWSGTPLLLEAGELLASERKDLFWEFIEKWLHSEENDTDSRTAKDCLKRIVRHGSSLLSESLASLFEFSLTLRSASPRLVLYRQLAEESLSSFPPFDDSNLKNEVGGASEANEKLETKKSDLLLVGVNPKSPGGKCCWVDTGGALFLEVSELLMWLRSPSELTGESFQQPELFDFDHIHAESSISSRTAILYGALGSDCFKEFHINLVQAAKEGKVMYVVRPVLPSGCEANVGNCGAVGAKDSLNLGGYGVELALKNMEYKAIDDSMIKEGVTLEDPRTEDLSQEVRGFVFSKLLAKLQCGDCYGERKPDLTSEIMSFRDYLLSSTTSETLEVWELKDLGHQTAQRIVHASDPLQSMQEISQNFPSVVSSLSRMKLNDSIKDEIVANQRYMPPGKSLMALNGALINIEDIDLYLLIDLVHQELSLADQFSKLKVMHADSVSQSDLVGFNINGTSFLYFLRIISRHHLRCILAEVASFYGHLVYVMTAAIPRTITQKLLSTVPPAESSMFRVDFRSTHVQYLNNLEEDAMYKRWRSNINEILMPVFPGQLRYIRKNLFHAVYVLDPATVCGLEACFISVVIDMIMSLYENHFPLRFGVILYSSKFIKSIEINGGELHSPVAEDDSPVNEDISSLIIRLFLFIKESHGTQTAFQFLSNVNRLRMESADSADDDALEIHHVEGAFVETILPKAKTPPQDMLLKLEKEKTFMDQSQESSMFVFKLGLTKLKCCLLMNGLVSESSEEALLNAMNDELQRIQEQVYYGNINSYTDVLEKVLSESGINRYNPQIITDAKVKPKFISLASSFLGRETELKDINYLHSPETVDDVKPVTHLLAVDVTSKKGMKLLHEGIRFLIGGSKGARLGVLFSASREADLPSIIFVKAFEITASTYSHKKKVLEFLDQLCSFYERTYLLASSATADSTQAFIDKVCEFAEANGLSSKVYRASLPEYSKGKVRKQLNKEVQFLHRQLGVESGANAVITNGRVTFPIDESTFLSHDLSLLESVEFKHRIKHIWEIIEEVNWQETYPDIDPDMLTSKFVSDIILFVTSSMAMRDRSSESARFEILSAEYSAVVFNSENSTIHIDAVIDPLSPTGQKLSSLLRVLQRYAQPSMRIVLNPMSSLVDIPLKNYYRYVVPTMDDFSNTDYSISGPKAFFANMPLSKTLTMNLDVPEPWLVEPVIAVHDLDNILLEKLGDTRTLQAVFELEALVLTGHCSEKDHEPPRGLQLILGTKSTPHLVDTLVMANLGYWQMKVSPGVWYLQLAPGRSSELYVLKEDGNANEDRSLSKRITINDLRGKVVHMEVVKKKGKENEKLLVSSDEDSHSQAEGHWNSNFLKWASGFIGGSEQSKKEKAAVDHGKVERHGKTINIFSIASGHLYERFLKIMILSVLKNTCRPVKFWFIKNYLSPQFKDVIPHMAQEYGFEYELITYKWPTWLHKQKEKQRIIWAYKILFLDVIFPLSLEKVIFVDADQVVRADMGELYDMDIKGRPLAYTPFCDNNKDMDGYRFWRQGFWKDHLRGRPYHISALYVVDLKRFRETAAGDNLRVFYETLSKDPNSLANLDQDLPNYAQHTVPIFSLPQEWLWCESWCGNATKSKAKTIDLCNNPMTKEPKLQGARRIVSEWPDLDSEARQFTAKILGEEVVTLETPAPVGPMQTSGSDASSKGDLESKAEL

SEQ ID NO: 4471 - protein, 1543 aa, Betta splendens
MDAGSYGAGFASSPPGIRLRMWLLGVVLLSLLWVVSGGADSKAVTTTLSTKWADTPLLLEASEFLAEENQEKFWNFVEANANIEGQHDDTDQAYYDLIVKRASALLSSVQVNMLKFALSLRAYSATVHSFQQIASNEPPPSGCKAFFSVHGEKTCNADGLAALLKTAPGRPKPYLFKGDHKYPGANSNAPVVILYAEFGTPDFQRLHQIITSIAYEGQATYMLRHYLANPSKRKVYLSGYGVELAIKNQEYKAKDDTQVQGAEVNATVIGENDSVDEVQGFLFGKLKALYPELKEQLKELRKHLVESTNEMAPLKVWQMQDLSFQTAARILAAPAVDALNVMKDLSQNFPTKARSITKTVVNSEIRKQIGENQKLFKGTLGLQPGDSALFINGLHIDLDTQDIFSVFEVLRSEARVMEGLQSLMIEPHYIHDILKLNVQPSDSDYAVDIRHPSISWINNLETDHRYSSWPYNVQELLRPTFPGVIRQIRKNFHNLVIILDPAQENAAELLSVAEMFYANNIPLRIGFVFVVSDGDDIDGMQDPGVALVRAYNYIKDEVDGQSAFDAVISMFNQVPVGGSLTVANVVKVLEKKFPYVEISSVLGADSSYDGNRKEGRAYYEQTGVGPLPVVMYNGVPYQREQLDPDELETVTMQKILETTSFYQRAVYLGELATDHDVVDFIMNQPNVVPRINARVLSTSRTYLDLSDTNNFFVDDYARFSSLDSTQKSTAVANSMNYMTKKGMTATNRHDDGFIRPVTFWVVGDFDKPSGRQLLYDSIRHMKTSNNVRLGMISNPSAAPSAESSRVTRAIWAAMQTQTANNAKNFITKMAKEEAAAALERGVDIAEFAVGGMDVSLFKSAYESPKLDFLLSHAAYCRDVLKLKKGQIAVISNGRIIGPLEEGEVFNQDDFLLLESIILKTSGERIKSKVQQFGTEEDRASDLVMKVDALLSAQPKAEARIEYGFADDRYSAVKIRPKEGDMYFDIVAVVDPVTRDAQKLAPLLSVLKQLINVNLRVFMNCQSKLSEMPLKSFYRYVLEPEVAFQADGSFSPGPLAKFLDMPQSPLFTLNLNTPESWMVESVHTRYDLDNIYLQEVENIVAAEYELEHLLLEGHCFDVSSGQPPRGLQFTLGTASEPIMVDTIVMANLGYFQLKANPGAWVLKLRKGRSDEIYKIYSHDGTDSSADSDDVIVVLNNFKGRIIKVKVQKKPDKIGEELLSDGTEENDTGFWKSLTRGFTGGANTEEPKQEKDDVINIFSLASGHLYERFLRIMMLSVLKNTKTPVKFWFLKNYLSPTFKEFIPHMAKEYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDSTKRSAKTIDLCNNPMTKEPKLQAAVRIVAEWTDYDQEIKRLQTRVQAGANHRAQQQGTDVHSEL

SEQ ID NO: 4472 - protein, 1554 aa, Lentinus tigrinus
MLRALVPLLAWPLLHTAAGKPPVNVELRTSWPSTPILLESLESVAIEEPGAFFPLLDAVTNPETFKDHPSPQDAHQHVFDTALALDYLAEPGAYVAAEMHVALHSASPKLEAFYQYYNDHHAARREDSEGCGSWVDWYGEVVCDAKALSRFVETESLDAPETAIDNTTSFAHASPKLLPFDHVLPDPSRLLELPPRVAVLYAQVNSANFRDLHSYLYAAVHSPTPRLTYVFRPIPPTNRDPAVRTYLSGYGVALDLKKTDYLAVDDRLQGGAGTTDDTAAAAQADEPDPIVTLLQQYPMDESVDVTVPLTEQELKEIDLQAAQLIYDAEDKLAALKHLAQNFPRYAGALARRVSVEQELVDELAANQPRARGGVNVAWLNGVTLDEKDINPFSLLRLIRKERNIMLSLMSLGLSSEQAIELLTHMTIAKAQSESGALDGLFDASDRAEGGGVIGWLNDFETDERYSMWGGNLKIILRPMYPGQFPTLKLNLFNIVLAVDLSQLSSIDFIASTVQSLINRGMPFRWGVAPLVETENGARMARLYYYLLENFGSTETFAFLYNLAQRGTPLQALSPTVDWLLVRQAFDALMARKDDIAETVETDLDAILEGTEGDLEKQRAYAARLSTTLESAPQGHVFFNGKHFDLDDDFLRYLQTESAEHLQHLQFKVYKGELTEEDDVSTYFYDLPTTAKRRNMYIHPSPKAGSLRIFSLPDLIERNGLKSSAGSFVYPAESEQVPLTTYVVADFDNEESQQLVKEALLSTPGSLSRLSFIHNPASVSPFCKSDDFASPSRFLAQLVSWDLLSRLTPEQLLSALGLSSAEVSDDNGAQEPFSFDDIIGTKAFTGEDCMKYLTASRLVVRQLELKPGEQALVVNGRVVGPIQPGEFVAGDFETLAAYEHHKRVKSVYEALFDVYEPLKDANNREDAAEITAIASSIVSSIQLPDASEAGLFNAPQRPRLRNYQMLNSAYTAFSIGDNTTALYHFGVLVDPLSEAAQKWSSLFEWISEIPGVYVEFHINPTRYNELPLKRFYRYNLLPRLAFDDSGNEVCTKTTFTDLPVEPIYTLAMDTPQSWLIRPREALYDLDNIQLGMLSPQDRTRGIKAVFDLDYLVVEGHARESATNAPPRGLQLQLVTSNSTPIADTLVMANLGYLQFKTKPGVYRLEIRPGRGREIFKMESAGNEGWNSPSVEEGGDEVTVTSFEGVTLYPRLVRLPGMENVDVLQVQSDVHEETGFVENVMSKVSSLFGSKQKEEKALVPIDDGQAEINIFTVASGHLYERFASIMILSVLRHTKSTVKFWFIENFLSPSFLEFIPHFAAEYGFQYELITYKWPSWLRAQKEKQRIIWAYKILFLDVLFPMDLKKVIFVDADQIVRTDLKELVELDLHGAPYGYTPMGDDNPDTEGFRFWKTGYWKDFLRGRPYHISALYVVDLVRFRELAAGDMLRGHYQQLSADPNSLANLDQDLPNNLQREVPIFSLPEDWLWCETWCNKDRLHRAKTIDLCQNPLTKEPKLDRARQIPEWEVYDSEIAKFARRLREGEGSTDGGELPKRDEL

SEQ ID NO: 4473 - protein, 1302 aa, Allomyces macrogynus
MLAVVCAVFLIFTLQVASTAAADGGQAAQDDTTQESPAFRVTLAARWQSDPWLEYFEEVARHNTSALDRLLPSVSQINSIDAAHRHLETTGALARETAQLINLGIQFRETLPRVAALLDVYNSTVHAHADLQSCSIFVVIDDKWTCDLDEALAWLSSDHDHGQDTHFDPAIDTAPMGDASARQKAIVYGHPRHASFAPFWQRLRKLPVRVALRYVPDTSSIVPARQRLNGYFVHLNIKDLEYKVTDDRTPTGEEAATQDAPTRLESLDAAGLETIAARVAQNVTTLDALARITAAYPAALPGIAATTTAPSAQLRAKLDANREMAEARLGRAETMLWANGKLLPASSVTIYHLLETLRGEVELAHDMQRIGLPWALAVSVLQHNVNSEAADYFDTCTIEPVVWLNDLESDVQYKPWPKSLRNLLTATRGMKAIRRNIFTLLFFMDAANPKHVAMALEFVTMVENNIPLRFGLVPLVNADPVSKTSRLGVELWDIYVAKGRDAALQWLASTPALSSTHPDKAAHATLLAARHQLAVHDDGEMFFNGRPIDVGESYQHQVMAEYQQQVEQLAMMVYYGQLDDRTDMNKYWCTKPTTWKTRSEFAFAKRKPEHRWADFPASALPEDADLAAQDQYPFVHVTVRGYIRDAALEAIKAAQATARFALEVIADATTDQGIVINGKLIRHLPVEMTVDDVKTLVHVEWVRRLKQLKLSPTCVAMDPPTFWKASSLWWKNHVASKKNENGFRSGLGDRMNPFDIVSCDEDKCLMVPAATESTESDGADEVPVVQLVALLNPVSTDAQRLVPLLQEVHRALPYVSVTVVWLATPVTKVPDRFTQLVGAGHDAAVFRDLPPILFTLFLDAPHPWVVMAAKSEHDLDNLIVRKNRGGDAEFELKHLLVEGHAVEAPHQSPPRGIQFELRGSTGHVEDTIVMANLGYFQLKASPGQWNLTLRAGRSSNVYEPVQQSVLVDSFLGVTLYPTVHKRAGKEDMSVLDEDRPHQSWWQQVVQTVTGPRKETVHVFSVASGHLYERFLSIMMQSVVDRTQNPVKFWLIEDFLSPSFKATLPALAREFQFEYQLVTYKWPEWLTAQSVKQRTIWGFKILFLDVLFPLNVDKIIFVDADQVVRADLAELVNMDLEGAVYGYTPFCDSRAEMDGFRFWKHGYWLSHLRGKPYHISALYVVDLKRFRQVAAGDILRQQYQGLAQDPNSLANLDQDLPNSLQHMLPIHSLPQEWLWCETWCDDTSLTRAKTIDLCNNPLTKEPKLDRARRLLPEWEAFDERAEKVRHNVLLELAAESRPGHDEL

SEQ ID NO: 4474 - protein, 1521 aa, Austrofundulus limnaeus
  MOD_RES (925)..(925): Any amino acid
MWFLCALLLSLLSAVSGGADSKAITTTLTTKWADTPLLLEASEFLAEESQEKFWDFVEANQNIEGEHDDTDQAYYELIVKKASALLSSVQLNMLKLALSLRAYSATVYSFQQIASTEPPPPGCSAFLSIHGVKTCDVEGLGTLLKTAAERPKPYLFKGDHRYQGSNPDAPVVILYAELGKADFQRFHQVLTSRASEGSATYVLRHYLAKPSEKKVFLSGYGVELAIKNQEYKAKDDTQVQGEEVNATVIGENDPVDEVQGFLFGKLKTIYPELKEQLKELRKHLVESTNEMAPLKVWQMQDLSFQTAARILAAPTVDALNVMKDLSQNFPTKARSITKTVVNSEIRKEISENQKFFKGTLGLQPGESALFINGLHIDLDTQDVFSVLDVLRSEARVMEGLRSLLVETPYIHDILKLNVQPSDSDYAVDIRNSAICWINNLETDHKYSSWPYNVQELLRPTFPGVIRQIRKNFHNLVIMLDPTQENTAELLSVAEMFYDNSIPLRIGMVFVVSDEDDVDGMQDAGVALVRAYNYIRDEVDSHSAFEAVISMFNRVAIGGRLSVADVVKVLEKRFPYVEVSSVLGADSSYDTNRKEGRAYYEQTGVGSLPAVMYNGIPYQREQLDPDELETVTMQKILETTSFYQRAVYLGELATDHDVVDFIMNQPNVVPRLNPRVLSTSRTYLDLSSTHNHFIDDYARFSTLDTKEKSTAVANSMNYMTKKGMTTTNRHDDGYIRPVTFWVVGDFDKPSGRQLLYDAIRHMKTSNNVRLGMINNPSADPSAETSQVARAVWAAMQTQSANNAKNFITKMAKEETVAALKKGADVEQFAVGGMDLSLFKSAYEGPKFDFLLSHAAFCRDVLKLKKGQRAVISNGRIIGPLEEKEVFNQDDFLLLENIILKTSGERIKSKVQQFEMEEDRASDLVMXVDALLSSQPKGEARIEYGFADDRYSAVKIRPKEGDVYFDVVAVVDPVTREAQKLAPLLTVLKQLVNLNLRVFMNCQSKLSEMPLKSFYRYVLEPEVVFQADGSFSPGPMAKFLDMPQSPLFTLNLNTPESWMVESVRTRYDLDNIYLEEVENIVAAEYELEHLLLEGHCFDVGSGQPPRGLQFTLGTASEPVIVDTIVMANLGYFQLKATPGAWMLKLRKGRSDEIYRIYSHDGTDSPADSDDIIVVLNNFKSRIIKVKVQKKPDKLNEELLSDGTEENDSGFWNSLARGFTGGGKVEEPKQEKDDVINIFSVASGHLYERFLRIMMLSVLKNTKTPVKFWFLKNYLSPTFKEFIPHMAKEYGFQYELVQYKWPRWLHQQTEKQRIIWGYKILFLDVLFPLAVDKILFVDADQIVRTDLKELRDLDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKRSAKTIDLCNNPMTKEPKLQAAVRIVSEWTDYDQEIKRLQTRVQENQTTQEQTTDVHSEL

SEQ ID NO: 4475 - protein, 1492 aa, Pseudomassariella vexata
MIRLLKLPCGIAATLLAAVCLNADHVAAAPSVNVAMKASFPSPPYLLELLESAAVENSTSYFALLDRVAAGYFDEAKSDKDLYEKFLRLLQADGHMNSPEALSTFKLALSLRSAAPRIEAHYQYYETAVQPSLGSMEEECADWILLGGKRYCSASLDHTETTTQAKQQIQLLPFDRTTGSGPEAVLYADISKPGFGSLHTALADKAKKGELSYRLRYRIGENDEREPLPVSGYGVELQLKRTDYIVIDDREAHFNPDTENSSPFEVVLDAEEEVTDLKPLSSSELSGLGIKAASFIMQSEDPFQNLIKLTQDFPKYSASVAAHNESEAFLAEHLFNRGQMVPAGMNVLWMNGVQLIERQIEPFTLVDLLRRERKLIKGVTDLGFTGKEAVSLLGHREVTAAKSGDDEPRRFDWTDEIEEGEVIIWLNNIEKDKRYAQYPTSLMALMQRTYPGQIPPIRKDLFNLILPVDFTNPDDLYVVVEQLQSFIQRLLPVQFGLVPLTPTKEAEDQAKMVFYLLENYGLAALLSYLESCHTGKKIEKLDQSQFETAIKDRSLLAEATALPFQDVFESEHHTKQVQLAKHWVERLKADTPVPPVFLNGQSIPREKGWLQAMSMKLGGDLQTIQQGIFLGNIDEEMWIPGIFIDGAPSRRNIYIYPDKNNQLTVLDVNKVYTEHGDLFNVVPVIEANADSSKETWAALTVVADFTIKAGLDLLLSALDFRRNNPGVRVDLVNNPASGTGFNVNALLKNDVEKLLEIENLETLEVLVAGEIRDKYEPSSYDSALGRFLAAAGINPGDQVLLLNGRVVGPLAAGSGFKEDDFQQLLEFEQSTRILPVYNAVDALNLTRKVSDPLAAAKITSITALSTISDLPEGIFESAPTLRTVVFDDWESEHTMIEVGDASTANIHLVAVLNPASEQGQKWAPILKVLSELDGVYIRIFLNPKEKMDELPVKRFYRYVLESSPTFDEAGKVRHLGASFKGLPSEALLNLGMNVPPSWLVAAKDSVHDLDNLKLSTIKSDIEATYELENILIEGHSREGAGGAPRGVQLVLGTERDPHFADTLIMANLGYFQFKANPGYYNIQLKHGRSSDIYTIESVGAKGYGAVAGDEGTEVALMDFQGTTLYPRLNRKPGMEQEDVLQEASTAGDLLSRGLKFAEGFLGGSKLKSASAEEHAEINIFSVASGHLYERMLNIMMVSVMKNTQHTVKFWFIEQFLSPSFKEFIPLLAEEYGFKYEMVTYKWPHWLRQQKEKQREIWGYKILFLDVLFPLSLDKVIFVDADQIVRTDMIDLVNHNLEGAPYGFTPMCDSRTEMEGFRFWKQGYWSNYLRGLPYHISALYVVDLRRFRELAAGDRLRQQYHQLSADPASLSNLDQDLPNHMQFQIPIHSLPQEWLWCETWCSDESQKEARTIDLCNNPQTKEPKLDRARRQVPEWTVYDSEIAAVARQKKGVSDVVSEESQKVVSGDEAKNPMSRRLEQESASEPTERPKDEL

SEQ ID NO: 4476 - protein, 311 aa, Poeciliopsis prolifica
SAFYNNNFPWLYESMVATAEVLICCLHMKSHESYRRRLTYSGFICSITGGGSKKDEGEKKKEDVLNIFSVASGHLYERFLRIMMLSVLRHTNTPVKFWFLKNYLSPSFKETISHMAKSYGFQYELVQYKWPRWLHQQTEKQRIIWGYKILFLDVLFPLAVDKIIFVDADQIVQADLKELRDLDLQGAPYGYTPFCDSRREMEGYRFWKSGYWASHLGQRKYHISALYVVDLKKFRKIAAGDRLRGQYQALSQDPNSLSNLDQDLPNNMIHQVAIKSLPQEWLWCETWCDDASKATAKTIDLVSPGAVTFKV

SEQ ID NO: 4477 - protein, 841 aa, Pythium insidiosum
MHQDGTITSPKKQTLLFWLDLGDRVHAAHVYEAVKAVQEDMGSLMRVGVVHRLSTASGGDGIGELVAGVIATVGDSDNEKHIGLVIEALRCVVKGKTVEATKSKMRGLVEKIDAWDADEVLTSLMQVFDASADVAVLSDEARQSLQLLNEALRDSHGAKVGDTPAMLFLNGFRVDLPVHSISNEDISALTSFDLSHRSQPVAKAFIKRSGKYTRDEANARSMEIVKACAIIDEYRKATRYSGISQDGSLLAIKLPGDQSLRVTAYVDPLSEAAQRMSSLIEMLHSHLNASVELMLVPSVDYSEFPLQRFYRFLFDKKSPTATKVSFRKLPIKPILTMKIDTPEAWNVQIHRSTEDLDNLRVDPDSPSDVRAVKTASFRLENLLVYGQCRDKTFEMYSPPNGLQLVLERDVGSVRLHRDTLVMKNLGYFQLQATPGVWDLHLARGRAVELYEILDAETERVLSSRNVIVSDFGSHVEQLLVRKRQGMEHEELLAPSKAGTKSKSDVEPISEDAGLIGSYWNSMLSLFGKKKDKAQKDDAKAVATATGSDSERTGETIHVFSLATGHLYERFLKIMMSSVLKRTKNPVTFWLLENFLSPDFKDSIPALRQKFGMDIRLVTYKWPNWLRQQTQKQRIIWGYKILFLDVLFPLGVQKIIYVDADQVVRADLKELWEMDLKGSPYGYTPFCDSRNVGYQFWRQGYWKDHLRGRPYHISALYVVDLALFRQMAAGDILRAIYDQLSADPNSLANLDQDLPNYAQHQISIFSLPQEWLWCESWCSDESKANAKTIDLCNNPKHKEPKLDMAKRVISGELFQESWLELDQEIREAEQEYVRVATTTSTS

SEQ ID NO: 4478 - protein, 1203 aa, Cercocebus atys
MTPLKVWELQDLSFQAASQIMSTPVYDAIKLMKDISQNFPIKARSLTRIAVNQHMREEIQENQKDLRDRFKIQPGDARLFINGLHVDMNVYDPFSILDMLKLEGKIMNGLRNLGINGEDMSKFLKLNSHIWEYTYVLDIRHSSIMWINDLENDDLYITWPTSCQKLLKPVFPGSIPSIRRNFHNLVLFIDPAQEYTLDFIKLADLFYSHKVPLRIGFVFVLNTDDEVDGANDAGVALWRAFNYIAEEFDISEAFISIVHMYQKVKKDQNILTVDNVKSVLQNTFPHANIWDILGINSKYDEERKTGASFYKMTGLGPLPQALYNGEPFKHEEMNIKELEMAVLQRMMDASVYLQREVFLGTLNDRTNAIDFLMDRNNVVPRINSLILHANQQYLNLISTSVTADVEDYSTFFFLDSQDKSAVIANNMYYLTQDDDSKISAVTLWIIADFDKPSGRKLLFNALKHMKTSVHSRLGIIYNPTSKINEENTAISRGILAAFLTQKTRFLRSFLGQLAKEETATAIYSGDKIKTFLIEGMNKNAFEKKYNTVGVNIFRTHQLFCQDVLKLRPGEMGIVSNGRFLGPLDEDLYAEDFYLLEKITFSNLVEKIKDIVENMGINSNNMSDFIMKVDALMSSLPKRASRYDVTFLRENHSVIKMNPQENDTFFDVIAIVDPLTREAQKMAQLLVVLGKIINMKIKLFMNCRGRLSEAPLESFYRFVLEPELMSGANDVSSLGPVAKFLDIPESPLLTLNMITPEGWLVETVHSNCDLDNIHLKDTEKTVTAEYELEYLLLEGHCFDKVTEQPPRGLQFTLGTKNKPVVVDTIVMANHGYFQLKANPGAWILRLHQGKSEDIYQIIGHEGTDSQADLEDVIVVLNSFKSKILEVKVKKETGKIKEDTLTDEDEKTKGMWDSIKSFTIRLHKEEKKEKDVLNIFSVASGHLYERFLRIMMLSVLRNTKTPVKFWLLKNYLSPTFKEVIPHMAKEYGFQYELVQYRWPRWLRQQTERQRIIWGYKILFLDVLFPLAVDKIIFVDADQIVRHDLKELRDFDLGGAPYGYTPFCDSRREMDGYRFWKTGYWASHLLRRKYHISALYVVDLKKFRRIGAGDRLRGQYQALSQDPNSLSNLDQDLPNDMIYQVAIKSLPQDWLWCETWCDDESKQRAKTIDLCNNPKTKEPKLKAAARNVSQNGWSMMLEITTTVRSS

SEQ ID NO: 4479 - protein, 1735 aa, Anthracocystis flocculosa
MRAAALRPLLLVLLALGISTLTALAEPTQPSPPIKVQLRAPWTKPSLSNNASSLLLEILEAANARAPDSFFPLVTQLTAPWNAADSSSSAAAATAHPDAKATSHRHRHHKGKHHLQHPGPTLASLSDRQLVSQAEDAIRSSHLFGTDKDEDQRASVDAALQLWHTSLALHDQSPRVQAFMQLYRTLNLDHRWSQKARTYKHGVERCHSWVDFEGQVLCDEDEVVQAIRQAAGQQHRQQQPPVRLLPFDHVLPARSPVSQSSSRSAHGHGPDLTFILYGDPFSFNFWGLHSLLEAYATGHREAEGGHRISYVLRWRPSADDKRADGAAQATPPKLHDDSTLYLAGYGAYLDLKKVDYLVIDDRKLREDAEVGQLDDGASDGEDHGHREQSAENRAWIEQQIGQALPAKINTGDDAVAELAKEARAALTKEEIDELGIRAAHVVASSSDPLRALEELSQNFPLYAERLARSSKLADWDNADMVNSLLALGDHRVKSGASELWLNGKSLDSQDFSPLRLIKTLDDERRLIAPLLGRLAGGVLDTEMAVDLISSLLIGRAFVASSDQSLGQAFFDASDRLERQQLLSEVDKNSGAADPASPGAITWWNDVTKGATSRWSKDLFNLLRPMWPGQFPQISLNLFNVVMVLDLGRRESCRFLSESIGPSIGKVGLHWGLVPGGLEGQDASSDSAKLARLFWEVFDLGGSEAATSYLRKLASSKKGGESRVDVKSARNEASLILHAHLAPGEVAQRLDDVVQGRVARHQQREKMARAYIARLRASTAESPRGHVFVNGQHVPFGSQLIQMLHQKIQDQIQILAPAIYQRHLTAESENLETVFYDQPETLKFRSKLVFPPVVATLDGGEDAPQHEGVTFAPGDIVSALHSLKDGRGDAEVLNRFLYSDSASQGEAETHDEAQYVNSTVWVMGDLDSSEGAEVVLKVISASQQAGKASERFRIGFLHVPVVGDVDTKRFGSSSPPLSAYLHRLMQDSSIERLAPAQLAEAVAAYVPLSDNLDQDDKIDGPSAPANQHEPTLEHDAAAGSAAERAWATPAMAAADKFWQRAGASVAATLRLDASRGPALLVHGKVVQGFKASDIGPEDIAALLTVESAKKVDAVVRALTTLKPDFDRLPARERSDLVAAVVSIATRAYAVDPADEGIFVKGKTPRTAILEALGSDEHVFELGDRASAALRLSVLIDPLSEAAQKWSTILRTAVKLQGAYVRVILNPKLAYGGEMPLKRFYRFSAPTKLRFDERGRELVLETPDGSRSVDTIVMANLAYLQFKAQPGLWRLAIRPGRSSQLYEMVSVGNVGWDSPGVEVTGEDITLDTLSGLKIYPVVRKRKGQEAEDLLEELDAEGRPVKKAARTGANGIGGGGVVGMLRYALDGASRAASQAVDVVRTTLGLDSSSSASQTSTTAVARKRHADINIFTVASGHLYERMAYIMVLSVVKHTQSSVKFWFIENFLSPSFKEFIPHLAERYGFEYELVTYAWPHWLRAQREKQRTIWGYKILFLDTLFPLDLSKVIFVDADQVVRTDLQELVDLDLGGAVYGYPPMGDDSDDMDGFRFWKHGYWKEYLRGRPYHISALYVVDLHRFRRVAAGDKLRGQYQALSADPASLANLDQDLPNNMQGSLPIHTLDKEWLWCETWCSSAWLDDAKTIDLCSNPKTKEPKLDRARRQIPEWSVYDAEVAALASEVAKRGESRNVVDPEQVVVDGGPRQGSHEADGGETRGGHDEL

SEQ ID NO: 4480 - protein, 218 aa, Artemisia annua
MANLGYWQMKVSPGVWYLQLAPGRSSDLYILQDGQEMHLTKRITIDYLRGKPVHLGVVKKKGKEHERLLIPSDDDDSSRKQGDEESWNSNILKWASSLIGGNGQSKKSVSTKVDLPNYAQHTVPIFSLPQEWLWCESWCGNSTKSRAKTIDLCNNPMTKEPKLQGARRIVTEWPDLDLEARRFTSKILGEDVSPVEKVVSPPAQQEVPEEDLERKDEL

SEQ ID NO: 4481 - protein, 1765 aa, Nannochloropsis gaditana
MGCEHRNKRSSESARVGYGLKQLLLVAALSCILPGFVLSAQARSVEFAVTADWPTWTLSSLQEAAEYLASEVEGDEGLLWSFVDSLQQSPSRWELDKALESPTFEEDALDTVWALTLNQTTPLLHPLSQSMLHLYLSIRAYSPTLEMHRSLRKGVAFQAAAAAPDRSGCREGTSTSWAVVSLGPGLEEEVYCEASRLEAALAALPTDGTQGAGPGSPEAKRALPFDHVYPGALPAHRLAPSVLVTLYSTIGTSEFYGYHNLLAPAAAAGTLTYVLRHYVPALSEERTVRTALQGYGVYLDVKNMEYRNIDDSPAPGSAAATEGTQEEPQEGEEGGGVVGEEDVSGLVFSTLLAREPSLSAQLRQLRLNLLKEEAEGESSVEAASGATNMKVWRMRDLGLQAAQTIAAAKDPLRKLQELAQNFPSRATRLSSLKVKEEYRTGAATALRSRALGYGTVLKPGTLFLNGLPRSLAGPIFNVFDILKALRGEIRALQRLAHLPAPPALRQQLIGMAATAPLLAHASEGQGRRGPPGQETRLDIYRGSKGALVYLNNLEKDAQYKRWPSSLRQLLFPSWQLQTIARNLYTLTLVLDLEDPDSWEALATLRRIYSRQFPVRFSVLLVSQACLARAEGKQGSLEAGGEEEFFLAGVREVVEGEGKHREPATSEVVGMLFHHLREEHGLEAATAFLFGLGVGGSWEVPAGAGAVGGEKVPAELGTYADVVSAYSQAVAVVKKSWKGGAYAEEAWAALAAGKGAEGARLMHKLVAERGIPVGSVVLNGKLQVTLDVEEALMQMLGEEQQLLSQMVGAGTLKDSTKSVLGALLKGPGVMERYHPWMDEDLRREAPAVMWLGGGKGGRARELVERLDYLHPPGTRAEVKALTVVLQGDLGSAEGLASASALLSFLRGGRWRSEEAAAVSKRKKEAPRCALVHTPAPTAADKGGLLAHMTRVVSCRSEAGEEREDVLLQVLERLAIFLRAEEGEAAEVGERPSAYDRFLDVLKKESEAGGPAQGPEASALLRTAEELREDATEGFRKASAQEQSRNSGSSPREGLGIQSADGGEEEGSLALVVNGRQVDLGGKALHPLDMEVILKLESQVFTLPLLALCNPRASPDAGAAQASPATARRISDLVAVAHSFLNVYARHPRVDVEGHLRLLQDSPAESLLLDLQPLGSAGGRVGQEDDPVLSNLSVTVLLDPLGEAAQRLAPILTTLRDHFHLPLRVLLAPHPELSEFPLKSYYRFALFPTRETHVLFQSLPPSLVLTTRVDTPEAWNVQTRQALQDLDNLKCEQGETGLVCGDREGSSHTSAELVLKNLLVSGQCFDAKLLEPVNGLQLVLVDGLEGAEGGEETAGRRQHHSDTLVMQNNAYFQLRADPGIWKVRLAEGRARELYEVVREDPTGRALVRVPEQELVVAKRDFTNALETLRVQKQAGKEDIPLLDEINQDEAEGGKEQRESKTWSTLSNLWAGRKAEVEGKPTGEGSGEEDETVHVFSLATGHLYERMLKIMMLSVSKRTSVPVKFWLLENFLSPAFKTAALAMAEHYNFQVEFITYKWPDWLRQQTEKQRIIWGYKILFLDVLFPLSVKKIIYVDADQVLRADLKELWDLDLKGRPYAYTPFCDSRNETLGFQFWRSGYWATHLQGRPYHISALYVVDLARFRLMGVGDKLRAVYDQLSRDPNSLANLDQDLPNYTQHMIPIFSLPQEWLWCETWCSDESKARAKTIDLCNSPLAKENKLHMARRVISGPLFNESWVELDEEVKALVG

SEQ ID NO: 4482 - protein, 1643 aa, Marchantia polymorpha
MASLSDFQFLRGCRMTFAVVVLALLVLAMVAEGSTHQSKNVNVAVRAKWTGTSLLLEASELVAKEGDPQFWRFVEGWMRDAEPAELSDEECVHKIVKEGTEIVGSSLAPLFQFSLSLRSASPKIVLYRQLAQQSISEHFSMRANTNNDGLDKVDQWSVSENPIAPEGQCCWVEVGSHVLLGESELKKWLQFTQDRSHAEEDEVEVYDFDHVYPGSEGGLFVAILYGALGTSCFRTSHSLLSESSKMGHVKYIYRPVLPSNCASSVESCAQVGAGSTLYLGGYGVELALKNMEYKAIDDSEEKKGDDSDNSQAQAEDLSQEERKVEEDGEVMTFRDNLLSSEIVDKINVGELKDLGYLTVQRIIHSSEPLRLMQEINQNFPKLVSSLCRMQLNDTVKEEIANNQRRVPPGKNLFAINGALVNPDTLDIFSLLELVEGELSVAGKIDQVKVPPNYIRKLLRLTDPRESSAFRLDFRSEHVHYMNNIEEDSMYKRWRPNLNEILMPAYPGQMRYIRKNLYHAVYIIDPALPVELKLLETMTYYVQNSVPMRFGVIFMSSKKIKAIESHGGDIAATLETTGEEDVSELIIRLFHYFKENMDLQTAFGFLNLVNEELDGSGEVDEEPFQASVAENIFLDILREKGKSTGPTILQNLKEGNEFKEKALESSAFAYRLGLSPMHPCMLMNGLFYGPSQVQNAAIAAMNEEMPRIQEAVYYGRINARTDVLDKMLSEGGQPRYNPQIVSSRRDDRRYVSLSSPVAEEDKVLTRLQYLHHPGSEDNLKPLTHWICVDLTQKSGIHLLQQGLRYLMEGAEKGRIGVLHNLESRDFSGSYSLLIQVVTTVANSPSRRAKVVPFLQKLLGNEEFIGASLGDSDATLEKKYVKLVLDLADEMGLKRDYLEDALLEPVRKQAVLEQIHEERVFVARAVGLKAGAMAVVTNGRVYDQQEGSHFVAEDFALLDSVEYERRIKPVEEIIQEIEWTNVEPDELTSEFLSTKIMAVSSSMASRSRGGDSANFEMLRAEHSAIVREVDGAYIHVDAVIDPLSVTGQKLTPLLVLLEDWLKPSFRIVFNPMNAITDLPLKNFYRYVVPSKNVFSSDGVLSPGPVGVFTNLPPSRTLTMNLDVPESWLVEPVVAVHDLDNIVLEKLKNERTMSAVYELEALVATGHCYEKDGDPPRGLQLLLGTKLHSHLVDTIVMANLGYWQMKAAPGVWTLQLAPGRSTELYTLEGPGEGTDAGLITKRVVVQDLKGKLVRFEVVKRHGKEDQQMLEVNDAEEDFEEISPRRQEKKKEGKGFLKWASDFLVGGGHSGENRNVLNSVAGGGQSQLRRGETINIFSIASGHLYERFLKIMMLSVIKNTNRPVKFWFIKNYLSPQFKDVIPHMAKEYGFEYDLVTYKWPTWLHKQTEKQRIIWAYKILFLDVIFPLSLKKVIFVDADQIVRTDMGELYDMDIKGRPLAYTPFCDNNREMDGYRFWNQGFWKDHLRGRPYHISALYVVDLVKFRQSAAGDNLRVFYESLSKDPNSLSNLDQDLPNYAQHTVPIFSLPQQWLWCESWCGNGTKAQAKTIDLCNNPQTKEPKLEGARRIVAEWPALDEEARQLTARILGGKVTQHVSDQHIKKQVPQSLDSGVVEEESNFVDLESKSEL

SEQ ID NO: 4483 - protein, 1543 aa, Acropora millepora
MAAKMSASSKISDILVATVLILLSKAKKKSCKSSNSKSIVTTLDARWHSSPLLLEASEYLAADSNEKFWAFVDLCKKVEFSHDSDEYQHIFQAAGKLLPPLGLNFLKFSLSLRYYSPRVELFNKVAHELPAPDCEAFIQLGSQIICDVSEAVSAIKKAENVPFSQAFEFDHHYPKSVNKSVAVVLYGKIGSRSFRLLHEQLEYFAKNENVDYVLRHYFQSSSKRKIRLSGYGVELAVKKTEYKAVDDSKVKDDAAGKVQEADDANEDEVEGFLFGKLRKMYPNVKENLEQFRMHLKESAHEMAPLKVWQLQDLSFQAAQRVMSSDPQGALKVLRDISQNLPMQTRSLVKTKVKEEMRKEILSNQKNFAHLGVEAGDSALMVNGLTLPVDELNPFQLLDLLRDEALAMDRLASLGIKDDFLGKLVSLSTQPEHESFVLDARHDSIVFINDLEKDRQYWGWPSDVQEILRPTFPGMMRYIAKNIFNLVIFVDPLDTHTAQLLKIVNELLHNSFPMRFGVSVVANIPLDEEADATSNAAVGIARAFHFIASDKDPRQALDWLLQVYDGVSEGEAPSADKVMQSFSSWYGQDEREEVFGEDSEYDENRKSAKRFFDKTGFHGLPRVILNGVEIDQDEDNIEEAIIREVMMQTGPIQHAVFSGSVHRYSNVYEYVMSQPNVVTRVNNLVQSLERPYIDLTGSGKITDVDINDSEAFSKLDSSEMISAVVKDVKYFTKQDEELSLKPITNWVIADLGIKEGRSLVRAALKHVKSSTSTRVGLIHNPAVKAGDNRPELLQIARTVEAVLASKPHVTPSMLAAMETLMNEENDFNLLSQDSKAMEDLLAKVSGLKKDGIKAKLSDKTSFNGKLFSHQLFCEQVVNLLPGQPAVITNGRVLGPLAGNSLFNEDDFKLLENFDMDLYARKVRNQVDEMEFDDLSADDDTSEFRSDLIMKAASALISREKRSRQEISFKQDEHSVMRIKPTHDGPSFDVVVIVDPLTKAAQKIAPILTVLQNVTNVNIQIAMNSREKLSELPLNRFYRYVLEPQLTFDKDGGLSEGPLALFLDMPQSVLLTMGINTPLGWMVEAVYSPHDLDNIKLQEVEKQVMANFELEYIFIEGHCSDFDTRQPPRGLQFTLGTRRNPTMFDTIVMANLGYFQLKAYPGAWSLRVREGRSAEIYDIESVSDSKEEEDKHFAVVVDSFVGKLLKVKVRRKPGMEGKDLLGDSDSQSGGIWDSLSSIVGSDSKEKTAQDETINVFSVASGHLYERFLRIMMLTVIKNTKNAVKFWFLKNFLSPSLTAFLPHMAQKYGFDYELVQYHWPHWLHAQTEKQRTIWGYKILFLDVLFPLHVKKIIFVDADLIVRADLKELNEIDLHGAPYAYTPFCSSRSEIDGFRFWNSGYWRSHLGGRPYHISALYVVDLDRFRRLAAGDRLRGQYQGLSQDPNSLSNLDQDLPNNMIHQVPIRSLPQEWLWCETWCDDASKSAAKAIDLCNNPMTKEPKLKSAVRIVKEWQDLDNEVRRLQESVAAANKTQSKQTDTTREEKDEL

SEQ ID NO: 4484 - protein, 681 aa, Electrophorus electricus
DGAIRPVTFWVVGDFDQPSGRQLLYDGIRHMKTSNNVRLGVINNPTESPSNGTALIGRAIWAAMQTQTANNAKNFITKLTKEETARALYTGADPADFAVAVKIRPREQEVYFDVVAVADPVTRGAQRLAPLLLVLKQLVNVNLRVFMNCQSKLSDMPLKSFYRYVLEPDVSFLADNSFAPGPMAKFLDMPQSPLFTLNLSPPESWMVESVRTRHDLDNIYLQEVESVVAAEYELEYLLLEGHCFDVSTGQPPRGLQFTLGTAAEPVIVDTIVMANLGYFQLKANPGAWVLRLRKGRSDDIYKIYSHDGTDSPAEAEDLIVVLNNFKSKIIKVKVQKKPEKMNEELLSDGTEEIDSGFWHSLTRGFTGGSKVEEGKPEKDDVINIFSVASGHLYERFLRIMMLSVLKHTETPVKFWFLKNYLSPTFKEWIPYMAQEYRFQYELVQYKWPRWLHQQTEKQRIIWGYKILFLDVLFPLAVDKIIFVDADQIVRTDLKELRDFDLEGAPYGYTPFCESRREMDGYRFWKTGYWASHLAGRKYHISALYVVDLKKFRKIAAGDRLRGQYQGLSQDPNSLSNLDQDLPNNMIHQVPIKSLPQDWLWCETWCDDTSKTKAKTIDLCNNPQTKEPKLQAAVRIVAEWVDYDQEVKSLYARYLEERERGGAPDRSHAQKGRRDDQEHTEL

SEQ ID NO: 4485 - protein, 3569 aa, Trichinella sp.
MTVFCANFTVESLLEATVYSMWVFPLIVVCFVSPVLVSPRKAHKNVIVSVRSKWPSTSLIMEASEFMSKESNEKFWQFIEAVIDKHQNSLGNKTDREVYNGILQIGDQILKSKARLEFLKLALTVRVHSATVEMHRQIAATSLDVQNGKSVYAVVHGKQISDLQQLDTILKHAEALARPVTYEFDHIYPGSKQGSVCVLLYADIENPHFKPWHLQLKKLVQRDGISYILRHYPKMNDDMVALSGYAVELAIKSTEYKAVDDSDKQTGSESGVSSSEEEVTDLNGFNLHLLEADELTPLKVWQLQHLSFQAGQRVILAPKEEALRVLRDISQNFPIMARSLTRMSINPNFKNEVEENQADAFSKLNIEPGDSAFFIDGIVIDLEEKDIFNLIELLKNEEMLISGLLKLGIRRKDFTLLYAMKGNDPNAEYAVDYTQWSPQYINNLESDAAYRNWGNSIHAILQPYFPGMIRPIAKNFFTLIFVLRLGDRASQNLLSTAYQMYEHVLPIRIGFIFVVNNDKSVSGYDDAGVAMLNAFNFIKEDRSVSKAVMFLIKIYNTSMRETISVEDVHKLFKSSYRDENLKSVFNSEEYNQGRSSGVDFIKESGLSMVPMVLMNGYPFTAEEISPEHIEEAILSKVMRFTVDIQKDVYEGNLKENMDVQQHLLKKPTVLPKLNYNILQMENIFLDMTDTSKYGAMSVEKFSHLDSSGKTQFIIESILYLTKNDDDILRPVTLWIVADVESDDGQQFFLNAIKYLKYSVDMRIALIHNPKSEAQATKGTASLVQACIQFLPLYQSKAVIGKIFANKITTLEDLINLSPSGISWPEFKKAYNSMSDIWMQLHVHYAKFVLNLDPGVGAIVANGKVLAPLSASDFNSLKDFNFIERYLLTSGCNDIAQHLKIIPYLDKSPKALSDLVMRLYAFLRRYNANEKRHWPIIENYHHSCIQIEASDPTAAQFDIVAIVDPLSPAAQKMSHLLVILSSVLNVHMKVCMNCKSKLSEIPLKNFFRMVLPRELEFADDGSLKAQPSARFSALPQKQLFTLNIIAPQSWMVESVEAVYDLDNIKMEEVKGDVVAKFQLEYILLEGRCFDERSGSPPRGLQFTLGTFHEPFMFDTIVMANLGYFQLKANPGAWILALREGKSAEIYEVKSVDGVVQNQTTSVVILDGFSGRMIHVKVAKKNDQLENELLAESEDAESESLWQSISKTFQSGEKYDVINIFSLASGHLYERFLRIMMLSVLKHTKTAVKFWLLKNYLSPGFKEFLPYMAGHYNFSYELVQYKWPRWLHQQTEKQRIMWGYKILFLDVLFPLDVKKIIFVDADQVVRTDMLNLMELDLEGAPYAYTPFCDSRKEMDGYRFWKQGYWENHLAGRKYHISALYVVDLKKFRQVAAGDRLRGQYHFLSRDPNSLSNLDQDLPNNMIHQVKIKSLPQEWLWCETWCDDKSKKFAKTIDLCNNPMTKEPKLQSAMRIIEEWKDYDSEIKDLLDQRTKDKWNITEQKIVDIGFQFTVYFLVFLEESWNRAMNKENQVQDNQSDDLPQATESINNATEMKARQRGMIEKKLRKYVVGIKNQNSLMKLRIMPANSLGTLRLSNRRLSKKSCGKLLCSDQKMKNDSVDCSRNRDKFKNYYRKHWDTDITVEDETVVGLKNRILKGDRSALASAITLVESNHPTKRAQGECLLQSMLKISKKRFDEHGPKSLIYRIAITGAPGAGKSTFIESFGLYLTRELKKKIAVLTIDPSSERTGGSIMGDVARMNELSKEPNCYIRPSATAGTLGGVRRGTHESVVLCEGAGYDVVLIETVGVGQSESAVANIADMVVLLLSPALGDELQGIKRGIMEMADLILVTKADGDLLNQARLTRAEFSSALKYSRSRFHCWRPQVLLVSSRTNKGITEIWNEMEHFRNALSENGVLLQQRHQQMLRWMWNHIDHVLSGLFRHHPDVVKMLPQLIREIQNDNVTPVTAGEKMEHFKKEHWKFRQEKNMLEIKVSKAAEKVYTDGFDLANASGSVNLKKNVRMSEENDLHEEEPERVPVSFADLRREQCEADNKIDPEFWRNRERMKTVSVALVLCLNIGIDPPDTVKPKPCARTECWIDPQCMPMQKALESIGTALQRQYQWWQPRARYKQALDPTVDDVRRLCISMRKNAKEERVLFHYNGHGVPRPTKNCEIWVFNKMFTQYIPLAIYDLQTWMGAPGVYVWDCNGAAQAIRAFKTCAKKQIQAYRCSLAARRKESTKTTVEFEPGVDLFQADDARQAELDRSRRRKTGLDCVSSKPLEVNFRSSSMVPDGPKIETNNKATAKDASKHLAGNSSGNNNHCIQLAACARDQTLPTDPALPADLFTCCLTTPIRMAVMYYILQNKLTDRYPVCIADRIPGSTGDRRSPLGELNWIFTAITDTIAWNLLPSETFQRLFRQDLLIASLYRNYLLADRVMRSYYCTPVSSPRLPPTHEHVMWQAWDMVVESVLEQLDVQALVAEVEANEATVMLPPGVPTAAGHGGAGVGAGASTAVAAAAMPGGGTATTGVSDAGSRAVGNDPTLTAGQQAQHDKLIAFEVWLQYGFYQGSAPQQLPIVLQVLLSQVLRVRALELLARFVDLGPKAVEQALAVGIFPYILRLLQSVSRDMRPLLTFIWAKILAVDNSCRLMLLKDHVHRYFLVHLNDPTVEVRRKLFAVFALARLMADCRQFQEAAFDCNDAPMRQWLALALGHLWTDYEAAKWQAIRCSLHQTLIGLLEDRLASVRAAAVFALGRLISTGGAGDKENKQNDGDQGNHCPNDEQSTNLAHSVAMSLVQHVCADSSATVRREALLGFFAFVRRFYPQFVTIAYEIDRELASSVPSRRHQHHELVSSYTVTTATIQRTRNFGISSSPVAANVDSSTLVKSTSLLFQPLLTAVSSSLNSSSNSMINIPLVRPSSRKSVSWLFGLARSSQENQKADNSKQEQSSQETITVLSRREVRRHRSIGPAALVNVNNVYVSVWRAVLKFLYDPDIEVSRLAHRLFKYVDRSVQNLRLLSSVGHQDSVDSLPVRRRSTAGYFHSSPDNGTAGQHPSPRPKFSFSGTHDHHQQQLVNDGNGNSGGYESPMGASPIALCTYSAIYTNPRRPVFGDGPASESSVHSSEASPETRRHLAPEREIGTTAASILSPPVDSEPVMKTDYLSTCAQQFRSPMFYLLSESCAPSPAALNAQPRTTQRILPSFIADRISLIHQHSSIEWNDKRKKYGKLWTYKNDFPATCMEFLPLEPLLCIGERDSVTVWNCNKGSVVAHFDNSSTSYTGQSGSDLSGNLVYLTFVNPYTHGFILTGTDCGEVRVWDVRLINEPDLTSKVPKGSIDFALLTAWMCADDARRFHTKPFTCYFWEQDPGLLFAAGDFRSIILWDAHTELKLAELKVGAGGDTYVCTLSADSNGHHLTAAGCSDGSVRLFDRRLPTSDSRIMTLRDLGRAVFKVHLEQASVGGGGGGGGRLVAASRSGQLCIWEPRMYREPVLFRDVGVRCRSSFDVHRYYPLIAAWNGAQVDLINFDGKSMGLFRPDVLNMTTTLGRLAALRFHPVQVSIGLAEQDGQFSLYGLRP

SEQ ID NO: 4486 - protein, 1435 aa, Pseudogymnoascus sp.
MVRLGNRWSLTGSALAFSCLQSIKVSASPTINVALATSFTSAPYLLELLETAGDENSTSYFPLLDRIAEGYFKDAKTDLELYNSFVKVLRDDGHLDSEGLASYSLALSLRTSAPRIEAQYQFYDTAIESSGDDSSCPVWVLFEGKKHCSPALDQAHGTYNGRRGTEQLQFDRITGNLSAPASILYADITSPEFNQFHKKLIQKAQKQEISYRIRHRKPNAKESKPLVIGGYGVELALKRTDYIVIDDREAEAQLQGESVKTEVVLEDEELADLKPLSASELVSLGLKASSFIMQSENPFEVLTRLSQDFPRYSSAIAAHNVSSAFAEEHVYNRGRLVPAGANVVWINGLQVPTRQMDAFSMLDILRKERKLLNKFSQLGLTGPQTISLLSHEDVAFTKADDEPARFDWRDGDGDVIIWLNNIEKDKRYNGWPETVQALIQGGYPGQLPQVRKDLFNLVFPVDLSNLQDVEIVVMQLSDFVKRSLPLRFGLVPLTNSDAALEQAKIAYYLLDSYGLSTLVAYLNGFYASKGAASSRNANFEAAIGERKPRTDKTTKTLEEVLDTNEANGPLEHSKLWTSRLGVNDKVPTVFVNGVAVPRDENWLQGMSQRVQMDVRLMQRAVFESTVTDDNWPPILFLHDAASGRNPFLMPENDKDLQLFDVNAIYSDHAEALDGLPVIKASPVAVQVDWAHMILVADVESEQGRHLLKAGVEFSKRNPTVEFVIVPSSESPAGILSTYEYMAERSFQFLKSGDLDNLVEAVSKSTGNEQKYTQKVADKWTAIGDFLGSVGLKSGQQGLLLNGRLVGPIPSEIELGISEFEQLLGFERTKRIKPALVAVKELGLSEAIADPLASAKLTSLVTLSFISNVPEGIFEQASTLRIDSFKVWKSEHTAIEIGDEPTASIHIQVALDPASQESQRWIPILKVLSELDGVYVKLFLNPKDKLMEIPIKRFYRYVLESKPLFNADGSLKDIKAQFASVPQEALLTVGMDVPAPWLVAPKQSVTDLDNIKLSSVNGDVNAVYELEHILIEGHSSEKETGQAPRGAQLLLGTAADAHFADTIIMANLGYFQFKANPGFYKISLQEGPSSKIYSIDTLGASGRDAAKPDESTEISLISFQGLTLFPQLSRNPGQETEDVLEPSTDLKDDIVSKGRKLAQNILGFGGKKSTSVVAAQPTQAEINIFSVASGHLYERMLNIMMVSVMKHTNHTVKFWFIEQFLSPSFKQSIPSLAAAYNFDYEMVTYKWPHWLRSQSEKQREIWGYKILFLDVLFPLSLDKVIFVDADQIVRTDMRELVDVDLQGAPYGFTPMCDSRVEMEGFRFWKQGYWKSFLRGLPYHISALYVVDLRRFREIAAGDRLRQQYHQLSADPNSLANLDQDLPNHMQALLPIHSLPQEWLWCETWCSDESLEGAKTIDLCNNPMTKEPKLDRARRQV

SEQ ID NO: 4487 - protein, 1453 aa, Candida dubliniensis
MSVIRYILYAIAVTILLNFVKATENNNFKVELETQWSNIDFLPNFIEAIAGFNESLYEQTIENIFGLSDNDEVLEDDASDQEIYSTVANSLRLADEDMDFVNFDLVYKKHTPRVAAHYDHYSDVLAKFGDRLKRECAKDSFGNTVETKNGQIQTWLLYNDKIYCSANDLFALRTDSSSNSTLLFDRVIGKSKNAPLLILYGNPTEESTKDFLKVLYPEAKAGKLKFVWRYIPSATKKLDSIPGFGVTLKMENYDYSYSEANPKYDLSRDFTKINESQELVSVNEKHLYELGVKLTSFILSNRYKTAKYDLLNTILTNFPKFIPYIARSPKLLNHEKVKSKVLGNEDIGLSQDSYGIYINGSPIHPLELDIYNLGSRIKEELQTVKDLVKLGFDVVQAKLLIAKFALLSAVKQTQFRNGNTLMGNNENRFKVYENEFKKGSSEKGGVLFFNNVESDNTFKEYTTNREEAYLGVGSYKLKPNQIPLLKENVHDLIFALNFGNKHQLRVFFTLSKVILDSGIPQQVGVLPVIGDDPMDEMLAKKFYWIAEKSSTQEALAILYKYFESDGPDEAADLLDKVEVPEDFKVDYDHVLNKFSIATASVIFNGVIYDLRAPNWQIAMSKQISQDISLIKTFLRQGPIEGKLKDLLYSNAKSERNLRIIPLEPSDIIYKKIDKELINNSIAFKKLDKEQGVSGTFWLVSDFARPEMITQLIDLLSLLKRKSIQVRVINTGDADFSEKLETDFKLTTLTNGQIDEIIEILEDSNISKAPNDGLRELLVTKQLPAHHSFLLFNSRYFRLDTAFEYEELDQIIEFEISQRLNLIPDVIEAYPDEFMSKKVSDFNSMLSGLDNMDWFDLMTSIVTKSFHVDDKRFIVDVSRFDFSSLDFSNSIDVKTYKENNPVDVLIILNPMDEYSQRLLSIVSSITQFSFLNIRILLQPRVDSKEEIKIHKFYRGVYPHAKPKFDSNGKWIQHYSSQFESIPSDVTYSTELDVPHKWIIVPQMSSIDLNNIYFNNHHSVNIKYSLKNILIEGYARDIRTGKAPDGLIFRAFNKNYSTDTSVMTSLDYFQIKAYPSIFNFSTTSNYTLLSASENKYQTNIEELESIEVPVFKIDGSTIYPRVKKSDNKKAMPMRRHAEINIFTIAGGQLYEKLTSIMIASVRKHNHRSTIKFWILEDFVSPQFKHLMKLISIKYNVEYEFISYKWPNFLRRQKSKERIIWGYKILFLDVLFPQDLDKIIFIDADQICRADLTELINMDLEGAPYGFTPMCDSREEMEGYRFWKEGYWSDVLKDDLKYHISALFVVDLQKFRSIKAGDRLRAHYQKLSSDPNSLSNLDQDLPNNMQRSIKIFSLPQSWLWCETWCSDKSLKDAKMIDLCNNPLTKENKLDTAKRLIPEWTGYEQEIESLVSLVQNDSAKEVSEEIESDVEKEVDHSDKNEEEEEDDDGDDYFHDEL

SEQ ID NO: 4488 - protein, 1512 aa, Wasmannia auropunctata
MKGLIFFYILSLCSSQLGADKKINKYVTTLINAKWNETPLVLEAAEYLSDENPSYFWKFIDSYSNRISNLVLATQKENYDVILELAEKFLSQSEIAVFKLALSLRIYSARVEMFSQMAVNKNVSSYGCNNVVNVGGTFTCSLEDVDRLLEQDTWEIIDTYDVDHRYLSTSESDKIMILYGQIGTPMFTDFHEKLKNIAETKGINYILRHYVKEREDKKLRLSGYGVELQMKSTEYKATDDSDIKDNTGKSSEMANDGMEEIEGINFMTLKKLYPDQQAELDKIQTYLLETSHEIGAFKVWQFQELSHQAAERIMKSPSTEALNILTDISQNFPMQAKSLIRTKVNSDMKKEMKLNQEIFMASLNIQPTDTALFINGLFFDLEAIDVLTLLESLRSELRVMEALHKIGFSNKKMSKLLALDLSGSTDNQNFAMDIRDSAINWINDIENDPRYSNWSPSLTELLRPTFPGMLRNIRRNLYNLVLIIDPLNEESMPLVALAQSLYAHSAPLRVGFVFVTNYNTSVTGLMDASVAVNNAYHYFADTRSPKEALHFLSELGNYIGPSGADVDDVKKVIRSKDSSASVPYILGEESEYDVGRHLASDFVKRCGFKKFPQALLNGVPLTPNQINSESYEEAVLSTIMSQTPMLQKAVYRGEVTEGDDIVDFLMNQPNVMPRLNERILKVDKNAWLNLIGTIPEDDDYTKWTSPNLSTYLMKKMHYLFVPRRNMRHLYSFWVVADLKSLAGRQLLREALEYVESNTDARISIIINAKDDANLKSDINKIVLAVISALSPEKAILYMRKILKEENAALIADSNFEIEDESVAAILKDQNSMLLLHQHYVKTVLNMEIGIRAVLCNGRIIGPLDNNEEFTNEDFSLLERFSQSTYGEKLFMKLIKDQIFNEDEYEESDITDDTIMKITSLLVPRPQTRNRYDVPFHGDDHSVIKIPATNSDEIAFNFIAIVDPVSRGAQKLGPILKTLQQALNCNIKVFLNCVDKNSDMPLKSFYRFVLESELQFTTEGDISGSIAKFTKLPTSSLLTQYIHAPENWLVEVVRSVYDLDNIKLDNVAMGVHSEFELEYLLLEGHCFEAVMGNPPRGLQFTLGTEKQPVMVDTIVMANLGYFQLKANPGEWVLRLRQGRSAEIYDFTTVDGQDVIQNGNDVKVLISSLRSHVLKVKVSKKPDKAGMDLLSDNEKDSGLWNSISRTFTATDENEDKDEKLNIFSLASGHLYERFLKIMMLSVIKHTKTPVKFWFLKNYLSPTLKDFLPHMAKEYGFEYELVQYKWPRWLHQQTEKQRTIWGYKILFLDVLFPLGVKKIIFVDADQVVRADLKELATMDLGGAPYAYTPFCDSRIEMDGFRFWKQGYWRNHLQGRAYHISALYVVDLKRFRRIAAGDRLRGQYQALSQDPNSLSNLDQDLPNNMIHQVAIKTLPQEWLWCETWCDDASKKNAKTIDLCNNPMTKEAKLQAAMRILPEWVGYDEEIKVLQQKVENANRQTEKDSETVDHVSGHTEL

SEQ ID NO: 4489 - protein, 1491 aa, Aspergillus homomorphus
MVSGSAFVASWRLTSVVIASALSCLVHATPSVNVALQASFDSAPYLIELLETAAEENATSYFPLLDRIADGAFDDAATDKELYDRFLEAVHTDGHLRTPEALSSFKLSLAIRSASPRIAAHYQYYNASVQQSLAAAQDAVCPVWVHSEGKQYCSSTLERAQQGVMGPSDPPELPFDRVFGDSSLPPAILYADVASPMFKDFHQSLTALAKEGQISYRVRYRPPQHWSSRPLFVSGYGVELALKRTDYIVIDDRAAEERGADGSDSKKSVDMEGDDLDDLRPLSSSEVSRLGPSTVGYVLDSESPLETLVKLSQDFPKYSARIAAYNVTRELLQDIQSSRLRMLPPGLNALWINGVQIDARQVDAFTLLDHLRRERKLIEKFRTLGLSASESVELLSHKFLAAAMAQDGPQRYNYRDEIEGGGVIMWLNDLAKDARYESWPSDLGGYMQRVFPGQLPSVRREANNVVIPVDLTNANDATLIVKSIQVFVKNKIPVRFGLVPTTSSAGSIAQLKVAHYLQDTFGLSSLMSYLEASLSRNKLSSPDKTAFQTATADRNVRPDKQLLTLDEVLKNDSLNATASRTTNYLKRLGITDKASHSFVNGAPIVRNENWAQELSARVSRDIQAIQQLIADGALDEDTWLPGLFLSEAFDRRNPVIVPEDPKDVRVVDMSQVAEAHGELLGQVPRIASIENDVLSSSYVIIVGDFNDESGFKMLSGALESLKNHGEAEVLLLHNPGADSSVWTGANTIHRYLKNPKTKEDGFDAAQLLEELTGTDLWSHKQIQEVDEFWAAQRPLVKDFGLASGASAIIINGRVVELPAEFALTSVDLDQLLAYERQKRIAPVAKAAKALGFDAKLRDPLAFAKLTSLTASSTVSDVPEGIYESTPDIRVNLFERWDKARSAVTVSNSEDPAITIVASIDPTSEVAQKWLPILKVLSELANVRMRLVLNPRDELQELPTKRFYRYVLDSEPSFSEDGSVAHPAASFSGVPAEALLTLGMDVPSSWLVAPKDSVYDLDNIKLSSVKEGSDVDAIYALEHILIEGHSRDLTTKTPPRGVQLILGTEENPQLSDTIIMANLGYFQFKAQPGLWKINLKPGRSERIFQLDSLGNEGYILHPNDDTSNEVALLSFQGKTLFPRLSRKKGQEMEDVLETGVKSGSAMEYVSKGLNFASDILSSVGINSSPKDVSAGKQADINIFSVASGHLYERMLNIMMVSVMRNTKHSVKFWFIEQFLSPSFKAFLPHLAAEYGFSYEMVTYKWPHWLRAQTEKQREIWGYKILFLDVLFPLSLDKVIFVDADQIVRTDMYDLVSLDLEGAPYGFTPMCDSRHEMEGFRFWKQGYWKNFLRGQPYHISALYVVDLSRFRALAAGDRLRGQYQMLSADPGSLSNLDQDLPNHMQHHIPIKSLPQEWLWCETWCSDESLGQARTIDLCNNPLTKEPKLERARRQVPEWTVYDEEIAALENRVRLETVQDEVPVSASGTGATWDKDEL

SEQ ID NO: 4490 - protein, 1472 aa, Phialophora attae
MHRSHLPWRLSVAAAFVVTFLVAGGAAAGHSVNVALQTSWNSAPFLVELLETAAAENPSSYFPLLDRIAQGTFADVSTERELYNKFVSVLDQDGLLPDAEALSSFKFALSLHEAAPRIQAHLQHYNTSVQPNMMAAQDAVCPVWVHFDGQQYCSPTLDRAQQPVDLAYGDDTLPFDRVLGPADAPSSIIYADITHPLFADFHSVVSQTAREGKTSYRVRYRATDQATSPVTLSGYGAELNLKRTDYIVIDDREASTKGNGDAADVKEPELDDELEIKSLTTTELWNLGLNAASWIAKHADPMQALLQVSTDFPRYSSFLAAQNASDDFVSEHRHNRELLLPAGYNALWINGLQIDPREINAYSLLDHLRRERKLIARVKDIGLTATEAVSILANDAIANSARNAVDQRFNWRDSDEGGEVIIFLNDLEKDSRYAAWPTSLMTLFQPQYQRGLPNVARDIHNLVVPIEVEKLSEIELVVTTLQMLVKRKLPLRVGLVPVGKSPISDTYSRLMYHLLDTYGLSTLLNFYGAIVKSGKVIPSPDKQFASAIKDRKLRAGKTAATYAEVTADDELTQRLTSRDAYADRLELNGPMPPFMLNGAVSPRTESWFETINSQIYMDTQMVMQSLYVGTLTDESVVRDFFLTDAAAKRNGLVIPHDEKDIRVVDVAAMTTEHAAVFDSLPRLPGAESALITDRAHLMVVADLDSNQGKSLLGAAMDLQEQVPEVDVLMVQNPGSESTATVSSLLYRWQSQTGPALDAEKKTKLRAFLAATGVTGSSAEDLRRDSSIYWSTAEPLIADLGLKPGDSALLLDYERTSRIAPATAAITALKLEEKFQNALDIAKITATVARSQKSELPEGMRGTAPMLRLDRYNLWDDTHTVVRAGTSKDPTIQVVAVLDPVAEASQPWISIVKTLSELEGVSVKIFLNPKEQLSELPSKRFYRQVVQSAPTFDDAGSLAAPEANFNKLPEDVLFNLGLTVPPSWLVSPKQSVADLDNIKFGVSDSDVGAVYELEHILIEGHARDSNVSSPPRGVQLLLGTEQDAHFTDTIIMANLGYFQFKANPGHWSISLMPGRSSKIYNLDSAGAEGYLPVPGDDNSAVTLMSFQGVTLYPRLSRREGQETADVLETSTLGSATDYLSKGASWASSALSSLGLKPSGGQAEINIFSVASGHLYERMLNIMMVSVMKHTKHTVKFWFIEQFLSPSFKATLPALAAHYNFDYEMVTYKWPHWLRGQKEKQREIWGYKILFLDVLFPLQLSKVIFVDADQIVRTDMMELNKVDLQGAPYGFTPMCDSRTEMEGFRFWKKGYWESYLAGKPYHISALYVVDLKKFRELAAGDRLRQQYHSLSADPESLSNLDQDLPNHMQHNLPIFSLPQEWLWCETWCSDESLGQAKTIDLCNNPLTKEPKLDRARRQVPEWNEYDEEIRGVIAKARGDLPDSAPSDKAEAAKERLEDFLEQEEGQKSLKKDEL

SEQ ID NO: 4491 - protein, 1743 aa, Microbotryum intermedium
MSSAHGPTSSPSRRRTRRTSVVLIPVLVVVGLLSVVPTCLASSCSSSCSTSCSTSNGARSVQARIKTPWAASSWVVQYLESLASEDEQLLHPFLAHLIRSNESTLLTTASNTARAQDRRREWTTLSHQLQRFLSQTGLGDDAAHSQAMVESLGLAMGLKEASVSLQAMQVVAERAWASTTFPPVLTAAATGVGRDVALECDNWVDLRGYRVCSVHDFWRVVGEEHNEGKGALQLPNTGNSSTRPKLYPFDHLSPRSPSSTLSSPPLVIFYASPSSPAFVEWYQLLTRLAGEEPPRLEYAMRWKASAASVQEPLLLSGYGAGLDIKKSDYLAIDDRLAVGAAGEQDATSLTTPDETTETIKMDPIKKKDIPLLGVRSTAYILSDPSPLTAFTRLTSSFPLLASKLSSLVPNISADLLQEIEANSFVPAGVQASFKLNGLLIPEAQVDPFVLLRLMRKERKFVTQLQRLATNDEDGGHALVDISPLQARKILMNQAISKAMKVGGKVVTEPSGRVSSHVLGHLFDASDREEEGGVVFWWNDLEKDRKYQSWGKDLKKLLQPTYPGQMNNVALNLNQAVFILDLTQPSALQLITRQVQTFVSRGLPIRFGLVPKLPSRGEEEEEEEEEADSAEESLAKVFWYLTEANGRAGTMRFLGQLLATLPTERVTTPHLRKTYEAFMLESTHISGGPLAPFAQVLELEVGSERANKARAYTKRLGVGGGDEASSVGAFLINGAFFDFDEEWTQHLQQTLSAHVQYEQQEVYFDKLTSQTDIANFFYDLPTTHKRRNRLVFTSETNPLKVVNLVEATRGVKREFVERTWIEAAAVVLKGEKGSEVEVGVDLDQVVSVHVVADLDSSEGRQLVTTALEYVQAHPEARVSLLHYPMLKEEQELPSRWAVSNLIYLLHTDDALGETLPKELVRFVRLNLNQTNVNDVIQLLLGGWDDDNPIKKHVKLGASRKVSLLAQEWWKSAALMAQRFGFERGQSGIVINGRVIGPLRRHEWTIGDLEALVAYEREERIDAVVEALRNVDLDLRLIDRSGWAQMVALATSVIAEAYEADPSNGLSGRETIERSRDYLDLQADHSSIVGPNEDQGLFEIAVVVDPATELAQRWAPILETLSHLDSIHLRVYLNPSLRIQDLPIKRFYAFTFAPSPQFDRSTGGERIPQVHFTDVPEDVLFTFAMDTPKAWLAFPKKSVHDLDNIRLKDLPAWARKQGVDADFELESLVVEGHAREVPRGTPPRGLQLELVNEGKGEEEQHRVDTIVMANLGYFQFKASPGPWRLSIREGKSSQVYSIETTGVEGWNSRGVEETGDEILVTTFEGVTLFPKFKRNKGHETTQLLDDSNKGVMKKGAQESVVDRVKNMYVRDSDGTFFLGVASKTYTSHSRLPFLRKSDLAIKKKAEINVFTVASGLLYERMAFLMVVSVMRHTQSTVKFWFIQNFLSPSFRAFIPHLAQEYGFEYELVTYKWPHWLRAQTEKQRTIWGYKILFLDVLFPLELERVIFVDSDQIVRTDLKQLVDLDLQGAPYAYTPMGDDRPEMDRFRFWKTGYWSNHLRGKPYHISALYVVDLDRFRAIAAGDRLRQQYQALSADPNSLANLDQDLPNNMQDQIPIYTLDRSWLWCETWCSDASLAQAKTIDLCNNPLTHEPKLRRAKRLIPEWTVYDDEIAALAKRVAGEQKGGLEKNDIGVFGGKADELGQAKGQKDELEAFVKEKNDEGEKVELRPVEEQSQDTAVPLKDEL

SEQ ID NO: 4492 - protein, 512 aa, Ostreococcus lucimarinus
MTNLQDLPLKSYYRYVAPPSSMTESPRAFITNVPTHKTLTMHVDFPEAWMVTTHRAAYDLDNLILKDIKEKTVHAEYLLESLLVTGHASDHNTGQPARGTQFVLEDKSVAVNPGTIVMSNLGYFQLPASPGMHKLSLRAGRSSDIFAFLQVKDLLDSEARDLTLSHDESTVDVLVDSFRGRQLDVSLARRKGKEDLDVLDEVSTSDNSGWLSSVFKRTKEADRIHIFSVASGHLYERFLKIMMASVKRSTKNPVKFWFIKNWLSPSFKDFLPYMAKEYDFEYELVSYKWPTWLNKQTEKQRIIWAYKILFLDVLFPLELNKVIFVDADQIVRADMSELWTMDLHGAPYGYTPMCDNNKEMEGFRFWKQGFWRDHLRGRPYHISALYVVDLDRFRAMAAGDRLRVMYDQLSRDPGSLANLDQDLPNYAQHDVPIFSLPQPWLWCESWCGNETKSAAKTIDLCNNPLTKEPKLEGARRIVQEWPGLDAEVRAFTERVEERMRVGDKTEDVKDEL

SEQ ID NO: 4493 - protein, 1488 aa, Acremonium chrysogenum
MIRLLQLPWSLAAVLVAALGATAAPAVNVGMKAAFPAGPYLLELLETAAAENSSSYFPLLDQIASGYFASASTEAQLYTSFLNLLREGGHITSPEALSTFNLALSLRTAAPRIEAHYQYYTTSVNSSPEATEGCQDWVLLDGDRHCSPSLDNPAKDLPATRDVEDLPFDRAVGVGKDAVLYADPASESFGAFHQALSRAAHNGELRYRLRYRRDQTMPANPLHVTGYGVELALKRTDYIVIDDRDAARDASQQPLTEVDFDEEEEVADLKPLSTSELAELGLKAASFIMHSDEPLETLVKLTQDLPKFSTSIASQKISDDFLSEHKQNRRHMAPPGINYLWMNGVQLIERQIEPFNLVDMVRRERDFLGGVLGLGFSGKQAISLLGHKGVSTAKANHEKPRFDWTDRTEDGRVIIWLNDLENDERYATYPSSLKSLLQRTYPGQLPPIGQNVFNLVLPLDLADPEDLTVVPQVFSLIKRGIPVRFGVVPLTPNDDAATQARMAYHLVEDYGVEALAAYLSAFLEDTKIEAVESLLATTVKSFELQDDATAKLFSEVIEAENYSQQIEFARQWSSRLEANAASRSVFANGAAIPRDRNWMQSVSVQLVEDLQRLQMAIFQARIDEEAWAPGFFLEGASLKRNTYILPEENSALRILDVNKIYNQHYDLFDKIPVIESYADSTKENWAVLTLLADITAASGKELLVEALKFKRDNPGVRLDIVHNPESAESAFKTNAALMANKKQLGDVEAVSEISQILQAQDGAEADDGFTAALDRFLTSSKIQPGTETLLLNGRVVGPISQADSFKADEFQQLLEFEQRNRILPVYTAIDDLGLGEKLNGPISAAKVTSLTALSTISDLPEGIFESAPTLRTNLYDEWESKYTAIETGNPDTASVHIAGLLNPLSEQGQRWAPILKVLSELDGVYLKLFLNPKEKIEELPVKRFFRYVLESKPSFDEETGKLKTLNATFRGLPSEALLTVGMNVPPAWLVAPSVSVHDLDNIKLGTIKSDVEALYELEHILIEGHSRETRGNPPRGAQLVLATDSNPHVTDTIVMANLGYFQFKANPGFYSIKLKEGRSADIYSIESVGAQGWEAVPGDEGTDVSVMDFKGTTLYPRLRRNPGMEQVDILGEEEEEDENLVAKGLKFAGSIFGGSSKDAAIPAKQQHADINIFSVASGHLYERMLNIMIVSVMRHTKHTVKFWFIEQFLSPSFKDFIPYMAEEYGFEYEMVTYKWPHWLRQQKEKQREIWGYKILFLDVLFPLSLDKVIFVDADQIVRTDMMDLVNHDLQGAPYGFTPMCDSRTEMDGFRFWKQGYWASHLRGLPYHISALYVVDLRRFRKLAAGDRLRQQYHSLSADPNSLSNLDQDLPNNMQFQIPIHSLPQEWLWCETWCSDEALATARTIDLCNNPETKEPKLDRARRQVPEWTVYDDEIAALDRRRRRGVEPVVVSAEEIGGAEEKAGEGGVSGVNTKSRRFEEEPVHTRDEL

SEQ ID NO: 4494 - protein, 1494 aa, Phialophora americana
MRTSNLPWRCALLSLARLCSVVTSAHISPSINVDLQASFSAGPFLVELLETAALENSSSYFPLLDRIADGVFTDLHTEQELYTRFLDVLQNEGHMSTAESLSSFKFALALHAAAPRVEAHFQYYNTSVQPHLMAAQDAVCPVWVYLDGQQFCSPALDRAQQAVTAPDVDDDLPFDRVLGTSPEGPASILYADITHPLFGQFHGVVSQTARQGKSTYRVRYRPSSLESDKPVYVSGYGVELVLKRTDYIVIDDRDAQKPEDVTSDQLSLEDVKDDNLKDLKPLTTSEVINLGLNAANFIAASSDPLDTLLQVTSDFPRYSSLLASANASKEFVLEHRGNRERFLPSGYNVFWINGVQIEPRQINAYSLLDHLRRERRIIGELKDLGLTSSEAISLLSSEVIAEAQANELPQRFDWRDDTEGHKVLMWLNDLEQDKRYATWSKSLRGLFQRTYPGQLPQIARDIHNLVVPIDMGNIKDIELVATSIQSLVRRSVPIRIALIPTGRSETADIYAKVAYHILDTYGLTALMNFFSDVVASKKLVSNPEKSFHNAIKGRTVRQERNPQPYQAILHDEDLRLQLQARDDYLKRLALDDSDPAFLINGVVLPRMDNWFELMSARLYADLQIIQQAVLQEAIFEESWIPNFFLFQAVKSRNELVFPNDPKDVIIVDIGLLTRQFADVFARLPRLVGSEATLLSDRAHLLVIADIEAKRGRALISEALLFHQRNPEIEILVLHNPNGEAQNSKYANALHALVQNGVRDLTVAQLEQLLGEDLTESADVSGESSAGFWTSQATLARALGLSEGQNGLWLNGRLLGPIEQPLTSADLESLLEVERRERIAPVTTAITGLALEDRFSDTLDLAKVTSLVALSLKSDLPEGLRESAPLIRMDRFKVWNTTHTSINLSNSADPTIQIVAVVDPASEIVQQWVPILQTLSQLSGVGVRIFLNPKDRLTELPVKRFFRQVISAEPSFNADGSLVNPKASFSGIPRDTLFNLGMIVPPSWLVAPKRSIHDLDNIKLSSVAEDDNIDATYELEHILIEGHARDVTNGPPPRGVQLLLGTEQEPHFTDTIVMANLGYFQFKANPGYWQISLKPGRSSKIFNIESVGPYGYSAEPGDETTSVALLSFQGLTLFPRLSRKPGMEEEDVLEASGSGGAMDYLSKGASFASSALSSLGFKKASTNADINIFSVASGHLYERMLNIMMVSVMKHTKHSVKFWFIEQFLSPSFKTTLPALAEHYGFEYEMVTYKWPYWLRGQKEKQREIWGYKILFLDVLFPLDLDKVIFVDADQIVRTDMMELNKVDLKGAPYGFTPMCDSRTEMEGFRFWKQGYWETYLRGKPYHISALYVVDLKRFRQLAAGDRLRQQYQALSADPASLSNLDQDLPNHMQHNLPIHSLPQEWLWCETWCSDESLAKAKTIDLCNNPQTKEPKLDRARRQVPEWTVYDEEIAAVIRAAKEKQGAEGIEAVPGAGDLNDADEGSQKVVSGERVRDEL

SEQ ID NO: 4495 - protein, 1547 aa, Urocitellus parryii
MELLIALTGLWLFSSVKADSKAITTSLTTKWFSTPLLLEASEFLAEDSQEKFWNFVEATQNIGSSDHHGTDYSYYHSILEAAFQFLSPLQQNLLKFCLSLRSYSATIQAFQQIAANEPPPEGCDSFFSVHGKKTCDFHTLETLLLTASERPKPLLFKGDHRYPSSNPESPVVIFYSEIGYENFSNFHHQLISKSNLGKINYVFRHYLSNPRREPVHLSGYGVELAIKSTEYKAKDDTQVKGTEVNTTVIGENDPIDEVQGFLFGKLRDLHPDLKEQLKELRKHLVESTNEMAPLKVWQLQDLSFQAAARILSAPVELALVVMKDLSQNFPTKARAITKTAVSSELRTEVEENQKYFKGTLGLQPGDSALFINGLHIDLDTQDIFSLFDVLRNEARVMEGLHRLGIEGIALHNILKLNIQPSEADYAVDIRSSAISWVNNLEADSRYNSWPSSLQELLRPTFPGVIRQIRKNLHNMVIIVDPAHEATAELINTAEMFLSNHIPLRIGFVFVVNDSEDVDGMQDAGVAVLRAYNYVVQEVDDYHAFQTLTHIYNKVRTGEKVKVEHVVSVLEKKYPYVEVNSILGIDSAYDQNRKEGRGYYEQTGVGPLPVVLFNGMPFEKEQLDPDELETITMHKILETTTFFQRAVYLGELSHDQDVVEYIMNQPNVVPRINSRILTAEREYLDLTANIPRTMLNRSGESDYQDNFFVDDYARFSALDSQGKTAALANSMNYLTKKGMSSKEIYDDSFIRPVTFWIVGDFDTPSGRQLLYDAIKHQKSSNNVRISMINNPSEEINYENTQISRAIWAALQTQTSNSAKNFITKMAKEETAEALAIGADIGEFSVGGMDFSLFKEVFESSKMDFILSHAVYCRDVLKLKKGQRAVISNGRIIGPLEDNELFNQDDFHLLENIILKTSGQKIKSHIQQLRVEEDVASDLVMKVDALLSAQPKGDARIEYRFFEDRHSAIKLRPKEGETYFDVMAVVDPVTREAQRLAPLLLVLTQLINMNLRIFMNCQSKLSDMPLKSFYRYVLEPEISFTSDNSFAKGPIAKFLDMPQSPLFTLNLNTPESWMVESVRTPYDLDNIYLEEVDSIVAAEYELEYLLLEGHCYDITTGQPPRGLQFTLGTSADPVIVDTIVMANLGYFQLKANPGAWLLRLRKGRSEDIYRIYSHDGTDSPPDADEVVVVLNNFKSKIIKVKVQKKADMVNEDLLSDGTNENESGFWDSFKWGFSGGQKAEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQNRFQKEKEIGILYKGKTKNQSQEEYQKHEEL

SEQ ID NO: 4496 - protein, 1566 aa, Mixia osmundae
MRLTAAVSLVPALLAWHGSATRSPPIKIDLQASWAAAPLVVQILESISLQSNDAFFDLLSDFTTSAQALIESPLAAHLSAKDVYDRSLALIAASPHFKQDGQIQLLKLSLAMREASPAIEALYNVSAGVVANARCASWVQYNDQTACTSKELLTLMASEAAHGASPKLHPFDHVKAQSSTVPTAILYTSLDSDAVYDLHRELLSRAQSGKLQYVVRWIRRRDENARKLRLSGWGASLDIKKSDYLAIDDRLQADNVESNQTNDGSASSDTKDYDKFGNPDESTDELAPLKARQVAHLGLRALQMIKKSQHPLDTSVRLSQDFPKLAYQLATEWEDELDDKLARELSNAQARQIEGGRNAVWINGLLLEETEMDPFRLLKILRRERDTNSRFAARGLTPLQTMSLLAHPALASASAAGSGPAASGLVEASALGAIFDASDRQEDASVILWWNDLEKDRRYRTWGKSLRELLRPTYPGQMNQVARNLINVIFSLDLSLPASHALLSQQIAVYINRGLPVRFGLVPFIPDESSSRRGVALAASQAFWHLVERAGRARALAFHQELAKSSKLTLEVKDLREAYRAAIAGLQASADRPAPVTFDQLDSAGDVPDRLQEQLSVTEKWQTRLGLSDFLPTGSQYGQVFINGGYHLVDEDWRTRFQTAMNIQMQYLQQQVYMRVLDDSADVSVFFYDLDTSYGRRNKYIFPSEERPLRLLEPSQIDALFERAYTRDAFLTRSQNASAASVWVFGDLASKQGEAQAREAIKLIWARRHARICLVHTGQSTPADAELVHRLKLQWNLRVHGKGYDEMLIVELHNEPDKDEVDPNFLPSTSPDSRAFDAASPFAPGELGVVINGRVVGPFEDVGLLSEDLASLIEFEHKTRIQPVVKAIDAIAPGLLTGDSKTIAQTVAALSAYAAHALQPDSEQSMFGPSSKLRSTDYMVLNGSLTSTSSGNPSTAWLHLGAAIDPLSEVGQRWSAIVRELALMPGVSTHVFFNPSRTLAELPLKRFYRFCMSRELAFDSNGAELEPRAEFRGVPSSVLLTFGADVNPAWLAFPKKTVYDLDNIRLSDLPASAKQSGLEATLELESILVQGHARESPGNSAPRGLQLVLGTQGQQATVDTIVMANLGYFQLKANPGAWQLAIRPGSLGEQVYTMETAGNLGWKSPANRDSTISVYTFEGNTVFPRFVYKTGKEGTDLLSDVSAPPPKAKGDGMLGRLKQAVMGGHDAKQSVLAVTETDPTINIFTVASGLLYERMAMLMVISVLRHTKSKCKFWFIQNFLSPSFKAFIPHLAREYGFDYELVTYKWPHWLRAQKEKQRTIWGYKILFLDVLFPLDLHRVIFVDSDQIVRHDLQDLIDMDLKGAPYAYAPMGDDRKEMEGFRFWKSGYWQNHLAGRPYHISALYVVDLDRFRQVAAGDRLRQQYQGLSADPGSLANLDQDLPNNMIHVIPIHTLDQSWLWCETWCSDESLKDAKTIDLCNNPMTHEPKLARARRLIPEWNVYDAEVAALAKRVAATADPAEAQAFAVDAGGLEQAKLQQKEYVDEGTAGDAPVDGATTPDEHRKDEL

SEQ ID NO: 4497 - protein, 1664 aa, Trypanosoma brucei
MSCCTLRSNEIRQLIVFIFVASIHCHVLTVEGKGVYVKVVAPWTETPLLQEGCEAVASLTVPVGTQTHDDAPSGFYKCLEDVWLRAEATNRSGGARTMTQKEQYDVLMDIMQSNKHPPHHVAFLTTKLAVRMHSPTVEAHRQLAGRAINRTGGCAAEGRPFALIGNKAFCDEHKLAKELELKGPNGSDATGGKADGETELNADNAMSVIANLDHVHPHLNGPNLVIMYGIVGEGQTMRLLQAVKRHKQTTKLVFRHLPVSGNQWNDMLAVQGYGVSVDIKSTEYRAVDDRIAGESTANLQHKPGRRDVLGAMGSGEEHLLGGFNISLLQRRYPDQSLQLSHFEDAVGKNIEQGVKVDLHSWEKAHIGIAAAQYVMDPSRKPLHALLDVLTNFPNYASLLSRMSFVAAARKDPKFVRELDAIGRSMYHGASHVFLNGCAVTTENINLFYMMEKIEEYERLLDTLSTILVSRSELHSSDDATRNGNTDMTDVVNGLARIQFQGESLSGGSGDTTARVWLPQDAVTWFNDVENNAYLYRLPTTLRSMLRNGAAAPTLPRRNVLHVVCIADPTTYEGMGTIFEVARRAQQPIRFGVVFVDKNWSPEVTLVGKKFDKVAVSDASKATLLVAATVWELMQGEADPAAVSDFLMAMTREMMAKQTITELSVKMITQSVLMQARKRAVDDVVLDPAFITHYEKTQKMVRTLGFSKFPVVLLNGRVHTDISIVLQHGIWEEFAHLQKLVEMGALSDDDDNLYESVLELSGARTRYVAALFENKTFADWSHNSVLSFLHKYPFIYPSTSGMNEVSLVSGVLTLHVPVTAQSLQATLNAVRSLLLCKGADETCGRTRLTFAVCGTSLKTNSRTVVDDLHLLLQHCGVADKSECLNLLQEFLLSTFEHSHPGWQLDDPKKYEHVLKGVKFSDQLQALFRASAEGSTRDQAGKPNQLFLLASEFCREMTGSVSAVHEITPGSVHYYVNGRLFVYDNFTEEDFEVATLEGGHTPKKVWNVLEEATFVGMDPGLEIPGSDQNFYASRIAAVVAALRRDAANNDRREEQKTRLPVSPGPLSFVVGATEKRVPRHRLTVVVDPVARASQQLVSLCNYISQLSIGAVCTVYLNPSLTVGNTIRNYYKFVGELQLRFDAEGRVVAPKAVFSHLPDKHLLTLGIEEAEYWTVFPMEAEYDLDNIILSRLPPSSKYLYATYRINSILISGSAEDDSTGGPSSGLPLQIRSSLYNHTSGSYTNTTRDTIVMTIKGYFQLQSTPGLWYLGVQPGAIARAFYISHHNDVPVLDVAIGSVGRHFNYTAGQSIPVVVSSFTGSFIRLGISRTAGFEEASIESIAAATVVASNAEWPPKGPRSERPKFPTLNIFTVASGHLYERFLRIMMHTVMRTSSDVHGANTTRIKFWLIENFLSPQFKELVPLLAEHYGFDVGFVTYRWPWWLNKQTEKQRTIWAYKILFLDVLFPLNVDRVIFVDADQIVQADLHELYNMNIGAAAMAYTPFCREYPNDATTNFRFWDQGFWLSHLRGKPYHISALYLVNVQRLRAALGGDKYRATYARLSEDPGSLANLDQDLPNFMQDEMPIFSLPEEWLWCETWCAGESKARAKTIDLCNNPLTKIPKLENVRRIVDGWDEMDRELEDLSKQLLEKRNAELRDGAEKKKDKES

SEQ ID NO: 4498 - protein, 1508 aa, Leptosphaeria maculans
MRAAASLLSARTFLALSTYAHIAASERQSINVALRAAFNPAPYLVELLETAAEENATAYYPILDRVSQGYFDDKNTEQDLYTAFVDLLRNDGHITEPEALASFNFALSVRSAAPRIEAHYQFYKTSVEPSLAAEQTTDCELWVSFHGKQYCSPTLEEPLGGIKSERTYELPFDRILGNSSALPAILYADITAPRFKKWHETLSETARQGKTSYRIRHKPSSKAPQSPLIVNGYGVELQLKRTDYIVIDDRPKAEGDNVADQKPLGTVLDEQEEITDLKPLSKEEVADLGPKAASFVMQSEEPMDTLLRLVQDFPKYSTIIASRNASENFLKEHFNNRELLLPTGYNIIWVNGVQIPARDVNPHSLLAHLRRERKLINGIRNQGLSGPDTISLLSHQAIAETQTEDEPQRYDFRDAAEGGNVIIYMNNIEKDSRYESWPTELRALLQRTYPGQLPSVRRDIHNAIMPVDLTSAGEVSIILDTMLSLIKRGIPVRWGFVPQTTTPGSLDQAKVIYYLQNSYGLSTVIKYLTASVNAKKLAAPNKTIFDTTVKGAKLRNEREALELADVLTSEAIQARIDASKQYLHRLAADKSNAPMFVNGVPIPLTEDWLSILSQRIGLDLRQIQKGVFESVISENSWVPQHFLFQAATKRNPLIIPEDEKNIQLINMAEFEELYGKALSSMPRVAATDLSSKSEWVHITLVADFDSKSGLALLKSVADFRDTKPNAEIVLIHNPQPGSMQSSASETLLDVYGNLGGEVTSEALWAVANEPADTRATREESRTLWKTVEPIYEALGLAPGQHGILVNGRFIGPIPEDQVFSLGDVETLVTYEMAKRIQPLSKAIEDLGLAQKLKTPFEVAKIQSLVALSTVSDVPEGIFETVSTLRISTFNNWASEHTAITKGDQDKAVFQIVASIDPASELAQKWVPILNTLSDMDGVQLKLFLNPRQSMQELPVKRFYRYILGARPHFNADGSVGHLKAQFSGIPKDALLNLGMDVSPSWLVAPEESIHDLDNIKLSSLPARTNIDAIYGLESILIEGHSRDTTNGGEPPRGAEVVLSTEKDPHFADTIIMANLGYFQFKANPGFYNIQLKSGRSREIFNLDSAGTKSYAAQPGDETTEIVLMSFQGATIFPRLSRKPGQETADILASEESLTSELVGKGTHKVNKLLGKIGLNFNSEKVLQKGAELLSGGKSGKKGTQADINIFSVASGHLYERMLNIMMLSVMKHTKHTVKFWFIEQFLSPSFKSFLPHMASTYGFEYEMVTYKWPHWLRGQTEKQREIWGYKILFLDVLFPLDLEKVIFVDADQIVRTDMYELITHDLEGAPYGFTPMGDSRTEMEGFRFWKTGYWANFLRGKPYHISALYVVDLVRFRQLAAGDRLRQQYHQLSADPNSLSNLDQDLPNNMQFQLPIHSLPKEWLWCETWCSDEDLATAKTIDLCNNPQTKEPKLDRARRQVPEWTVYDEEIAALAKKVKGEAGVKAVEVDIQEEEQRREKREKDEERKRDEL

SEQ ID NO: 4499 - protein, 1485 aa, Amorphotheca resinae
MGVFSLPWSLTGALLASTYLPSLFACASPSINVGLQASFSSAPYLLELLETAADENATSYFPLLDRIADGYFSKASTDKELYDQFIQVLKDDGHMSDPETLSVYQFALSMRSSAPRIEAHYQYYHTAVEPSLKVEQDTTCPEWVLFDDKQYCSPALDAPHQDVSDNSQIEELPFDRVFGNPSAPVSILYADISSPTFGQFHKILVKRAREGKASYRVRYKKAISPESKPLIIPGYGVELALKRTDYIVIDDRKDNEAKPSEAVSETEVKFEDEEFADLKPLSSSELLDLSVKTSSFIMQSEKPFDTLIKLSQDFPKYSSAVASHNATAEFLAEHSYNRGRIVPAGFNVWWMNGARLTDRQIGALSLLHLLRKERKLVKGVTDLGFTGKEAIELLTDQAIAAVNADDEPQRFDWRDEIEGGNAIIWLNDLEKDKRYADWPTALPAMLQRTYPGQLPPVRRDCFTLVLPVDLTSMQDVYVIADTLISFVRRKLAIHIGIVPITKTARAEDQAAVLYHLLDTYGLTALSEYLEASYNSRSVESASKSVFESTIKKKKPRANKATQSFEDVLESEEYRSQVQASKKWIRRLAADSTIPPMFVDGVALPRGENFLQTMSSRVMADLQSIQAAIYEEYFKADAWLPSYFLAQAAKKRNALVVPEDESSLRIFDVNNLLGGNDEFVKTLPRVEADPSSAKDDWGHMIVIADLDSEAGKKLLSTAILFHKTNPSVELTVVHNPASDTTNFAVSNLLFSHVRDHSYQAFQDADDLAAILTADVSKEKNVAQQEADEYWQGAKFLVKSISFRPGQNGLLLNGRLVGPVTATSELDLEDFEQLLSYERSNRISPVYAAVKTLGRADSLVDPLSAAKISSIVATSMLPGTPDGIVEKDSTARMSLHGLWNSSHTAIEVGDISTATIQMTLLVDPASEQGQKWIPIIKALSELEGVYVKLFLNPKERLQEIPVKRFYRYVLGSKPTFDDSGALQSLGASFTGVPQDALLTVGMDVPPAWLVAPKVSVHDLDNIKLSSIKTDVNAVYELEHILIEGHSREVPTGGAPRGAQLVLGTKRDPYFADTIIMANLGYFQFKANPGFYKIQLQEGRSSEIYNIESIGSRGWLPVPGDESTDIILMSFQGVTLFPRLSRKPGMEGKDVLEEKADSTLDIVSRGLSFAQGILGGKGKDAEKETHAEINIFSVASGHLYERMLNIMMVSVMKHTKHTVKFWFIEQFLSPSFKDFIPYLAAEYGFKYEMVTYKWPHWLRHQTEKQREIWGYKILFLDVLFPLSLDKVIFVDADQIVRTDMIDLVNHDLKGAPYGFTPMCDSRTEMEGFRFWKQGYWEKFLRGLPYHISALYVVDLKRFRQMAAGDRLRQQYHSLSSDPNSLSNLDQDLPNHMQTILPIHSLPQEWLWCETWCSDESLKDARTIDLCNNPLTKEPKLDRARRQVPEWTVYDDEIAAVDRKRKGLDGNGEKKAQSGTVEVKTEKRTRDEL

SEQ ID NO: 4500 - protein, 1476 aa, Penicillium antarcticum
MKMGSRISWRWYAAIGALAGCIANANASPAVNVALQASFDSAPYLVELLESAADENSTAYFPLLDRIADGTFEDLTTEEELYNRFLTVVQEGGHLRTPESLSSFKLSLSVRSSAPRIEAHYQFYNTSVQQSLGAAQDAVCPVWVHLEGKQYCSSALERAQQDVLDAQDPRELPFDRVLGDISLPPAVLYADISAPMFKDFHETLSDMAKQGQISYRVRYRPPRHWVSRPLFVSGYGVELALKKTDYIVIDDRAAEKLDTETNADRETKKDAPDDLRPLSASEVARLGINSAKYVMDSPDPLEALIKLSQNFPKYSSTVAAHNATGEMLQEIRHNRAKMLPGGYNVMWINGVQIDTRQIDAFSLLEHLRRERKLIEKFRSLGLSASDAVKILSHQILTEAQAGGEEQRYDYRDDSEENQVIIWLNDLEKDSRYEGWSSELEAYIAGGYPGQLPPVRRDLHNVVVPVDLSDPESMMLIAGNLHAFIKRGIPVRFGLVPLSSSPESAAQLKVAHYLFDAYGLDSLVKYLEAYATKGKRGSPDKSCFVAATKEHQLIGDHPALSLDQVLKSEKYNALVSHTAAYQRRLSLTGDEPHFLVNGIPVSREGNWMQGMSMQISRDLKLVQQGIVEDLFEGDAWLPEFFLAGAFKRRNTFLMPEDPKSVRIVDLANVLGSDENVLNRIPHITSEKSALESVHMIVVGDFEAEGVALLTEALNLRKEHTDVEVFLLHNAASDDVALPKNLVMVYRSLAKGESIDQVLAKLSASDDDAEVPEIVVEELSAVQELHQRLAKELGFEPGTEGLVVNGRAVGPVEKDYPLTVDELSQLIAYERLKRLDPVALAVAQLGFQTKISSPLDFAKLTSLVALSMISDVPEGIFENTPDFRMDVSDKWRTVYSVITVSNSDDPAINVAVVLDPASEVAQRWLPIIKVLSELSGVQLKIFLNPKEDLKELPVKRFYRYVLESEPSFTENGALARPQASFTGVPVEALLTLGMDVPSSWLVAPKESIHDLDNIKLSSLKAGTDVDAIYALEHILIEGHSRDLTTKTPPRGVQLTLGTEKNHYFADTIIMANLGYFQFKAQPGLWQINLKPGRSEKLFNIDSVGGLGYRPQPGDESNEVALLTFQGRTLFPRLSRKPGHEEEDVLETGIQPGSTKDYFAKGLNFASGVLSSVGVNTKTNDQQADINIFSVASGHLYERMLNIMMVSVMRHTKHTVKFWFIEQFLSPSFRAFLPSLAKEYNFSYEMVTYKWPHWLRSQKEKQREIWGYKMLFLDVLFPLSLDKVIFVDADQIVRTDMHDLVTHDLQDAPYGFTPMGDSRSEMEGFRFWKSGYWSNFLRGKPYHISALYVVDLNRFRALAAGDRLRGQYQMLSSDPNSLSNLDQDLPNHMQHHIPIHSLPQEWLWCETWCADEDLGAAKTIDLCNNPLTKEPKLERARRQVPEWTVYDDEIAALAKRVAGVEDAAGVEFVQSGEEKKDEL

SEQ ID NO: 4501 - protein, 1323 aa, Torulaspora delbrueckii
MFLCSFIANVIFWLRLTSALDLNGAGIGVKEQAKVWSILGFLIQGEQRSILVDLYPFVTGLEDYESDIECEDCDLPTIVSGILSTEYGMKDIAALLPIYSNLYPMGMLKDDHDTSNESRFVLNGKQYVKSDDVFYLKSKELQKQAEFSDLEVTQPNEVIIGNNKEAPIVILYGCPDEAGEFEEFNRNLYNEATTSGKLRYIWRSSCPLERSHITGVPVSFTLRNQSSPAALPIESLDVPEEFTNRLPSFETPTAEELSGIDLKVAKLVADHYFKYRDFHSTLSYAKGIINNLPLLLQQLAKLDTNTSEISKSNERLSDLGISYDMLGIYVNGQNMRLSEVDRYNLLSAVVSEYLRLSHLGAALQTADKNCTLATAKQLLQEFSRLSLPNLEELQPIKVDLHRIPGFSESVIYFNDIEQDGQYDELGTEIQKFFGKSKFGEIPEYRQNWNEVIFVIDFGRLDDQEAKYALDGLNRALKAVAQGYPQRVGLLPLNTGSAEGIINDIYRLKDKDLNELMEFLETIPTPDFSSKSYDKAPNYSRILNELQIHETSIIVNGEIYPFKKNSWHYLIAKVMKKDKAFLKKELLKFGSKKELTDIDVRGLLHLRSSNTRHGKYAPDYFVDSSYTSLDNSVLQLFGGRVLEYTKGKDYLALHTVTLFDDFSCSQALERYKHILETSFVGVRVRIIHRGSLKDHTWNKLKIILSNELDMAQIDSLIKTSKTSYSVPEVSKDDISRWLVDFSDESLSDGAFLVVNGRFIILDNEEVPSKNQFEAIIKREAKRTLDTLKALEIVCPSTLEGEISPDFTEMVSATLTKLFYHGAQLYNNGIDYTPEGFLPRINVNLEFNNFTVFESHSDEKPVDVSLFLDPTEERSQTLLSLVTFLEPIPFVNLRIVLLPTEDLKITPVNRIYLDDSSDVVIEEESKKEYQVELDVPSDFYVTNTSQLDGVIVEVHAFKKGELISESKIDGVGGVCLELVDPQNNVVANCITMTTFGYGQLRAKSLGTGFSIRSCDPRFRVTSFASNGRSDYVRSTTFPLLSLNKAKVHVEVEEISGAKMVVDSDSDEMHIFTILKDNGEDEEKTQKMIISVLLNAKNRKVKFWILDQAFLTKSFKEFCQRITQSTDFEGSVEFIKYKWPLWLRPQRFSDRRMDLYKVLFVDVIFPQNVSQILYMEPDSSPIDPTELYDEEVSLPFSLLEASGPGYWDSGYWAKTLQERRAKFHTTDPAFLINLQNLRKLEMGDKLRIHYQRLSADRNSLINAAQDLLNDLQVEVPINTLSPLTKSRLKVDDEEVALWLDGGSFEEELNEELAAEELRGDLIHDEL

SEQ ID NO: 4502 - protein, 1360 aa, Myotis brandtii
MAQAWLRYAPHPPFMNQASNEFMAEESNEKFWQFLDTVKELAIYKKRESGYSYYNLILKKAGQFLDNLHINLLKFAFSIRAYSPTIQMFQQIAADEPPPDGCDAFVVIHKKHTCKINEIKKLLKKATSRPRPYLFEGDHKFPTNKENLPVIILYAEMGTRSFSKFHTVLSEKAQNGEILYVLRHYIQKPTSRKMYLSGYGVELAIKSTEYKTLDDTQVKTVTNTTVEGEIETNEVQGFFFGKLKERYSDLRDNLTAFQKYLIESSKEMMPLKVWELQDLSFQAASQIMATPVYDALKLMKDISQNFPIKARSLTRISINQHMKKEIQKNQQDLHNRFEIQPGDARLYINGLPVDMDALDPFRIGFVFIVNTDDEVDGTNDAGVALWRTFNYIAKEHDVLQAFISVTHMYQKVKNQNILTVDNVKSVLQDKFPHANILDILGIDSRYDNKRKAGASFYKMTGLGPLPQALYNGESFNHEELNIQKLERALLQKMMDMTIYLQREVFMGTLNDRTNAIDFLMDKNNVVPRINPLILYSEGQYLNLISTSVTTDVEDFSTFFFLDSQDKSAVIAENMYYLTHEDEDVISSITLWIIADFDKPSGRKLLLNALKHMKKSFHSRLGVIYNPTSKINEENTAISRGILAAFLTQKNSFLRNFLRKLAREETATAIYSGDKIKTFLTEEMDKNAFEKKYNTIGVNIFRTHQLFCQDVLKLGPGEMGIVSNGKYLGPLNEDFCAEDFSLLEKITFTNLSEKIKGIVENMAINSKKKSDLVMKVDALVSSLPTRESRHNVKFLKENHSIIKINPQENDMFFDVIAIVDPLTREGQMMAQLLIVLGKIINMKLKLFMNCRDKLSEAPLKSFYRFVLEPELTLVTNDLIEPVAKFLDIPESPLLTLNMITPEGWLVETVHSNCDLDNIHLKDIERTVIAEYELEYLLLEGHCFDRTTEQPPRGLQFTLGTKSQPVAVDTIVMANLGYFQLKANPGAWILKLRQGKSEDIYQIVGHEGTDSQSDLGDVIVVLNSFKSKILEIQVQKKPDKIKEDILTDEEKTGMWDSIKSFTRSLHKEKDKKETDVLNIFSVASGHLYERFLRIMMLSVLRNTKTPVKFWFLKNYLSPTFKEVIPYMAKEYGFQYELVQYKWPRWLHQQTEKQRIIWGYKILFLDVLFPLAVDKIIFVDADQIVRHDLKELRDFDLGGAPYGYTPFCDSRTDMDGYRFWKKGYWASHLLRRKYHISALYVVDLKRFRRIAAGDRLRGQYQALSQDPNSLSNLDQDLPNNMIYQVAIKSLPQDWLWCETWCDDESKQRAKTIDLCNNPKTKEPKLKAAARIVPEWVEYDTEIRQLLDHLENKKENAILTHDEL

SEQ ID NO: 4503 - protein, 1794 aa, Chlorella sorokiniana
MAAPRRAAAARRAAAAPPLLALALLLAMVGSTAAAQLEPKGAKIALRAKWPGTPLLHEAAEFLADEDSALFWRFVEGWQASAAAQLGAAPSPEQCWAGIRSAAAPHLSAGMARLLDASLAARQYSPRLEMFRQLAEASRGEAAPGGSEAAAAPRCCWALLGGKAFTAAAPLAAAVEAALAAAPGSNHEVEEDGAGAVYSFDHIYAPPGNAAPPLNITAPGTIPVELFAPVGARCAGELHAVLAAAAARSEAAAAAAAGGKPAPPRLAYAWRPVLGDSGSACAAAGEVHPCTRLGTEGPLVLPGFGVELALKNMEYNAQDDSKKPAGGGEEKATEEEAGDEEAAAQAEGEGGGEGDKGGAPAPASEDGVMKVKLKALGLQAAQRVLNAATVGGSGIAALDALQEAAQDFPRLVEQLSGLKYSKTLRMAVEGLQRFIPPGSQFFLLNGLVYNTREFNLYAFLDALRREVRLCDALRGAGLPPAQLREAMLLRGTVAGSNEPPRLRLPSNEFVLWVNDLERDEKYASWPHELQSLLMPMYPGRLPTIARNVLTAVFLFDPATPAALEIGAVAYQLEQQGWPVRIGLVPVVPSRVARLRGSAGPKSHDPPSTSERMARLLSAVAQAHGAAAVTQLFYEVRSTMPPDQDEAEDFEQRLWGQVSMVVHARWSDWSEEEEEEDGAAQALEAATAADGGEALAAIDPAAAKLLDGAAELAFSAGLAGPSRAGVLVFNGAVTVNDGSGWQSATVGALQMQMQIVQEDIYMQRLTDGVKDVHEEILRLHGAIPRYNPRIMPLDGGGPGFLRISGESEEYPARQLALSGPLLGLNATAAPSGDGASSEGGLWARYFGPQPSLVDEDDEEPQGSQQQLAAVTHWVAADVTSRQGLRLVAAALQYRSSSGRLAVLVNSAAATAAAAAAGGSSKGQGLAPIERLLVAVSCGLLQTDLTDLADALDGVLQQAEAPGILSLEQLDELGQFGGRLAADLDALSDKLPAAAASQARFVRSALGLAPGACAVVTNGRLLELPPPPPAKAEASTHEEEHSLEAHDFELLELYAAQHQYSAQVAALVRAAQQAGALAGADASAVAAVVSSALAAATPEEVDQRSGRVADLVQRQSQQRNALALPRPSASSGTQGTDTEQGSPSDENEVAPPPVVVHAVLNPLSKAAQRLAPLIGFLQELLDAEALVLLNPKREYDDMPLKTFYRYVLPHLPPAGTSASGQASAAPAPAAAEFSGLPPNKVLTLGMDEPEPWLVEPVEAAHDLDNLRLQELGDAPTMEATYELEALMLTGMCLDLASLAARIRDQIHPRGVQLELAALNAPAAAPPLVDTLVMSNLGYFQLKSRPGLWKLRLAPGRSQELYTIASSTGASSSGQKAEAAVAGADAHQVPVALSSFSGKHMHLFLRKDAARLTEDVLTGNATDGGSKGSLWDRVSAWRGGGSGKGGAPAHLDAEAGDEGERETIHVFTVASGHMYERLQKIMILSATKRTPARVKFWFIKNYMSPQMKAFVPYMARKYDFDYEFVTYKWPSWLHKQTEKQRIIWAYKILFLDVLFPLGLKKVIFCDSDQVVRADLRELWHMDLQGAPYGYTPFCDNNRDMEGFRFWKQGFWRDHLQGKPYHISALYVVDLERFRQIAAGDRLRVMYDGLSKDPNSLSNLDQDLPNYAQHTVPIFSLPQEWLWCETWCGSETRPQAKTIDLCNNPLTKEPKLQSARRIIAEWPDLNREAEEFTAAVERVQRGELSEAALMADQSLFHVKLTPMAEGVAWSSGEAGQQAQQAQQAGSGSGGDGSGHEEL

SEQ ID NO: 4504 - protein, 1524 aa, Rhizophagus irregularis
MVLKKLKYNTLLLVSYLFCIIFIVSKAETPPVQTWLKTSWDAPHLLLEIIESVSVENSTAYYPLINEFINLGLFSSELTYHEMYNTALDVIESKQYLSTPTSISILEFSLSLHTTAPAIQAYYHYYNTTVVPSKHEPDINFNPECDVWVDWYGHQACNVEIFKELTGISSTGKFDKLLNSSDQHPKLLSFDHILSSNAETTKPLIILYADVISPSFVPFHQFITDLVDNEEVEYVLRYKPPRGSRNSLHLAGYGVELALKKTDYIVIDDREVETGRGLIEKLSEHLFDENISEIKPLTASAIRELGLKATQFIISSQNPLLTLTHLSQNLPKYSYHIAQLNLNSSLKQEIKINQNYFGLDSNSFWLNGLTVDPSSVDPFSLLKLLRRERQNVLSLMSLNMTSQQAVEFLASPIILESKSSQELTKGIFDVRDKSEKQNIIIWFNDIEKDKRYSNWPPRIFDILHPIYPGHMRYIRKNLFNTLFVIDLSSVKSLEVINEINLFIERNIPIRFGLIPLVVKEKNESIIMAKIFYYLIDQYTMPLIMQFSSQVLNELKNSPSANIVKIAEKQFNNVINDQTPKDNTSVKSFDDIIKSDTESSLEEQILGATEFINKFRIDADGKGKGALFINGKYFDLDDNYQRDMIQTITEHTGFIQQKVYVGEISDHTNVFEYFMTLPRVPSRRNPHVFVSDSQPLNVINLVKNDEKLSSIRYIYSTKQDGNEVPVSLLLITNFDSEYGAKQGLEALKYLDESSNARVAFIHNPSTQPSIREDISLSSLIYLILHKSQEIPISNYESTNPARSFGWQFADKVKSQTYWKEWNSFTRKTLKLNENDTAIIVNGRVVGPFIKEDLFVVDDFNLLVELEFSERIEPVINAAKAANLTIHLDRSNYPDFVNKATSIITASMTSDVPVGLFGGQELKRDLSFKKLKSENSKIVVGDIEAAIYKISVLIDPLSETAQKWSTILEILSQIDGVAIELYFNPKMNLAEIPIKRFYRYVLEPKLKFNTTTGNLIAPSAHFSNLPEDPLLTLGMDVIQAWLVTPKVSIHDLDNIRLANLDSRLRIKGVESVFELNNILIEGHARDMTLQAPPSGLQIVLGTKNNPVMVDTIVMANLGYLQLKANPGIWTFSLREGRSSEIFDIQSAGSEGWYSRNVEEIGNEIVLNNFEGLIIYPRFTRKPGKENEDVLKLEEKDGIWNYFMDKFSKNVSKQNKAEINIFSVASGHLYERFLSIMILSVLKHTKSRVKFWFIENFLSPSFKDFIPHMAEEYNFEYELVTYKWPHWLRAQKEKQRTIWGYKILFLDVLFPLDLDKVIFVDADQIVRADLKELVDMDLQGAPYGYTPFCDNRPEMDGFRFWKHGYWKDHLKGKPYHISALYVVDLQRFRHMAAGDQIRGQYQSLSVDPNSLANLDQDLPNNIQHIVPIFSLPLEWLWCETWCSDESLAGARTIDLCNNPMTKEPKLDRARRQVPEWESYDKEIATFAAKISQSQKSFITESNIQSKSTIEVSSESKIPVKTEKHEEL

SEQ ID NO: 4505 - protein, 1604 aa, Sorghum bicolor
MAPARGVRSGGSAAAAALVSVLLVGCLVAGGEGAEIRRQKNVQTALRAKWAGTPLLLEASELLSKEWKDLFWDFIDHWKELEKGSECLTAKCCVQKIVEDARTLLNEPLSSIFEFSLTLRSASPRLVLYRQLAKESLSSFPIDDSPEQISGHGTGKTFDGAVDPNSSGGTCCWVDTGNVLLFNSADLHEWLGGLGKLAMDSTEQPELFDFDHIYPRTNITAPVAIFYGAVGTNCFKEMHVQLAEASKQGKVRYALRPVLPSGCGTTSTFCGSVGTVDAVTLSGYGVELALKNMEYKAMDDTAIKKSVPLEDPKTEDLSQEVRGFIFSKILERKPELNAEIMAFRDYLLSSTVSDTLEVWELKDLGHQTAQRIVQASDPLQSMQEINQNFPSIVSSLSRMKLDDSIKDEIIANQRMVPPGKSLMALNGALINIEDLDLYLLMDMVHGELSLADQFVRLKLPQSAAHKILSAPPPAESNSFRVDFRSSHVHCLNNLEEDDMYRRWRSNIQEMRYIRKNLFHSVYVLDPASACGAETIDMILSLYQDGVPIRFGIIMYSSRFINVIEESDGTPTNNGEDTSILITRLFLYIKETYSTQLAFQFLSNIHKSRNGEDDYNEELVEAHQVEGAFVESLLSNAKSHPQDVLLKLQKENVYKQEAEESSRFVHKLGLYKLQCCLLMNGFVHEASEEATMNAMNDELPRIQEQVYYGHIQSHTDVLEKFLSENSYKRYNPSITGNSAEKKFVSLFASYHQDSSVFNDMKYLQSPGTTDDAKPITHLLAIDLSSKVGTKLLSEAIRYLMDGSDRARVGLLLYVHTGGSSPILLLKDIFDRTIYSFSYKEKVLVFLHGLLKFYEAQPLPASSVADDWTRNMMEKVYTLAAETALPVDDYKAWFKSFSADTVLKGIDKLSDFLFGQLGLVFGSNAVITNGRVFIMNEGESFLANDLGLLESIEYDLRTKYIFEIIEEVEFAGVDPDDLTSQFYSDIAMLISSSMSVRERTSERARFEILHAEHSAIKLNNANSSIHIDAVIDPLSPIGQKLAPLLRILWKQIQPSMRIVLNPISSLADLPLKNFYRFVLPSMDDFSSTDHSVHGPKAFFANMPLSKTLTMNIDVPEPWLVEPVIAIHDLDNILLENLGDVRTLQAVFELEALLLTGHCIEKDRDPPRGLQFILGTKQRPHLVDTLVMANLGYWQMKVSPGVWYLQLAPGRSADLYELPPKLIAIDSLRGKLMHIEVQKKKGKEHEELLNAADDYHFQEKTDNKGWNNNLLKWASSLISGDASSKNKADKITDRKDARQGETINIFSVASGHLYERFLKIMILSVLKETQRPVKFWFIKNYLSPQFKDVIPHMAREYGFEYELITYKWPTWLHKQKEKQRIIWAYKILFLDVIFPLSLRKVIFVDADQIVRADMGELYDMNLKGRPLAYTPFCDNNKDMDGYRFWKQGFWKDHLRGRPYHISALYVVDLAKFRQTASGDTLRVFYEQLSKDPNSLSNLDQDLPNYAQHTVPIFSLPQEWLWCESWCGNATKARAKTIDLCNNPMTKEPKLQGARRIVPEWTGLDSEARQFTARILGDDVESAEATPPPSETPKPEDKDTDQEVKDEL

SEQ ID NO: 4506 - protein, 1595 aa, Plicaturopsis crispa
MLAAAGLVAISLALRQVIATGPPVKVSVRSSWPAPPLLLEVVESVAFERPDAFFPLLESVTNPENIPPQPHTPKVLYEHALRTALSTGYLGAPGALSSVELNLALHAATPKIEAFYQYYVDRYGEENGEEKCGGGSWVDWYGEAVCDIQGLEDAITKSEQEAEELVLSRPKVLPFDHIYPAPSETLSPPSRTAIFYASPDSARFWELHSFMLNLARSPGSDFEYIFRHMPPRDRDEGARNYLSGYGVSLDLKKMDYLALDDRHASSTENDSVDTGAAFQASTDTILALLDALPETAGEENTAPLTEDELLEIGLQATQLISTSPDPLTTLSHLAENFPAYAPRIARRVVVNSSLEEEVHANQLRAPAGVNIMWLNGAVVKEADISPFGLLRTLRKERGLITGLTTLGLTGAQAVEFISHPAVAAAQSQGAVVDGMFDASDRPEGGDVLVWWNDLTKDTRYKHGRWQTSIFALQRQMYPGQFHQIRLNIFNVVVSVDLSQTSSLHFVAGTVSNIINRSFPFRWGIVPNVETTAGRQMARLFYWLIDHYGRAKTMQFFKQIAQLQVPPQLLPPQVEWALVKKEFQTLVSENPLKKEDDEEEIVVDFGAIVGTGDEQDERIDKARAYGVRLGTDLASSPQGHAFVNGKHFDIDDTFLRYMQGELAQQLQFLQERLYEGSITEDTEPDIDTYFYDLSTTATRRNRYIYPSTGTLRVYNLFDLFSQAKFDASPSRFVNPPDSTQIPLSIYVVADLDSDEGVALMKEALQSMEPESKTRISFIHNPVNSSATVTDRPHMSWFLSHLISASLLPQTSPSHLLRALGLESIVDTHNNPQVVLAKDEGSLDKLTGGVGLNDIDAAEYASYEKSCRLVARELGLAPGEQALIVNGRIVGPFPAGEFLAEDLQTLETYELQRRAQPVLGALQTVLSPDAIFDRDTFANLVSIASSIVWSAQLPDPSENGLFDTPMRLRTRSYKLLEGNHTALEFGDEKTAICHISVILDPVSEAAQKWSTMIEWLASLPDVFVELHLNPARYKEIPLKRFYRYNLASRLSFDDDGKEIPAQTVFNGLPVEPIYTLGVEVLQSWLVRPREALYDLDNIQLGSLAPEHRRGGVEAIFDLDYLVVEGHARDTYTGSPPRGVQLELTDGKGKPIDDTQVVATLGYLQFKARPGVFQLGIREGRGREIYKMESVGNEGWHSPSVEEAGDEVTVTSFEGLTLYPRLARQSGMEDADVLADLDDADSEPQSLIKDVVSKVLSFFKFKQEEPKDIVVSDSDQADINIFTVASGLLYERFVSIMILSVMRNTNSTVKFWFIENFLSPSFLEFIPHLASAYNFKYELVTYKWPSFIRPQKEKQRIIWAYKILFLDVLFPMDLKKVIFVDADQIVRADLKELVDLDLHGAPYGYTPMGDDNEEMEGFRFWKTGYWKDFLRGRPYHISALYVIDLVRFRQIAAGDILRQQYQQLSADPNSLANLDQDLPNNLQREVPIFSLPEDWLWCETWCSKDRLHRAKTIDLCQNPLTKEPKLARARQIPEWEEYDSEIARFARKLADEGLIRSQAAAADANVLANVGNVAVPHEAGAETGEGDDSVDSVQRDEL

SEQ ID NO: 4507 - protein, 1519 aa, Malassezia vespertilionis
MRLAAWLVYLAWLAAAVCAQQCVRVRVQHPWYNSSAARSAPMLEMLESARAVWTDDYFSLLSMLWSENGIHTQLHVAYDDAPPAALYTAIEALLVYHTRSTDVFAEAHLDEWRANIALHSQAAMVAAQYQLYESMRLAAHAPGCRSWVHWQKKAYCSAAQLRAAVLHDLAHGAWAASNVYPDDAVYAPRIFSEHAPVVVLYADPYAPENGAMHAALMQLAKDAPLRYVLRWKPSYGRTGELAHAYIGGYGIALHLKKVDYLVIDDRAVGAAAEPMFDAASEASVRNAQRTFTSVQDELYAGSAQRASVAEAVAAQADIPQEYVAILGFAVSHLVLTSTDPLETLEELTRNFPAHAAGLVHYVDRMPVPNPILDTLAGEQAQAGMCAVWINGKEVDTHAFTPLGILPQLHAERSLLRMFAGPELGISPSDASALLTDKHLTRAFLGHEAALFDASDRVESRDAPLVAWINDLEAYADVWYTNLNVLLQPRFPGQPLMLASNFFNLLVLPDLGLPTAFRVLAGLVHAQADPLGLHIGVMPLVQTQRDETLAAVLWAAIERLPAPALGTLLDEYAERTAPLDPSEARAALREMLEVYSVALDEEDHAFFRHGTLPAATAHRIAMARAYMARLHIIPQGLGAAFMNGQAIPLDRRVLQTALGLQVEQTRLAAEAIMRGEISKEQAPTYFYDLPTTRKSRSKLVSAMEEDAHTYINLPHVFSALRNQDAADTSSQDTELNALRDFVYSGAAAPNVTVRVVADFDAPQGTALLQRVLAAAVHASVPFRVGTVHIPTKPVHSASLSHFLYCAQSQRALQKMPAHELLHALERAGGLDALIESYGIAKTPAAHADVFWQRAAKQFVQNGVDVRQGPSLVINGLALNNLDPASLDAAALNAGIAWEATQHAAPVVQAAPIECDAHSQNVELLASLLGTAFATPEAAHGNFAQAPPARINLTGIQSQNPAAFSIGDAGATVHVTLLLDPLADDAPGLVSTAQMLASLHDTLVTIVLNPAHTASLPLQKFSQFTAQPRPAFDSHGALVPTGIDMHNLPPSAVLTMELLAPRSLVAMPDAAVYDLDNLRLADLSTDRVEVVYGVKSILVEGYTSSGIARVPRGLALVLHAEDGQALDTIVMENLGYFQFRAQPGVWRMDIHAGRSKDVYTMTSTGTHSSEQGLSVAHLLGKTLYPTFAKRAGMENADLVTSLDVENSGAWTAFLQRIKHAATSAWQRTLPATTPHASINIFTLASGHLYERMTYIMILSVLRHTKSTVKFWFVENFLSPSFKRFIPHLAAAYHFEYQLITYAWPEWLNKQTEKQRIIWAYKILFLDVLFPLDLDRVIFVDADQIVRTDLQALVDMDLQGAPYAYPPMGEDSEDMDGFRFWRQGYWKNFLRGRPYHISALYVVDLKRFRAVAAGDILRKKYQMLSMDKNNLANLDQDLPNNLQTVLPIHTLDKTWLWCETWCSNDWLPLAKTIDLCSNPKTKEPKLDRARRQIPEWNALDEEVAALAKSVAEGGQALVHDEL

SEQ ID NO: 4508 - protein, 1538 aa, Quercus suber
MGSGTRLWLGAGLLSFICRIDAVPAVNVALRTSFGAPPYLVELLETAAEENATTYFHLLDRIADGYFDDSTTDHELYTTFRGLLQEEGHISRAEDLSSFDFALSIRSTAPRIESHYQYYNTSTLQSSGEDCETWLHVPSKGQKYCSPELSEAHAHSMGRPSSSKLHLLPFDRVLGDASSQRPSVLYSDITSTSFRAFYKRLSRSARNGKSALVLRYKPPKAVVKQPLTVSGYGVELALKRTDYIVIDDRQAEQEPKGVSGSAETNLSEDEMSDLRPLSSSELRGLGMKAASFVQGSDSPFDTLHRLLQDFPKHSAVIAGTNISKDIVQEHLANRQVLLPSGHNMLWINGVQVMPRDVDAYSLLECLRRERKLIRGVRELGLSAHEAIDLLAHEAITASQTSQEAQRYDWRDETEGSNVIMWLNNIEKDKRYAEWPASVNALLQRTYPGQLPSVRRDLHNLVIPIDFASFADVELIVDGIQNYVKRKVPIRFGLVPTGTSSASVGQTKLVYYLLDRYGLGAALSYLEQSLVGAGRKYSAPQEKYFAKAIEDRQIRNNRSVLSFEDVLSDASVANRLNKCADYLSRLGHKPSSPSIFINGVPIAKTDDWLQAMSQRISQDIRVLQEAVYQKTVTDDDYLPDLFLTKASLRRNALISPEEDSELKHLDLGTLPEIADIPSMPFSEDTIERELVHVTLVDDFDTLEGFSHLMEALLFKRLHDNVELGVLYAQSDAATLRRKVQDYESMQSTELMQTLLYKYDASAKLALESAQVTDPGELGLLDRRTIIHTIFDSFPEVSAESTSIWPTFAEAVKSIGSKAVLINGRVVGPIPFGAEFTLDDFESLLSYERKKRLLSAALAIEGMKISAKAATPYAFARISNLIALSQVNDVPAGIFEAPSTARTSMFKSWVAEHTAIKLGNADTANIQIFASIDPASETAQRWLPVINTLSKLDGVYVCLFLNPKERLEELPIKRFYRHVLEPKPTFTSEGALEGLSARFSGLPADALLNMGMDLPPSWLVAPRDSVHDLDNIKLSATKTGHDIEAVYELEHILIEGHSRDGTSGPPPRGAQLVLGTQLDPHSADTIIMANLGYFQFKANPGIYNLAMQSGRSEEIFQIDSAGSKYTAKVDDDTTEIALTSFRGVTLYPRLSRKPGMEEEDVLEASKSGLETFAEGADKLLAQAGIHNSEASRLINQAAKFGSSLFSGSVAKSATTHHHADINIFSVASGHLYERMLNIMMLSVMKHTKHTVKFWFIEQFLSPSFKDFLPAMAEEYGFQYEMVTYKWPHWLRGQKEKQREIWGYKILFLDVLFPLDLDKVIFVDADQIVRTDMYELVQHDLEGAPYGFTPMCDSRTEMEGFRFWKQGYWKNFLRGLPYHISALYVVDLKKFRQIAAGDRLRQQYHQLSADPASLSNLDQDLPNHMQMALPIHSLPQEWLWCETWCSDEALEDAKTIDLCNNPQTKEPKLDRARRQVPEWTVYDDEIAAVAKRHNSKMAEGKPVAADAGSAGVQGQEEESVQEKLQREDAEREKKARVRDEL

SEQ ID NO: 4509 - protein, 1478 aa, Colletotrichum spinosum
MVRPYQLPMGIALTLLAASNVAAVPSVTVDMKAAFPSGPYLLELLESAAGENATSFFPLLDRIASGHFSDSKTDKEVYDKFLQVLHDDGHITAPEALSTFKMALSLRTAAPRIEAHYQYYQTAVVPKLESDAQDDCEVWAELGGKQYCTPSLDAGKDTKLSEAKALPFDRTLGSGNEAVLYADPTSSSFGAFHSALAQKARHGEFEYRLRYTKPANSYKEPLPVSGYGVELALKRTDYIVIDDREAHSDDSQKTVTSEGVLDAEEEVADLKPLSKSELEQLGLKAASFIMQSQNPFEALVRLSQDFPKFSTSIAAHDVSENFLTEHQQNRQQLVPSGMNVLWMNGVQLIERQIEAFTLIDILRRERKLIDGVRDLGFSGGQAVSLLGHPKVADSKADDEPPRFDWTDDLEEGKVIIFLNDLEKDERYAEFPTNLMSLLQRVYPGQLPPIRRDIFNLVVPLDPSNADDLNVLSQLNMFVKRKLPIRFGIVPLTPTKEATAITQILYYLLDSYGFDAFFEYLDTVVSESKTDKPSKAAFEKAIKDKELLAEATAVAFDDVMQSEGAQQVTKLAQHWAKRLNANTAVPPVFINGVPVPREGNWLQAMSVKAANDLQSMQRAVYLNMVDEEMWLPDFFIEKAVKRRNTYIYPEDDKSLRILDVNKIYTDHEGLFKNIPVVDALAESTKENWAVLTVVADVTSEEGANLLLGALAFRRNNPGVRLDFLHNPSDVSAASAVNAALKASDKLAEAKSVADIKSTIEAAGSDTDALYAAALTNFLSFAAIKPGSSVLILNGRVVGPFTEEEPFQPDDFQYLLDFEQKSRILPVYAAVDELGLTDKISGPLAAAKITSVTALSTISDLPEGIFESAPSMRVSAYDTWNSTHTAIEIGNPETSSIHLVGLLNPASEQAQRWAPILKVVSELEGVYMKLFLNPKDKIDELPVKRFFRYVLESEPTFDEAGNVRALEASFEGLPSEALLNAGMDVPPSWLVAPKVSVHDPDNIKLSSIKTNVHASYELESILIEGHSREGKTSSPPRGAQLVLGTEKEPHFADTIVMANLGYFQFKANPGFYNIQLKQGRSSDIYTIDSIGAKGWTPVLGDEGTEVVLMDFQGTTLYPRLSRKPGQEDTEVLAETNEDNSIVGRGLKFAGGMLGKKTKSVSDEEHAEINIFSVASGHLYERMLNIMMVSVMKNTKHTVKFWFIEQFLSPSFKDFIPHLAEEYGFKYEMVTFKWPHWLRQQKEKQREIWGYKILFLDVLFPLSLDKVIFVDADQIVRTDMISLVNHDLEGKPYGFTPMCDSRTEMEGFRFWKQGYWANYLRGQPYHISALYVVDLRRFRELAAGDRLRQTYHSLSADPNSLANLDQDLPNHMQFQIPIHSLPQEWLWCETWCSDESQKDAKTIDLCNNPQTKEPKLDRARRQVPEWTVYDDEIAALDRKRKGGLPAEEAKKEEPVVEEKNTKSRNWEEPPAKETHVIDELY

SEQ ID NO: 4510 - protein, 785 aa, Trichinella patagoniensis
MILIQLTFLLEILKKYSVDMRIALIHNPKSEAQATKGTASLVQACIQFLPLYQSKAVIGKIFANKIATLEDLINVSPSGISWPEFKKAYNSMSDIWMQLHVHYAKFVLNLDPGVGAIVANGKVLAPLSASDFNSLKDFNFIERYLLTSGCNDIAQHLKIIPYLDKSPKALSDLVMRLYAFLRRYNANEKRHWPIIENYHHSCVQIEASDPTAAQFDIVAIVDPLSPAAQKMSHLLVILSSVLNVHMKVCMNCKSKLSEIPLKNFFRMVLPRELEFADDGSLKTQPSARFSALPQKQLFTLNIIAPQSWMVESVEAVYDLDNIKMEEVKGDVVAKFQLEYILLEGRCFDERSGSPPRGLQFTLGTFHEPFMFDTIVMANLGYFQLKANPGAWILALREGKSAEIYEVKSVDGVVQNQTTSVVILDGFSGRMIHVKVAKKNDQLENELLAESEDAESESLWQSISKTFQSGEKYDVINIFSLASGHLYERFLRIMMLSVLKHTKTSVKFWLLKNYLSPGFKEFLPYMAGHYNFSYELVQYKWPRWLHQQTEKQRIMWGYKILFLDVLFPLDVKKIIFVDADQVVRTDMLNLMELDLEGAPYAYTPFCDSRKEMDGYRFWKQGYWENHLAGRKYHISALYVVDLKKFRQVAAGDRLRGQYHFLSRDPNSLSNLDQDLPNNMIHQVKIKSLPQEWLWCETWCDDKSKKFAKTIDLEPKLQSAMRIIEEWKDYDSEIKDLLDQRTKDKWNITEQKIVDIGFQFTAYFLVFLEESWNRAMNKENQVQDNQS

SEQ ID NO: 4511 - protein, 1247 aa, Kluyveromyces lactis
MVLFRLRIVFLLLTVLHITQAFNEGIGKRWLSASLVDYDALSTDQWMQLYRKITLSDEEEDEEDEDDDEGIEESISSASAEKVQQVEGLSGAISKYVQIAPIDDEFKETCFVLNGKIYSKSDDSFYFKTSELDAQALVPDFDVLKDREIAIGTNASAPIVVLYGCETDLEFADFNRNLYNEAKFGKIRMTWRPTCIIGDTPEYALSATLSDKNWDQKANVHLVIDDSDLKIKDPVKLKYLDQKELEDLDMKFTALLLEKFNEDHDFDSFFEYFKSLSYNFPAVAPVIASKDNIDTTPAKNIVKDFNKRKISHELLGLYINGQQWRLSELDETTLPAILAKEWSRVNDLKEKLSKFPGAELENFLKYFTVGYSYTAYFDKNRYDFYRTPGFSEAVVFFNNFEKDELYKDLPEDNMAFLEPSDFEPIPSIKQNWNELIFFINFDDMTQFKDDGAVGSLLQAIDQMETGYPIRLGLIPFSSSGSNSVVDMIYKLKSESDKPLQSIIDYLRTLIGHSEKIQPQTKHKGSAYDEYLERFKIADTCIAMNGVLLPFQAKAWKIHTSRILSADIEYLKSELQALGDSSNLSVRQLLHHRSLTLKNPVYIPNRMLDETFTRVNNRALHVLGSRTIIFSDPNQKTSPIHTITLVDDFNSYSAVQKIRALLRNNHKSVSFRLVHVGDLSKSWDNFKMEFSTGKLSGKIASKTTVNFIVDPFLNVLSSWLPDISIKALRKPFAVINGKFFNTDDDLYSVELWHNILVHHSSRTLDVLKTLHHIGALDENIMNPSAIEELTAAVIKYVHHGYLVLNNGIPYTTESSMPRVSLSELEEYTITSRSDQSVINVTLLLDPVEERTQRLLYLSSLLKDLPFVKTEVALVPTANLTLNPVHRFYNASTGISDNGFLSEFDYPHNINPDDKSIIIEAHVFDEGDDVSIDIIDGLAGVCLQLMDNAGNVIDKGLSMKSFGYVQLSLPSLQKGLKLENCDSSYEITALSTMAEANYIEVESFDVDNSLPTQIHVKVRKTTAEIMNEKDDRVNVMVVVHDGQESVAVKRIERVKKEIGDKAKFYILAQRPKLIVREMPASVDYHLLTYTWPLWLRPQRFSAKELEAKSILLLDTMVPKNVDYLVVLSLTDDSSDTIPWNDIASFSDAVFYLKPAKTKEGSYWNFGYWKKYLQKYDLPFYDLSSSYIINMKKWREIDAGTSLRLHYHLLSKSFISLNNFRADLVNSIQLKVPIAPLEEHTDELFEQDEL

SEQ ID NO: 4512 - protein, 669 aa, Rhizopus microsporus
MLYQYENAKRIMHVEKAIVGSEKNLKNNTPDAVMKLTAIIENDKAQATQDVIESREPVHRRRQYQKIPRTQYTQFTAGSYSDDTFLEIGLIIDPLSEAAQKIAPIVHTFSEIEGVSVVTYLNPVSTLQELPLKRFYRYVFDKEPHFDTNTGEKQVPTAYFANLPVKPLYTLGVETTNAWHVTVKEANMDLDNILLTSIPDNQHGISAVYELQSILVEGHCLDSINKSPPRGLEFELISPSGLDKKDTLVMANLGYFQLKASPGIWKLALREGRSSSVYSIQDVGANGKWNWNTEFNGSKGIDDTLALISFEGLTITPLVHKNPGMEDEDVLEPAQPKPKENTGGLWSSINQKIFGTKETEITSPSVNKATNAEINIFSVASGKLYERFLSIMMASVMKHTKSTVKFWFIENFLSPEFKDFVPHMAKEYGFDYEMVTYKWPAWLRAQHEKQRTIWGYKILFLDVLFPLSLDKVIFVDADQIVRSDLKELIDMDLHGAPYGYTPFCSDRTEMDGFRFWKEGYWKNHLRGKPYHISALYVVDLVRFRQLAAGDRLRAQYQQLSADPNSLANLDQDLPNNMQHIVPIYSLPQEWLWCETWCSDESLKKAKTIDLCNNPLTKEPKLDRARRQVPEWETYDKEIDELRKRIMAGGSSSLPKQDEPSIKKHLKDEL

SEQ ID NO: 4513 - protein, 846 aa, Odocoileus virginianus
MDNFFVDDYARFTVLDSQGKTAAIANSMNYLTKKGMSSKEIYDDSFIRPVTFWIVGDFDSPSGRQLLYDAIKHQKSSNNVRVSMINNPSEDISYEKTRISRAIWAALQTQTSNSAKNFITKMAKEETAEALAAGTDIREFSVGGMDFSLFKEVFESSKMDFILSHAMYCRDVLKLKKGQRAVISNGRIIGPLEDSEFFNQDDFHLLENIILKTSGQKIKSHIQQLRVEEDVASDLVMKVDALLSAQPKGDARIEYQFFEDRHSAIKLKPKEGETYFDVVAVIDPVTREAQRLAPLLLVLTQLINMNLRVFMNCQSKLSDMPLKSFYRYVLEPEISFTSDNSFTKGPIAKFLDMPQSPLFTLNLNTPESWMVESVKTPYDLDNIYLEEVDSIVAAEYELEYLLLEGHCYDITTGQPPRGLQFTLGTSAKPVIVDTIVMANLGYFQLKANPGAWILRLRKGRSEDIYRIYSHDGTDSPPDADEVVVVLNNFKSKIIKVKVQKKADMVNEDLLSDGTNENESGFWDSFKWGFTGGQKTEEVKQDKDDIINIFSVASGHLYERFLRIMMLSVLKNTKTPVKFWFLKNYLSPTFKEFIPYMADKYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQHRFQEEKEMGVLYGDKTAKEARREGPQTHEEL

SEQ ID NO: 4514 - protein, 1714 aa, Fomitiporia mediterranea
MRSLKSRGKAWARCACLGLASSCVASIAAGASPPVRVSLHTSWPAVPLLLEAIESVSTEEPGAFFPLLDALVNSDSLPSLDTLSPEAIHQATLKTATLLGYLQDPESYASVELQIALHAAAPKVQAFYQFYVDQKYPTLGEECGSWVEWYGERVCDLDTLVRFAGHEMIDADEQITNTTYIRPKLLPFDHILPDPSRSLEPPPRTAIFYASPTSRNFRELHSYLYKLASTPKPRVEYVFRHIPTLPDGDESIGKSYLSGYGVALDLKKTDYLAVDDRRSASRDPLDGDASTEVQDEEIDLIKTLLDQYPESSVTDASSSLSEEELRIISIKATQLVANSSDPLTTLKHLSQNFPKYASGLSQRIILNNSLVAEVLDNRMKAAGGVNMMWLNGITVQETDLTPLGLLRILRKERGVVQSLTSLGLSSGQAVDLLTHKAIGLAQSESAEVLDALFDASDRPEGGDAIVWWNDLTKDSRYAKWNPSLTGLLRQLYPGQFHNVRQNLINVVLVADLSQMSSLNFIAGPVSNIISRNFPIRFGVVPSAETEEGKKMARLFYYLINSFGRAKTMGFLSRVGQINVPPQFLNPEVDWDLVRREFAELQRENALLEDEEKRVPVVDFDSILDGSYEEPKSEDESESESRAEAETEAQIEITKPTIGEQIERAHLYAQRLDATPASCPSGHAFVNGKHFDLDDTFLKQLQNEMSMQIQFLQEKVYMAEISDENADTIDTYFYDLPSTDLRRNRYIFPSTSSKPGPLGSVSGLRIVNVPEMFEKSGFAPGSGAYLYPESEEVLETTFIVADLDSEGGIALMREALRSLESSGTVTRLSFVHNPSLDTTTTHNPQRHISPIISHLIAHDLLSKISLKEFDVLLSPETSSFSSGNSGSSTDQLVLSENSVVYQLLRDVGVSMDGLSDAEAHERYTVASGLLVRELGIGLGELSIVVNGRIIGPVEPFDFTAADFTTLENYELRKRTKPVIEALTNLTITSEGRNRIEYGHLVSMASSVISAVQLSDPSEQGLFNGNLRPRQRNYRHLAGNYTSFSFGDPETAAYQFGVLVDPLSEAAQKWSVFLEWLSAIPSVYIQVYLNPGVYNEVPLKRFYRFNLPSRLSFDENGAEVEAETVMDNLPIEPLYTLAMDVPPAWLVRPREAFYDLDNIQLSTLSPEDREHGLSAIFELDYIVIEGHAREGLTVMPPRGLQMQLTSLDGSPVADTQVVLNMGYLQFKAKPGVFQLDIREGRGRDVYELESAGNEGWNSPNVSVAGNEITLTSFEGLTLYPRVRRRPGMENADVLDEFVMGEEGGKGLFSDIASRVVSFFRPKGPIVETIAPTQADINIFTVASGLLYERFASIMILSVLRNTQSTVKFWFIENFLSPSFLEFLPHFAEAYNFQYELVTYKWPSWLRQQKEKQRIIWAYKILFLDVLFPMDLKKVIFVDADQIVRADLKELVDLDLHGAPYGYTPMGDDNVEMEGFRFWKTGYWKDFLQGRPYHISALYVVDLARFRQIAAGDILRGQYQQLSQDPNSLANLDQDLPNNLQREVPIFSLHEDWLWCETWCSKDRLHRAKTIDLCQNPLTKEPKLSRARQIPEWEEYDAEIARFARSLADAGKIRSHIAAADSNVLASSIGANGGTTNANANSDDNGGEDREGDGVGEGDGTWIVRLPTSMFEHKHLDHLNLQHHDQNPVYNPIDISTNYTEYANPHQKAYGNFSKCI

SEQ ID NO: 4515 - protein, 1577 aa, Trichomalopsis sarcophagae
DEDVHHVNADVSEREPVDVSGRSSLFYRYVPLDDGELCFVNGGELAPSKKSRNVDKNHVWVDCMWIFLLLCPLLVNVNSAYAEKKINKYVTTLIDAKWKDTPLVLEVAEYLNDENPNLFWRFVDEVSGRSSDFEKSAKAKDHYDLVISIAEKFLSAAEIAVMKLGLSLRIYSARVEMFSQMAENKEISNLECHNFIDAGGKFTCSVDEIQELMNQEDLVPIDTYSVDHFYLGKQHTDKTLVLYGQMGTDGFTLLHDKLKSLAETNKLNYILRHYVKERPDRRLRLSGYGVELQMKSTEYKATDDSDIKDNEERAEEDTDESDEIDGINFATLKKLYPDEHKKLNDLQTYLLENSHEIGALKVWQFQELSHQAAERIMNSPASEAINVLTDISQNFPMQAKSLIKTKVSNDMKKEMKMNQEIFSGSLNIQPTETALFINGLFFDLEAIDVLTLLESLRTELRVMESLHKIGFGSKKMGKLLALDLSNSVDSRDFAIDIRDSAVIWVNDIENDFRYNRWSPSLTELLRPTFPGMLRNVRRNLYNLVIIIDPLSEESAPLVALAESLYAHSAPLRIGFVFLTNFNMTETGTTDPSIAINNAYHYLNDAKSSKEAMLFLSSLSNYIGPDGLEVNDVKKALKAKDPKANVNYVLGEESEYDVGRHLASDFIKRTGFKKFPQVLLNGVPLPSNQLNADSFEEAVLSTIMSQTPMIQKAVYRGEVTEGDDVVDFLMNQPNVMPRLNERVLKAEKNNWLNLIGSLPTDTDYKKWSSQDISTWLMENLKYLYIPRKTVTNHLYTLWIAADLELPAGRKLMKEALDYLESNTDARGSLIINSESTSKPESNINKIALAAISALPVEKSFDYIRNLINNETFELIQNGEFVIEDEKVKEQLKQQELLISVQQHYAKHILSLSSNGRIVVFNGRILGPFDDDEEFTSEDFALLERFSQSTYGDKLFKYLMKSQLFDDDEYEKSDVTDDMIMKITSLLVPRPQTRSRFDVPFHGDEHSAIKIPAANPDDVAFSLIAVVDPVSRGAQKLGPILNVLRHSLNCDIKVFLNCVDKNSDMPLKSFYRFVLEPELQFTSNGDIVGATAKFTKLPTSSLLTQYIHAPENWLVEVVRSVYDLDNIKLDNVAIGVHSEFELEYLLLEGHCFEALIGNPPRGLQITLGTEKQPVMVDTIVMANLGYFQLKANPGEWLLKLRQGRSAEIYDITSVDGLDVIHKGNNVKVLISSLRSNVLKLKVTKKPDKAGVDLLADDEKGSGIWDSISRTFTNSEEGDEQDEKINIFSLASGHLYERFLKIMMLSVIKHTKSPVKFWFLKNYLSPTLKDFLPHMAKEYGFEYELIQYKWPRWLHQQTEKQRTIWGYKILFLDVLFPLDVKKIIFVDADQVVRADLKELATMDLGGAPYAYTPFCDSRREMDGFRFWKQGYWRNHLQGRSYHISALYVVDLKRFRRVAAGDRLRGQYQALSQDPNSLSNLDQDLPNNMIHQVAIKTLPQEWLWCETWCDDNSKKYAKTIDLCNNPMTKEAKLQAAMRILPEWVGYDEEIKALQQKIENENRQTEKEEEHNGPDSDKHEEL

SEQ ID NO: 4516 - protein, 1487 aa, Trichoderma asperellum
MTRHRWRPWNLIVGSMLALQAHSAPSVNVGMNAAFPAGPYLLELLETAAAENSSSYFPLLDRIATGYFASASTDAALYEKFLQVLQEDGCLSSAEGLSTFKLALSLRSAAPRVEAHYQYYSTVVSPTLGEGPESECFNWVLLDGKQYCKPELEEVIKDGLLSLQNKHLPFDRVLGAGREAILYADITSETFGEYHKALSKAAAEGSLSYRIRYHRTQTTPRATLHMSGYGVELALKKTDYIVIDDRLQDEESHHQNIGAGAGLDDSEDVADIKPLTASDLSSLGLKATSFILQSDDPLETLVKLTQDLPKFLTSIVAHNVSTRFEKEFKLNSLKGVPGGLNLLWLNGVQLIERQIEPFALIERLRQERKLIDGFRALGLNGKQAVSILGHQDVSTAKEGGEALRYDWTDRLEDGRVIIWLNDIESDDVYEDYPKSLTSLLQPSYPGQLPPIGKNIFTLIAPVDFSNPEDVSYIMQLISFISRGISIRFGLVPLISTPEAIVKAKIVYHLFENYGINGLFTYLGQLEDATKLTNEELFARITGDHAPLVDSDKMSLAEVLEADTYEQQLGFAQQWIKRLKVDTPIRPVFLNGLPIIRDENWIQELGMQIGEDLRVVQKGVFLGMLTDDDWAPGIFLNKALSRRNDYITPDDEGKGLTVLNINKIYIEHADLFSNIPVLEFASESLKEDWSAATVIADLTTTSGKGLVLSALEFKRRNSGARIEIVHNPVSSDGAASINAALMANLGSLGDIQDISELSDLMQTPIEDKNKDGYFEALQRFLGASKVPLGAQMIMLNGRMIGPISEDSEFDVDDFQQFLEVEQARRILPILKAVEELGLVDKLSTPLDAAKITSIAALSTISDLPEGIFESATSARTSLYDKWPSTHTIEKGDPEAASVHIVGLINPVSEQGQRWAPILKVLSELEGVHLKLFINPPEKIEELPVKRFFRYVLKSQPTFNDEGEVKGLQATFNGLPSEALLTTAVDVPPAWLVAPLDSIHDLDNIKLSAVKTDVHATYELKHILIEGHSREGKASAPRGAQLILATEKEPLITDTIVMANIGFFQFKANPGVYSIRLKEGRSSEIYEIESIGAQGWNPVPGDNGTELALIDFQGVTLYPRLRRRSGMEAEDILQEKDTQDNNIISKGIKLAESLFGGKSKTKSLSEREHAEINIFSVASGHLYERMLNIMIVSVMRHTNHTVKFWFIEQFLSPSFKEFIPHMAEKYGFKYEMISYKWPHWLRQQKEKQREIWGYKILFLDVLFPLSLDKVIFVDADQVVRTDMINLMNLDLEGAPYGFTPMCDSRVEMEGFRFWKQGYWANYLRGRPYHISALYVVDLRRFRELAAGDRLRQQYHSLSADPNSLANLDQDLPNHMQFNIPIHSLPQEWLWCETWCSDESLVEARTIDLCNNPLTKEPKLDRARRQIPEWVAYDEEIAALHQIYKGEAAVTPGKERLSEGGEETAEVGAEDKNTKSRRLESDGTHTKDEL

SEQ ID NO: 4517 - protein, 1406 aa, Chaetomium globosum
MTWPSELRLQGSARASDEGGLEAPRLLAGLFSHAPRETAASENATVYFSILDRIAKGHFVEAKTDKALYEKFIQVLRDDGHMDREALSTFKLALSMRTAAPRVEAHYQYYATAVEPSLSEDQDGCGQWFYVDGKQYCTPAIGDVHRAVTENNQGRPLPFDRKFGTGARDVILYADITASDFGTYHETAMKIAQSGEGAYRVRYRRSPAHPSEALSVNGYGVELTLKRTDYIVIDDRNTGAAKASGNEAQKPIGSSEVVLDDEEVTDIKPLEKSELASLGMKAASFIMQSESPFETLLKLTQDFPKYSTSLGAHNVSAEFRAEHEDNRKVLVPEGMNVLWMNGVQLIERQIQPFGLVDLLTRERRLINGVLDLGLTGQQAISLLGHTDVAHAKSGGEEPRRFDWRDEIEDGRVIVWLNNLEKDKRYQDFAPSIWALMQHFGQGLPQYSRRLVPIRFGLVPLTPTGEAIEQAKIVYYLLETHGLSAAVSYLEKSLEHQKTAKPDESIFNEAIKDRPLRPESTVLSFNDIFTSESHEKQIHLAKHWVERLRAGGEVPSVFMDGFAIPRDENWLRAMNQKLMGDLQALQQAAYFGQVNDGTWIPGRFLENAITRRNTLIFPEDAKDLKVLNVNKVYTEHHNVFDKVPVIEADDQSTKEDWAALTVIADLDSLEGQKLLLFALQFRSEHSGVRVDIVHNPKDVARPASQLTQRIKARESDLAAAIQLLDLETILESGKAETDAAYDTALASFIADFSLKEGDNALILNGRVAGPIVSAEEFKKEDFVQFLEAERASRILPVYKAVEDLGLGDKILGPLDAAKLTSVTALSGISDLPQGIFDQASSARTAAFNELKGAHTSFQVGDSSTATIFFVAVINPASEVGQKWAAVLKVLSELEGVHLQVFLNPADELGELPIKRFYRYVLESSPSFDDHGKVSVDDLDNLRIKDIKAKRGTDHIEAVYQLENILIEGHSRELPAGQPPRGVQLVLGTEKDSQFADTIIMANLGFFQFKANPGVYNLRLKEGRSSDIFTMESLGAEGWTPVPGDDSDEIALMDFQGTTLYPRLRRKPGMEEEDVLEEANTDTATGAAGAAMDFVSKGLKFAEGLLGRGKPTAETTNSLATTQHAEINIFSVASGHLYERMLNIMMVSVMRHTNHTVKFWFIEQFLSPSFKDFIPHLAAEYNFSYEMVTYKWPHWLRQQKEKQREIWGYKILFLDVLFPLSLDKVIFVDADQIVRTDMHELATLDLEGAPYGFTPMCDSRTEMEGFRFWKTGYWANYLKGHPYHISALYAVDLRRFRELAAGDRLRQQYHALSADPNSLANLDQDLPNHMQFQIPIHSLPQSGCGARRGAATTLSRRPAPSTCAITRRPRSPSWTGRGGRCSSGPSTTRRSLRWRGGEEEQRGQVERL

SEQ ID NO: 4518 - protein, 1517 aa, Postia placenta
MHGRKAQSGTRPSLIIFGSHALSPPVQVELRSSWPVSDSLLELLETIYIEESEAFFPLLNSLTNPETLPNPPPLTPEDVHRHALEAILADGYLSVPGVLAAVEMDLALHAATPKLEAFYQYYADRHASRLNETRQDCESWVDWYGEVVCDAETLAQLAGVETIDPPDLGDVERTYSRPKLLPFDHIQPHPDRTLDTPPRTAVLYASLSSRNFRELHEYLYAASTVASPHVEYVFRPIPSGNRDPAERVYLSGYGVALDMKKMDYLALDDRWQGIGLKATQLIHDSDEPLSTLIHLSQNFPRHATSLSRRVTVSEDVEAEVQNNHAKVAPGGNMAWLNGMLLQEKDMNPFGLLRLLRRERTTMLSLTSLGLSPGQAVELLTHDAIVRAQGQSSVLDGIFDASDRPEEGELLRPMYPGQFPNIRANVFNVVLAVDLSQSSSIHFLAVTVSNIINRNFPFRWGLAPIVETEEGAQMARLVSYLIEHFGNVQAMEFLRFISQADKPIEALAPTVDWALVRSTFSALMAQSEIPEGLATDLDKILAGAVDAPTINTDKARAYAQRLGVTLSSAPHGHVFVNGKHFDLDDAFLRAMQIEFGGQMAFLQEKIATGKLTDEELPNISTYFYDQPTSAKRRNAYIYPSGKTDDLQIFSLLDLVGKNGFPRQSESFVYPPESERVSLTTYIVADFDTKEGISLVKEVLTAVTSSYPSRVSFIHNPANLTKAPSTVETASSSLLAQLICQGILHHVPPSRLVETLGLEDASADEQSSQVVLPAAGSLDDILHEGTLSNKEYDDYVRSSRLIVRDLKLEPGEQALIVNGRVVGPFEPEEFVAEDLGALATYEMRTRVQPVIDALESIYEGLNDLDRASYTDIVTLASSIVSSIQLPDASGVGLFNAPEKPRQRRYQLLDGEYTAHIFGDNTTAMYHFGIVLDPLSEAAQKWSSLIQWLLHIPGVYTELHINPAVYGELPLKRFYRYNLLPRPTFHENGEEVHAKTKFIGLPVEPIYTLAMDVPQSWLARPREALHDLDNILLGALSAHERDRGVHAVFDLDYLVIEGHAREPLTHVPPRGVQLQLVTHAGTAIADTQVVANLGYLQFRTKPGVFHLEIRPGSGREIFEMESVGNEGWDSSPVDEVGNEITLTSFEGLTLYPRLRRRPGMDRADVLADAVEGSSAPKGLLTELTSRLSSIFAGHKNTDLASSGSGQADINIFTVASGLLYERFASIMILSVLRNTNTQSTVKFWFIENFLSPSFLEFIPHFAKEYGFQYELVTYKWPSWLRAQKEKQRIIWAYKILFLDVLFPMDLKKVIFVDADQIVRTDLKELVDLDLHGAPYGYTPMGDDNVEMEGFRFWKTGYWKEFLHGMAYHISALYVVDLVRFRQIAAGDKLRGHYQQLSADPNSLANLDQDLPNNLQREVPIFSLPEDWLWVCSKDRLHRAKTIDLCQNPLTKEPKLARARQIPEWEEYDGEIANFARRLAEDGRMRSEIVAADVNVLADVGAARVAPGSPIETQEHSRDEL

SEQ ID NO: 4519 - protein, 1614 aa, Hypholoma sublateritium
MKSALRLLVAAFSALQVAGSSSPPVKVELRSSWPAPPFLSEILETVSLENPDEFFTYVDLLTGPDGLVSSNTLSPEAILQTALEIGIDNGIIRDISVLNTIQMNLAMHAATPKLEAFYSYYDGTQGELGAESKYDKGKACGSWVDWYGKVVCDVETLAHLAGVEAIDPPKVSNTDAPQARPKLLTFDHIFPPPAAILERPPRTAILYASLTSSNFRELHTYLMKLTNRLDPHVEYVFRHVPPAAPSEARNFLSGYGVALDLKKMDYLALDDRNTNTEGGSRSTSKSDSEQEEEPVDPVLSLIFSHPENTSAPDASVPLTAEEFANLGAQTAQIITSSSSPLNTLTQLSQNFPKYMTTVARRVVVNESLEDGLHENSLRVQQGLNAMWLNGLQVEPKVVHPFGLLKLLKKEKGVIENLVAQGLDSTQAFEVLTHSAISEAQRGGAAMDAVFDASDRPEGGDVIVWWNDMEKDKRYARWSPSLLALLRPMYPGALPNIKANLFNVILVVDLSKISTLNFLAGAVSSIINRDIPLRFGMVPVSDSDDGRKMAKLFYHLITNHGRRKTLEFLSALAQLQLPPHMRTETVQWEAVRTIYDRLHQSEGEEKPEELIPTLASIFDDQPEETVPFEKIGLYADRLGATLSKSAGGHAFFNGKHFDFNDDLLRNLQAEVAVQIAFLQEKVYTGALADGNYGETMANWFYDLPTTNLRRNSYIYPSSTGGNLRIFNLPDVFGKTRFRASPATYLYSSAEFEAISESLYIVADLDSEAGRSLIKEAITSLTAESKTRIAFIHNPISPNASEKDIRPPTSWMLAHLHIRQLLSKATPASLLSALDLDGPVVPSESTQIPIGQRDAFKSLSGGISLSGILPEEYVEYVKTSRLVARTIQLVPGEAALVVNGRVVGPIAPDDFQKPDFAALEEYESRKRAEPVVKALSAVAPQLIEDKYLHADIVSMVASVVASTHQPDPSESGLFDAPPQPRQTSYKLLESNYTKFEFGDNATAIHHIAVVLDPLSETGQKWSGLITWLSSLPDIHVEIHLNPGRYNDVPLKRFYRYNLLQALSFDSNGQIVHPQTVFEDMPIDPIYTLAMDVPTAWLVRPSEALYDLDNIQLGKLFPGDNVVEAIFQLDYIVIEGHARESSTQTPPRGLQVQLVTGDGAQIDDTQVVANLGYFQFKATPGVFQLEIRPGRGRAVFKLDSAGNEGWESPTVEEAGNEITVTSFEGLTLYPRFSRLPGQEIADVLAEAEEEGSKGLFDDLSNKVFSMFKGKEDVVSTDVVTVKQQADINIFTVASGLLYERFVGIMILSVLRNTNSTVKFWFIENFLSPSFLEFIPHMAKEYNFDYELVTYKWPSWLRAQTEKQRIIWAYKILFLDVLFPMDLKKVIFVDADQIVRADLKELVDLDLQGAPYGYTPMGDDNTDMEGFRFWKTGYWREFLRGKSYHISALYVIDLVRFRQLAAGDILRGQYQQLSADPNSLANLDQDLPNNIQDQVPIFSLDEDWLWCETWCSKDRLHRAKTIDLCQNPLTKEPKLARARQIPEWDEYDTEIAQLTRRLAEEGKIHSRMATADANVLADAGAATAGSVKPPADVDPEHDPLGVAEGDAAASEGPSHDEL

SEQ ID NO: 4520 - protein, 1576 aa, Serendipita vermifera
MAPSTGIFAFLTACSSITLVTASVPVTVGLRSSWPAHNLLLEILETAAIDQPSRFFPLVDILTSPDAFPSPLARLSPEAIHQASLEIAQKQGYLADDSALRAFELALALHVSSPKLEAFYQYYEDRNLDRLPPPTGYLVEECASWVDWYGSRLCSSDDLRGVLSREGLEDGKNTTILPKRTKLLPFDHVFPEPESTLFTPPRTAIMYADVSSPNFRDLHEYLMASATTLPPKIQYVFRHVPPPKVTQGSPKREYLTGYGVGLDLKKTDYLALDDRRASTGGTTGDLIEASAEEAPRVDIIRDLLDALPLPENYDALNSTAPLTKDEFKYLGVQAAQLIVGSPNPIDTLMQLSEDFPRYATELARKLDMDGNMQLEMMKISRAIPRGASMAWINGKVIENVDEFNPFNVLNLLRAERSNVDALTSLGLTPGQAIEVMTGRPVYESFSQGNVLDGIFDVTDREEGGDVIFWLNDLEKDKRYGGWPTAIEAISTQIYPGSFHSLAINLWNVVMAVDLSNRESLIWIFQHVSNIINRSFPFHWGIVPLLDTPEAEKAARVFYYVYRHYGPKETMDFIRSLIAAQPEGESVDFLITNAFFNNLGINVLPLLKIELDQSVSHDYDTVIAGQEPHSIEQLEKARKWAKRIDVQAKKDQLGHAFFNGKHYPLDINFLGQLQQVCGAQTAYLQGEVQTGRLSSQSGVDMSTYFYDLPTTPKRRNRYLFPDADSSPLRVQRLDTLFRGAGFEYPYRDFIYPVAAETSAPLTVTTWIVGDMDHPSTTDLVNEALLALSQQKDFRLGFIHAPKVLPMSDATNTPRQSTILQQLSGHFDPISAEEMIDILKNGAQDPVKSREYLQFCMSGQLLAREIGLKPGEKAIIVNGRIIGPVTADVFKAEDFVPLIAYERQRRVDPLTKALDDAGFSASSLDRAKYADLTATAASIVAAIHIPDPTEEGLLQMPMRPRQRGYRLLDTKHAKTTHGTEATSTYHIAAIFDPVSETAQKWSSLLKWLSTLDSVYMEIYLVSDQTKEELPLKRFYRSSLRDRLAFDEAGEEVPAMVRFDRLPEEPIYTLAMEVPSSWLVRPRESEHDLDNIHLASLSPSERAVGVKAIFDLDFLVIEGHAREPASRSSPRGLQLQLVNHEFTPVADTLVVENLGYFQFKAKPGVFQLEIMKGRGEDIFMIESVGNAGWDSPPVNSDAGAQVTLTSFEGLTLYPRFKRHQGQTDSDVLRPRREGFISNAVQRVVSALSTWIQPPPVAQQADINIFTVASGHLYERFASIMILSVMKNTNSTVKFWFIENFLSPAFLEFIPHLAEQYKFQYELVTYKWPSWLRSQREKQRVIWGYKILFLDVLFPMDLKKVIFVDADQIVRADLQELVDLDLQGAPYGYTPMGDDNTDMEGFRFWKTGYWKDFLRGRPYHISALYVIDLVKFRQLAAGDRLRGHYQQLSADPHSLANLDQDLPNNMQAEVPIFSLDKDWLWCETWCSKDRLDKAKTIDLCQNPLTKEPKLSRARQIPEWSQYDAEIAKFARQLMIDGKIGSNALGAEVDALAGEKATPSAEGSAADEKVEEKPVTPHDEL

SEQ ID NO: 4521 - protein, 1551 aa, Sphaerulina musiva
MAKQRPWIAAAALVSLLAPTNAVPSVNVAVRSAFGAPPFLLELLETAAEENSTSYFPLLDRIADGYFDASTTDQQLYTTFRALLASEGHLGPEDLSSFDYALAIHSAAPRIEAHYQYYNTSVVPTLSKERDGYAGCETWVYVPFSGQKYCSPDLDEKSAERLGQPGSASVKHLPFDRVLGDVTSDKASVLYADVGSESFRKFHGTLSKTAREGKTSYRVRYRAFEGVESRPLTVSGYGVELALKRTDYIVIDDRQGDGEEGKEKDDGKNAVETTLSEEEVSDLRPLSQSELRRLGVRAASFVMASEDPFKTLLKLSQDFPKHSTSIAATDVSKDFVDEHTANRNILLPSGYNVMWINGVQIMSRDVEAYALLEHLRRERRMIRSVQEIGLSAVEAVELLSHEAITEAQVHQESPRYDWRDDAEGGNVIIWMNDIEKDKRYMDWPESVTSLLQRAFPGQLPSVKKDIHNLVVPVDFAEYNDVYLVVEQLRSFVQRKVPIRFGLAPWVRSEASGEQAAIVIYLTENYGLGAALSYLEESIAAAGRKFGKPSEKIFESVKAAGKLRPNKKDLGFSEIPNESTLVARLSRAKDYISRLASTDPVPPVLINGVPIARTEDWMQTMSQQITIDLRSLQQAVYEGTLGDEDYLPTMFLDKASLRRNPLVVPEDEKSLRYINLGEHPELAALPGIPADAQTIERELVHLTVVADLDSKRGLEQLMEVLLYQRDHDNVEVAILHIPHEGETHKIVASDLTKAGGDASLKALLQQYDDIRGETSIPEGSSDLETRRNVLYDILYQKVSRETSPEIDEQVRSAWAPFRDLTTAVGVTSGKKALIVNGRIVGPVEDDVSLGISDIETLLAFERKRRFLPAALAIEALGIQEKASTPLAFARITNLIALSLVSDVPEGIFEAAPTVRSDVFKNFNASHTAIHIGDPKTATIQINAAVDPASEAAQKWIPIIKVLSEFDGVYVRLFLNPRDRLEEIPIKRFYRHVLSSKPAFETDGSLAPTGAQFRGLPADALLNMGMDLPPAWLVAPEVTVHDLDNIKLSAVKSDVSAVYELEHILIEGHTTDVTVGPPPRGAQLVLSTDADPHFADTIIMANLGYFQFKANPGIYNLGMQKGRSEDIFHIDSTGATGLNEQATDNTTEIALMSFKGVTLFPRISRNKGMEEEDVLEPSKSALESLADGAGDLLAQVGLGNGAQKFLGKAASLLSKSNSVNAAAESKKQHAEINIFSVASGHLYERMLNIMMVSVMKHTTHTVKFWFIEQFLSPSFKDFLPVMAETYGFEYEMVTYKWPHWLRGQKEKQREIWGYKILFLDVLFPLDLDKVIFVDADQIVRTDMYELVTLDLQGAPYGFTPMCDSRTEMEGFRFWKQGYWKKFLNGLPYHISALYVVDLKRFRQMAAGDRLRQNYHQLSADPNSLSNLDQDLPNHMQSLLPIHSLPQEWLWCETWCSDASLKDAKTIDLCNNPQTKEPKLERARRQVPEWVEYDEEIAQVASKYRAAKKVGESLQHDGVLGEESMQERLQREDAEREEAKRKKEEEEKRGRDEL

SEQ ID NO: 4522 - protein, 1567 aa, Patagioenas fasciata
MAAAEASCPEAAGAARAGRERGGRGQLLKTFTLPGSSRIGCFYKMGILITVLGIWFGSSLVKGDSKAVTTSLTTKWSSTPLLLETSEFLSEEGQEKFWNFVEASQNVKISEQDGSDYSSYHEMLKIACQTLSPLQQNLLKFSLSLRSYSATVQAFQQIAADEPPPKGCTLFFAVHGEKTCEFDSLGNLLQTASERPKPFLFKGDHKYPVSNPESPVVILYAEIGSEEFYKHHKSLVSKAEAGEITYVLRHFISNPSKEKVYLSGYGVELAIKSTEYKAKDDTQVKGTDVNATVIEESDPIDEVQGFLFGKLRQLYPDLTEELKELRKHLVESTNEMAPLKVWQLQDLSFQTAARILAAPPVDALMVMKDLSQNFPTKARAITKTVVSSELRAEIEENQKYFKGTLGLQPGDSALFINGLLIDLDTQDIFSLIDVLRNEARVMEGLHRLGIEGLSLHNVLKLNIQPSDSDYAVDIRSPAISWINNLEVDSRYNSWPSNVQDLLRPTFPGVIRQIRKNFHNFVLIVDPTHETTAELLNVAEMFFSNHIPLRIGLVFVVNDSEDVDGLQDAGVALLRAYNYVAQEMDNNYAFQTVMSIYNKVKTGDQLKVQHVVSVLEKQYPYVEVNSILGIDSAYDQNRKAARGYYEQTGVGPLPVVLFNGMPFQKDQLDPDDLETVTMHKILETTSIFQRAVYLGELSNDQDVVEYIMNQPNVVPRINSRILMSDREYLDLTGMNNFYVDDFARFTTLDTKDKTAAVANSMTYLTKKDDSFVRPVTFWIVGDFDKPLGRQLLYDAVKHLKSSNNVRISMINNPSEDPNSKNTLVAKAIWAALQTQTSNNAKNFITKMAKEENAKALEAGADILEFAVGGMNTNIFKEAFESPKVDFILSHAIYCRDVLKLKKGQRAVISNGRIIGPLEDGEMFNQDDFHLLENIILKTSGQKIKSQIQQLGFEEDLASDLVMKVDALLSAQPKGEARIEYHFFEERYSAVKLRPKEGETYFDVVAIVDPVTRDAQRLAPLLLVLNQLINMNLRVFMNCQSKLSDMPLKSFYRYVLEPEILFTADNNFALGPIAKFLDMPQSPLFTLNLNTPESWMVESVRTPYDLDNIYLEEVDNVVAAEYELEYLLLEGHCYDITTGQPPRGLQFTLGTSTNPVIVDTIVMANLGYFQLKANPGAWTLRLRKGRSEDIYRIYSHDGTDSPPEASEVIVVLNNFKSKIIKVKVQKKLDMMNEDLLSDGTSENESGFWESLKWGFTGGQKNEDVKQDKDDVLNIFSVASGHLYERFLRIMMLSVLKHTKTPLKFWFLKNYLSPTFKEFIPYMAEKYNFQYELVQYKWPRWLHQQTEKQRIIWGYKILFLDVLFPLAVDKILFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAMRIVPEWQEYDQEIKLLYSLFQKEKETGTPAEMPGQHTHDPAAHVEL

SEQ ID NO: 4523 - protein, 1603 aa, Morus notabilis
METRFRSGFCVLIVLVFVGLCGVRSVCAENRRPKNVQISVQAKWSGTPLLLEAGELLSNEWKDFFWDFIEVWLHSENDDADSYSAKDCLKKILRHGRSLLSEPLASIFEFTLTLRSASPRLVLYRQLAEESLSSFPLTDETTQNSLGEGISETNEQLQTKKSDPLSVGVNPKSPNGKCCWVDNGGTLFFDVADLRSWLQSSSDPAVDSFQQPELFEFDHIHVHSSAGSPVAILYGALGTDCFREFHFTLVEAAKEGKVRYAVRPVLPSGCEAKIGHCGGVGTRNSLNLGGYGVELALKNMEYKAMDDSTVKKGITLEDPHTEDLSQEVRGFIFSKILERKPELTSEIMAFRDHLLSTTISDMLDVWELKDLGHQAAQRIVQASDPLRSMEEINQNFPNIVSSLSRMKLNDSVKDEITANQRMIPPGKSLMALNGALINIDDVDLYSLVDLVHQDLSLADQFLKLKLYGFASERLYNKRVSEFVQILMPVFPGQLRYIRKNLFHAVYVIDPATICGLEASLRLLSIDMITSLYENSFPMRFGVILYSSNLIKQIEKSGGEINTSVDDNGLNEEDLSSLIIRLFLYVKENHGIQTAFQFMSNVNKLRIESDGPDDDAMERQHVEGAFVETILPKAKSLPQDLLLNLQREKTFKELSEESTMLVFKLGLAKLKCCLLMNGLVFDTNEESLMNAMNDELPRIQEQVYYGHINSHTDVLDKFLSESGISRYNPQIIADVKPRFISLSAFILGDEVVLNNVNYLHSPGTVDDLKPVTHLLAVDVTSGKGMKLLHEGLRYLMKGSKVARLGVLFNCNHDADASSLLFMKAFEITTSSFSHKKNVIDFLDQLSSFYENNFLPMSSEASGSTPTFIDKVAEIAVANGLSSKTYITALSDFSAENLRKHYNKVTQLLYRKFGLESGGSAVITNGRVMYPSDGSTFLSHDLHLLESVEFKQRIKLIVEIIDEVNWQDVDPDTLTSKFISDIVMLVSSSMAMRDRSSESARFEVLHAQHSAVILGNENSSIHIDAVIDPLSQTGQKVSSLLRVLWKYVQPSMRIVLNPMSSLVDLPLKNYYRYVVPSMPKKKKKSSSLDDFSSIDQTIDGPKAFFTNMPLSKTLTMNLDVPEPWLVEPVIAVHDMDNILLENVGDTRTLQAVFELEALVLTGHCSEKDHDPPRGLQLILGTKTTPHLVDTLVMANLGYWQMKVSPGVWYLQLAPGRSSELYDFKESGDGNQQKPLSKRITMDDLRGKVVHLEVVKKKGKEHEKLLVSDDDDSSQDDKKGNSWNSNLLKWASGIIGGSEQSKKSKSTLVEQGKRGRHGKTINIFSIASGHLYERFLKIMILSVLKNTNRPVKFWFIKNYLSPQFKDVIPHMAQEYGFEYELVTYKWPTWLHKQKEKQRIIWAYKILFLDVIFPLSLEKVIFVDADQVVRADMGELYDMDIKGRPLAYTPFCDNNKDMDGYRFWRQGFWKEHLRGRPYHISALYVVDLKKVRQTAAGDNLRDLPNYAQHTVPIFSLPQEWLWCESWCGNSTKSKAKTIDLCNNPMTKEPKLQGARRIVSEWVDLDLEARQFTAKILGDQIDEATPPQSQDPITADQSPEDLESKAEL

SEQ ID NO: 4524 - protein, 1442 aa, Rhizopus stolonifer
MTAPRILQAILGLVTVGLCTLKTEAQTPTVDLTMVAPWAVPNFLVEVAETVATQNETAYFSFIHDFIALEKKSSSWTPSQLYSEVVSVISFLGNDNTNFFKAALAIHEAAPRIESYHQYYRESVTPTLSQYDDQCGTWIQIGKQQFCSIESFKEYKGSYLPIEVLAFDHVVRPKNELKKVPVLVLYTDRFSAEFSDFYRHLTTSPLYLSAYGVELALKKTDYLVIDDRSSEAASKDSIKEKLSKMGRKIGQSLFHTNQKAKIDPLTPAEIQKLGLKAAQYVAKSTNPLETLTQLSQDFPKYAKSVSEVELDVAFEKEVIENQHSLLRAGLNAIWLNGKGLEYSQINPFYLIRALRSERKLIKSFERLGLTPKQAIQVISNPALTAADRASSEGNSEIYDVRDTPENPFIVWWNDIEKDKKYSGWTDDMEEYLRPSYPGQLHPVKKNIFNLIMVEDLANIDALARIVNEIQMMIRRLVPIRFGIVPFVKQDDNMSTIMAQALNYIIQEHGKGDGMNFLTQALETLRLEGKRHPSLSDIQQSFEKTIAKANNSKSKKSFREALETQQRMSIQQVGIDNNVMFMNGKLIEFTEERANQKEAHIANLWIFANLNTISGLKLASEALSFTESNSKIRIALIHSSTTETQSKDYITIPVTDDNTKPLFSDVLGNLIFNGDGMSVTQAKEIIDLAIKNHLEQAKEDLDNSKVEAIFPGSPIIDMEAKAISEKWSLLNNHLEKHGLERGFFGIVLNGRIVGPFDGDVEFSKENFGALFNLEHTKRIAPIEQSIRESGYINTDHHPIADILAKATALIETDKANTAKGATEDNEPVYRHRVYNLISSTQHTRIVVGDLDNSFLEIGVIIDPLSEDTQKWAPILQTLSEIEGISVVIHLNPISQLDELPIRRFYRYVFDKEPHFDSNTGQKTIPTAYFADLPIDPLYTLGVETNNAWHVTVREANMDLDNILLSSLKEGTSGVSAVYELESILLEGHCIDSNSKSAPRGLEFEISTPSGSSKKDTLVMANLGYFQLKALPGVWKLGLREGRSSVIYSVEDIGTEGKWNWDAVEKKTDTLALTSFEGLTVMPLVHKNPGMEMEDVLGSSTNIKKQKDDKSSGLWSSLSEKLFGKKQDDQEKENNAAIKPKQADINIFSVASGKLYERFLSIMMVSVMKHTDSTVKFWFIENFLSPEFKNFVPYMAKEYGFEYEMITYKWPSWLRAQQEKQRTIWGYKILFLDVLFPLSLDKVIFVDADQIVRTDLKELIDMDLQGAPYGYTPFCSDRTEMDGFRFWTEGYWKNHLRGRPYHISALYVVDLVRFRQLAAGDRLRAQYQQLSADPNSLANLDQDLPNNMQHAVPIFSLPQEWLWCETWCSDESLKKAKTIDLCNNPLTKEPKLDRARRQVPEWEAYDNEIDKLRQKTATEAMHKEKHGDQIVISAGKDQHVKDEL

SEQ ID NO: 4525 - protein, 1644 aa, Jatropha curcas
MDIRFRSGFCVFIILICVSFSGFVSVSGENRRPKNVQVAVRAKWEGTPVLLEAAELLSKEWKDLYWEFIEVWLRAEEIEADSHSAKDCLKRILNHGKSLLSDQVASLFEFSLILRSASPRLVLYRQLAEESLSSFPLCDDSISSNDSEEIAETSEKNESKRSETLLVGVNPKSPCGKCCWVDTGGALFFDVAELRLWLNSPVNHAGDSFHQPELFDFDHVHFGSHTRSPVAILYGALGTDCFKEFHVTLVESAKQGRVKYVVRPVLPAGCEGKVGHCGAIGAKDSLNLGGYGVELALKNMEYKAMDDSAIKKGVTLEDPRTEDLSQEVRGFIFSKILERKPELTSEIMAFRDYLLSSTISDTLDVWELKDLGHQTAQRIVHASDPLQSMQEISQNFPSVVSSLSRMKLNSSIKDEITANQRMIPPGKSLLALNGALINIEDIDLYLLVDMVQQELLLADQFSKLKVPHSTIRKLLSTMSPPESNMFRIDFRSTHVHYLNNLEEDAMYKRWRSNINEILMPVFPGQVRYIRKNLFHAVYVLDPATSCGLESIDVIISLYENNFPMRFGLLLYSSKFIKKIEVGDADLHLSSVENDSQTQEDMSSLIIRLFIYIKENYGIRTAFQFLSNVNRLRKESAESIDDSLEMHHVEGAFVETVLPKATSPPQDILLKLEKEKTYNELSQESSMFVFKLGLYRLQCCLLMNGLVIDSSEEALMNAMNDELPRIQEQVYYGHINSRTDILEKFMSESSIGRYNPQIIAEGKAKPRFISLSSSVFEGQSMINDICYLHSPDTVDDLKPVTQLLVVDITSLRGIKLLHEGILYLIRGSKVARLGVIFSANQDADLPGLFFVKVFEITASSFSHKKNVLNFLEHLCTFYEQKYILGSSSATESAAFINKVYELANANELSLKAYESALVDFSTDMMRNHLNKVAQFLYRQLGLEAGVNAVVTNGRVTVLDDEGTFLSHDLNLLESLEFKQRIKHIVEIIEEVHWQDIDPDMLTSKFVSDVVMSVSSAMALRDRSSESARFEILNAEYSAVIIENENSGVHIDAVVDPLSPIGQKVASLLRVLRQYTQPSMRIVLNPMSSLVDLPLKNFYRYVVPTMDDFSSTDYTVNGPKAFFANMPLSKTLTMNLDVPEPWLVEPVIAVHDLDNILLENLGDTRTLQAVFELEALVLTGHCSEKDQDPPRGLQLILGTKSTPHLVDTIVMANLGYWQMKVSPGVWYLQLAPGRSFDLYVLKEDGSRDLDKLLSKRITINDLRGKVVHLEVAKKKGMEHENLLVSSDDDNHSQRKNKGSNNNWNSNIFKWASGLIGGQGKKDENTSTEHGKCTRRGKPINIFSIASGHLYERFLKIMILSVLKNTNRPVKFWFIKNYLSPQFKDVIPYMAQEYGFEYELITYKWPSWLHKQKEKQRIIWAYKILFLDVIFPLSLEKVIFVDADQVVRADMGELYDMDIKGRPLAYTPFCDNNKDMDGYRFWRQGFWKEHLRGKSYHISALYVVDLVKFRETAAGDNLRVFYETLSKDPNSLANLDQDLPNYAQHTVPIFSLPQEWLWCESWCGNSTKAKAKTIDLCNNPMTKEPKLQGARRIVSEWVDLDSEARQFTAKILGDEIDSKEHVAAPNKPKDPATGSSAEEHTEDKSEL

SEQ ID NO: 4526 - protein, 1488 aa, Diplocarpon rosae
MELFTMPWSLTRALLVTTYLHSLSVSASPSINVGMKASFSSAPYLLELLETAGNENGTSYFPLLDRIADGHFSQASTDKELFEAFAKTLKEDGHMVEPETLSSWKFAVSMRASAPRIEAHYQYYHTAAEPSLKSEHDTSCQVWVLFNGKQYCSPELDADSGHIVGESQLQELQFDRILGSSSSPPSILYADITSPTFAKFHKILVQTAREGKTSYRIRHRRSLAVEEKPLIIPGYGVELALKRTDYIVIDDREESEGKAASATPKKEVRFEDEEFADLKPLSSSELSSLGLKASSFIMQSENPLESLVKLSQDFPKYSSAIASHNVSSEFIAEHQFNRDQMVPAGKNIMWMNGVQLMDRQIEALDLLDIFRKERKLVNSLRDLGLTRSQAIKLLSHFEVSMVNAESDAPRFDWRDEIEGGKVIIWMNDIEKDKRYASWPTTVHAFLKRVYPGQLPTVRRDCFNVILPVDLTNPQDILVVADTVLSFVKRKLALRFGLVPLTSTPDSVSHAKVVYHLLDSYGIQAAMAYLEAAYTSQKLSAPTVKSFQTAIEGRTVRNDKTALTLEEVLESESYQGRIEASKKWVKRLAADSKIPLMFIDGAAIPREENWLQLMSQTVTNDLQAIQQAIFSETFDEETWLPSHFLLGASTRRNTLIVPEDEKTLKLLDVSKLVKENKDILSILPRIEADASSEKASWAHVILVADLESKAGEKLLATAAVFREANPSIELVIVHSPSSINTESGISTDFYKHMLGTGHKAFSHINDLTAVLTAELAAPGEEIQQQSVQYWRGADAVVKSLGLLPGQNALLLNGRLVGPIPADSDFDQGDFEQLLSYERSKRITPAYAALESLGLLESISTPLAAAKISSIVATSTISDTPDGMFEQASTLRMSRFDIWNSTYTAIEIGDIVTASIQITVTLDPASQLGQKWVPILKVLSELEGVFTKIFLNPRELLQELPVKRFYRYVLNSQPTFDDAGALRPLSATFTGVPQEALLNLGMDIPPAWLVAPKVSVYDLDNIKLSSIKTDVEALYELENILIEGHSREIPGGAAPRGVQLALGTERNAHTADTIIMSNLGYFQFKANPGYYKIGLLEGRSAEIFNIDSVGSKGWGPIAGDENTEVVLMSFKGATLYPRISRKPGMATEDVLESKPESKMDFVSRGINFAQGILGKGKGISEKEVQAEINIFSVASGHLYERMLNIMMVSVMKHTKHTVKFWFIEQFLSPSFKDFIPSLSAEYGFKYEMVTYKWPHWLRAQTEKQREIWGYKILFLDVLFPLSLDKVIFVDADQIVRTDMIELVNHDLHGAPYGFTPMCDSRVEMEGFRFWKQGYWERFLGGLPYHISALYIVDLHRFRQIAAGDRLRQQYHQLSADPNSLSNLDQDLPNHMQSVLPIHSLPQEWLWCETWCSDESLKDAKTIDLCNNPQTKEPKLDRARRQVPEWTVYDDEIAAVDRRRKGLPVNSTAEKNARSRALAAEAVTSSKKDEL

SEQ ID NO: 4527 - protein, 1565 aa, Macrostomum lignano
AAQFVSLFGAGCSLPLLLLALISIAPPCVLARSKFVSVNMFAKWQSTSLLAEASEFLHQQNSELFWQYLDNLAQRNDLSSMTDSAEYQLALSESSRLAPGSRSDLLRLWLSLRAASPALEMNAQLGLNDADRCLKSLDSSGGFAVLPGGGIACTADQLDAELAAANASAPLQLYRTDKVRLESAGVDEQQLPPTVLLYARLASGGFPAWHVAMTTLAKAGKLRYAFRHAPPAELNSLQRRQQRTRLSGYGVELAIKSTEYKAMDDSKVEDSKEDSHRRHDEEDEVQGFLFSKLRALHPNLSQELNQFKQHLLDSSTEIAPLKAWQLQDLSYQAAQRVLTVTVDDSLHVLRDLSQNYPVRAKALSQIAVLPSLRAQLEANQRLFQQQLGLPQGASLLLVNGRPVDLEFYDVFTMLQSLTEEASLMDAATQLGLPASHVASVVLRSLAASSASASDEKFALDFRDPAVVYLNDLEQSQVYAQWPRSVHDLLKPAFPGTMRRIARNLFNLVVFIDPAVKESADLIRYCEAFVQHTVPIRIGLVWAPKDEVGRALVRSFNFVKNDKGSTRSAVSYLTDIYSVTFEQGYSLNLEFAHQYFKGLYPDVDSKDALGDKSSDYEDQLAAGQAFLARSGLASAPAVLLNGGLLDTNAAVTNFEETVLTEIMRQTSELQREVAAGQLKDSQNVVDFINERPNVVKRLNQRLLQGGKTLTQAQLNAVGKLSYFVKNDDSATRAASLWLACDLATAGCRSHAYEALRLVKASAQLRLALLHTGEPGLLLAKALQSAASTVATKSAKHAVNLASKLCKPENWPAVSGINEAAVGNKALKELAVHGMDWDAFAAAADSDQTRRELDKLSKFASTELGTPAAASTAEPPSLALVSNGRLVGPLPQPEVDPADLRLLERLALSRAGRAVAESLDKLSNTELASVGNDRSELSMRLSALLNSHPAAVGSGSGSTSSSGGSTSGSSATRRIAMPDGLQPGGLLKLEPMEPNSARPSLEVTAIVDPLSRDAQKMSHILLVLRQALNARITVAFNCREKLSEPPLKTFYRYLLTAAPVFAKDGSLSSAGSTVNFDGMPSQPILTLGIDTPHNWMAEVVNSPYDLDNIQLAAVSGSGVHAEYELEYLLVEGHCVDSASNQIPRGLQFTLGTVQRPLLRDTIVMYNLGYFQLKAAPNAWQLRLRAGKSADIYDIAAHENTDGETAAGDPVAVLDSFRSKVITVRVAKKPDRLDDSLLGDEPAQQSIWGSISNAFTASPTVSSEDRDQTLNIFSVASGHLYERFLRIMMLSVLKNTKSKVKFWFLKNFLSPSFIKFIPYYAEKYNFEYALVQYKWPRWLNRQTEKQRIIWAYKILFLDVLFPLDVKRIIFVDADQIVRTDMQQLADMDIRGAPYAYTPFCDSRRDMEGFRFWKTGYWANHLGNRPYHISALYLVDLVRFRRLAAGDRLRGQYQGLSQDPNSLANLDQDLPNYMIHQVAIYSLPQEWLYCETWCDPATKKSAKTIDLCNNPKTKEPKLEAAQRIVPEWRDYDKELRAIWDEFHAGKSAANGQQQQQPKVPDSSSGHTEL

SEQ ID NO: 4528 - protein, 1543 aa, Crassostrea virginica
MTCRQRLQPLPKVPPHHYRDYNMAAPINMWWLLVYAFITVALAKQKPVTVSVDAKWPSTPLLLEASEYIAGESNDKFWEFVDGVSALAPDQVQSDTAQSNYHLIQKYAGKVLSPLHVRLMRFSLSLRSFSPAIENFQQMSNEEQAPEECDMFVSINGEKTCDVNKIEDVIGTAADKPKTAIYKFDHVYPGTGNKEVVATLYGELGKPGFNDMHEKLKSLSKQKKVTYVLRHYVKTPSETNTRLSGYGVELAIKSTEYKAKDDTKIEVKGDGTNTEEEDQLDDDVEGFDFAKLKELYPEQKADLKKLRNHLISSSSELAALKVWELQDLSYQAAQKVLNAEPDDQIKVLQDLSQNFPSRTRSLVKVQLKSEVKNEMNQNKKVFESALSLGAGESAMLLNGIPVEMEVYDVYTLLDLMKSEARLMEGLFSLGFKGAELEKFMRLDLGGDKKEFALDIRHTAIQFLNDLENDKKYKNWPNSVQDILRPTFPGMLRHVAKNIFHLVYFVDPTRKTDIELIKMAEAFLVHSAPIRLSLVFVVNFDLGVDPHEDASVALSRAFDYIRQEHTFPKALSFVTDIYEKAKGEEITPEMVMKELKKKYSDADMSEVFGKESDEYDILRIAAKDYIEKSGLADFPQVLLNGIPLKKNYLTEETFEEGVVSQIMAQTPDIQRAVYQGNLHDYMNILEYLMEKENVLPRLNSRVLSPPKQTLDFSTVIDDSLTLDSLYQKTAGEITAITARDMKYLQRKDEETLIPVTLWVVCDVETPEGRELLYSAIRQLKHSHEMRLGVVFNHNSVLDSDLLISKAVYTALQTLDNNHAKSLVTKLVKEENVQALKSGDKKIEDLEVHGMDMAAFKKALEKQTTDFLTHHASFIRNALGWDETDRGVVANGKVCGPLDENEKFTTEDVDLLTKVEYQNVARSIKTQIMLMGVEGNRGSELIMKISSLLSSKTSTTERKELSGLKDEHSAIKLPANPDAPAYQIEVVLDPVSQEAQKIAPMIKVLRDVVNVDVKIYMNCRDKLSEMPVKNYYRYVLEPDLTFKPDGSLTSGPVARFTDLPEKSILTMGVNPPESWLVESVKAAHDLDNILLEEVESGVNAQFALEYILIEGHCSDVSTGQPPRGLQFTLGMNVSKPLVDTIVMANLGYFQLKANPGVWFLNLREGRSRDIYSISGHELTDTPQGSEDIVVSINSFKSKILRIKVEKKKDKMTEQLLKDEDDDKSIWDSISSSFKPKEETEEKVLNIFSLASGHMYERLMRIMMLSVLKHTESKVKFWFLKNYLSPSFKDFIPKMAKEYGFEYELVQYKWPRWLNQQKEKQRVMWGYKILFLDVLFPLDVKKIIFVDADQVVRTDLQELNDLDLEGAPYGYTPFCSSRKEMDGFRFWNSGYWNSHLAGREYHISALYVVDLKKFRRIAAGDRLRGQYQGLSQDPNSLSNLDQDLPNNMIHQVAIKSLPQDWLWCETWCSDESKKTAKTIDLCNNPLTKEPKLKAALRILPEWKEYDYEVKVLWDKVYNTSTRLQVEYEPPSIDENKIGSKLEHDEL

SEQ ID NO: 4529 - protein, 1639 aa, Tilletiopsis washingtonensis
MRLTAPLQAAALLLSGSLAAAASSSSSPPVSVSLVSPWAAPPLVLELLEAAHTQDPDGFWTLLTHLTGPWAFNDSRGSTATAPRSAQAYHTAATRLLDQHGLLGAPGEREMWNLALALHTEAPKIAAFWQLYEHSGPARQWATAAVGREAQCASWVAWGDEVLCTEQELVRALTAGVAPSSPHTVAFDHIFSHPDAAESSTLDEQPTAVLYADVTSANFWSLHTTLLEHVLGSRVVAEGGADVPPLRYVLRWRPSAQGTEGPKATMAGYGATLDLKKVDYLVIDDRKLQEDSSAVRDVREDGAVSSDDQLSDRAWLDAQIGAQPEDAEQALSSLTKEELADLDVLATQVIATSSDPLRALEQLVKDFPLHAVALARRAPKPDAALLSELAELQSQTMDPGSSDIWLNGKALTEKEITPLGIIPALRADHAHVASLTSPLLNMSNEAALDLLSYAPIGVAQDLTAAGSLLFDASDRIERAAAGAQAGAPGVLSWFNDLEKDSHYESWSPSLQALIRPLWPGAFPHIARNLFNVVLVMDLGQPGTCRFLAESVIPTIPRIGLRWGLVPGGLEGKDETSLQLARMFWYLSENWGVEVVAKWLRRLARSRIEGGRISLDTAREELQAQLHNAVPAEDFPALFEALSSGEYPGLASRERMTRSYVRRLHLELDESMRGGHVMLNGESIPLTNNLINAMHAAVTAQSRVLAPLVYYRKIDSENTPDVSHFFYDLPTTFKTRSALVFADTGAAPAGNKPRAVDLVRLSAKATFKAPLETFVYPEAGARVNATLWVVGDLDSVAGAHLVYEAAKGLSKASYRLGLIHVPQTRGQGGPLSAFLAQLLASGQADAVSGPQLAEGVKAVAGAKLRAKADEQSPEPSTVPHWLSERGWATPGADSANGFWSEAPALARALGVKSGQIGLVVNGRVLTDFDPNATFAEDITTLVAFESVRRINAVVEGLEEAGVEVAKMEPAAHATTVMLATSVMSHAYFVDESAEGIFTPPQTGRNSVIDSVFAARATFEVGKRSTARTRLSVVLDPLSERTQSWAPVLRMLAELPDTHIRVLLNPRPKLRELPLKRFYRFAAPAQPAFDLTGQQTGATLEFHGLPEAAVLTLGLDTPPSWLCMSDEAVYDLDNIRLADIPAHARTAGVRAQYALKHILLEAHVRDADQAGQSGIPRGLELILESPDGAVELDTIVMANLGYAQFLPPSPGLYRLRIRDGRSKELYEMRSVGNLGWESPSVEVTGTDITLTSLHGLTIYPQVRRREGQENESLIEDLDLGAVPEPEAERGAAGYLRIAKNFFGGLKQQAERVKPVRPASDGANADINIFTVASGHLYERMASIMVLSVLKHTQSSVKFWFIENELSPSFKAFLPHLAAEYGFRYELITYAWPHWLRSQREKQRRIWGYKILFLDVLFPLDLKKVIFVDADQIVRVDLQELVDTNLQGAPYGYPPMGDDRPEVEGFRFWKQGYWKTFLRGKPYHISALYVVDLARFRRVAAGDQLRGQYQQLSSDPGSLANLDQDLPNNMQFQLPIHTLDKSWLWCETWCSDASLAAAKTIDLCQNPAVKSTKLERARKIPEWTAYDDEVARLAQRLASQQLLADNIAASNETVALPVPESELQPEPEPALDAEPAPRHDEL

SEQ ID NO: 4530 - protein, 1647 aa, Branchiostoma floridae
MILQILLILLYSKFPLLTTLARSEIARFRHPRWQPPVLDTGDRIGFKQLIRQPANHSSTRVCHVVLLTSGLASPSPKKFKVTKLGYHSMLLFMVTVLAGVILTAEAKSKSIVATLDAKWRDTPLLLEASEFLAQESNDAFWSFANKVADADPEKITSQSDHSYHHYIQKLTHGVLSEAQVKVLRFTLALRAHSPTVEMFAHLVDDLPSIPDCPAFVDVHNQMTCDPSRVKGMVDTASGRQRPYLYKVDHQYPGTSPDVPVVILYAELGTQAFKDFHTVLRDMADKGDINYVLRHYIKVRPDRKVRLSGYGVELAIKSTEYKAVDDSKVQGDAPGVEVEVEGEDEVEGFIFKKLRQLYPDLKEKLKTFRSYLIESTNEMAPLKVWQIQDLSFQAAQRIVSSSPQDALRVMRDVSQNFPTQARSLVRTQVQDEVRKEIQDNQKVFSETLDMGAGESALLINGLHVDLDIVDPFLLLDTIKNEVKLMEGLWSLGIREDDLKSLLYLPVDSEVDNYAIDIRDHAVHWINDLEKDYQYKSWPSNLQELLRPMFPGMLRHIRKNMYHMVFFLDPLKKEAGELVKLADLFYRNQAPVRIGLVFVVNDEKDVEGQDDVGVALIRAYNFIQQDQGSDKAFLWLNSVYSLARNKDSLLEMDHIKEKFRRKYPGDDIADVIAADTDYDDKRRAGRQFYQRTGLGPLPQVLMNGVPFTEEEISPENFEESVVSKILGITPELQRAVYMGELTNSMNLMEWLMDRPNVMPRLNPRVLSTKKRTLDLTTQPGKSPLADSAAFSRLSSNQMAATLANNMKYLTKKDESVTRPVTMWVVCDMESTEGRQLLYDAIKHMKSSNTVRIGVLHNPASTPEDGSQTFARAVQAALDTQTMTMAKNFITKLAKEENIPLVQGGKLAELYVNGMDTAKFEAALKKDQKKQTGVLTSHWTFVKNTLKVRPGQRAIVANGMIVGPLDPSETFDPDDFGLLEKFVKSLAADNVAQKIKDMELNLKNDGLNDLVMKASGLLIANQRSDSRREVTYSSDQHSAVKIPGDPNEAAFDIVAVVDPTTRDAQRLAPILMSLTITDASLTISDASLTLTGVNYDAIADVLQQVVNANLKVFMNSRDKLSEMPLKSFYRYVLEPEVGFMVNTSFSPGPSAKFVDMPDSTLFTLNMKPPESWLIESVRTPYDLDNIRLEDVVPGTTINAEYELEYLLLEGHCYDAMSGQPPRGLQFTLGTHNTPVMVDTIVMANLGYFQLKANPGAWLLRMRAGRSEEIYQITSHDGTDTPAGSEDVTVIMDSFKSKIIKIKVNKKPDKLQEDLLSDEGESGGGIWDSISSFTGGGKKSGDDADEEDVINIFSVASGHLYERLLRIMMLSVLKHTKTPVKFWFLKNYLSPAVMDFLPHMAKEYGFQYELVQYKWPRWLHQQTEKQRIIWGYKILFLDVLFPLSVKKIIFVDADQIVRTDIKELRDLDLGGAPYGYTPFCDSRKEMNGFRFWKSGYWASHLGGRKYHISALYVVDLKKFRRIAAGDRLRGQYQGLSQDPNSLSNLDQDLPNNMIHQVAIKSLPQEWLWCETWCDDASKATAKTIDLCNNPLTKEPKLEAAVRIVPEWTDYDNEIKALQQRLTNGEKSASSKTGGETLQPEESQRHHHDDEL

SEQ ID NO: 4531 - protein, 1368 aa, Callipepla squamata
MVNFCQKKVKKNSGILSKPVKILGHLNTMIAADEPPPEGCTLFFAVHGEKTCEYDSLGALLKAASGRPKPFLFKGDHTYPASNPDSPVVILYAEIGTEGFYRVHKLLVKKAEAGEITYVLRHFIANPSEEKVYLSGYGVELAIKSTEYKAKDDTQVKGTDVNATVIDEDDPIDEVQGFLFGKLRQLYPDLNEELKELRKHLVESTNEMAPLKVWQLQDLSFQTAARILAAPSVDALMVMKDLSQNFPTKASLFDVLRNEARVMEGLHSLGIEGFSLHNILKLNIQPSDSDYAVDIRSPAISVLIVDPAHETTAELLNVAEMFLSNHIPLRIGLVFVVNDGDDVDGLQDPGVALLRVYNYVAQEMDNNYAFQTVMSIYNKVKTGDQLKVEHVVSVLEKEYPYVEVNSVLGIDSAYDQNRKAARSYYEQTGVGPLPVVLFNGMPFQKDQLDPDDLETVTMHKILETTSIFQRAVYLGELSNDQDVVEYIMNQPNVVPRINSRILMSDREYLDLTAMNNFYVDDFARFSTLDSREKTAAVANSMTYLTKRDDSFVRPVTFWIVGDFDKPSGRQLLYDAIKHQKSSNNVRISMINNPSEDPNSSNTVVAKAIWAALQTQTSNNAKNFITKMAKEEVAKALEAGADILEFAVGGMDTNIFKEAFESPKVDFILSHAIYCRDVLKLKKGQRAVISNGRIIGPLEDGEMFNQDDFHLLENIILKTSGQKIKSQIQQLGFEEDLASDLVMKVDALLSAQPKGEARIEYHFFEERHSAVKLRPKEGETYFDVVAIVDPVTRDAQRLAPLLLVLNQLINMNLRVFMNCQSKLSDMPLKSFYRYVLEPEISFTAENSFASGPIAKFLDMPQSPLFTLNLNTPESWMVESVRTPYDLDNIYLEEVDNIVAAEYELEYLLLEGHCYDITTGQPPRGLQFTLGTSTNPVIVDTIVMANLGYFQLKANPGAWTLRLRKGRSEDIYRIYSHDGTDSPPEANEVVVVLNNFKSKIIKVKVQKKLDMMNEDLLSDGTSENESGFWESLKWGFTGGQKKEDVKQDKEDVLNIFSVASGHLYERFLRIMMLSVLKHTKTPLKFWFLKNYLSPTFKDFIPYMAKKYNFQYELVQYKWPRWLHQQTEKQRIIWGYKILFLDVLFPLAVDKILFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAMRIVPEWQDYDQEIKQLHNLFQKEKETGTPAQMSGQHTQERPKDCIAMFNAAIKPKPRSPLSHTSLT

SEQ ID NO: 4532 - protein, 1673 aa, Unknown
  Description of Unknown: Oryza sativa Indica Group sequence
MEAARGARSRVPVAAVVAVVLVAGLAAGGSAAEIRRQKNVQVALRAKWAGTPLLLEASELLSKEWKDLFWDFIDHWKELDKASECLTAKCCVQKIVEDARSFLSEPLASIFEFSLTLRSASPRLVLYRQLAEESLSSIPVKDGTLEQTSGPSTGENFHEAVKGTCCWVDTGSALLFNSADLRKWLDGLGKLAVDSTQQPELFEFDHIYPQSNITAPIAIFYGAFGTKCFKELHVHLAEASKQGKVRYALRHVLPSGCQATSSFCGSVGAIDAVTLSGYGVELALKNMEYKAMDDTAIKKGVALEDPKTEDLSQEVRGFIFSKILERKPALNAEIMSFRDYLLSSTVSDTLEVWELKDLGHQTAQRILHASDPLQSMQEINQNFPSIVSSLSRMKLDDSIKDEIIANQRMVPPGKSLMALNGALINIEDLDLYLLMDMVHEELSLADQFVKLKIPGSAVHKILSAAPPTESNSFRVDFRSSHVHYLNNLEEDALYKRWRSNINELLMPVFPGQMRYIRKNLFHAVYVFDPASTIDMVLSLYQDSVPIRFGIILYSSRLISVIEENDGNLPVNNGSKTEEDISILIIRLFLYIKETYSTQLAYQFLSNIHKSQNSGDDYNEESVEAHHVEGAFVDSLLSSAKSHPQDVLLKLQKENMHKQEAEESSRFVHKLGLYKLQCCLLMNGLVHESSEDATMNAMNDELPRIQEQVYYGHIQSHTDVLEKFLSESSYKRYNPSITGKSTENKRFVSLVGPYHQGDSTLHDITYLHSHGTTDDAKPVTHLVAVDISSKIGIKLLHEAIRYLMAGSNRARVGLLIYVRNDNPSPILHMKDIFDRTISSFSYKEKVLDFLHELCKFYEGQHVPSSGVGDKISTMREKVYSIAAETGLPVDNYKAWFTSYSHDAVLRGMNKLSDFLFGKLGLEFGSNAVITNGRVFVVNEGDSFLTDDLGLLESMEYELRTKHIYEIIEEIEWTGVDPDDLTSKFYSDVAMLISSSMSIRERPSERAHFEILHAEHSAIKLNGMSSGVHIDAVIDPLSPAGQKLAPLLRILWRQIQPSMRIVLNPISSLADLPLKNYYRFVLPSMDDFSSTDYSVHGPKAFFANMPLSKTLTMNIDVPEPWLVEPVIAIHDLDNILLENLGDVRTLQAVFELEALLLTGHCKEKDRDPPRGLQFILGTKRRPHLVDTLVMANLGYWQMKVSPGVWYLQLAPGRSADLYELPSKLIAIDSLRGKLMHIEVQKRGGKEHEDLLNADDDNHFQEKMDNKGWNNNLLKWASSFISGDSSSKKKDEKISLLGQAIDKEFMKSVGAGVTPKAALRCNRLQNGLYIGAHPQKHKHLIEIEDEMVSLNFEYCINLNACLMMDLKAARQGETINIFSVASGHLYERFLKIMILSVLKQTQRPVKFWFIKNYLSPQFKDVIPHMAQEYGFEYELVTYKWPTWLHKQKEKQRIIWAYKILFLDVIFPLSLRKVIFVDADQIVRADMGELYDMNLKGRPLAYTPFCDNNKEMDGYRFWKQGFWKDHLRGRPYHISALYVVDLAKFRQTASGDTLRVFYETLSKDPNSLSNLDQDLPNYAQHTVPIFSLPQEWLWCESWCGNATKARAKTIDLCNNPMTKEPKLQGAKRIVPEWVDLDSEARQFTARILGDNPESPGTTSPPSDTPKSDDKGAKHDEL

SEQ ID NO: 4533 - protein, 1510 aa, Pseudomyrmex gracilis
MRGLIYFCILLLCSTQLGADKKIKYVTTLIDAKWNETPLVLEAAEYLSDENPRYFWKFIDAYSQKISNLVIGTEKENYDIILELIKRYLSTSEIAVFKLGLSLRIYSARVEMFSQMAVNKNVSSHGCNNIVDIGGTFTCSLEDIDRLLEQDVWKTTDTYDVDHKYLSTTESDKAIILYGQIGTPTFIEFHEKLKNIAETKGINYILRHYVKDRMDKKLRLSGYGVELQMKSTEYKATDDSDIKDTEKSSEVTSDGMEEIEGINFMTLKQLYPDLQAELDKIQTHLLDTSHEIGAFKVWQFQELSHQAAERIMKSSADALNVLTDISQNFPMQAKSLIRTKVNSDMKAEMKLNQEIFMASLNIQPTDTALFVNGLFFDLEAIDVLTLLESLRSELRVMEALHRIGFSNKKMSKLLALDLSGSTDSQTFAMDIRDSAINWINDIENDPRYSKWSPSLTELLRPTFPGMIRNIRRNMYNLVLIIDPLSSESASLLSLAQSFYAHSVPLRIGFVFVTNYNTSVTGLMDSSVAVNNAYHYFADSKSSKEALNFLIQLGHFVGPNGAEIDDIKRVIQSIDSSADTDYILGEESEYDVGRHLAHDFIKRCGFKKFPQALLNGVPLMPVQANFESYEEAVLSNIMLQTPILQKAVYRGEITEGDDVVDFLMNQPNVMPRLNERVLKVDKNKWLNLIGSIPEDEDYTKWNSPQDLSTYIMKNMRYFFVSRRSTTHHFYSFWIVTDLKSLAGRQLLREALEYVEINTDARVGVIINAENDANVKSDINKIVLAALSALSPENAILYVRKVLKEANADLIADDKFEIEDESVAALLENQNPILSLHRHYVANVLNVEIGDRAILCNGRIIGPLDSDEEFTSDDFSLLERFSQSSYGDKLFIKLMKDEIFNDDEYEKGEITNDMIMKITSLLVPRPQTRSRYDVPFHGDDHSVIKIPANNPDEVAFNFIAIVDPVSRGAQKLGSILKTLQQALNCNIKVFLNCLDKNSDMPLKSFYRFVLEPELQFTAEGDISGSIAKFTKLPTSSLLTQYIHAPENWLVEVVRSVYDLDNIKLDNVAMGVHSEFELEYLLLEGHCFEAIVGNPPRGLQFTLGTEKRPVMVDTIVMANLGYFQLKANPGEWMLRLRQGRSAEIYDFTSVEGQDVIQNGNDVKVLISSLRSHVLKVKVSKKPDKVGVDLLSDDEKDAGLWNSISRTFTSDEGEDQDEKLNIFSLASGHLYERFLKIMMLSVIKHTKSPVKFWFLKNYLSPTLKDFLPHMAKEYGFEYELVQYKWPRWLHQQTEKQRTIWGYKILFLDVLFPLNLKKIIFVDADQVVRADLKELATMDLRGAPYAYTPFCDSRTEMDGFRFWKQGYWRNHLQGRAYHISALYVVDLKRFRRIAAGDRLRGQYQALSQDPNSLSNLDQDLPNNMIHQVAIKTLPQEWLWCETWCDDASKKYAKTIDLCNNPMTKEAKLQAAMRILPEWVGYDEEIKALQQKVENANRQTEKESETVDDVSKHEEL

SEQ ID NO: 4534 - protein, 1533 aa, Tuber borchii
MRLPNFGGRLSVGLLLLSPCVRLVSCGPAVNVALKASWNGAPFLLELLETAAEEVGASYFPLLDRIAAGDFADIGSDKALYDAFLRVAREEGFLVGQEELASFNFALSIHAAAPRIEAHYHYYVNSLEPIMGRLYDATCGVWLQWSHKQVCDTGGDFEDMLNSWERYRNDRRRLQFDRVLETQEDKPAAILYADIEAPNFKRFHQVLRDYAKQGILTYRVRYKPQTHRKGRPVILSGYGVELALKKTDYIAMDDRDVSGEGDLKKGKDTQTPIKELDDQEIQDIKPLHPEDMSLLGMKAASFVMDSEDPLTTLLKLLQDFPKHASSVAAVGINPDVTDVLQGNWDSFLGPGQNALWINGVQLENSDTNAFALLEHLRRERRFVNSFKTLGVNSSEAIQLLSHQVLANSKRDEVPQRFDYRDNIEGGKAIVWLNDLEKDSRYREWSAAVNTLLRRVYPGQLHPLRRNVHHLVVPVNLASKDDLALVTEQLRLFVDRKIALRFGVVPLAGTPEAVAQAKVFYYLNEAYGLPVALGYLELALGSGQSLKPDAKVLEQAIKEAELIEGRTALPLEEVLSSEAIGEHIKASKSWAGRMGANSLIPPVFINGLSLAKDEQWMQIMSARLQADVQFTQRAVYEEIANDETDFVALLLGNAATHRNAYIFPEGEESVKTINVGRLLQEYAGVFEKLPTIFSDKPDKLVESTIWVIGDFDEKDGYELLQGASELQKLAPGVNLVFINNPQLVSEKPALSTLLHQLHQVGFFKGPEQLQQLLEEVSPFKEHVDIPKVETLLQMQIPDVKPASWQFPNHIESGNFWKESQKMLKAAGFKPGQRGVIINGRVVGPVPVDEEFGAEDFRQLLEYEHSRRILPALEAANEIGVLEKLKGPQSSACLTNLIALSSIPEVPTSMFQGPSLARTDAFDKLWKQEHVAIESGDKDKATFQVVASIDPASELAQKWVPILKVLSEMRGVYIKIYLNPQKMIAELPVKRFYRHVLNSAPVFDENGNLIDPQARFENIPELPLLSLSMDVPPSWLVTPKESPYDLDNLKIQSLKDRLKGGDIEALYELRSILIEGHSTDIINGGPPKGVQLVLGTEKEPHFADTIVMANLGYFQFKANPGHYRMELKEGRSKEIFHIDSTGTKGIQRGNHEAAGEDSEIALLSFQGATLFPRLSRNPGMEVEDVLEQSTSVPKNVGDFATRLLRKVEDVLVNVGFLAPAADLKPQAEINIFSVASGHLYERFLNIMMLSVMKHTDKSVKFWFIENFLSPSFKDFIPTMAEEYGFEYELVTYKWPHWLRGQKEKQREIWGYKILFLDVLFPLDLDKVIFVDADQIVRTDMKELVDLDLQGAPYGFTPMCDSREEIEGFRFWKQGYWKNFLRGLPYHISALYVVDLKRFRQIAAGDRLRQQYHQLSADPNSLSNLDQDLPNHMQSMLPIHSLPQEWLWCETWCSDESLKTAKTIDLCNNPMTKEPKLDRARRQVPEWTAYDEEIAALARRNLKKEGEESETTKQLEKGETVEALKESEEPTIKQEL

SEQ ID NO: 4535 - protein, 1554 aa, Botryobasidium botryosum
MKVHSEISLACLFLPLVLGASPPVKVQLRSSWPAPELLLEIIESAAAERAQSFFPVFDLLTAPPSFTKKHAKRTQQEIFSTALETLDSLGYLSDPTDLASFHLSLSLHSATPKIEAFYQYYNDVANSSSVEWLGDKLDCISWVDWHGKRVCDLAALKELYEDPASQPKLLSFDHVLPDPSKYIQAPLPTAILYVSFESISFRVLHKYLYDLSNRPEPRVQYIIRYVPPQKPSPDPRRNTLSGYGVIMDLKKMDYLALDDRRGGAPGESTADKSEAHAAAEDPVQAILEKLPELDTNSSALPADEFIDIGLKATQLIVNSSDPLATLQDLSQSFPKYASTIVRRVEVHENVSQEISQKNTQVQAGMNAIWLNGRVIPTEDLNPFGLMRTLRKERQIMTSLTGLGLTPSQAVDVITNEAIADALSKPSILDERFDASDRPEGGKALVWWNDIEADSRYERWPTALTGLMQQLFPGQFHRVRRNLNNIVMVVDLTSGSVLDILNGPITNIIGRALPFRFGVVPAVETESGIKAARLFYYLIENYGPETTLGFFSAFATAEHTPLDFDQAKAAFEKLVEGEAPRVEEASKDFDAIVSGLYEDRIEAARSYSERLGASLAASAGGHAFVNGKHLDVDENFFRGLQSETNTVTNYLQEQIYYGKLSDSEDGPVDMATYFYDMPTTSTRRNKHIYPSGGPNGLQIHNLQELFASSNVIVKTKITSKSFVYSRPDDLSQQVPLSIWVVGDLNAPSTLSLLKEALKAILTLVSASELLAFIERIEADPVAALSPDNGSGSQSHLTAESRLLEIVNAHTFERLDHVAYDGYCHATKLMAHLLKLNKNENSLIINGRIVGPIKPNEMISADISALAAYELRKRVAPVVEALQPIFSNTERNTFAHIVSTASSIINSASLGSADQKVVARKRQYLSFTRDYTSFEIGEKPYALFQIAALIDPVSESAQKWAPLLKWLSSIEEEVHVHVTLNPAMGHTELPLKRFYQYNLRPQLTFDMKGREQDTFVKFKGLPIDPIYTLGMDTHPAWLVRPFESEHDLDNIHLSSLTASEIKSGVKAIFDLDYIILEGHAREGETPNPPRGVQLQLTTSDSTPVADTLIVANLGYFQFKATPGVYQLSIREGRGREVWEMQSVGNNGYHSPSIKETGSGVSLTDFEGVTIYPRLVKRPGMGSADVLDTEPPIVHQGVLGSLFSNIVTRFGSFVNPKKEQGLAQRQADINIFTVASGLLYERFASIMILSVMRNTNSTVKFWFIENFLSPSFLEFIPHLAKAYNFEYELVTYKWPSWLRGQKEKQRVIWGYKILFLDVLFPMDLKKVIFVDADQIVRTDLKELVALDLHGAPYGYTPMGDDNTDMEGFRFWKTGYWKDYLRGKPYHISALYVIDLVRFRELAAGDRLRSQYQMLSSDPNSLANLDQDLPNHLQHEVPIYSLDKSWLWCETWCTKDRLDQAKTIDLCQNPLTKEPKLSRARQIPEWEEYDSEIARFARQLADDGKIKSRAIAADSDVLATVGNTRQNDSPESDIGPEASQGEIVEDKVDGDGHSHDEL

SEQ ID NO: 4536 - protein, 1597 aa, Sparassis crispa
MKAPLSFASLITLLFVYKSYALNPPVKVELRSSWPAPPVLLECIEAIATENDEAFFPLLDTLTNPEVPIPSPHTPEVVHRSAFEAAISEGFLSRPGEYASVQMDLALHTATPKIEAVYQYYTDRHAARTASVHNDDCGSWVDWYGQVACDVQTLVHLAGVETIDPAVPSTVNASFPRPKLLPFDHVQPSPARVLARPPRTAIFYASLSSSNFRELHSYLYATSSAPNPHIEYVFRAIPPENRDLSLRTYLSGYGVALDLKKMDYLALDDRRQGSSGQTAESDGAVESISDVDSVMVLVQQYPANTDVNASTPLTDDELLNIGLQATQLIYDADEPLPALKQLSQNFPKYAAPLARRITVDPALLDEVEENQVKVPGGANIAWLNGVNIGEKDMNPFALLRLLRKERGTMLSLTSLGLSPEQAIRLLTHPSISAAQSEPDAVSELFDASDRPEEGGVIVWWNDLEKDSRYARWSRSLRILLRPMYPGQFPNVKANLFNVVLAVDLSQSSSLHFISTSVSNIISRSFPARFGIVPIVETEEGARMARLFYYLIENFGRAKTMSFLKSLSQIDIPIQRLTPTVNWGLVRSEFGNLLTESKQPGEGVITNLDTILHGGTESPGFGLDKARAYAARLGVTLTSASQGHAFVNGKHLVLNDDFLRQLQLELGQQLQYLQEQIATGHLRDNDIETISTYFYDLPTTAKRRNTYIHTGKSGMNMINLPDLLSRVKYPSGSFVYPSDLEQIPLSAYIVADFDTDGGRTLMKEALISTKVGSASRVSFIHNPATPWSASTRRPPTSSLLAHLITKDTLHRVSPSRLLKVLGLSEPSVPIHSPQVVISPEGSLDDILGGTLLEDAGQETYEDFVQASRLLVRELGLAAGEQAVIVNGRVVGPLLPGGFVAEDFETLMTYELRKRVEPVVEALENIFGSLESFDRGSYAEMVALTSSVVSAIQVPDPSEVGLFNAPYKPRKLSYQLLSGKYTSFMFGENSTALFHFGIVVDPLSESAQKWSSLIEWLLNIPEVFVELHINPARYRELPLRRFYRYNLQPRLLYDDNGEEIRAETEFSGLAVEPIYTLAMDVPQSWLVRPREALHDLDNIQLSTLSARDRAHGVHAIFELDYLVIEGHARDVLTSAPPRGVQLQLATSQGVPIADTLVVANLGYLQFRTKPGVFKLEIRPGRGREIFKMESVGNEGWDSPHVDVDGDEITLTNFEGLTLYPRLARLPGMDRADVLAEAPPKAPTAKEVLEDIVSWVSSLFSSSKGSENNTLSSPSDQADINIFTVASGLLYERFVSIMVLSVLRNTNSTVKFWFIENFLSPSFLEFIPHLAEAYGFKYELVTYKWPSWLRAQKEKQRIIWAYKILFLDVLFPMDLKKVIFVDADQIVRADLKELVDLDLHGAPYGYTPMGDDNEEMEGFRFWKTGYWKEFLRGLPYHISALYVVDLVRFRQIAAGDILRGHYQQLSADPNSLANLDQDLPNNLQREVPIFSLPEDWLWCETWCSKDRLNRAKTIDLCQNPLTKEPKLARARHIPEWEEYDSEIARFARRLAEEGCIRSEIVAADSNVLADAGAEHRTHGTAVDKQSEGVEGKAEYVRDEL

SEQ ID NO: 4537 - protein, 845 aa, Caenorhabditis nigoni
MKIPPTYGNEFLSKTGLGNGPQALLNGYPLDLTSSSESLDVVLFENIQKQTLRLQFALYQRLITDSVKIDEFWLKEETNPDLKIRVNIRIVKAFNEKRFVNSDSDFSENSENSENPTLTIIANFENSKNRLSIAKWLKSLNLSLKIALISNPTTSSDSEESSCPSDSEDLESAILRLENQDSCIGARKFSNFLRKNEIPAGEMTVIFNGLVIGPFEENEKEEFLEIEDFEFLENLWEERGAKKTSAFLSQHFPNQYDVTIRFFSILSKIYQKDVPRIAFDNFKDPENRNLIIFPPKNPESPFSTITWILNPVSREAQHLVSIVKLMSNVLNAKVEIIFNPPNELHEMPIKRFYRFVASEFLEFDENGKIKDQSAIFSNLPQKQLSTMSVETNDGWMIEVKKADDDLDNILLENTSGDVESEFSLEHILVEGQSQKSGTGDASNGLELELKSENTKYDTIVMRNLGYFQLKAEPGIWNLRIRNGTSSENFRIQKVDSKEVHGEITVVVDSFTRKWTQLVVKEIEDKKEQKEGSAMGRLMEKAKNFFSTPPPSETINVFSLASGHLYERFMRIMIASVMKNTQSRKVKFWLLKNYLSPKFKESIPILADFYGFEYELVEYKWPKWLHQQTEKQRVMWGYKILFLDVLFPLNVDKIIFVDADQVVRADLLELMDFDLKGAPYGYVPFCESRKEMDGFRFWKTGYWNTHLMGRRYHISALYVVDLKAFRKFAAGDRLRGRYDNLSADPNSLSNLDQDLPNNMIHEVPIKSLPQDWLWCETWCDDRSKKTAKTIDLCNNPLTKEPKLSSAQRIIGEWKTLDKEISNVIEKRIRKNSEEEREETEESREEL

SEQ ID NO: 4538 - protein, 1617 aa, Cajanus cajan
MAMGFRSPSPLLIFIFILILAAIAPTFSRPPSPKNVQTALRAKWSATPLLLEAGELLSKEDQRLFWNFIHVWLNADHHAAQSHSAKSCVNRILEHSRPLLREPLASLFEFSLILRSASPALVLYRQLAHDSLTRSSNAQITELDPLRAGESLKSPGGKCCWVDTGHNLFFEVSELLSWLETDDKLVAGSIQRPQLFDFDHVHFDSSVGSPVAVLYGALGTSCFKEFHAALVGAAKQGKVNYVLRPVLPAGCETDFGHCGSVGASGSVNLGGYGVELAFKNMEYKAMDDTTIKKGVTLEDPRTEDLSQEVRGFIFSKILERKPELTSDIMTFRDYLLSSTVSDTLDVWELKDLGHQTVQRIVRASDPLQSMHDINQNFPNIVSSLSRMKLDDSVRDEIMANQRMIPPGKSLMAINGALVNVEDIDLYLLIDLVHQDLLLADQFSKMKIPPSTVRKLLSTSPPSESSMFRVDFRATRVHYLNNLEEDAKYKRWRSNLNEILMPVFPGQLRHIRKNLFHAVFVLDPATICGLESIDLITSLYENDFPVRFGIMLYSSKYITQLDNHSAKEEGDNFEEDISDMIIRLFSYIQENHGIQLAFEFLSNVNKLRVESDEHVEDAHLEMHHVEEAFVETILPKVKSPPQETLIKLKAEPEWKELSQESSMLVFKLGLSKIHCSLLMNGLVIDPTEDALLNALNDETQRIQEQVYFGQIKSHTDVLAKFLSEAGIQRYNPRIISDNKPRFISLSTFIFGEASILKDIDYLHSPGTMDDLKPVTHLLAVDITSGSGLKLLRQGLNYLREGSKDARIGLLFSANQSTDSFSLLFVKVFEITSSSYSHKKNVLDFLDQLCSLYQQKYFHKSAVEVDSTQAFIDKVCELAEANGLPSEGYRSALPEFSTGEVRRHLSKVGNFLHRVIGSESGVNAVFTNGRVTYPIDESTFLSADLLLLESIEFKQRTKHILEIIEEVNWQDVDPDMLTSKFISDIVMAISSSMAMRERSSESARFEILNDQHSAIILHNENSSIHIDACLDPLSPTSQKLSGILRVLWKYIQPSMRIVLNPLSSLADLPLKNYYRYVVPSMDDFSSADSSINGPKAFFANMPLSKTLTMNLDVPEPWLVEPVIAIHDLDNILLENLGDTRTLQSVFELEALVLTGHCSEKDHDPPRGLQLILGTKTTPHLVDTIVMANLGYWQMKVSPGVWFLQLAPGRSSELYILKEGADGIQNKESSKLITINDLRGKVVHMDVVKRKGKEHEKLLISDDDEEDPQDTKKGSSWNSNILKWASGFISSNEQPKNAESNSLEKERGGRHGKTINIFSIASGHLYERFLKIMILSVLKNTHRPVKFWFIKNYLSPPFKDLIPHMAQEYGFECELITYKWPTWLHKQKEKQRIIWAYKILFLDVIFPLSLEKVIFVDADQIVRADMGELYDMDIKGKPLAYTPFCDNNKEMDGYRFWRQGFWKDHLRGKPYHISALYVVDLKKFRETASGDNLRVFYETLSKDPNSLSNLDQDLPNYAQHIVPIFSLPQEWLWCESWCGNATKLKAKTIDLCNNPMTKEPKLQGARRIVSEWPDLDLEASRFTSRILGDDVVEPMQTPNQSKDLASEDSLKEDLESKAEL

SEQ ID NO: 4539 - protein, 1693 aa, Rhodotorula toruloides
MWLSGLQSLLLAGLAASAAAHRSPPVAARVEAWPAPDLVTQFLETIALEAPNEFFHFLSFLSSNPHSHHFLRAGTLLPPSLRAANNLAKQGVNPIFAPEGTLQLNETYALLDAAAGRSLLFRSKGLRESLQTSLANREASVIIEGMRGLWEEREAVVPVREGSDSQGEEACESWIDVAGARACSEEEFWEIVGNEEKGGKKPIKLPSSTNSTRPQRYSFDHVSPHGDESHLPRFVFWANPTSPSFQRLFTFLHSLSAPKAIPVSNPKSLTSQSPPAAHAAPHPPRLQFVVRWKPSSAAHRAQKKLVMSGYGAALDIKKSDYLAIDDRVTGQSTAGGKDADGEVSKEPVLEIEGDLPPKMEPVKKGDVAELAIRTAQFILASDQPFKAFVDLTSAFPRLASHLPTLVPDPDPHLISEVSTNQMSSVLTTRSSFFLNGVPLTEAEVDPFAFLRLMRKERKHIVDLLSLSIHMTGKEARDILIGGSPRSPSSSRDRIGVDALGELYDSTDRDEGGQVILWWNDLEKDRRYKSWSKSVRELLRPVYPGSMNLVARNLNNVVFVLDLTRPGALSLVVEHIKQFVGRGIPVRFGVVPVVGASSEDNSLQTLMAQVIWYLTDALGRAPTMQFLATLLKASPESTISEDLLKRAYLQLAATASHVDGGPLARFSELRHYGIGRRAGGSHSRLTKTREYLKRLGVPLAAAAETKKSLGAFFMNGAYFPIDDDFTQNLQRTLGLHTQYLAQEVYLRSLTDDMDASSFFADLPTTYKRRNPYISPSPETNPLKIVNLVEALDGVHRGWLHSFYIEGTSGLTNETTGLDIEDPPAVATIYVITDLNDPAGADLAVAALKLAEKTTQVRISFVHNPADPFAELHPWTLSRTLFALQKDHQLAEILPDELTEYIDLNLDKGGPAKGDGHDWPEDNPLRAILADGVKDKSGGDADLFWDEVQWFRYKLGFKEGESGIVINGRVIGPLPAGSFGAADFKTLLAYEMEKRIKPVVSAIDLTAVLKKNFDRLKRSHIYNVATSIVGAAHLPDPAAGIFGNGPVERRRDYLGLAANHSAIVGARETGALFEVAVVIDPATELAQRWAPIVETLSQLNSTHVRLYLNPSLHVTEVPIKRFYQYTFNSTLTFDDTTGQEVQPAIRFNDIPEDVLLTFGIDAQQSWLAFPKHSVHDLDNIRLADLPAWSKSSGVEAVLELESLLVEGHARDMPSSRPPRGLQLELRRGGHNASEQQQRVDTTVMANLGYLQFKASPGAWQLGIRAGRSSEVFELESIGADGWKSGTVNKTGTTFVVSTLEGLTLYPRFTRKPGHELTELLDESADVVASARTAAAGLFERVKSMIPFLAPKAGQELVSTGKKAEINVFTVASGLLYERMALLMVVSVLRHTKSSVKFWFIQNFLSPSFKAFIPHMAREFGFDYELVTYKWPHWLRAQKEKQRTIWGYKILFLDVLFPLELDRVIFVDSDQIVRADLKELVDLDLHGAPYAFAPMGDDRAEMEGFRFWKTGYWKNHLKGNPYHISALYVVDLDRFRQIAAGDRLRQQYQALSADPHSLANLDQDLPNNMQGTIPIYTLGREWLWCETWCSDESLAQAKTIDLCNNPLTHEPKLQRAKRLIPEWLEYDAEVSAFAQRVAAGQEGGETAASVFRNRADELEQAVQQAKEREEFVEEQQQARSGSGEGDLREQRVKDEL

SEQ ID NO: 4540 - protein, 1529 aa, Xenopus tropicalis
MMETAMILLGLCLCISSVSADSKAVTTSLTAKWASTPLLLEASEFLAEEAPDKFWAFVDEVQQVKDQGSDSINYELMVNKASRQLTPQQENLLKFALSLRTYSATVQTFQQMAADEPPPAGCTSFIVVHGAKTCVLENLPSLLKTASQRPKPFLFKGDHRYPYGAPESPVVILYAEIGSKDFARFHQLLSLKAQEDGINYILRHFVSNPRSEKVFLSGYGVELSMKSTEYKAKDDTQVKGNDVNATVVGDNDPVDEVQGFLFGKLRQLYPELKEQLKELRKHLIDSTNEMAPLKVWELQDLSYQSAAHILSAPPAEALMVMKDLSQNFPTKARALTRTVVDSALRKEVEENQKYFKSNLGVHPGDSALFINGLHVDLDSQDIFSLFDTLRNEARVMEGLFRLGIDGTALQNVLKLNIQPSTADYAVDIRHPAITWVNNLEMDSRYNSWPSTLQELLRPTFPGVIRQIRRNFHNFVIIFDPVHDSTSELINLAEMFLSNHIPVRVGLVFVVDDSEDVDGFQDAGVALLRAFNYVSDEVNEYHAFQTIVSIYNKVPAGKRLTVKHVTAVLEQRYPYIELSSILGKDSAYDQSRKEGKEYFLQTGLSPLPVVLFNGIPFSKEQLQPDELETATMQKIMETTTFFQKAVYLGELTNDQDVVDHIMNQPNVVPRINLRILEAERRYLDLTTLNNYFIDDYKRFSSLNSNSKSAAIVNSMTYLTKKGMSSREIYDDSFVRPVTFWIVGDFDQPSGRQLLYDAIKHQKSSNNVRIGILSNPSQDPSAESTRIARAIWAALQTQNSNNAKNFITKIVKEENARQIEAGKDPVEFAVGGMDTSLFREMFESPKVDFILSHTLYCREVLKLKKGERAIISNGRIIGPLRDDEIFNQDDFHLLENLVLKTSAQNIKSHIKLLQVEEDHASDLVMKVDSLLSSQPKGEGRVNYQIPEDAHSAIKLRPTEGMIYFDVVAVVDPVTKAAQRLAPLLLVLKQVLNMNLRVFMNCQSKLSEMPLKSFYRYVLEPEVMFTSQKNIAPGPIAKFLDMPQSPLFTLSLDTPDSWMVESVRTPYDLDNIYLEEVDSVVAAEFELEYLLLEGHCFDVSTGQPPRGLQFTLGTSTNPVVVDTIVMANLGYFQLKANPGAWMLRLRKGRSEDIYTIYSHEGTDSDPEASDVVVVLHDFKSKIIKVKVQKKPDKMNEDLLSDGNSENESGFWDSITWGLAGSQKQDDVKAEKEDVLNIFSVASGHLYERFLRIMMLSVLKNTQTPVKFWFLKNYLSPTFKNFIPYMAKKYNFQYELVQYKWPRWLHQQTEKQRIIWGYKILFLDVLFPLAVDKFIFVDADQIVRTDLKELREFNLDGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDTSKKKAKTIDLCNNPMTKEPKLQAAVRIVPEWQEYDQEIKKLYSHFQDESSNGSLHQPDTSTKPDKENHMEL

SEQ ID NO: 4541 - protein, 472 aa, Porphyra umbilicalis
MGNLGYFQLKAAAPGAWRLSLAPAGGGGNTSAYAITSIEGAGAGVGTVTADGDVAVVVDSLDGARGTLLRVRHRAEAGGDAAAVGDGGGGGGGVRDKLSSLFRRGAPSPTASATAAAGASVDGAADGAPAHDPRIHVFSVASGHLYERLLKIMMLSVVRHAGAPVKFWLLQNTLSPAFKALLPGFAAAHGFEVGLVTFRWPTWLRAQTDAQRTIWAYKILFLDVLFPLTLRRVIFVDSDQVVRADLAELMALPLDGAPYGYVPFCESRRDVDGFRFWKGGYWAGILAGRPYHISALYVVDLDVFRSTRAGDTLRAVYQSLSADPASLSNLDQDLPNYAAVTPGGGAPGGHPLVRIFSLPQEWLWCDSWCDQASKPAAKTIDLCNNPLTKVPKLVAAKTIIPEWEEYDRMAAATTAEVYARLAQAVASGGGGLGGEGGVPPPPPDEPLAVPEPAVADGGAAAGVGDGVSRDEL

SEQ ID NO: 4542 - protein, 1530 aa, Blattella germanica
MKFVVLGLLVHLLCSGAGGASKQKTKSVTTLIEAKWEVTPLVLEISEYLADENAEYLWEYVDAISALKPSLADLESDRYRYEQAVDVAGLLITPAQTSVLKLALSLHIYSPKVEMYSQMALERGLSALSCPVAADVGGKLTCCTEEMKKLISQKLGDDSSRVETFGLDHHYPGSQNNSLTVILYGEMGTPEFAEFHQILKTYAVKGDIDYVLRHYIKERPNKRVRLSGYGVELQIKSTEYKVQDDTQVKGDKAEDSNEQDDEDDEIEGFNFSRLKQLYPDMKDNLDKLRLHLLESSNEMAPLKVWQVQELSLQAAERIMSSPKEEALKVLTNIAQNFPLQARSLVRTIVKDELKQEIKRNQELFASSLNLQPTDTALFVNGMFFDLDVVDVISLLEVVRQELRVMEGLHKIGISDSYMSSLLALDFSSGSSSSSTPEYAIDIRDSAVMWVNDIEHDKQYRRWSESLMELLRPTFPGMLRSVRRNLYNLVILANPARKEAKPLLKLAESFYVHTAPLRIGLVFAVNPDQSVSGQEDAGVALLNAFNYVSDVKDAYHGLSFITDVYATIKDDRDVTVEDVTSLLRTKYRSADIDEIFGEDSEYETGRRLARDFVERSGFRRMPQALLNGIPLTEKHLNAEDFEEAVLSEIMNQTPLYQKAVYKGEFTEGDNALDFIMNQPNVMPRLNDRILNQDKNQYLDVTGTPLAEEIPLTLKAFSSLSPRDKTATIIDRGVEYYMKKHADQTPHIITHWIRSSGSIRVGVLLNPSDGQFGVVDKLVLAAPKVLQPNHAREYINAILSDDSLVEAINSGKKAAEDVSVPNVDPSGLSEAIKKDMSELLKGQQLYSQQVLNIPAGGKAIVTNGRILGPLEENEKFTLDDFSLLERYSMNSYGDKILQTIKKNNANDEDDDSDALQNSNVMMQAVSLLVSRPQSRSRFEIPVHTDIHSVVKIPPHNTSEPAFDLAVIVDPVSRGAQRVGPILSVLQEVLNCHIKVYLNCVEKNSDMPLKSFYRFVLEPEVHFTSDGRQTSGPMARFANMPTSPLLTQNMQVPENWLVESVRSPYDLDNIRLEDVESVVHSEFELEYLLLEGHCFEATMGNPPRGLQITLGTETQPVVVDTIVMANLGYFQLKANPGAWLLRLRQGRSAEIFDIVSHDGSDTPANSSDIKVLISSFRSHVLKLKVAKKPDKMHMDLLSDDNDPNSGLWNSITSTFGGSKPSEEDGDERLNIFSLASGHLYERFLRIMMLSVLKNTKTPVKFWFLKNYLSPTFKDFLPHMAKEYGFEYELVQYKWPRWLHQQTEKQRIIWGYKILFLDVLFPLDVKKIIFVDADQRIYDELYASQVVRADMKELRDYDLGGAPYGYTPFCDSRTEMDGFRFWKQGYWRNHLQGRRYHISALYVVDLRRFRRIAAGDRLRGQYQALSQDPNSLSNLDQDLPNNMIHQVAIKSLPQEWLWCETWCDDSSKQYAKTIDLCNNPLTKEAKLTAAMRIVSEWKSYDIEIKRLQTRIDGNKTEGILDSKPDISSSRKAGE

SEQ ID NO: 4543 - protein, 1548 aa, Baudoinia panamericana
MGERNSRAVFAGIFCLFLSAIAVPSVNVGLQAAFDAPPLLVELLETAAEENATAYFPLLDRIAEGYFHTARTDKELYTIFRTLLEEDGHLSKADDLSSFDFALSIHSTAPRIAAHYHYYDTAVKPSLGPDEDEGCETWAYAAFNGQKFCSPDMAESGAQVPGLPSEHLHQLPFDRVLGAADSNRPSVLYADVLSESFRAFHRTMSKTAADGKTSYRVRYKPSRSLVSTPLTVNGYGVELALKRTDYIVIDDRQADGEPKPATAAAADATLSEEDVSDLRPLSSSELLRLGLKASSFVMASDAQLDTLLRLTQDFPKHSSAIALFNVSDDFMKEHRDNRDLLLPAGFNVLWINGVQIMARDLDAFSLLEHLRRERKMINGVRELGLSGAEAIELLSHEAITASAVNQEVQRYDWRDESEGGNVIMWLNDIEKDKRYADWSGSIMALLQRTYPGQLPAVKRDIHNLVVPIDFSSHADVMTVVENLQGFVQRKVPIRFGLVPHLKTPTSTDQTKIVYYLIETYGLSAALDYLAKSVSTAGRKFGPPQEKLFTQTTEGRKVRQDRSILAFADVLASTEFDERLKGAQAYIKRLGAGQASPPILINGAPIPHTDEWLQTMSQRLGLDARTVQQAVYEGTVNEDSYLPHVFLSQASLRRNPIVTPEDDKDVRHVSLGELPQMAGLPSLPASESTIERELVHVTVAADFSSLEGMQQLMEALLFKDLHDNVELAFLHLPGDGSAHPTSNAEAETEDVIGHVQSLQQTYEASMQRPKGEEAEVPDYDGRQAIYKLLYRTLRDQSSAHSSLRASAASRKLAQAVNILPGQHALLINGRVVGPMPASTILELDDLEAVMAYERKKRLLPAALAIEGLGLQAKASTPSAFARISNLIALSQVSSLPEGIFEAAPTVRSGAFKAWNSSYTAIKVGDVEAANVQITASIDPASEVGQRWLPIIKTLSELDGTATTLYLNPRERLEEIPIKRFYRHVLQSKPTFDADGALEGLTARFGGLPADALLNMGMDLPPSWLVAPKDSIHDLDNIKLSAIKSGADIEATYELEHILIEGHSRDVTLGPPPRGAQLVLGTERDPHFADTIIMANLGYFQFKANPGVYNLTLQEGRSQEIFHIDSAGTLGYEPQPGDNTTEIALMSFRGSTLFPRLARQPGMEDEDVLEAPKTALDNFTEGAETLLAQVGLSSSQTRKYLSKAARWGVALISGKGKPTDVSAEAHADINIFSVASGHLYERMLNIMMVSVMKHTNHTVKFWFIEQFLSPSFKSFVPSLAKEYGFKYEMVTYKWPHWLRGQKEKQREIWGYKILFLDVLFPLDLDKVIFVDADQIVRTDMYELVQHDLHGAPYGFTPMCDSRTEMEGFRFWKQGYWKNFLRGLPYHISALYVVDLKKFRQIAAGDRLRQQYHQLSADPASLSNLDQDLPNHMQMVLPIHSLPQDWLWCETWCSDEALKTAKTIDLCNNPMTKEPKLDRARRQVPEWTVYDDEIAAVAKRYKESQAAGRPVAGSAGDAGVQGEEEESIQERLQREDAEKERKKQEHVKDEL

SEQ ID NO: 4544 - protein, 1751 aa, Chlamydomonas eustigma
MIILSVLLFSISTLYTQAQQKGVSVSLRARWNGTPYVSETAEFLADEDPSLLWKYLEVFGSAHEPSDMEQCWSHIMSHASALVPQGVAQVLPLVVASRQYTARLEMFQQLRKQAHPDDVSCCLVDVEGRAAHSAHEVQELITAALVTGATFNGTISLVEGDHVHPSSAEGSTAPSITAVLYGPLGAACTSELHSELRKVTGLKYAFRPVLVGECEVGACMRLGSEERTALPGFGVEAVLKNMEYSALDDKKTSSTIDESGAVTEEVVSGTVKGFDFDTLVSRNPHLKQELASLKDHLLSSDDEEAVKVWDLADLGLQATQRIMAASDPLSVLAEISQNFPALVSSLSRQKVNESLRSAVAFNQQILSPGTNYMLINGITFDINTLDFFGLLDRLRQEARLQRSLSSVLGLPSKAVQQLLAMRADASGDGGLSDARLELGKMTPHVIFQNNLEKDFMYTSRFSPSLMDLLQTFPGRLRPLARNVFTLVLIADPTDPATLQLSKILYKMYSDYYPVRFGLALSVPSVIQRLESQRRTGSSVHAPAWNNMISSEQVSRALLTMRTAFGGQAAFSLLATIANAVGLEWGAMDSLVRGSFISNWEQAAKTATGAKARLAAKKTGEEAWEGVITGSGYASEVGMELSDSTQWLMSKGLTRSSHPIAWLNGVLIPCPEVTPATEQELMYKILMEQQKLQEAIYFGRLVDEEDVLEQVMEEHTTVTRYNPNIMGAADAEGGEGVVQQIISLSEVLRHPARPHLPGLSFYHQPAKTVVGSPPRINAVTYYVASDLSTAEGRSLAIQALRYMSEMPSSSKTARVIIIPNPVDPLAPPSLLELLILSASDIRYEPRQEVASFLYKLIKDQTLNEVLSSAAQAPNPAQTEAMKAKAVEAHMDAESYIAALEKRLKPDAGAVQLREELSSLCRSALKLQPGDSAVVANGRLMLIHSPSTGRTEEFVAEDFQLLQLLMGKYMMGTALASEVQKLVSEATAAGTSLYNGGSTEAQSNVMDDIVAVTASEFLSGNNGDNKISPGASKQLMQVTGRLKGKAVELSSSSYNEETGETTQDEGGSSPHITVILNPLTRSAQRISQVLQLIRATLGCSVALYLNPQRDLTDLPLKAFYRYALPEFEGHPSNTQPAPPVATLMKLPQKRVLTINMDVPEPWLVEPVKAPFDLDNLRLADSTTRTALVEYDLEAIMLTGSCIDVTQGRGTPPRGLQLHLGSPFQPHIVDTLVMSNLAYFQLKTSPGRWLLSLAPGRTRQLYTLDKDKAVGSDLAVSKRSTDVASAVDDVDDDQDGDDKAISSQIIISSLSGKHILFKVHKRPGMEKEDVLLADKEEAETAASEYDEDEGIWDMMFGGGKRKKKKNKETKQQAALTAAGDKQLSGEMPGAITSGSQQQGQQVALRGGEVINVFTVASGHMYERLQKIMFLSVVKNTKSRVKFWIIKNYMSPQHKATLPELAKNFGFEYEFVTYKWPHWLHKQTDKQRIIWAYKILFLDVLFPLNVERVIFVDSDQVIRTDLAELYHMDIKGAPYAYTPFCDNNKEMDEFRFWKGGFWKDHLQGKPYHISALYLVDLKRFRALAAGDNLRIVYDQLSKDPNSLANLDQDLPNYAQHSIPIFSLPQEWLWCESWCGNETKHKAKTIDLCNNPKTKEPKLSAARRILPEWEGLDHDQATATTRAEELLLINPGSCAAGMCNGFAEGGPADDNAAAEVGFAANSNRARTERGPDVYETKAEKEGKEQQPVLNGDHEEL

SEQ ID NO: 4545 - protein, 1605 aa, Panaeolus cyanescens
MNRALLLLGAVISVLQAAASPPVEVALRSSWSAPPLLAEILETVALENPSVFFEYLDQLTNPEVIPTLVGLSPEATHQAALQVAIDNFLLHEPSALSLVQLNLGLHAATPKLEAYYNYYNEHHQNSAGTSCGSWVDWYGTVICDVEALAALVKTEAIDAPNSSIPTRPQLLTFDHIFPPPDRILERPPRTAILYGSLTSPNFRELYVYLLKLTNTLDPHVEFVFRHIPPSQPSVTRNYLSGYGVALDLKKMDYLALDDRNSNVGSSSNTGSTATDSDIGKEKADLVLPLILSHPENASAPDASVPISEDERRVIGSRSMQIVLDSEDQLNTLIQLSQNFPKYATQLARRVALNESVAEEIKANSIIVPQGHNFFWLNGAPIDAKDVSPFGLIKAFKKERSIMSSLTNGDQITRQQAFELMTDPAVEVAHKTNAVAEAIFDASDRPEGGDIIFWWNDMEKDSRYSRWPESLYTLLRSMYPGQLPLVRRNLFNCILILDLSDRGALNFVANPMANVIERDFPLRFGLVPTPETENGAKMAKLFHYLTTEFGKKPTLSFIQSLSRAVVPDPMQRNVEWSAVSDLYDQLVNARKEQKPDFVPVSLEDIFKGKLERSAPIEKMNDYVERLGAVLGPTAPMGHAFFNGKHLPFDDDFLRNLQSELSAQTQFLAGKVYEMELTDENAGETMSNYFYDLPTTSKRRNKYIFPTGSTAAVNRIANIPEIFNQLKMESSSWTYVYPTKKNAISQSLLIIADLDSDHGLSLIKNALLSLDENSRTRVSFIHNPSTLPVVNSDDRPTASWLLAHLYMRGQLSKASPSTLLSALGLADSATKFEQDGAQAPLSVDNAVKALTGGQGIAGIAKEEYHDFVRNGRLLARRLKVAPGESVLSVNGRIVGPIGSDGFQSADFKALEEFEWKKRTEPIVKAFETVIPYLSDDKYRFADVVSSSSSVVAASQQLDPSEIGLFDAPPRPRQRNYKLLAANYTAIRIGDEESALYRVAVILDPISETSQKWSSLIKWLVNIPDVWVEIHLNSKGYYDDLPIKRFYRYNLAPTLRFNDNGEEVAAVARFEGIPVDPIYTLAMDVPTSWLVRPNVALYDLDNIQLNKLFPGDTSVEAIFQLDHIVIEGHARDVKLGSAPRGVQLELTSSEGVPIDDTLVVYNLGYFQFKAGPGVFQLKIRPGRSQEIFKLESAGNEGWDSPSVEEAGDTITVTSFEGITLYPRLARLPGKEKEDVLAEADEEESKSVFEEFTDRFKSLFGSAKKDSKDLVPVKQQADINIFTVASGLLYERFVGIMILSVLKNTNSSVKFWFIENFLSPSFLEFIPHMAEKYNFEYELVTYKWPSWLRAQTEKQRIIWAYKILFLDVLFPLDLKKVIFVDADQIVRADLQELVDLDLEGAPYGYTPMGDDNTDMEGFRFWKTGYWKEFLQGKPYHISALYVIDLVRFRQLAAGDILRGQYQQLSADPNSLANLDQDLPNNLQQQVPIFSLDEDWLWCETWCSKDRLHRAKTIDLCQNPLTKEPKLARARQIPEWEEYDAEIARLARDLAAEGKIHTRMATADANVLAGGGPPNTDKSDGVEDETNVQTPPNEASTRHVENKQSTHDEL

SEQ ID NO: 4546 - protein, 1562 aa, Lodderomyces elongisporus
MVLWLTFFLPFFITFAASLHNDLPKVGGEVLLHVEAPWNDTDFKALLIESIAGFNESLYLPALELIYGLGDSEEVDLANDKEVYESVITGLSIEQSDIDFINFNLVYKRFAPRVIAHYNHYEQVLLKQNFNKQLLVHCEKDLFGEIVEKKNGEIPAWVSYNNEIYCSVSDLFALKTIRGGGSNNRNSDSDRDINISISNDRKGHTLFDRVIGINKGAPLVQFYGDPSAESTQRFLSLLHQEAIAGKLQFVWRYVPLGSPKKRNFLAGYSCELVKLDTIGSEPNSSTLSLQKNFAEIANSSTCVESTAITTTITTTTTTTAKKTKSETKTNLDTLNEIGYKLTSFVLFNKYSMAKVDVLRTIVNNFPKFLYFLDKFPENYHVRKVKTKAIENENMGLLRDSIGLYINGSPIHHLELDVFKLVEKIQQEQSIVENLVELGFDSKQAKLLIQKFALLSSVKQSQFDSGNTIMGNNDNRFMVFKSLFRKSNALKGGVVFFNNIEKDQNYQDYQDNPYAAYLGPDSQTLKPNQIPPLRENVHDIIFAINLADKQQLKIMFAMSKLILDSGIPQQIGVLPLSGSSMDLDIANRFYHILKVLNPQEALAFLYKYLDDSDNFEKVFEKVDLEKNFNVNLNTIPEKYSIFKPSVIVNGVIYDLSLPTWQMSMSKQIAQDISSLKANLKQAPSSRGLKNILYNNAKARRNARISQNPRDSLYKLIGDDLLEISHLFKKKELGQMNQIAATMWFVSDFSHEDSLKQFINLLKLIELGASIQVRVLNLGNTSIFKELMKNLQQQQQQQQQQQQRYGNNVVDFSALTDSSLGQLYDVIRNGQLSTQRNETIVKAVEHMQLPTQHSYMLLNSRYLRMDIVYSVNDLEELLEFEWKQRLNMIEDVVSAYPEAFHNFDLIDFAHEMSKLGHKSINDWFDLLSSVVTKSFHVDDKTFVVDVNRFDFDSVDMSNSIEILPYTEKKTVDVLLIIDPMDESFSQKAINMIAAIESFSFVNIRILLQPGIIGNGGVMGSETLPYKRFYRGIYPSSIPIFGTNGQWLLDTKPSAVYENLPFANYLLKTEYPEKWVVEGNGYFPTNMDPDCFNPSLSNVYFNFKMTGLLVDGYARDIHTGRTPEQLQLELSSDNSKTDTLVMSALNYFQMKAPPGVSQSLSASSDHVLLSASRNKYDSNVAIEELQTFDVPVFDLSGTQLHVRVDDTLSKAFLKRKQENDKLQVQNQKRKSKTRFDSNLNIFTTICKKLDESLVGKLIASVRKYNPSADVTFWVLSNYASSTFKAMKLQLETEYNVTIEFVTYKWPNFVRRQLLKQKICQGYKVLFLDVLFPQELENVVYMSPNLICRADLSTLVNLELYNAPYAFPSMCEDKENGDVDMFWKHGYWHEILGKNGLNYHSSEMFVANLTRIRDLGIGNVLRSHYQKLSSDSQSLHILDQDLVNNLQGRIKIETLSNVWGWTDKWCPKSTLQGAKIITYEENESDDERGSKGLVVSQEIPELKAYEKKIKMLYQNAQNIIEISQRLDPKLGGTAGADEEEQAGDFVEEASDGEEGGWDDTDYHDEL

SEQ ID NO: 4547 - protein, 1520 aa, Basidiobolus meristosporus
MVSFKFSALLSVVYLSSAAVADTPPVKTWLQTSWGAPDVALEILEYVSKQNGTAFFPLLDAITKSDISEKSQAVKYNSILSLIEKQELLSPPFTGPLLKLSLAVHDTAPAVQAYYHYYNVSVIPEHMERDSSFDVTCSVWADWYGEQICDVEKLRSRVSKYSASTVNPTSKLLVFDHIQNPDGVDLKETPMVILYANPLSEKFKEFHDYLYELSEQALLSYVLRYKPTDKKVDPLYLSGYGVELALKNTEYMVVDDRKVDHDEKDDAQARSTILHGEEGSSNAEVDKLDEEIPEIKALRSGQIKSLGIKTMQYILQSQQPLRILRQISQNFPKYAHILAQQPTNTTFEREMNNPSGVSPGTNLININGLPVDTTQINPFSLVKLLRTEASIIAALESFSINPRQAIELLSSAHLSASGDNAVFQDIFDVRASDQAITWWNDLEKDRRYSNWPKGMFSLLSPVYPGQMRYIRKNIFSALFALDLSVKEHLNLVVNDISEFIRQEVPVRFGIVPIVDQSDSNASLMAKSFEYFLTEYGRIPAMTFLKTVYEKLGQPSGEFNRVIQDSFESTVASSKIKNPEAPTTFEAFLHDQKYDEILAEIRDFSTRFNFTPGKNAGMFLNGKYFDVEQGYQRNLIETYRIHVEYLQMAVYRREITDETNVYEHFLTLPSAYPRRNPILFVSDKQPLDMIGLDSLTQHTDQLFDTILYVSDAQPQPVSLWLISDFTTEEGAKLGLEALKSYGESPDFRVAFIHKGSGHAQGDASLILYNALANGGENQIAELKSLFENIVAHEPLDSRIQALEELKPVAAAHWDQYKRFLNNAIKPHQGVGSIIINGRIINSIPSVKQLSADDIAFLVKYERRERVDPLLAALKELNLVTITDSPDSIMKICFVVNQSPMLHASQDGFENKPAVRSRLNFDHQSPEKLITVGDQDKAIFDIQGVLDPLSEDAQKWTSVLEALAELDIVRIQILLNPVRNLEKLPIKRFYRYVFQHEPRFDPETGNLIAPLARFNGLPSDPLLTLGMDTISPWLVTPIASIHDLDNIRLADLDDRNKRGVEATFQLKHILVEGHCRDMTTNAPPRGLQLVLGTTSFPSLVDTIVMANLGYLQLKANPGVWKLSLRDGRSKELYHLESSGSQGWYSGTVEEIGNEVVLNNFEGVVIFPRVRKNSGMENQELDQESAKENEKAGFWASLKSKIFKEKSNEAPEASKEIQKRQAEINVFSVASGHLYERFLSIMILSVLKNTESTVKFWFIENFLSPSFKDFLPHMAKEHNFDYELVTYKWPHWLRGQTEKQRTIWGYKILFLDVLFPLDLNKVIFVDADQVVRADLKELVDMDLHGAPYGYTPFCDDRPEIDGFRFWKHGYWQNHLQGKPYHISALYVIDLNRFRQMAAGDRLRGQYHALSADPNSLANLDQDLPNNMQHEVPIHSLPVEWLWCETWCSDGSLKKAKTIDLCNNPMTKEPKLERAKRLLPEWEGYDEEVHQLVKRLNSDKRSAKESATVIQSATVAAPEIKDEL

SEQ ID NO: 4548 - protein, 1651 aa, Trypanosoma conorhini
MARQTDWGESRRRLAATLTVLLLLGGSSVLVGTPTVEGKGVKVTVTAPWTETPLLQEGCEMVAARGALLGGFYHCLQEAWHRVQAVNSTGGAQSLTQKAQYDVLLEMMAKANWPPVQMELAKMKLAARFYSPAVQAHWQLARTARELAGGCSTEGGRPFVLVAGKVVCSEYFLEEILSGPASADEAHEGKEEEAFSLFAGLDHVHPGSAGGRVVILYGIVGEEQTMRLFQVAERHLRTLRLAFRHLPVVGRMWENALHVQGYGVTVDLKNVEYKVINEKNTDGTQTDAGVAEATKGPESLGAVGGFNLDMLAQRYPQLRPQLTTFAGHLADAIDRDEVRVDFQVWETQYMGIAAAQRVMDAENEKRLGVLMNILTNFPLHASKLSKMGASVNNNMSKVMHKELLDFAGVLRPGAPQVFLNGRHVSNADLNLFSLLEKLEADEELFQGLRRVLTSYRVPTANDDGFALVHKDVLNQAMKSVTESARRRLASHGLEKGDSTPRVWMPQRGIFWLNNLEADVRFAYMPSALRAILTTRPNGVPVIPRKNLVHAVSVVDPTTLEGVQDIGVILKLDQSNQPIRFGIVFADREWSPEISVSTEVDDIRLKPSLSSVTAIITATVWELLNGEERLQEVLEFLSEVVYTLEALGGLSEDGVVGFSANVLTLSGKRDVREVLADPLFVEYYQTTQAKLRQLMLGKFPLTLINGNVFQENVLQALRQGFMIELMHVRGLVVRGDLTDDDKVDFYESILRLSGARERYNAALYKDEAYMDWTPKPILDFLHHRPFLHPTKRTEGTPLVTSVLAIQSPMGATALGALLKATGNLLQCVNATEKCIHVRLTYAICGAATEVNYHTLAGDLERLLLRRKEGEDGNQQRLQLVHEFLLKIAAQNKTRELDDPKVYESWFASMKFSPELQSLLDASDAGLDAQLQTQRGLLRGFCAQVGAESSFAELSLADAAAARERQKNEGSVYYYVNGRRLVYNDDLSAEDLKDADQQELSLAEAVSEALSEVSFTRLSDELQQGELDSRFYASKVAALTELWRRDAARGSPMEEERHLPSTSGLASFVVQPVNAGAEPHHTLTMVVDPVARHSQLLVSLCDYVTRLPLGVSCIVHMGTPQQLAKPMRNFYLFVSELEMRFDAVGGVLPPAAVFHRLPSRHLLTLGIEEPESWTVFPLDAKYDLDNLILDQLPSSSQYAHATYGINSILLTGSAREAGRPVPASGLPLMIRSTRTNPAAALTRDTIVMAILGYFQLQSSPGVWYLTVQPGGFAETFYISQVNHIPLNDAGNKKRISGFNYTAGQNIPVVISSFIGKALTLDISKTPGRERMTMSDIEAAYPERADWPPAGPRTTKPRSPTLNIFSVASGHLYERFLRMMIHSVMRTSSDVHGANTTRIKFWLIENFLSPQFKALIPLLASHYGFDVALVTYRWPWWLHKQTEKQRTIWAYKVLFLDVLFPLDVERVIFVDADQTVQADLHELYNMNIGGAPTAYTPFCRKYPNLATKNFRFWDQGFWAQHLRGRPYHISAIYLVDLRRLRAMAGGDKYRMMYSQLSPDPNSLANLDQDLPNFMQDEVPIYSLPEEWLWCETWCGAESKARAKTIDLCNNPLTKMPKLDNAKLIIPGWEETDAELEALSDKLLKKQQQQQQSEN

SEQ ID NO: 4549 - protein, 1564 aa, Galleria mellonella
MQVTGFRILFFIWAIVFVALTNGTGQPNRDEKKAKSVTTFVSAKWEVTPIVLELAEYLSSENTDLFWSFVDGINSLKSSLEVLDTDKQVYDACVGVASTLLVPAQLRMAKLALSMHLTSPTVRMFDQIATQNGAKDVACDTFVHIASRKVCDNDVLRDILKSYDQYNAEEHKLETYLLDHTYPSSDNKSLTAILYGELGMIEFATKHKILSTYADKGVINYVVRWNVKPRGKPKVRLSGYGVELQLKSTEYKSQDDTTPKESEDGEAPTPSEEEDENDPQNQIDGFNFGRLKNLFPALRSPLERFRRHLSESSEELEPLKVWQMQALSMQAAAAVVDAHDAGGDEALKVLSSIAQNFPMQTKSLIHVNVPRSFRDEVLYNQDIWASSLGLRAAEPLLLVSGAQYDAEDIDLLGLLAALREDIGPMNTLHALGLSKKTINTLMSLELGESYTWEEYGLDIRDTAITWLNDLETDERYRRWPSSYMELLRPTYPGMLRNLRRNIYNYVIVIDPTSYASGPPLKLGETLLRHATPVRVGLVLAPSSGPLETAVRSAFNYIAQEKNSNKEAFFFLSQLLNNQEESLNIEQVKKQLKKYVSSGTNIDAIISEDDYNFGRQLAEEFVSKLGSNKYPQVLINGVPLSEEGGAGSSSVEVLEETLVTSLSRHTARLQRAVFRGDLADTDDALDYLMKQPHVMPRLNRRVLGADSSQYLDLSGVPSSSELFTEDKVHRLMHLTGRDALATALPLLKYFTKAGKNDKITQTIWVAGDLNDKLCRELLKNALTFMTESGGVRVAFIPNVDGSPSVDQSLNKVVIAALATLEPAKATKYVMQLLEDEGCHEKQNCDILPELVAALQQHAWTLRAARVLCARALRLRSGARALVHNARLIGPFADDEQFTLDDFLLLERFSNRVYADKISEVLDKKKTSKNDVLDDDDSEERAPLTADERVRATAVLAARSPRARTPLPSGLRTEHSLVDLPPLIPDEAAIEIVAVLDPASVAAQHVAPLLLVLRRVVNCRIKLFLNPQDKNSDMPLKSFYRYVLEPELQFTSTGAATGGAGARFGRLPHAPLLSLELRTPPNWLVECVKSVYDLDNIRLADVDTLVHSEFELEYLLLEGHAWDVGVGTPPRGLQLVLGTRDRPDMVDTIVMANLGYFQLKANPGAWMLRLRPGRSDDIYEIVGHENTDTPAGSADIQVLMSSFRSHVIKLRVNKKPDRQHLDLLVENDDNNSGGIWNSIASSFGGGEEQEVQDETINVFSVASGHLYERFLRIMMLSVLKNTKSPVKFWFLKNYLSPSLKDSLPYMAQEYGFEYELVQYQWPRWLQRQRDRQRTIWGYKILFLDVLFPLHVKKIIFVDADQIVRADLKELVDLDLGGAPYGYTPFCDSRKEMEGFRFWKQGYWRNHLQGRSYHISALYVVDLKRFRRIAAGDRLRGQYQALSQDPNSLSNLDQDLPNNMIHQVAIKSLPQEWLWCETWCDDKSKKYAKTIDLCNNPMTKEAKLSAAMRIVPEWREYDEEIKALQARVRRGLYQAADHEQEIENVPHDENLPTGNHIKKEHGQHTEL

SEQ ID NO: 4550 - protein, 807 aa, Emiliania huxleyi
MQTLSAEVRTVQRLVRTGKLTDEHQDVYATIANATATFPRYNEALLQPIDKVVMAGLKPSAHLGAIKWLATPPAPPSPPSEAAPPVAAPPPAEEDMYAYAGARACRWGAAQRSRVGFAAWEKLLQTTHDFGAARRLLALLHAAALAGEALTPELLASAVPEAFSAAETANLIAGVKSVVAPHHAALCRSLGVSAAPAIVVNGRLVDAATAGKLDAAPGATLVRELVGEDAAEEAADAGGAPSAEEFGQRSDLLMLAALELTAVLDPLSKEAQRAVPILMALHESLGLSVTLHLNPSLQIDKFPLESFYRYVVSLEPSFDNAGRSLSPQLDRALFSSLRTPQVLTLHVDAPEAWLLECTEAAYDMDNLRLAELGDRRTVSAVYELASLLITGSCEDVGSRHPPNGLQLLLGTTAQPHATDTLVMSNLGYFQLKAAPGVWDLSLAPGPSSEVFTLRTAPALLAAGHSTRAFRGGMQRIDPATLNDAAAVRVTMADFTGANILLLAQKRPGLESWWSGGEKGDASETVHVFSLAHLYERFLKIMLQSVLQRTKRHVKFWFLKNFLSPAFIGSLPAMAAALGIERGRGHALGFEYGLVQYQWPSWLHKQTDKQRIIWGYKILFLDVMFPLSVVNADVGELWDMKLPGRAAVAMTPFCQADANPDTTGFRFFAQGYWRDHLQGRPYHISALFVVDLHKFRRRAYGDQYRVFYDSLSKDPNSLSNLDQDLPNYAQHVVPIHSLPEEWLWCETWCGNTSKPRAKTIDLCNNPLTKEPKLSQATRVIGERWSALDAVAKGIEEAESPAQPSRDEL

SEQ ID NO: 4551 - protein, 1530 aa, Carassius auratus
MIMRVVFVVLVLLRVHHVHSASKGVVASLQAKWSMTPLLLETSEFIREDGEEKFWQFVDTVKELTVYKNGESVRSYYNLIIKKAGQFLTDLQVNLLKLSLSLRAYSPAVHAFQQIASDEPPPDGCTAFVVVHGQNACSTKDMKKLLKTAAGRPRPYLYKSDHQYPGGNGTDLPVAVLYAEIGTKEFNTFHKVLSERAQEGKLVYVLRHFVFEPKNEKMLLSGYGVELAIKSTEYKAVDDTQVKESKSVTADNEDENEEVQGFLFGKLKKSHPELQEELGELRKHLLESTNDMTPLKVWELQDLSFQAASRIMTVPKFDSLKLMQDLSQNFPSRARSLTRVAVNQDMRKEIEDNQKRLSESMGIQPGDASLFINGIHVDLDIHNAFSILDILRTEAKILEGLHNLGIRGSSVSKFLHLPSSTTVEDSYALDIRHSSVMWVNDIEKDSMYRHWPSSVQELLRATFPGVIRQIRRNFYNLVLFLDPIQEESIELVKLAELFYKHNIPLRIGFVLVVSTDDKVDGYSDAGVALFRLLNYISEEYDEAQAFTSMVSIYNRVEVGEILSVNTVTAYLKKKFPKANAARILGVDSSYDDNRKAGGGFYKKSGLGALPVGLFNGIPLSSDEMDPEELETVLLQKIMETTNFFQRAVFMGQITESVDVVDFLMEQANVVPRINPLILSSERRYLDFTSSPVADDWDDTTMFSYLDSKDKTAVVSKRMKYFIREEEEVLYGVTMWIVADIEQPSGRQLLRNALKHMKSSSSNCRVGVINNPSGKPTEDNSALYRAVWASLLTQSSKNMLDFTLKLLKEENVELLKQGTKIKHLLKQGMDHDAFEKKFNTMEVDFLHSQQKYCKDVLKLKAGQRAVVSNGRVLSLLDDEEEFSAEDFHLLEKITLRTSAEKIKSKIKQMSLNAQKASDLIMKVDALLTASPKGEARKDVKLLKDKHSVLQLAQREDEVFYDVVAIVDPLTRDAQKLAPLLVVLGQVVNMKVQVFMNCRAKLSEMPLKSFYQYVLEPDVSFFGNNSLSPGPVARFTEIPESPLLTLNMITPESWMVEPVRSPYDLDNIHLQEVSGVVNADYELEYLLLEGHCFDLSTGQPPRGLQFTLGMRQEPLMHDTIVMANLGYFQLKANPGAWILRMREGRSEDIYQIQAHDGTDSPDDAGDVIVVLNSFHSKIIKVRVQKKPDKLNEDLLSEGTESKGLWDSLTSVWSSLEKSFAGGPSVDGDDKKKDVLNIFSVASGHLYERFLRIMMLSVLQHTKTPVKFWFLKNYLSPSFKDTISHMAKAYGFQYELVQYKWPRWLHQQTEKQRIIWGYKILFLDVLFPLAVDKIIFVDADQIVRADLKELRDLDLEGAPYGYTPFCDSRKEMEGYRFWKTGYWASHLAHRKYHISALYVVDLKKFRKIAAGDRLRGQYQALSQDPNSLSNLDQDLPNNMIHQVAIKSLPQEWMWCETWCDDNSKTTAKTIDLCNNPKTKEPKLSAAVRIVPEWSKYDNEIKQFLKQVKEQEEITEDRSSSSSSQHTGTRRDEL

SEQ ID NO: 4552 - protein, 1610 aa, Nelumbo nucifera
  MOD_RES (1158)..(1158): Any amino acid
MELRFRSRSLGTCFLILLFLIFVSSAVLAENRRPKNVQVSLRAKWSGTPLLLEAGELLSTGWKDLFWEFIEVWLHEEDNIDYYTAKDCVHKIIKHVRPLISEPLASLLEFSLPLRSASPRLVLYRQLAEDSLSSFPPSDVTITNGFTSNVSESVANAGSKKIGELLVGKNPISPGGKCCWVDIGSSLIFDISELLLWLSHSGLSGDALQQPELFEFDHVHFGSSVSGPIAVLYGALGTDCFKEFHVALVEASIKGKVKYVVRPVLPSGCEAASGQCGAIGTGDSPNLGGYGVELALKNMEYKAMDDSTIKKGVTLEDPHTDDLSQEVRGFIFSRILERNPELTTEIMAFRDYLLSSTISDTLDIWELKDLGHQTAQRIVHASDPLQAMQEINQNFPSVVSSLSRMKLNHSIKDEILSNQRMVPPGKSLVALNGALINIEDIDLYLLMDIVQQELSLADQFSKFKIPQSTIRKLLSTLPPSESNAVRVDFRSVHVHYLNNLEVDAMYKRWRSNLNDLLMPVFPGQLRYIRKNLFHAVYVLDPASVCGLESIDMILSLYENNYPIRFGIIFYSSKFIKKIEDHNGEIPLFSDGVIDSHSPDDISSLIIRLFVHVKDTYGAQTAFQFLSNVNRLSRTSDDSSEDSLEVHHVEGAFVEAILSKAKSPPQDVLLKLEKELTFKEQAEESSLFVYKLGLSKLQCCLLMNGLVHEPTEDALINAINDELPRIQEQVYFGHINSHTDVLDKFLSESGYHRYNPQIIGQGKGQKRFISLSASTLGSELLLNDINYLHSAGTADDLKPVTHLLAVNLTSREGIKLLHEGIRYLMGGSKRGRVGFLFTAKGNPHSLSFYFLKAFQFTASSLGDKESVLKFLDKLCSFYEQEFTHASLTDATDTMAFINRVCDLAIESGLPSEGYKAALSDFSMEMLVKHLDKVSHFLYGQLGLEFGATAVITNGRVTLLGRSTFLCHDLGLLESMEFEQRIKHIMGIIEEMEWHDIDSDLVTSKYISDIIMLVSSSLSLRERNSDSARFEILNAKYSAIVLNNENSSVHIDAVVDPLSPLGQKLSPLLHILWKCIKPSMRIVLNPLSSLVDLPLKNYYRYVVPTMDDFSGVDKSVNGPKAFFANMPLSKTLTMNLDVPEPWLVEPIIAVHDLDNILLEXLGETRTLQAVYELEALILTGHCSEKDHDPPRGLQLILGTKNRPHLVDTIVMANLGYWQMKVSPGVWYLQLAPGRSSDLYILKENGDRSQHSSLLKQITINDLRGKLVHLEVVKKMGKEHEQLLDSSAESSHLQERKEHKSGGRHGKTINIFSIASGHLYERFLKIMILSVLRNTQRPVKFWFIKNYLSPQFKDLIPHMAQEYEFQYELITYKWPTWLHKQKEKQRIIWAYKILFLDVIFPISLEKVIFVDADQVVRADMGELYDMDIKGRPLAYTPFCDNNKDMDGYRFWRQGFWKEHLRGKPYHISALYVVDLVKFRQTAAGDNLRVFYETLSKDPNSLANLDQDLPNYAQHTVPIFSLPQEWLWCESWCGNATKSKAKTIDLCNNPMTKEPKLQGAKRIISEWTDIDSEARRFTAGLLGENKKQESIPPGQTGNSVDVRSDEDMESKSEL

SEQ ID NO: 4553 - protein, 1489 aa, Hypoxylon sp.
MIRLFQLPCGLAATFLAALCLGPSHVVAGPSVNVAMQAAFPAPPYLVELLETAAGENATSYFALLDRIADGTFTNSKTDKQLYEKFLEVLKEDGHMASSEALSTFKLALSMRSAAPRIEAHYQYYDTAVAPSLGEARDDCAEWILLSGKQYCSASLAHAEGHISGDSQLRSLPFDRALGAGSEAILYADITKPEFGAFHKSLADMARKGEVSYRLRYRIDRAEKREPLPVSGYGVELQLKRTDYIVIDDRDAGTETDSAAKPAPTDVVLDGEEEVTDLKPLSSSELSSLGLKAGSFIMQSEDPFQTLIKLTQDFPKFSGSIAAHNASDAFVKEHRQNRALGVPAGMNVFWMNGVQLIERQIDPFTLVDSIRRERKLIEGVTDLGLTGKEAVSLLGNREVTIAKSDDEPRRFDWRDEIEEGRVIIWLNNIEKDKRYADYPKSLMALMQRTYPGQIPPIRKDIFNLIVPVDLTKSEDLSLVVEQLQGYIRRLLPVRFGLVPLTRTKEAEERAKVAYHLLENYGLATLMSYLELCKKGGSDQANFGKAVKDRTPKAESTPLPFKEVLESEDHIKQVELAKHWVERLNADTEVPPLFLNGIAIPREDTWLQMMTMRMSTDLQLVQQGVFMGQVDDETWIPGLFLEGAPTRRNPYIFMEGDNTLTVLNVNKLYTEHKDLFDLVPVIEANEDTSKETWATLTVVADLSSQQGLRLLLSALAFRRNNPGVRLDIVHNPSRSSNAHEINALLKKDIAKLLEIENLETLEVLLSGPVDVRDDGYNTALSRFLTAAAITPGSQLLILNGRVVGPLAPNSEFKEADFDLLLEFEQATRILPVYKAIDSLGLTDKVSGPLAAAKLTSVTALSTISDLPEGIFESAPTLRTTMYDQWNSSYTMIDTGDAATANIHFVAMINPASEVGQKWAPILKVLSQLDGVYMRIFLNPKEKLEELPVKRFYRYVLDSAPSFDEAGKVKPLGATFKGLPSEALLNLGMDVPPAWLVAAKYSVHDLDNLKLSSIKTDVDAVYELEHILIEGHSRETTSSPPRGVQLLLGTERDPHVDDTIIMANLGYFQFKANPGYYNITLKEGRSSEIFNIISVGAKGYNAVPGDEGTEVALMGFQGTTLYPRLERKPGMELEDVLEESSSDSSGDIISRGLKFAEGILGGSKPKPKSVSDEVHAEINIFSVASGHLYERMLNIMMVSVMKNTNHTVKFWFIEQFLSPSFKDFIPHLAKEYGFKYEMVTYKWPHWLRQQKEKQREIWGYKILFLDVLFPLSLDKVIFVDADQIVRTDMIDLVNLDLEGAPYGFTPMCDSRTEMEGFRFWKQGYWKNYLRGSPYHISALYVVDLKRFRQLAAGDRLRQHYHQLSADPASLSNLDQDLPNHMQFVIPIHSLPQEWLWCETWCSDESLKEARTIDLCNNPQTKEPKLDRARRQVPEWTVYDEEIAALDRRRKGLATTLDDTQKVLSGSAEEKNTKSRRFEKESQPKTRTKDEL

SEQ ID NO: 4554 - protein, 486 aa, Laodelphax striatellus
MISDSSLFVLLPVSSTSQPPSPAHSSADPKWQAPAFDITVIVDPVSRGAQKIGPILSVLRQVVNCDIRIFLNCVEKNSDMPLKSFYRYVLEPEVQFTADGHLAAGPYAKFTNMPGAPLLTQNMHVPENWLVESIVSPYDLDNIRLEEVQSVVHSQFELEHLLLEGHCFEATMGNPPRGLQITLGTESEPVVVDTIVMANLGYFQLKANPGAWILRLRQGRSSEIFDITSHEGSDTPVNSTDIKVLISSFRSHVLKLRVTKKPDKIGMDLLGEDDDSQPGLWNSITSTFGSSKEEQVEAETINIFSVASGHLYERFLRIMMLSVLKNTKSPVKFWFLKNYLSPTFKDFLPRMAKEYGFQYELVQYKWPRWLHQQTEKQRIIWGYKILFLDVLFPLDVKKIIFVDADQVVRADMKELVDLDLGGAPYGYTPFCESRTTMDGFRFWKHGYWRNHLQGRRYHISALYVVDLRRLEAWLLAKSLARQTLPY

SEQ ID NO: 4555 - protein, 1795 aa, Leptomonas pyrrhocoris
MNTPPCNSRALLRLAVLLAFSALLCTTQHTNAKGIHVTVEASWNETSFLQEGCEWAGRTFGPTAFYSCVNALWDYHLRRGNDPVDGNSAASHEAVSARYSTQEVQYTAIWELARTLTETQMADTALFAVEMSSRVYSPAVEAHYATATQTLSAISASEQGDIAAASASPPRSTGPCGEPFGVLYTPALSASGQMQAQPVHSAVELKALLTALEQHQGTADSSSPSSRVPVVSVRDVSLTRLDYRYPSRAPQSEVSAVLVLYGLLGSSATKELHEAAVEWMEKGEGTVRPTSDAATTPTLAYFFRHLPVSRTRLCGPTAAEQVHESKDHAALVEEQWDTPLVVQGYGVTVDFKNMEYKVLDEKATAQQRAKAEAEGNDAAASSPAETLLAPADQADRVVAGFHMRRLTERYPHLALSLKELATLVEDEMGGRDLKVDFDVWELQNIGLAATQYIREVENSSRRLHVLKDVVNRFPLYAAALSRIAAQPNRLEVVQKALAGVRQRLSPGVSALFVEGWRVEAKDLSLFGVLDALKSNEAVSHHIKRALTTRLVPPGEEENNAVAARNVATVKVAPTLLEKVSNYVKRAAWRAAEEHGAGATSDAAFAIPDQYVTWLNDVEAEERFEGMPRQLKTFFTQASGVTPFPRRNLLHFVFIWNALRRSHLQRISMIYNLNRQGLLARYGLLLLDPEWSPEVASETTTATGAAGQAAGFAGQSSLSPEVLAISALAYHLAQAGQPQALIEVIVQLLQAHAAEDAISEDLISSNTVQQVCRGVADAVFGSSLEELMSNVDFVNHYHETQAMLRRFPMAEYPAALINGVVLDSYGGALPAALHKEVLQLREWVANGDLTDDMEDLYTQILQLRGAADHLQPALLRPPQTMPWTSTQAVVAFIEDAPYLYSAAYAFDVPSLTQILTLPCHATESTLHQLQTVLSALQSCADVTSERDAHYAVCRSLRVSIVSCPAAIATTTAADISPSSSDVSRYIAALLRQTVQRDVAEAKRLITIQRYVSHLRKALAMSPTVGGTQRRAGVLDRATVTAALAHDPLPDDLQVKETGTPADVLQRVSGSRDFWAALGAAMPARDVNVTLVTNGRLIAMDDTFTAWDVLEAARQMLPMTKAIEEAVVKVNFAEMTSVDADGAQFTSDEMDNAFYGGKIACLTSVFEHEKMAHEAVKSASPLVREEHLFASAEDRKRLRAVLFSVNNTPNGAASTGDGEELHRITAVVDPSSRDAQLIVSLVSYLMESPLRLRLTVLLNPSLDVKFPIRDFYEYVASARVNFDASSGRVMAPAATFTQLPARALLTLGVEEPPTWTVFSQAAEEDLDNILLSQLSPGTPFVFAVYRMHSILVTGDATDVLVGRPPDGLPLSLTTANARSTDTQVMANQNGYYQLQAGPGLWYLSVKPGPVAAAYCIEAIGPHPIPACAEGRGEINFTQGQHIPVVLDSFSGRYLSLRVRHTPTSSLPTSATGDGSGRDLHAILQKMASDVTHTWPPPWRARVARPHPPAKPTLHVFSVASGHLYERFLRMMFYSVHRTSSDKYGANTTRIKFWVIENFLSPQFKRYIPLLAAELGFEVGFVTYRWPWWLPRQTEKQRKIWAYKILFLDVIFPLDVDRVIFVDADQTAQADLHELYNMDIGNSPVAMTPFCQKYRNEATVPFRFWEHGFWVDHLRGKPYHISAIFLVDLRRFRAMLAGDSYRSTYANLALDPNSLANLDQDLPNYLQANIPIFSLPEQWLWCETWCSAKSKSKAKTIDLCNNPLTKMPKLDNAKMVIPGWEELDNKLQNMSDSLLGLH

SEQ ID NO: 4556 - protein, 1189 aa, Aphanomyces astaci
MSLMWMGVATVVAAACSSVAESRQVQVNLTTSFLASPLHPVLETSEYLSQDNPALFFTYVAAVDVRYNAIKDKNNVNYTKVALEAAADVLPADSSVSRLLPFVLQTRAHSPSIELFNQTCAASGQHDFQLPVDHEYPSSNTAAATAPHVIVYGALTSPSFRAFHSTFVPLAVTGKVHYIVRHAPTDNTLPVLVHGYGVTLHVKNMEYKSFDDSKATSSHNSTATEDDIDADQDEFVVSVLMKKNDEVAQALREYLDGFEGAHGTDDDEDAKDVTTPAPWQLTQLGYLATQYIMAAEDPLKRLQLLSQNFPKYASSLVLASKPVPQQTIDDINHARSQVATQRLYNRIVVNGLPVDFNEYGFNAFDFLKSLNGELRLADTLAKLDPTGSIKAAMGSLSSAPSDVRISLRGPVDGDAPLYLNSIETDEETAEWPTDLGSLRGPSWSLIYLRKTIVEDKDVATVFHVSKMFLAARANGKSARDKYLREVLSLNDLTVKEVLQIYSQAVGERYTNDDWLQTAKAILTDGDNDGVWAMTNLVAEKNLPINSQVFNGVVRKHVNVQEDIMTHFARDQPLYQTLVRANQITDDSDMLSELLGNDETYAVFCPWFDPEYKPPTTVVQLDWNDPVRCFLPDQHVIYVNGRPLELVAPVTPSLFDGLVTYESATRSKAVSKAYVSQFKHNVLTAEDAADKTLQLNVVLSMVDSYLKTPRVAAVLPDDVQRPTYSYVTPSGSSSLDVVAYLDPLSDTAQRASGILRMLHSVLHAKITLVLVPPPSYDEFPLKRFYRFLWGGTSSSLVEFDRLPRHPVLTLNIETPELWNVQMVQSDVDIDNIQQNASATFTIKDVLVYGQCVDKTNAQYPTLPNGLQLVLERSVAKLHSHKDTVVMKNLGYFQLQAAPVPVIVYDFLSKTLQLEVKKQPGQEGVRLLDDGPEAPKAPAQPEETSVWTSLVQWGAGSSKLEARKGDTIHVFSLATGRHLYERMLKLMMLSVLKRTNNPVTFWLLENFLSPDFKNSVAALQAEFGMDIRLVTYKWPNWLRRQTDKQRIIWGYKILYWKDHLRGKPYHISALYVVDLVKFKRMAAGDSLRAIYDQLSADPNSLSNLDQDLPNYAQHQIPIFSLPQEWLWCESWCSDESKAEAKTIDLCNNPKHKEPKLDMAKRVISGDLFPESWLQLDAEVKAAEAAYELASN

SEQ ID NO: 4557 - protein, 270 aa, Teladorsagia circumcincta
MMVSVVKNTEKPVKFWLLKNYLSPQFKESLPLLSAKYGFDYALVEYKWPRWLHQQKEKHRVMWGYKILFLDVLFPLDVQKIIFVDADQVVRADLMELMEFDLGGAPYGYVPFCDSRKEMDGFRFWKQGYWSNHLAGRRYHISALYVVDLQKFRQVAAGDRLRGQYQGLSNDPNSLSNLDQDLPNNMIHQVKIKSLPQEWLWCETWCDDASKQSAKTIDLCNNPLTKEPKLDSAIRIIPEWRDYDSEIRGVLKNDRKHQKEAAEDHEHSEL

SEQ ID NO: 4558 - protein, 713 aa, Aphanomyces invadans
MSKKPEADVLTHARLFLQLHLDAAPNDKILTKLNEWLTSTPSFSHPFSFKVDPHDHVIYVNGRPLDLAASPLSAEHFDVLVVHEASTRSKAVSKAYVAQFKHDNLSVEDAADKSLAFNLVMNAIDEYLKVRRVPSVLPEVNPLYSYETPTSQPSGLDVVAYLDPLSETAQRASGILRMLASVLHAKITLVLLPSPSYEEFPLKRFYRFLWGGSESSSVDFVRLPRKPVLTLNIEPPELWNVQMIQSDVDVDNIQDDASATFYIKDVLVYGQCVDRTIVHYPSLPNGLQLTLERSAGTVHSHKDTVVMKNLGYFQLQAAPGVWELGLAKGRHSKLYELVIQEDRATTVPVIVYDFLSSTLQLVVKKQHGQESVRLLDEDEPAHKTTGEAVEEKSYWRSLVQWGSDPPSSKRDARSGDTIHVFSLATGAGHLYERMLKLMMLSVMKRTKNPVTFWLLENFLSPGTKCTVVWLLTTSLASADFKNSVGALQAEFGMDIRFITYKWPNWLRRQTEKQRIIWGYKILFLDVLFPLGVEKIIYVDADQVVRADLNELWTMDLQGRPYGYTPFCDSRNVGYWKDHLRGKPYHISALYVVDLVKFKRMAAGDSLRAIYDQLSADPHSLSNLDQDLPNYAQHQIPIFSLPQEWLWCESWCSDESKRLAKTIDLCNNPKHKEPKLDMAKRVISGDLFPESWLELDAEVKAAEAAYAEGPHLDV

SEQ ID NO: 4559 - protein, 1227 aa, Musa balbisiana
MELRWRSWVLGALFISLLFGGFGGSGCLGFAVNRRPKNVQVSLRAKWAGTSLLLESGSLGYLEQPELFEFDHVYLASSIISPVAILYGAIGTECFKDFHIILAEASKQGKIKYVVRPVLPPRCQAVSSYCSAVGSSDAVNLGGYGVELALKNMEYKAMDDTMIKEDLGHQTVQRIVHASDPLQSMQEINQNFPSIVSSLSRMKLNDSIKDEILANQRMVPPGKSLVALNGALINIEDIDLYLLMDLVQQELSFADHFSKLKLPLSAIQKLLSAAPPSESNAFRIDFRSGHVHYLNNLEEDAMYKRWRSNINEILMPVFPGQLRYIRKNLFHAVYTIDMILSLHQSSIPMRFGIILYSSKLVKMIEENGGHLPSSAVQDDKKRTEDVSSLIIRLFLYVKENYDTQLAFQFLGNVNKLWNSGDDFGEENLEAHHVEGAFVDSLLSKAKSPPHDTLLKLEKELTYKEEADGSSLFVFKLGLSRLECCLLMNGLVYEANQEASINAMNEELPRIQEQVYYGHINSKTDVLEKFLSENGYRRYNPQIGGSKRARVAMLLYSTVGASSTASHFVKAFDTAVSGFLHGQLGLEYGSNAVITNGRIFILKDGSPFLSDDLSLLESVEYELRIKYIYEIIDQVEWVDVDPDDLTSAVNLNTGNSSIHIDAVIDPLSPSGQKLSPLLRILWKCIRPSMRIVLNPVSSLADLPLKNYYRFVVPSLDDFSNVDYSVNGPKAFFSNMPLSKTLTMNLDVPEPWLVEPVVAIHDLDNILLENLGDLRTLQAVFELEALLLTGHCAEKDHDPPRGLQLILGTKRGPHLVDTLVMANLGYWQMKVSPGVWYLQLAPGRSADLYALKEGGAGSPGNRSAKLITINDLRGKLVHLEVAKKRGKEHEELLNASDDQLLEKRKEGQNSWNTNILKWASGMIGSGGLSRKGETRLVRYERFLKIMILSVLKNTQRPVKFWFIKNYLSPQFKDVIPHMAQEYGFQYELITYKWPTWLHKQKEKQRIIWAYKILFLDVIFPLSLRKVIFVDADQIVRADMGDLYDMDLKGRSLAYTPFCDNNKEMDGYRFWRQGFWKDHLQGKPYHISALYVVDLMKFRQTAAGDTLRVYYETLSKDPNSLSNLDQDLPNYAQHTVPIFSLPQEWLWCESWCGNATKAKAKTIDLCNNPMTKEPKLQGARRIVPEWVDLDAEARQLTARILGEEVDSNEPVTSTLPLPDGPQNNHKKDEL

SEQ ID NO: 4560 - protein, 1524 aa, Aplysia californica
MARLFLQGIAILLMIKCYVDAKQKPVNIALSGKWNSTPLLLEASEFLAKESAESFWTFVGRIADQDPDSIQTAADDIKYKLVQKFASELLSPLQLSFLKFSLALRAYSPAVNMYQQIVEQIEIKKDCSSFIDVNGKYTCDTNEMSELLTTAITRSPSPLYQFDHIYPNSGKRKAVVILYAEIGTKGFLEFHPALSKLASGGEITYVLRHFIKNQSPDKVRLSGYGVELSIKSTEYKAKDDTKVEGGGDSDASDDEDDGEEVDGIVFSKLKELHPDLKAELKEFRNHLMDSATELTPFKVWQLQDLSYQASQRIVSAPPNDALQFLQDISQNFPTLARSLVRTAVSTEFKREVKKNKEKFEFQNVGAGESLLYLNGLSVDMEIYDVFTLLDVMVSEARLVEGLHALGFKGNNLQKFLQLDLKEGGDDMSYAVDIRHSAIQYLNDLGQDKKYRTWPNSIQDLLRPTFPGMLRHIAKNIFHLVFVVDPLDSTSKSLLKMAEAFYVHKAPLRLGIAFVVNSDPKADGFTDAGIALVRAYTFVSMDKGAPAKGLSFITDVYEKAGTAELTADAVIAEFALQYPGEDKDLVFGKSDDYDDVRKAGNDFVSRSGLSGMPQVLINGVPLDQSQLGDNFEESVVIEVLKQTQVIQSAVYKGEVNDRTDIMEWWMERDNVLPRLNSRVLAPPAFRVDLTGSAGEDRVSAPALAAELSAKDLTSAISDGLVYLTKREEESVRPVTMWVVADLETSHGRELMYNAIKHVKVSNDLRLSVVFNSLTTKIDNNSINRAVWVALRTLPMPLAKSLVTKLVKEDNAKALLAGTKTLQDLEVHGMDIDKYIADLSAQNTDFLKVHGQFASRVLSLRPGEKAIVTNGAVLGPIGREEELSVEDVNLMERLAYQQAGKKVAEAVSALPDKKEGGSDLVMKVCGLLTSKDKREKRHKIDYYGDKYSVVKIPADSSIPAFTVEAILDPVSREAQKMTPILMVLQQIANVDIRIYLNPREKLSEMPLKNFYRFVLEPEITFDGQGSLSKGPSARFLDLPQKSLLTLSMDTPESWMVGAVTSPYDLDNILLEEVEKSVSADFELEYILMEGHCSDATTMQPPRGLQFVLGTDNAPSVVDTIVMANLGYFQLKANPGLWTLNLRDGRSKEIYNIESHENTDSPLNSSQVFVAINSFKSKIIRVKVAKKPDKMDKSLLSDDGDEGAGLWDSISSTLTGSGNKEEEKDTTLNIFSVASGHLYERFLRIMMLSVLKNTQSKVKFWFLKNYLSPSFKDFIPYMAQEYGFEYELVQYKWPRWLNQQKEKQRIIWGYKILFLDVLFPLDVKKIIFVDADQIVRADLQELHDLDLGGAPYGYTPFCDSRKEMDGFRFWRSGYWKSHLAGRKYHISALYVVDLKRFRRIAAGDRLRGQYQGLSQDPNSLANLDQDLPNNMIHQVAIKSLPQEWLYCETWCDVSEKPKAKTIDLCNNPLTKEPKLAAAMRIVPEWKDYDYEVKVLWDDIYHTNTKEQIEYEPPQLNKKSDTKRKEEL

SEQ ID NO: 4561 - protein, 1472 aa, Cordyceps militaris
MSRHLSSRLIVAVLAASQVAASPSVNVRMQAAFTSGPYLLELLETATAENSSAYFPLLDRIASGRFAKLSTEAELYEEFTSVVRADGHITSPEAQSTFNLDLSLRSSIPRVEANYQYYDTVVALSDIDTSCEAWVLLGGNQYCTPELDTAAKIGVFDSKLSALPFDRSIGVGKGAVLYADPTSPNFGKFHELLQRAAKAGELNYRVRYRRPLNVRNKPLLVSGFGVELALKRTDYIVIDDRASQHEGGAQKPLNTEAIFEEQESTDIRPLSTSELETLGMKSSSFIQSSKSPFETLVKLMQDFPKFSASISAHNVSTSFSEEYQRGYLQRVPRGVNALWMNGLQLIERQIEPFSLVEMLRRERKLLDIVRNLGLDGVDAISLLGHEKVAASKSDTGEAIRYEWTDKLEDGRAIVWLNDLEKDTRYAQYPDELSSLLQRTFPGQIPAIARNVFNVVSALDLSDADDLTVLSQLAVLITRGIPIHFGVVPLTSNTEALKQAKVIRHLIDRYGFNGLQTYIDGLGEDPDPQLTESSFSQVVDSQIAAADTQAHEYAKVLETEEFDTHFKMAREWITRLKAADKTAPVFFVNGALMPRTANWLQSMSMQISEDLQTVQKGVYHGVIGDDAWVPGIFLERALKRRNEYLSIDDAHPLRILDVSKLYEDHQYLFSTIPVQKCDPQAAKEEWAAVTVITDATSLRGVELILSALEFKQSNPGVQIDFIHNPVSTEGASDVNEALKVATSSSSFGTSGEIEKLVREAKTGSSNGDYAISLKRFLSYAELQPGSSSVLLNGRLIGPIAPEDSFLEDDFTQLLGLERKSRILPVLEALDDLGLGDKVYDPISAAKLTSITALSTIPNLPEGIFESSSSIRSTVYEKWDANHTTIEVGDAESASIHLVALLNPLSEQAQRWVPLLRVLSELDGVYLKLFLNPKEKLEELPIKRFFRYVLESKPSFDESGAIRGGQATFNGLPSEALLTLAMDVPPAWLVAAKDSIHDLDNIKLSSTNSDVDATYELEHILIQGHSREGKSSPPRGAQLVLGTAKEPHLTDTIVMANLGFFQFKANPGIYSIHLKEGRSADIFKIESVGAQGWTAVPGDEGTSLALLDFQGTTLYPRLSRKPGMEEIDVLEEGDGRAEGIVSKGFKLAEGLLGNALGRKSSSDLEHAEINIFSVASGHLYERMLNIMMVSVMRHTKHTVKFWFIEQFLSPSFKEFIPHLAEEYGFKYEMVTYKWPHWLRKQKEKQREIWGYKILFLDVLFPLSVDKVIFVDADQIVRTDMMDLVKLDLEGAPYGFTPMCDSRTEMEGFRFWKQGYWANYLRGRPYHISALYVVDLRRFREIAAGDRLRQQYQALSADPNSLANLDQDLPNHMQFQLPIHSLPQEWLWCETWCSDESQSEARTIDLCNNPETKEPKLDRARRQVPEWTEYDDEIAALAKRVKTTDSRDGNGKKANPERNSKSRNFEEPVHTKDEL

SEQ ID NO: 4562 - protein, 1510 aa, Delphinapterus leucas
MAKAGDVVRLLLGSTALWLSLLGARTASASKAVTANLAAKWPETPLLLEASEFMAEESNEKFWQFLETVQELAIYKQTESDYSYYNLILRKAGQFLDNLHINLLKFAFSIRAYSPTIQMFQQIAADEPPPDGCVAFVVIHEKHTCKVNEIKKLLKKATSRPRPYLYKGDHKFPANKENLPVIILYAEMGTRAFRKFHTVLSEKAQNGEILYVLRHYVQKPASQKMYLSGYGVELAIKSTEYKVLDDTQGKTVTNTSIEDITETNEVQGFLFGKLKERYSDLRDNLTTFQKYLIESNNEMMPLKVWELQDLSFQAASQIMSTPVYDAIKLMKDISQNFPIKARSLTRTAVNQRMREEIQENQKHLQDRFEIQPGDAGLYINGLHVDMDSYDPFNLLDMLKLEGKVMNGLRNLGIKEEHMSKFLKLSSPDWDDTYALDIRHSSIMWINDLETDDLYVMWPSSCQELLKPVSPGSIPFIRRNFHNLVLFIDPAQEYTVDFIKLAELFFYHKIPLRIGFVFIVNTDDEVDGKNDAGVALWRAFNYIAEEHDVSQAFISIVHMYQKVENHNILTVDNVKGVLQNEFPHANIWDILGIYSKYDGERKAGASYYRMTGLGPLPQALYNGESFHHEELNIRELETAVLHRMMDETAYLQKEVFMGTLNDRTNAIDFLMDRNNVVPRINPLILYNKWQYLNLISTSVTADVEDSSTFFFLDSQDKSAVIAENMYYVTQEDDVISSVTFWIIADFDKPSGRKLLFNALNHLEISVHGRLGVIYNPTSKIDEDNTAISRGILAAFLTLENSFLRNFLRKLAEEETATAIYSGDKIKRFLTEGMNKNAFEKKYNTIGVNIFRTHQLFCQDVLKLRPGEIGVVSNGKFLGPLDEDFCAEDFYLLEKITLTHLVEKIEDIVENTEVNSKNLSDLVMKIDALLSSLPKHASRYDVTFLEENHSIIKINSQENDMSFDVIAIVDPLTREAQKMAQLLIVLGKIINMKIKLFMNCRGKLSEAPLKSFYRFVLEPELTLPPNDVTGPVAKFLDIPESPLLTLNMITPESWLVETVHSNCDLDNIHLKDIEKTVTAEYELEYLLLEGHCFDIITEEPPWGLQFTLGTKNKPVVVDTIVMANLGYFQLKANPGAWILKLRQGKSEDIYQIVGHEETDSQPDLGEVVVVLNSFKSKILEVQVQKKPDKIQEDILSDKDEKKGVWDSIKSFTRSLHKKEDNKETDVLNIFSVASGHLYERFLRIMMLSVLRNTKTPVKFWFLKNYLSPTFKEVIPHMAEEYGFQYELVQYRWPRWLHQQTEKQRIIWGYKILFLDVLFPLAVDKIIFVDADQVVRHDLKELRDFDLDGAPYGYTPFCDSRTEMDGYRFWKTGYWASHLLRRKYHISALYVVDLKKFRRIAAGDRLRGQYQTLSQDPNSLSNLDQDLPNNMIYQVAIKSLPQDWLWCETWCDDESKQRAKTIDLCNNPKTKEPKLKAAARIVPEWVEYDTEIRQLLDHLENKKKNAILTHDEL

SEQ ID NO: 4563 - protein, 1515 aa, Centruroides sculpturatus
MLQKIWLVYLCYIIINIGTSVFCQKSVSVVLDSKWKYTPLHLETSEFLAEENNELFWRFISEVCKLGPGYLQNLSQQEQYEVILNITSKILSPARLALLKFSLSLRIHSPAVEMFHQIAYDKNLPTSCESVVEINKQFACNVEDLEKLLISVERDDVDIYKVDHHFKTLTSNSLIVILYGEIGTSSFNKFHQYLKNKAENQEVDYVMRHFVLNRSSEKVRLSGYGVELAIKSTEYKAQDDTKVKEDETTQTEEGNKQDEIEGFVFSKLKELYGDQKDKLEELRSHLVESTKEIATLKVWELQELSLQTAQRILSSSIEESLRIMGDVAQNFPIQARSLIHIGVSSDLKKEVEKNQQMFIQYHNIAPSDTALFINGMYFDMEVTDIFTLLQVLKQETRVIEGLHSVSVPESKVSKLLKMDFIEDKQEYAIDIRDSAVQYINDIETDRHYKNWPGSVQDLLRPTYPGMLRNVRKNIYHLIIIADPSQSDAKDIFKLAESFYVHKAPVRIGIIFAANPDTSLNGFENAGVALLNAFNFIAQDKTPYDGLSFITEVYATSEGKEFTPEIVKNHFHSKYPNEDLELIFGDDSDYDTGRRLAWDFINRTGIGNPPQVLINGVALKQSQLNVDMFEDAILTEVMRQTPFIQKSVYKGDLSDFHNVLDYLMSQKNVMPRLNQKILTPGKNFIDLTGVVVEGINQADLPYMSQKDFATTFAAHMNYLTKREEVVFRPLTWWIVGDLETPEGRELLNAALVHLKTSNEIRIGIVHNPLNPDSFKERIITKAVYVSTKVLNRNHAKLFITKLIKTTNAIQLLEGTRKPIDFALSDMNSDEYQATLEKEDDQFLAFHSAFARIVLGLAPGARAVVANGKIIGPFESGEEFLDDDFNLLEKFSMNVYGEKLSKELKGESETAEADSNIMMKATSVLLAQTNSRTRHDIKFYADKHSVLKIPASDPDEPAHELIAIVDPVSRGAQKLSAILLVLQRVINSHLKIFFNCIDKHSSMPLKSFFRFVLEPELHFTSSKQTVLGPMARFNKLPTTSLLTLGMITPENWMVESVRSPYDLDNIHLEQVESGIYAEFELEHLLIEGHCFEQTSGNPPRGLQFTLGTKTSPVMVDTIVMANLGYFQLKANPGTWLLRLRQGRSSDIYNVVSHEGTDSPSGSTEVVVIISNFRSHIIKIRVNKKPGKQYEELLYDDDEDSRSGIWNTITSSFSGDSKNKDEEDDDKINIFSLASGHLYERLLRIMMLSVLKNTQTPVKFWFLKNYLSPTFKDFLPLMAQKYNFEYELVQYKWPRWLNQQTEKQRLIWGYKILFLDVLFPLDIKKIIFVDADQVVRGDMKELRDLDLGGAPYGYTPFCDSRTDMDGYRFWKSGYWASHLAGRKYHISALYVVDLKKFRRIAAGDRLRGQYQGLSQDPNSLANLDQDLPNNMIHQVNIKSLPQEWLWCETWCDDKSKQYAKTIDLCNNPKTKEPKLVSAMRIIPEWKDYDTEIKQLFEQYKEGKVSTKLQTDHDKHEEL

SEQ ID NO: 4564 - protein, 1545 aa, Chrysochloris asiatica
MAAAMALSAVRLLLGAVWLSLLGAGTVAASKAVTAHLAAKWPETPWLLEASEFIAEESNEKFWQFLETVQELAIYKQTESDYSYYNLILKKAGQFLDNLHINLLKFAFSIRAYSPTIQMFQQIAAEEPPPDGCSAFVVVHKEHTCKPSEIQKLLRKAASRPKPYLFQSDHKFPTKKEKLPVVILYAEIGTSAFVKFHKLLSGKAHTGEILYVLRHYIQRPSSWKMYLSGYGVELAIKSTEYKALDDTQIKTANDTVVEDENEASEVQGFLFGKLKEIHSDLRDNLTAFQKYLIESNKEMVPLKVWELQDLSFQAASQIVSAPAYDALKLMKDISQNYPLRARSLTRVAVNQQMRKEIQENQKDLQDRFDIQPGDTRLYINGLRVDTDGYDPFSILDMLKLEGKMMNGLQNLGINGEDISKFLKLNSHTWEYNYALDIRHSSIKWINDLEHDDLYITWSPSCRELLKPAFPGNIPSIRRNFHNLVLFIDPAEEYTLDFIELAELFYSHKIPLRIGFVFILNTDDEVDVTNDAGVALWRAFNYITKEHSVSQAFVHMVQMYEEVSQNILTVDIVKSVLQKKFPQVNVWDVLGMNSKYDEERKAGANFYKMSGLGPLPQALYNGEPFKLEDMTLKDLEMAVLHRMVDTCVYLQREVFMGTLNDRTNVINYLMDKNTVVPRINNLILHSKPQYLNLIPTSVTADLEDFTTFFFLDSQDKSAVIAKNMYYLTPEDDTISAVTLWIIADFDKPSGRKLLFNALKHMRKSVHSRLGVIYNPTSKITEENTAVSRGILTAFLTQKNRNLKYLLRKLTKEEIATAIYFGDKIKTFLTEEIDLNTFEKKYNTIGVNIFRTHQLFCQDVLKLGPGEMGIVSNGKFFGPLDETFYAEDFYLLEKITFNSLVMNIKDIIKNMEISSKNTMSDLVMKVDVLVSSLPERVSRSDVTFLKEHHSIVKINPQEKNLFFDVLAIVDPLTRETQKLSQLLIVLNKIINMKVRLFMNCRGKLSEAPLKSFYRFVLEPELMLGANDLHSPGPVAKFLDIPESPLLTLNLITPEGWLVETVHSNCDLDNIHLKDIERTVTAEYELEYLLLEGHCFDIMTEEPPRGLQFTLGTKNQAVVFDTVVMANLGYFQLKANPGAWILKLRRGKSEDIYQIVGHEGTDSQKDVGNVIVVLNSFKSKILEVQVQKTPGKIEEDILTDKDDKKKGMWDSLKSFTIRLHKEDKRETDVINIFSVASGHLYERFLRIMMLSVLRHTKTPVKFWFLKNYLSPTFKEVIPHMAKEYGFQYELVQYKWPRWLHQQTEKQRIIWGYKILFLDVLFPLAVNKIIFVDADQVVRHDLKELRDLDLGGAPYGYTPFCDSRTEMDGYRFWKTGYWATHLLRRKYHISALYVVDLKKFRKIAAGDRLRGQYQALSQDPNSLSNLDQDLPNNMIYQVAIKSLPQDWLWCETWCDDESKQRAKTIDLCNNPKTKEPKLKAAARIIPEWVEYDAEIRQLLEHIKTKKSNSRFFYRTFDSHAQYWSWTPSSSSGLMVEEIVVRGVLIHDEL

SEQ ID NO: 4565 - protein, 1382 aa, Lepisosteus oculatus
MSDIQPKPYLFKFDHTFPANNGSDLPVVILYAEIGTNKFNTFHKLLSERARDGKIIYVLRHFVVNTKMEKMHLSGYSVELAIKSTEYKAVDDTQVKDANSTVSEAEDESDDVQGFIFATLKKAHPELKEQLSEFRKHLIESSNDMAPLKVWELQDLSFQAAAQITSVPKYDALKMMRDISQNFPIKARSVTRTVVNQEMRREIEENQKYLSEKLGIQPGEGGLFINGLHIDLDMHTPFSILDIIRREGKVMEGLHNLGIKDDDLSKLLRLNVHPLEDTFALDIRHPAIMWVNDIEKDHIYRTWPSSCQELLRATFPGVIRQIRRNFFNLVLFIDPSQEDTVELVKLAELFYQHKIPLRIGFVFVVNTDDKVDGYLDAGVALFRVLNYIVEKYDFSQAFMSMVSIYNKVDSGENLTVDIVVEYLKKKFPSADVPGILGIESVYDDKRKAGGVFYRKSGLSALPQALFNGIPFRREEMDPDDLETNLLQRIMDTTTFFQRAVFMVQLSDDADVVEFLMDQSNVVPRINPLILSTARSYLDLTSRPAVQDWQDTVTFSYLDSRDKSAVISENMKYITKNEEDVHIYGVTIWIVADFDKPPGRRLLSNALKHMKSSPNTRIGVINNPTVKPTEENSLVARAIWATLLTQKQQETFPFITKLIKEENIQLLAQGTKLKDLFLQGMDKDSLEKRHNTIGVDFIRTQQLFCKDVLKLLPGQMAVVSNGRVLGPFEEKEELHPEDFQLLEKITLSTSAEKVKVKIKQMNWKGKQASDFVMKVDALLTSAHKGESRKDIRFIKDELSVVQIPPREDEVFYHVVAIVDPVSREAQKMSSLLIVLSQVINMKLQVFMNCKSKLSEMPLKGFYRFVLEPDVSFLSNNSLSPGPVAKFVEMPESPLFTLNMITPESWLVESVRSFYDLDNIHLQELNGFVTAEYELEYLLLEGHCFDITTGQPPRGLQFTLGTKTDLLMQDTIVMANLGYFQLKANPGAWTLRLRKSRSEDIYQILAHDGTDSPAESDDVIVVLNSFHSKIIKVQVQKKADKVNEDLLSDGTEDRGVWESLTSLWKSLEKSITGGSKSEDAENKKEDVLNIFSLASGHLYERFLRIMMLSVLRHTKTPVKFWFLKNYLSPMFKESIPLMAKAYGFQYELVQYKWPRWLHQQTEKQRIIWGYKILFLDVLFPLAVDKIIFVDADQIVRTNLKELRDLDLEGAPYGYTPFCDSRKDMDGYRFWKSGYWASHLGNRKYHISALYVVDLKKFRKIAAGDRLRGQYQALSQDPNSLSNLDQDLPNNMIHQVAIKSLPQEWLWCETWCDDNSKSAAKTIDLCNNPKTKEPKLKAAMRIVPEWMEYDTEIKQLLKHAKDKNLKDTSQSARTKNKRDPERDEL

SEQ ID NO: 4566 - protein, 1552 aa, Glycine soja
MGDLIELSERVRVYVMGYRSACLVLILFLILGIGTGIASSETPRPKNVQASLGAKWSGTPLLLEAGELLSKEDPRLFWDFIDIWLNAAADDQSHSAKACVIEILHHARPLLRQPLASLFEFSLILRSASPALVLYRQLAHDSLASFPLQDARAHAEITKLDPLRLGISLKSPGGKCCWVHTSQNLFFDVSQLLSWLQTQTPVGDSSQRPQLFDFDHVHFDSSAGGPVAILYGALGTGCFKDFHAALAEAAKQGKVNYVLRPVLPAGCETNFGHCGSVGASDSVNLGGYGVELAFKNMEYKAMDDSAIKKGVTLEDPRTEDLSQEVRGFIFSKILERKPELASEIMTFRDYLLSSTVSDTLDVWELKDLGHQTVQRIVRASDPLQSMHDINQNFPNIVSSLSRMKLDDSVQDEIMANQRMIPPGKSLMAINGALVNVEDIDLYLLIDLVHQDLLLADQFSKLKIPHSTVRKLLSTSPPSESSMFRVDFRTTHVHYLNNLEEDAKYKRWRSNLNEILMPVFPGQLRHIRKNLFHAVFVLDPATILKSLIFGTLQSIDTIISLYENNFPVRFGIVLYSSKSITRLENHSAKEDGDKFEEDISDMIIRLFSYIKGNHGIQLAFEFLSNVNKLRIESDDHIDDAHLELHHVEGAFVETILPKVKSPPQEILLKLQKEPELKELSQESSMLVFKLGLSKIHCSLLMNGLVIDPTEPVTHLLAVDITSGSGLHLLRQGLNYLREGSKEARIGFLFSANQSTDSFSLLFVKVFEITSSSYSHKKNVLDFLEQLCSLYQQKYLLSSAVEADSIQAFIDKVCELAEANGLPSDGYRSALPEFSADEVRRHLSKVENFFHRVLGSESSANAVFTNGRVTYPIDESTFLSPDLLLLESIEFKQRTKHILEIIEEVKWQDVDPDMLTSKFISDIVMTVSSSMATRERSSESARFEMLNDQHSAIILHNENSSIHIDACLDPLSPTSQKLSGILRVLWKYIQPSMRIVLNPLSSLADLPLKNYYRYVVPSMDDFSSADSSINGPKAFFANMPLSKTLTMNLDVPEPWLVEPVIAVHDLDNILLENLGDTRTLQAIFELEALVLTGHCSEKDHDPPRGLQLILGTKTTPHLVDTIVMANLGYWQMKVSPGVWFLQLAPGRSSELYILKEGVDGIQIKQSSKFIIINDLRGKVVHMDVVKRKGKEHEKLLISDDDAPQDKKKESSWNSNLLKWASGFISSNEQPKNAETNSPEKGRGGRHGKTINIFSIASGHLYERFLKIMILSVLKNTHRPVKFWFIKNYLSPPFKDLIPHMAQEYGFECELITYKWPTWLHKQKEKQRIIWAYKILFLDVIFPLSLEKVIFVDADQIVRTDMGELYDMDIKGKPLAYTPFCDNNREMDGYRFWRQGFWKDHLRGKPYHISALYVVDLKKFRETASGDNLRVFYETLSKDPNSLANLDQDLPNYAQHIVPIFSLPQEWLWCESWCGNATKSKAKTIDLCNNPMTKEPKLQGARRIVSEWPDLDLEASKFTARILGDDLEPLQSPNQSKDLTSEGALKEDLESKAEL

SEQ ID NO: 4567 - protein, 1281 aa, Entamoeba histolytica
MKILILILFTTALGTIQVSLKSNWKDTPLLYETLSYLNEYNNELLLPFFEGIIEKDVFNLRGEKAYNTFIELLPENNRKLIELALSLRSQSPFVAASNSINISCNGIIRGNKCSLNGKEEKGRFEYERYLLYLTKQTNTTGILIIPQENIKEKFNLLKQLMKEKVISSMALFLKPSLSEGIKDGIITPLDTMNLTGYDIEIMHRNFKREFGIIKEKEDYIYLKEWNNEELRIGMMDYLLNDKEKSISNKLMNITQEFPLSIINLLKRKNESLKIISENLREVNSQMMLINGISFNLQQQSIYDFIDILQKEDNKLHELQKYELPKNLFISSLVSKENKETIRFLIPSEHIIKLNSLDSYLYERFPKQLESFFQYNPYRLFRYTSQDLYTFIATLDFNDLSQTLNSLKVIQTFMFRYMAPLQFGIIPINIPTNEIGKILLSSIIDINNKWGTDGLMKFIEKVDELQINSVSQITDFFRKFYRLRVSTFEYNINNYLNNTKILNTINYMNNHGFKFNAFYLNGVFINPEKMVSEFSKIYSSDIPILQELIRTKQLHDGNIYKQLQNKFQWIKYIDNDLMTIKQNSIANWKEPFNISKPEDINHIITLCGDGDEVKMNQIIEKLYELHSKEKWKIIGGMKNITENQIIENKFKTKEFKEIIKILKEGNKKEICENANIIFDSIKIKGNEHLEEQIKLVLHGIKHLSENLKRDIGINKLGIAMNLILLDSLTTNRVYDNNQSPLTVKQVVNDVNSIQYNIKLLIDPIMREAQKVSKMLQILEELYPNQINIEMILIKTSGKGGDFPCEYYYSNIPFKPIFNNNQRKDQDLIIQSLPKNIMFQLKIITAQNIDTLLTNTTVDIDNFKNNGTIMIEYSLTNLVIEATSQSKVYIGNEYRYNIINVTGDNGFINQGVLSKDGYFQTLVPPGIYSTYSNPSMYYKFITLNQPFEVLNFKFTVHELSFQSVLLSLEEKNKIMNELNTNKPSTSNSFISNLFGNKKDEPPIEIFTIAGGKDYERTVKILIYSVKKNTKSPLKFWLIEDFLSPEGRIKLKEYGKALGVTIEYCRFHWPYFMFKQVSKTRIIWANKILFLDMMFPQTVDKIIFMDSDQVTRADAKELWNFDIQGNAIAMTPFCDGEWLNKETVNYRFWYHDSWQHALQNRPYHISALFIADLKTFRMNNVGEQYRSMYNNLAFDPNNLANLDQDLPNYIQNYVPIFSLPQEWLWCESWCNQKVKSKAKTIDLCSNPIKPLGKIESALKYIEEWKSYDEIVHGMEEKINNKKEL

SEQ ID NO: 4568 - protein, 1547 aa, Pisolithus microcarpus
MDASALASVRARLALHAASPRLAASAEHYDLRLSNVPDDARLFSAECASWVDWYGRVVCDADRLLQLVNESTGNAMPRPARFPFDHVHSVQHLQDEPHYTAVHYADPTAPSFASLHSALLGLEPKVEYVLRWARGAGEKNTNELSSYLSGYGVALDLKKMDYLVIDDRHWSAGVSDSSGSSASPSSHANTKDKNFSEEALSCVFESLPYVDELAEARAKAGEPLSMQEITDLGVKAAQFLTSVSSQPYIGSVHAHRCWDHPPSVEVFLRTLSTSFPLYATSLARKITVSGELKDEVHENWARSAPGANMVWVNGRALNEDQGASGNIFGILRTVRRERRLVKSLVALGMTREQAIELLMHPVHSSAQSTGSHLGSRRRPVVEEDEERKRTFTISPKFAEFVEGLVDASDRREGGDVIIWLNDLEKDPRNSRISPSLIGLLRVHTMSLFSPALHIRYNLVNVVFVLDMSQLRSFSILSTIHDNFVMRGYPVRWGFVPETRGEGLKIARLLYYIERIYGKDTMMNFIQRLLAMHSQRRLTAFSWDVVNELFVTFNAVDDLGTVTGGVVPLLDEPAADNLLFRAQKYAKRVGVAAQGTAGKGHVFVNGRYSSLNDNVMRQIASEATVQLQILQEMVYIGEITDADAPSLSTFFYDLPSTVTRRNPYISVDVKAGQNSDSRGLEIFDLTELFWSTGFAPEEGFFVLPTNDHVVPMTMYIIADLDTPQGIKLATEALKFIETAADTRITFVHNPEVATSGGQASSLLITLIQARALSHFSSTDLVAALAGDNQDSTYEFLRNERLASNAAAEAEVSRLKQAMRAVARHLGLRPGERAILVNGRLVGPFDSNSEFLEEDFETLEVFEKKKRVGQIMDALDDVFHGIGNLEPSKRSDLIAVASSIIYADQQPDPGEVGPFDTAPRPRTQNYRLLSGNYTKFTFGDKSTALTQVALLLDPLSDAAQKWSSILEYHARLFPEIFIELYLNPSQLSEIPLKRFYRYNVMPSLQYDENGQEIPCRAMFTALPEEPIYTLAMDVPHSWLVRPRSALYDLDNIQLGLLQGEERARGVQALYALDYLVVEGHVYELQTNNPPRGVQLQLIDITDQSVVDDTQVVANLGYTQFKARPGTFRLEIRQGRGRTLYSLDSVGAEGWNSPSVAEAGDEFTVMDFDRLTLYPRLARRPGMEGMDVLDDLERVEDEPGVVDNLLSKLLSLFKPTSDEDKALAKMPGENAEINIFTVASGLLYERFASIMILSVLRNTKSTVKFWFIENFLSPSFLEFIPHMAKEYGFQYELVTYKWPSWLRPQKEKQRIIWAYKILFLDVLFPMDLKKVIFVDADQIVRADLKELVELDLHGAPYAYVPMGDDNHEMEGFRFWKTGYWRDFLRGRPYHISALYVVDLSRFRQMAAGDILRGQYQLLSADPNSLANLDQDLPNNLQREVPIYSLHEDWLWCETWCSKDRLHRAKTIDLCQNPLTKEPKLSRARQIPEWEQYDAEIARFVRRLAAEGKIRGGASTADSKILAGVGASAPVPVKSSEQTDIGDQPRTRDEL

SEQ ID NO: 4569 - protein, 1479 aa, Malassezia restricta
MMEAAGQVWPHAFFSLVSRIWSHPSAGGELKDMSYERLYHHMEGVLRSLAVDVHDAYPESHLEEWRTLVAQHAQAAKVESYYQMFEAGSNLRSLNVPCDTFVHVNGHAYCSLPAARQAIQALNTSSPLLAHDHVHPSHTAPGPSLVLYADPYSTSIHEFHDMLHALSSTSHVKYVFRWRPSVASVKSRPMSRYFSGFGTTMHLKKVDYLVLDDRHIDKSHHAELPMSHEPDRVRIFSDQLQNKLHRLLGTKRPSVQDAVTRHSNLTISELAQLDVAATHAILSSDDPMSTWESIVLDFPIHSGTLSDYMDTIPDDDTILDTLNNVEKRLISPGITQLWINGLPVPVTELQPLSFIKRMHDELDLIEAFGASELGISPDGAEMIMANPSVNAAFAPIQAAPQFYDASDALESSSELGMPVIAWVNDLTNSMYADWPKTLKDMMRYRWMSGLPLIQQNFFQLVVLLDMRDPRALLLLGMYLDATLMDYAIRWGIVPLLEDEDCHVLAQLLWLGMEQLAALEIPLFLQKLAATPLTPEGRVDPKQARAVLRSMLPASAQEDNELMAFLNGGERISGYKRLLELAKSYLGRLHTMKRPGSSGVAYFNGQEVSLDEHLISQVFAATKYQLQMAWDDIRDGYIDSQDRYTRYFYDLRDTKSRRSALVTMVEDAQSFVRPSVYVRLPDVTRELGEHARPIRDFLYSPGDTSVSIRLLGDLNDRATLDILLRALEAMETTPFRLSFVHTGTSDGLLSEWLLQAMHAGALSNMSHNDLYHALESNNLAASLENLRQKYHIPTTKYSWSQISLAFSQALELKHVGPIILLNGQSLDHIQGVSQFDIESVVAWEDEVHVQALLNALDVPDETRESRAQVIEFAVSVVGWNFAKNSDQEGPMESAPQKRDPSGMYLHNSDLMLRMGQDSAPIHITGLLDPLCTNAPQLVSLLRMMSTFSCVRISLMLNPRIRVPSLPFNQFTRFDYRTQPRFDEHGQEDMPSLSFESLPESSVLTMQIHAPRSLVAMADEAVYDLDNIRLADVHGRLDTVYSVNSILVEGHARAEHGPIPEGLQLVLSSDDQRSQLDTIVMENLGYFQFRAQPGRWTLRIREGRSQDLYEMTSVGALGWSSPPVSHTGAAITLDTLEGVTIFPTFRKHKGKEMEELISSVDMAESLTTSKFSSLLHQAVSYVGQLLRPMRSKGKHAEINVFTLASGHLYERMTYIMILSVLRHTKSSVKFWFVENFLSPSFKSFIPHLAQAYHFDYELITYAWPEWLREQTEKQRMIWAYKILFLDVLFPLDLDRVIFVDADQIVRTDLKQLVDMDLHGAPYAYPPMGDDSEDMDGYRFWKQGYWKNVLRGHPYHISALYVVDLKRFRSIAAGNILRVHYQQLTADKNSLANLDQDLPNNLQPLLPIHTLDKTWLWCETWCSHDWLPQAKTIDLCSNPKTKEPKLDRARRQIPEWTELDNEVAAFAESLRSPSYSTPHDEL

SEQ ID NO: 4570 - protein, 535 aa, Brettanomyces bruxellensis
  MOD_RES (3)..(3): Any amino acid
  MOD_RES (177)..(177): Any amino acid
  MOD_RES (193)..(193): Any amino acid
  MOD_RES (229)..(229): Any amino acid
  MOD_RES (394)..(394): Any amino acid
  MOD_RES (398)..(398): Any amino acid
  MOD_RES (474)..(474): Any amino acid
  MOD_RES (518)..(518): Any amino acid
  MOD_RES (525)..(526): Any amino acid
  MOD_RES (531)..(531): Any amino acid
  MOD_RES (535)..(535): Any amino acid
MEXIGINRLYRGMFRPPVKFDDNGTFDENELQIIFDEVPGKPLFSLSVDEPQSWIVGIKEANADLDNIKLDISGPVVGVYEVENIMIEGYSRDVVSPSAKPIGLVLELSSSFNDKMQETSVMANFGYFQLKANPGEWSLRVKPETKGADIYDLVGVSLNSTSLDIGDGKISSFDFGXSNLGGLNSFSQYFQKXLEKENDFIIGDHNIERKNNGGSNSYFSSFLSKLKNXVLSTKKAEEHKNADINIFSIASGHLYERLLEIMTASVMKHTEHSVKFWFIENYMSPKLKAELPLLANHYGFQYEFITYKWPVWLRHQREKQRIVWAYKMLFLDVLFPQSLDKVIFVDADQICRTDMKDLVDLDLEGAPYGFTPMCDSRKEMEGFRFWKKGYWKRXLGDXYKYHISALYVVDLDKFRSLAAGDILRQHYQELSKDPKSLSNLDQDLPNNLQDVLEIHSLPQNWLWCETWCSDESLXDARTIDLCNNPLTKESKLERARRQIPEWNDYDQEVABLVYHKNXSHKEGEXXKSQSXNHEX

SEQ ID NO: 4571 - protein, 1514 aa, Steinernema carpocapsae
MRHFVLTWAFVLLTLGCATVESFSKKPVITSVTSKWGQTSLLAETSEYFASESNERFWQFVLEVVERLNSDEYKTYTPQKVYEAALKLASPVLGDSTNDMLKLSLSLRIHSPAVVMQYQLGNEHDNIDCPAFIDLNGKIACNVSELDEVMKTALEGTPSVLISTDHVCPSTNGHKDVPVLILYGDLGSQSWLTLHIAARALSTSGKVKYVFRHFQKFNTKLTSPVGLSGYGVELAIKNTEYKAVDDSAVKSDDKFEADEDIPELEDVAGLNFNVLKKRNSHLRDNLKKLWMEMNEKQELTLLKQWEVQDLGFQAAQSVVDADPEDAIAHLVDLSQNFPTHARLLTKVSVNKNLRKEVEMNQENAFAPLKLDSGDSALYINGIPVDLDSMDLFQILEVLKKEEALANAFNKMDIGREYLSLLFNEAPTEDAPAYAIDFRDGFPEYINDLDKDKMYRGWGNSVKMMLQPYFPGMIRPIARNFFTLVFVVDPAHPDTRSLLKTAYSFYSHQVAMRIGFIFVANDNRETANGMHDASVALLNFYNFVKTEKSIPKAIYHLSNLLDTIDGQITPEDVHRFFRQEFSDQEVEDIFGSNSDYDNGRSAGAAFFRKSKIGSTPKVLLNGVALDDEGIKGDKFEETVINEVMRQTQKIQMAVMKGRLTDRDNVMKWIMSQPEVLPRLNSRVLSGESKYVPLTGISQCKLNVFSQFVKASTEAKGECVMERMKYLTKSDEDNTRWFNVWVAGDMDSESGRDLLANAMKHLKKSNSMRLGLLQNPAQKSEDVGKVTNLIYNSIRLLPNHITKQMLLKLTKADIAKKVDDGVMKVDDVAVQGMSVDSFKKEVGLMNYDFLRMEADYAQSVVGLKPGQRAVIVNGMVVGPFEDDESFEVEDFALLETVIARKNAESIAKTVDGWDFHKRDGKSSDMLMRVFSAMGAFSQKKTRNWVVFSDDVHSVVTLSKNEEKRPVVDVVAVVDPLSKQAQKLAPLLQLIYNVLNCDMKIAMNPKAKLSELPLKRFYRFVANNELLFDKHGNLINPMAIFNDLPSKQLLTMSVSPPDSWMVQPIYAKYDLDNIKMEQVGKNGVIVRFELATILLEGHCFDEITGGPPRGLQFIIGTEKKRDLSDTIVMANLGYFQLKASPGAWVVSLREGRSKDIYEIKSHTNTEEGGNNESIRVLIDSFSGRTIRVRVAKRPSMQDYNLLDESDSDGSLFSGLSSAFSGGDSNEVINVFSLASGHLYERFMRIMMLSVVKNTKHPVKFWLLNNYLSPQFRESLPKMAKKYNIKYELVEYKWPRWLNQQSEKQRVMWGYKILFLDVLFPLNVKKIIFVDADQIVRADLMELMDLDLGGAPYGFTPFCESRKSMDGFRFWKQGYWANHLAGRKYHISALYVIDLVKFRQLAAGDRLRGQYQGLSADPNSLANLDQDLPNNMIHQVRIKSLPQEWLWCETWCDDDSKSRAKTIDLCNNPLTKEPKLDSAVRIVGEWKDYDDEIKSLLNQKVVEPSSEAKEAENAHSEL

SEQ ID NO: 4572 - protein, 1280 aa, Caenorhabditis briggsae
YNFGISTASSLLDASEYPLLRFSIASRIFSPRIEVHRQISKKFQPNSCKNTFFVYGNQVGCQLSELNFKEYSGNAEIFEFDHIFPMKSKANRTLIIYGVLGTAELKNMILEAKILVETRENLNFALRFLSLSSGTTKVSLSGYGVELALKNTEYKAVDHLTQELPENLHGLNFRILKNRHTDRHNELESLRENLEKLGEIVPLKQWQLKDLGLKTCERIQEDSMELEEIERVLQDFPIHARTISHRSLNESFTKPIQKFQKTLKSAGIGNGENLLALNGRILSKSDSKIDLFELIERKTEKKVMDRLIEIGSVSEDSEIDYSKLLTLFDFSPIAISKNAFDYRKTKPVFLNDLESFLSPYRSLHLLLQPFPSDQIRPIARNIFNLILFIDPFDSEDKLLDLAQKYLKGKVFIRIGLVPFFNENKWGVSVQEGVNSKEISKEARKIWKTNEDILKALKNGNEFLLKTGLGKGPQALLNGYPLDTSSSESFDAALFDNIQKQTLRLQLALYQRLITDSVKIDDFWLKEETNPDLKTRVSMRIFSAKFEFFRIVKAFNERRFVELDSEASENPENPTLAIIANFENTKNRLSITKWLKSLKFPLKIALISNPTTSSDSEDSSCPSDSENLESAILRLENQESCIGARKFSNFLRKNEIKAGEMAVIFNGLVIGPFEENEKEQFLEIEDFEFLENLWKERGAKKTSAFLSQHFPNQDDVTIKFFSVLSKIYKKDVPRVAFDNFKDLENRNLIIFPPKNPESPYSTITWILNPVSREAQHLVSIVKLMSNVLNAKVEIIFNPSSELHEMPIKRFYRFVASEFLEFDENGKIKDQSAIFSNLPQKQLLTMSVETNDGWMIEVKKADDDLDNILLENTSGDVESEFSLEHILVEGQSQKSGTGDASDGLELELKSENTKYDTIVMRNLGYFQLKAEPGIWDLKIRNGTSSENFWIQKIDSKEVNGKITVVVDSFTRKWTQLVVEEIEDKKEQKEGSAMGRLMEKAKNFFSTPPPSETINVFSLASGHLYERFMRIMIVSVMKNTQSGKVKFWLLKNYLSPKFKESIPILADFYGFEYELVEYKWPKWLHQQTEKQRVMWGYKILFLDVLFPLNVDKIIFVDADQVVRADLLELMDFDLKGSPYGYVPFCESRKEMDGFRFWKTGYWNTHLMGRRYHISALYVVDLKAFRKFAAGDRLRGRYDNLSADPNSLSNLDQDLPNNMIHEVPIKSLPQNWLWCETWCDDRSKKTAKTIDLCNNPLTKEPKLSSAQRIIGEWKELDEEISNVI

SEQ ID NO: 4573 - protein, 856 aa, Caenorhabditis remanei
KGSQFLENFGLSKVSHALLNGYLLDVSSPENFDLILQENVQKQTIRLQMMIYHGMINDNVKIDEWWLAKETNPDIVARINQKIVIAFNDRRFLKLDEKAFSDMITSVDYFPKSSLSSLKSSNVSTWIIADFQNPINRFFAANTLKSVARKSENRIAIISNPKLSSHNSESESCSFEYGDLENLIEALESTDNCIKTTVSSKFLFTNGINPGETVIVSNGLIIGPFSDEREYLKVEDFDYLKELWNEKGAGRTSEFFKKQYSVDDVDIKFYSAMARMYRKDVSRISFDEFNNSENIITFPPENSSLPSVTITWISNPVSREAQQIISIVKLMSKVLNAKVEIIFNPAAEILESPIKRFYRFVAKEELEFNDFGAVENHFAVFSNLPQKQLLTMSIETNDGWMIELKEAEYDLDNILLESISEDVESVYSLEHILVEGQSRKSSGEASDGLEIELQSGDTTYDTLVMLNLGYYQLKAEPGVWNLHLREGSSSEKYKFLKVDSKQVEKDIKVVVDSFTGKWIQLVVDEVESKKKPEPSKIEKLMNSAKSFFSTPAPSDTINVFSLASGHLYERFMRIMIVSVMKNTKTQKVKFWFLKNYLSPKFKKSIPLLADFYGFDYELVEYKWPKWLHQQTEKQRVMWGYKILFLDVLFPLNVEKIIFVDADQVVRADLQELMDFNLNGSPYGQSFEPFIFRYVPFCESRKEMEGFRFWKTGYWNNHLMGRRYHISALYVVDLKAFREFSAGDRLRGRYDSLSADPNSLSNLDQDLPNNMIHEVPIKSLPQDWLWCETWCDDNSKKTAKTIDLCNNPLTKEPKLNSAQRIIGEWKDLDEEISNVIRNDNRTKRSKLSESNEDKEEL

SEQ ID NO: 4574 - protein, 1734 aa, Macleaya cordata
MDLQGRSVRYFTSYFLIILIVLSFAGSSVASENRRPKNVQVSLRAKWSGTPLLLEAGELLSKEWKDLFWEFIDIWLREENDSGSSTAKHCVQNIVKYGRSLLTEPLSSIFEFSLTLRSSSPRLVLYRQLAEDSLSSFPPADETNPRDVTGDTLEEPDVIPVSKRADNILIGMNPQGPNGKCCWVDTGGVLFFDVSELLLWLDSHSGSPGDSFEPPEIFDFDHVHFDSSIASPVAILYGALGTNCFKDFHVVLAEASRKGRVKYVVRPVLPSGCEATTGSCGAVGTRDALNLGGYGVELALKNMEYKAMDDSAIKKGVTLEDPRTEDLTQDVRGFIFSKILERKPEMTAEIMAFRDYLLSSTVSDTLDVWELKDLGHQTAQRIVHASDPLQSMQEINQNFPSIVSSLSRMKLNDSIKDEILANQRMIPPGKSLMALNGALINIEDIDLYMLLDMVHQELSLADQFSKLKIPKRTIKKLLSTLPPSEANTIRVDFRSTHVHYLNNLEEDAMYKRWRSNLNDLLMPVFPGQLRYIRKNLFHAVYVLDPASSVDMIISMYENNFPIRFGVILYSSKLITKIEENGGEPPQDGSHSVEDISSLIIRLFIYIEENHGPQMAFQFLSNVNKLRSESEDLAEETLEVHHVEGAFVETLLSKAKSLPQDVLLKLQKELTFKERAEDSSLFVFNLGLFKLKCCLLMNGLVSESTEDAVQNAMNDELPRIQEQVYYGHINSHTDVLDKFLSESGYRRYNLQIIGEGKTQKRFKSLSASILGSDSVLNDISYLHSPGTVDDMKPVTHLLAVNLTSKKGIKLLREGIRYLMGGSKRARLGVLFSTENGAGSPSLLFVKVFRFTATSFSYEQKLLDFSEQLCFLFEREYMLTMDSESTPLFIEKVLELAKANGLPAEDYKVALSDVSTDLLRNHLDKVSHFLYRHMGLEFGASAVITNGRVVLPTQGSTFLRHDLDLLESVEFDQRIKHVMEVIEEVDWEDIDPDILTSKFLSDLIMFVSSSMAMRERSSESARFEILNAKYSAVVLNNDNSSIHIDAVIDPLSPLGQKLSPLLRVLWKYVQPSMRIVLNPLSSLVDLPLKNYYRYVLPTMDDFSSSDFSINGPKAFFANMPLSKTLTMNLDVPEPWLVEPVIAIHDLDNILLENLGDTRTLQAVFELESLVLTGHCSEKDHEPPRGLQLILGTKSKPHLVDTLVMANLGYWQMKVSPGVWYLQLAPGRSSDLYLLKENEDGSEILPLSKRITINDLRGKLVHLEVVKKKGKEHEQLLASSDDDSTLEENKKGNLKSWNTNLLKWASDLIGGSEHTKRKGASVEHREDGRHGKTINIFSIASGHLYERFLKIMILSVLKNTHRPVKFWFIKNYLSPQFKDVIPHMAREYGFEYELITYKWPTWLHKQKEKQRIIWAYKILFLDVIFPLSLEKVIFVDADQIVRADMGELYDMDIKGRPLAYTPFCDNNKDMDGYRFWRQGFWKEHLRGRPYHISALYVVDLVKFRQTAAGDNLRVFYETLSKDPNSLSNLDQASLMDFDLPNYAQHTVPIFSLPQEWLWCESWCGNSTKPKAKTIDLCNNPMTKEPKLQGAKRIVSEWPDLDLEARRFTARISGEEMDNTQETVVTPNQKENEIKPLLFLNTSVHPAYAGMSSPCGEYLGVVLICKMRRSSSSNNQPLPLDYLHTEPTSRSVKAWFKLGAEVPEREPHPYTTILVVADPPNTRRTRHILVDVSSPYNS

SEQ ID NO: 4575 - protein, 1668 aa, Trypanosoma cruzi
MELGPRDCSKSMNQPHHRPRNIAYCTDWGRGRGRFAATLTILLLWSVSLILLEAPTVEGKGVHVTLLAPWTETPLLQEGCEMVAARGAHFVGFYQCMQDVWKRVQAMNSSDGAAKLTQKSQYDILLDMMEQANWPPTQVKLAKMRLAARLYSPVVEAHWQLARKAKQLIGGCSTEGGPFVLTAGKVICSEDLLEETLSAPAPVNETQDGHEDEAFSLFAEIDQLHPNAKGSRVVILYGVVGEEQTMQLLQVLERHLHAVRLAFRHLPISGRMWEHPLHVQGYAVTVDLKNVEYKVIDEKDKNDAGTDANDANTVEETESIGSVGGFNLTLLTQRYPQLKPQLNAFASHLVDMIDRDEVKVDFQMWETQYMGIAAAQYVMDAENEKRLNVLMNLLTKFPLHASKLSKMGATVKAKMNKKMHEELMEFASVVRSGTSPVFLNGRNLAAEKLNLFSFLQKLDEEEQLLEGVQRVFTSYRLPSANDDGFFSAKTDALNQAMVSVRRSVHRYIASNGLEDGEPVPRIWLPQRSVLWLNNIQRDVNYVYMPAALEAILHLNINGVPVIPRKNLIHAVCVVDPTTVAGLQNILTILKLEESKQPVRLGIVFADNKWSPELSVFKRGNDFITDKSLSGVTVIIAATVWELLKGEEHPQDVLEFLSEVVQARSTRGNLEEDEIKVISSNILTLAGKTTLDNILTDASFVEYYQDTQMKLREMKLDASPFTLLNGKMFQGNMLHALRQNFMEELHYVRGLVQSDALTERDDDDFYESILRLSGARERYNEAFYSEKFYADWTSKPVLDFLLHRPFLLPTIRSKKTPLVSSVLTIQSPMGEAALEALVKTIRNLLQCEDETQKCVNVRFTYVVCDVAKESKRRTMAGDLERLIVRRKGGDDGKQQVQWVYDFLQKIAAQNNTRQLMDPDLYEGLVAEVNFSPEVKKLLDASDEGLDAQLQVQRGIVNGFCAQLEADSLSTSSLSANGAAAGREKGNKEGAVYYYVNGRRFVYDDSFLEEDFRTAEEMEMLLAGAVSEALSKVEFTTMSSELEPSDLESHFYASKVAALSEVLRRDAARGSPMQEENHLPSTSGLTSFVVKPANGDTVPRHTLTVVIDPVAQQSQFLISLCDYVTRSPLGISCTVHMGATEHASKLMRNFYQFVSEMELRFDAVGRVVPPAAVFHRLPSKHLLTLGIEEPESWTVFSLDAKYDLDNILLDKLPSSSQYLHAVYRINSILLTGSARDAEQPNPSRGLPLLIRSTKTNPEAGVTRDTLVMAIMGYFQLQSSPGVWYLTVQPGDIAKIFYISQVDDIPVNDGANKNHHGRFNYTAGQNIPVVVSSFTGKFLMLGVSKTPGHEEVSIEDVNEASALHVDWPPKGPIKSKPDRPTLNIFSVASGHLYERFLRMMIHSVMRTSFDVHGANTTRIKFWLIENFLSPQFKTLVPLLAKHYGFDVGFVTYRWPWWLHKQTEKQRTIWAYKVLFLDVLFPLDVDRVIFVDADQTVLADLHELYNMDIGNAPTAYTPFCRKHPNPATKNFRFWDHGYWLEHLHGKPYHISAIYLVDLRRLRAIAGGDKYRLVYSRLSSDPNSLANLDQDLPNFIQDQVPIYSLPEEWLWCETWCGAESKARAKTIDLCNNPLTKMPKLDNARLIIPGWEETDTELEALSEKLLQQQKQQMS

SEQ ID NO: 4576 - protein, 1501 aa, Microsporum canis
MSFTKPWPLRPLNLFLASLVLFPNVSQASSSVNVALSASFHSAPYLMELLETAAEENSTSYFPLLDRIADGRFADATTEKDLYEQFIQVLSEDGHVTDPVALSSFKFALSIRSTAPRIQAHYQYYNSSVENSLMAAQDAVCQVWAHYDGSQYCSPTLEHAQQPLIAGRDESLEKLLPFDRVLAVSNGDEEESQQSLVLYADITSPLFGEFHKAVSKRARDGEISYRVRYRPSTTASGPAKPLFVSGYGVELSLKRTDYIMIDDRTEEKGDSKQSAPDTKPTLAADGLAESPTADLEPLSSSEVSSLGLNAASFVMNSDDPFDTLVKLSDDFPRHSKTIAAFNATSEFLTEYRENRGEGLQPGINSMWINGVQMSPRNIDAFSLLAHLRQERKLMNSLNELGLSAQEAVKLLSNPVISKAQTVQGSQRFDYRDDIEGGGVIIWLNDLEKDPRYEEWSDEVTTLLQPTYPGQFHELRREVHNVVLPLDLANKEDITLFVEEIQAFVLNKVPIRFGLVPLQRSELSREQAKIAYYLQDAYGLEAVFSYFTEIYSAQKFALPSKADFETAIKGRVLNDDRSAILFEDVVKSTELDAVISKSKDYLKRLAADGENPPMFANAIPLERGENWIHFLIDRLFKDVQGMQRRIYEGAYKEDVWLPSFYLEDASPKCNPMIVPEDASDITVKSINDAYTKHTDAFNKIPRIPGKSGSTIEKWAQLALAIDLDNEHGAKQLANAVEFHKANPEVEILILHKPTSPAKKGSLSIGLHSLLDGGRDLKTDSVIALLHKDVESKSTSSNSEKYYSSVQSVLSELGVAENGMHVLLNGRLIGPLNQTTILDVQDLELALQYERSRRITPVVKALGSLQATDKIRDHSAFARLTSMVALSTISDIPQGTFQSGPMIRTGIFNDWASEHSAITISNTETPLIQIVATVDPATEVAQRWIPILKVLSNLSSVSLKIYLTPLESIKELPVKRFYRHILEAAPSFHDDGSLRQPRASFHGVPQEALLNLGMDVPPSWLVAPKDSVHDLDNIKLSSLKEGTNVDAIYELEHILIEGHSRDMSNNKPPRGVQLLLGTEKDPHFTDTIIMANLGYFQFKAQPGHWQITLKPGRSEQIFNLDSVGGMGYTPKPGDDNNEVSLLSFQGKTLFPRLSRKPGHESDDVLEDGGNKPSSAKNFLSQGLNFASGIFSGVAKTQKEKHADINIFSVASGHLYERMLNIMMLSVTKHTKHSVKFWFIEQFLSPSFKSFVPHLAEKYGFSYEMVTYKWPHWLRPQREKQREIWGYKILFLDVLFPLSLDKVIFVDADQIVRTDMYDLVSLDLEGAPYGFTPMCDSRTEIEGFRFWNQGYWKRFLRGKPYHISALYVVDLNRFRTIAAGDRLRGQYQSLSADPASLSNLDQDLPNHMQHSIPIKSLPQDWLWCETWCSDESLKTAKTIDLCNNPQTKEPKLDRARRQVPEWTVYDEEIAQLAKTVGAQDSEADHTSHDETEEPELEATDKDEL

SEQ ID NO: 4577 - protein, 1546 aa, Chrysochromulina tobinii
MAVSALIVTLLGLAAAEDTLTPKNIDISLTARWPETPIAAEAAEFLAVEGSQLFWTFAETYVPPEGGSDEAHLAAVELAAAKLLSPLGLKLLRGYLAAHIFSARVEMFRQLQTREEQEHGMDSADGWVRACGRVQALSASEPAPALVDAVLAGGCSVPESLEERETAEVTPLAVDHVFGSVGGGTAPMVVLYAPLGSAAFRAAHATLTQRAREGAIVYVYRPQVRAAPGARAQSLQGYGVQLAIKNMEYKVLDDKAVQDLGGIEGDDDEAAEGEAEDEADVGGFFFGTLASRRPELAEQLQALQGTLLAQETEASTKLKAWAMQDLGLQAATRVLAASDPLKALRDVCQNFPFASGKLSKLKVSQELSVGVRASQQTYFGPGYNGAFLNGLALPITDNDFYGLMNTIQSELHTIDALSSLELPAATISRLVSLPPPQASLRINPSHEAVLFINDVVKDKKYQQFDPQLRAMTRVNIDEAQRLGLLLTKLFLFLKKKAGTQASLKFLSAVNENRMQMMMGFFGGGGYDELEEHHLAKAFEQAYPRKLGEQLDRLTVYQGIVQGTITDFDELAAGGSRFLRDKGLGAAPAILTNGVLTPVTQNYEQEVMMALNAEHRFVSSLISKRVLTDETTDKAAAIIKAGLAFPRYSKALLLPIDDIEVAPLTPAAALASVAWLASIAAPKDEAAVAEAAPKDGAAVAETDSMAAADDEFGDEQMFGAGEEEGGAGADADAGAIDPALLHSVSHLLVIDLCQPAHLSVLAGTLSALEASPNGRSRLGLLHNPTAASHEACAPAAAAAWTALVRAFDGSTYAPLKALVALLHAASLAPGASSISSALASAVLPAKARGGPAVDLGAHAAYAATLGLGAGAGALITNGRLVLLTGGAPLDAVDVALLEEYELRQRAEGAAHLISQLTVSHDKDASVEGGAARWRSDVLMHAVVQLTSVAKRALARDAGKDRKVQLQPDDLPCGAACVRIPGEGVGAAMELVAILDPLSKAAQRLAPLMMELHVALGCTVTLHLNPDTAITEFPLEDFYRYVVSLTPKFDADGRSLAPTADMARFARLKTPQVLTLHLDAPEAWLVQVNEAAYDMDNLRLAELGERRTLYARYELVSVLITGSCQDFRKHEPPNGLQLLLGTSPAAPHSTDTLVMSNLGYWQLKAMPGAWLLSLAPGPSSEVFSIHSDAKLVAAGHATALLGGRGHIDVAGLQPRRAIRLLVSDFTGLHATLLVSKKWAFGSAGSAADDDVVNVFSLASGHLYERFLKIMMQSVVDRTTRKVKFWLLKNFLSPAFMGFLPHMAKEVGFDYELVQYQWPTWLHKQTNKQRIIWGYKILFLDVMFPLHLKRIIYIDADQVINADVGELWDLKMPPRTAVAMTPFCNRDANPDTTGFRFFAHGYWKDHLRGHPYHILALFVVDLHKFRRRAYGDQYRIFYDSLSKDPNSLANLDQDLPNYAQHVVPIHSLPEEWLWCETWCGNASKPAAKTVDLCNNPLTKEPKLNQAHRIVGKRWSTYDERSNEIERSLSAAARAHDAASDGAAKPRDEL

SEQ ID NO: 4578 - protein, 1493 aa, Orycteropus afer
MGPLIIFTGLWLFSAVKADSKAITTSLTTKWVTTPLLLEASEFLAENSQEKFWNFVEDSQNIGSSEDHGTDYSYYHAILEAAFRFLSPLQQNLLKFCLSLHSYSATIQAFQQIAADEPPPEGCNSFFSVHGEKTCDFDNLETLLRTASERPKPLLFKGDHRYPSSNLESPVVIFYSEIGHKEFSVFHQQLISKSNAGKINYVFRHYISNPGKKPVYLSGYGVELAIKSTEYKAKDDTQVKGTEVNATVIGENDPIDEVQGFFFGKLRDLHPDLKEQLKELRKHLVESTNEMAPLKVWQLQGNKTPEKSLAFILYFKGTLGLQPGDSALFINGLHIDLDTQDIFSLSDVLRNEARVMEGLHRLGIGGLSLHNVLKLNIQPTEADYAVDIRSPAISWINNLEIDSRYDSWPSSLQELLRPTFPGVIRQIRKNLHNMVFIFDPAHDITAELINTAEMFLSNHIPLRIGLIFVVNDSEDVDGMQDAGVAVLRAYNYVAQDLDDYHAFQTLIHIYNKVRTGEKVKIEHVVSVLEKKYPYVEVNSILGIDSTYDQNRKEARAYYEQTGVGPLPVVLFNGMPLEKEQLDPDELETITMHKILESTTFFQRAVYLGELSSDQDVIEYIMNQPNVVPRINSRILTAERKYLDLTSTNNFFVDDYARFSVLDSQGKTAAIANSMNYLTKRGMSSKEIYDDSFIRPITFWIVGDFDRLSGRQLLYDAIKHQKSSNNVRISIINNPSENISYENTQISRAIWAALQMQTSNSAKNFITKMVKEETAEALARGADIGAFSVGGMDFSLFKEVFESSKMDFILSHAMYCRDVLKLKKGQRAVISNGRIIGPLEDSELFNQDDFHLLENIILKTSGQKIKSHIQHLQIEEDVASDLVMKVDALLSTQPKGDARIEHHFFEDRHSAIKLRPKEGETYFDVVAIIDPVTREAQRLAPLLLVMTQLINMNLRVFMNCQSKLSDMPLKSFYRYVLEPEILFTSENSFAKGPIAKFLDMPQSPLFTLNLNTPESWMVESVRTPYDLDNIYLEEVDSIVTAEYELEYLLLEGHCYDITTGQPPRGLQFTLGTSANPVIVDTIVMANLGYFQLKANPGAWILRLRKGRSEDIYRIYSHDGTDSPPDADEVVVVLNNFKSKIIKVKVQKKADKVNEDLLSDGTKNENESGFWDSFKWGFSGGHKTEEVKQDKDDIINIFSVASGHLYERFLRIMMLSVLKNTKTPVKFWFLKNYLSPTFKEFIPYMANEYNFQYELVQYKWPRWLYQQTEKQRIIWGYKILFLDVLFPLIVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKQRAKTIDLCNNPMTKEPKLEAAMRIVPEWQDYDQEIKQLQIRFQKEKEAGPLSKETKTKEPSQEGPQTHEEL

SEQ ID NO: 4579 - protein, 1566 aa, Bicyclus anynana
MNTAGLRIFLFVIAHMFIICAGDNDASTRNEKKSKGVTTFVSAKWEATPLVLELAEYMSAESSDLFWSFFDGIISLKTSLSDLETDKQVYDACIGVASTLLAPAQLRMAKLALSMHLTSPTVRMFDQIATQNGAKELDCDSFVSIASRKVCDNDALRDVLKSLQQYNPEEHKLETYLLDHSFPTSDNKSLTAILYGELGTSDFAGKHKILAGYADKGLINYVVRWNVKSRGKPKLRLSGYGVELQLKSTEYKSQDDSTPKEADGDDAASPSEEEDENDPQNQIDGFNFGKLKNLFPALRTPLERFRRHLSEMSEELAPLKVWQMQGLSMQAAAAVIDAHDSGGDEALKVLTSIAQNFPMQTKSLIHVNVPRSFRDEVLYNQDIWASSLGLRPAEPLLLVSGAQYDAEEVDVMALLAALREDIGPINTLHALGLSKKFINKLMSLEVGESFTWEEYGLDIRDTAITWLNDLEVDERYRRWPSSFMDLLRPTYPGMLRNMRRNIYNYVIIVDPTSPASGPPLKLGETLLKHATPVRVGLVLAPGSNDPLLGAAIRSAFNYIAQDRNSNKEAFYFLNQLHSNQEESVTLESVKKHLKKYTSSNVDLDEIISEDSEYNFGNQLAEEFVAKVGTNKYPLVLINGVPLWDDSASPVTSSVELLEEALVTALARHTGRLQRAVFRGELSDTDDAVDYLMKQAHIMPRLNRRVLASEPSQYLDLSGAPSSMELFTEERVHRLLHLTGRDALATALPILKYFTRPGKPEKITQTIWVAGDLNVKESRDLLRNALTFMRESGGVRVAFIPNVDGTSSLDQSLNKVVLAALTTLESVKATKYVTQLLENEGCHERQDCDIMPELVPALNKYAWVLKASRVLCARSLRLRAGERAVVHNSRIIGPFAQEEGFSLEDFVLLERYSNQVYGDKLSEVFIKKKTSSNEVLDDDDDDTVELSTENYMKVISVLAARSPRVRTPLPAGLRTEHSVIELPPLYEDEAAVEIVAVVDPASTPAQRLAPLLLVLRRVVNCRLQLFLNPQDKNSDMPLKSFYRYVLEPELQFNANGAQTAGAIARFSRLPHAPLLSLELRTPTNWLVECVKSVYDLDNIRLADVDSLVHSEFELEYLLLEGHAWDSTLSTPPRGLQLVLGTRDKPETMDTIVMANLGYFQLKANPGAWIMRLRPGRSDDIYEILGHENTDTPAGSADIQVLMSSFRSHVIKLRVSKKPDQQHLDLLVENDEKNTGGIWNSIASSFGGGEEAEAQDETINVFSVASGHLYERFLRIMMLSVLKHTKSPVKFWFLKNYLSPSLKDILPYMAQEYGFSYELVQYQWPRWLQRQRDRQRTIWGYKILFLDVLFPLHVKKIIFVDADQIVRADLKELVDLDLGGAPYGYTPFCESRKEMEGFRFWKQGYWRNHLQGRSYHISALYVVDLKRFRRIAAGDRLRGQYQALSQDPNSLSNLDQDLPNNMIHQVAIKSLPQEWLWCETWCDDKSKQYAKTIDLCNNPMTKEAKLSAAMRIVPEWQTYDDEIKALQARVRRGLYQHADHEQEIENMDPEDVAVEQSASDKDHEHTEL

SEQ ID NO: 4580 - protein, 1469 aa, Metarhizium album
MRLPCIARLLAGFSLLVPPVSAVSAVKVGMIAAFDAAPYLLELVETAAGENSSSYFPLLDRIASGYFLTASSEAELYRRFLDVIHEDGHITRSDALSTFNLALSLRSAAPRIEAHYQHYSKAMEPLKELRDCDTWVLLDHMQYCTPNLDTGEKNDLASAVAKPLPFDRSLGMGRDAILYADPTSNEFAEYHQSLSKAAHAMNLRYRLRYRRSKSHISRPLPVSGYGVELALKKTDYIVMDDRHSSKNTDQSPMKPVEVLDGTDDVVDLKPLSTSELSSIGMKAASYIKNSDHPFDALVKLTQDFPRFASSIASQNVSQAFAAENKQNRAQKMPGGVNFLWMNGAQLTDREIQPFALANMLRSERKLVDGIRDLGFDGEQAVALLSHKAVSTIHKDDKPLRYDWTDRLEAGGVILWLNDLENDERYISYPKTLTSLLQLTFPGQIPPIGRNVFNLVIPADLSDAEDLQFISEVEAIIDRGVPIRFGLVPLQLSDEAKTQAKIAYFLTENYGIESTISYIKQLAKAQQKMTDSGTLLSTITESRTLLPGGESMSLSMILQASDFTEKLVQAGNWARRLKADTAVRPLFMNGILVPRDQNWMQSLGMKVSGDLQTIQRGIFHGVLDDDTWTIEVFLEGAVSRRNIYISETNEKALRVLNIAKIYDENADMFNAVPIVDSSAESTTENWAVVTVLADMSSRAGLDILLSALEFRRSNPAVRLDFINTQADFKASSQVNRALKANQAKFKEIVTIQELEELLREASDYDASDNFAASVAEFLAETKIPTGSQVVIMNGRVIGPIAAASTFNADDFEQLLEYEQTRRILPVHAAVAELGLSERISDSMAAAKLSSIVALSALSDFPEGIFESSSGVRSTIYTAWNSSHTGVESGDPKKSSIHIVGLLDPVSEKSQKWVYILRVLAELDGVYVKLFLNPKELVEELPVKRFFRYVIESTPKFDENGSVKDLTATFSGLPLNALMTVGMDVPPAWLVAPKSSVHDLDNIQLSAAKSDIEATYELQHILIEGHSRDDQESAPRGAQLVLATENEPHLTDTIVMANLGFFQFKANPGVYNIRLKEGRSAEIFTIESIGAQGWESAPDDKGNELALMDFQGTTLYPRLKRRPGMENQDVLEDTSNSSKGSMVSKSLKFAEGLLSGGKGKSTSDSQHAEINIFSVASGHLYERMLNIMMVSVMRNTKHSVKFWFIEQFLSPSFKEFIPHLANEYGFKYEMITYKWPHWLRQQKEKQREIWGYKILFLDVLFPLSLDKVIFVDADQIVRTDMMDLVNLDLNGAPYGFTPMCDSRTEMEGFRFWKQGYWANYLRGRPYHISALYVVDLRRFRELAAGDRLRQQYHALSADPASLSNLDQDLPNHMQFQIPIHSLSQDWLWCETWCSDESLAKARTIDLCNNPQTKEPKLDRARRQVPEWTMYDQEIAALDLKRKQRVQSEATETDRTRSEDGEAGHHHSRDEL

SEQ ID NO: 4581 - protein, 1535 aa, Rhincodon typus
MAALWVAGFAKNDNAGILATLALVYLFFSVVNADSKAVTTTLTTKWPSTPLLLEASEFLAEESKTKFWDFVDAAQEIHPNQETDISYYKYILQKADEFLTPVQANLLKFALSLRAYSATVQTFQQIAAEEPPPEDCSAFVNVHGEKSCNPDGLEVLLQSALERPKPYLFKGDHIDASLRPELPVVILYGEIGTKEFSKFHKLLRSKSEVGNINYVLRHYVANPSKEKVFLSGYGVELAIKSTEYKAKDDTQVTGSELNATVINENDPVDEVQGFLFGKLKQLYPEIKEQLKELRKHLVESTNEMAPLKVWQLQDLSFQAAARILAAPTDDALMVMRDLSQNFPTKARSITRTVVNSAMRREIEEHQQTFKETFGLHPGDSALFINGLSIDLDVQDIFSVLDLLRNEARLMEGLHDLGIQGDELHELLKLNVQPADSDYGVEIRNPAIYWINNLETDSKYNTWPSNVQELLRPTFLGVIRQIRKNFHNFVLIVDPTDESTPELLKMAEMFYTNDIPLRIGLVFVVDDSDEANGLKDPGVALFRAFNFVADELDNMNAFQTIISIYSKVKEGEKLAIEHIIGVLEKDFSNVEVTSILGPNSAYDRNRKECKDYYKQSGLGPLPIALYNGMPYQREQLDPDELETVTMHKILDNTAFFQKVVYLGELNNDQDVVDFIMNQPSIVPRINSRILSSERDYLDLSAEAKDSVDDYSHFAFLKSEEKSAAVANNMQYLSKRDDKYIRPLTFWIVGDFDDSSGRQLLYESLKHLKSSNNLRIGLINNPTTEPTEENTIIARAIWAALNTQSVNNAKNFITKLAKEETAKALADGADIMEFAVGGMDNDAFKKMFETLKLDFILSHSSFCKDVVKLKGGQRAIISNGRIIGPLEENEIFNQNDFHLLESIAVEAAEKIKVRIRMLMVEEDLASDLVMKVDSLLSSKSKGESRLDLRFFEGEFSAIKLRPKEEQVYFEVMAITDPVTRDAQRLSSFLLVLNQLVNMNLHVLMNCQPKLSEMPLKSIYRFVLEPEITFSADGSFAPGPVAKFLDMPQSPLFTLIINTPESWMVESVHTSYDLDNIYLKEIDGGIAAEYELEYLLLEGHCYDVSTGQPPRGLQFTLGTNANQEIVDTIVMANLGYFQLKANPGAWVLRLRKGRSEDIYKIYSHDGTDSPAGTDEVTVVLNSFKSKIIKVKVQKKPEKMSEELLSDDNSENEGFWESIKRGFTGGPKPEELRSDKEDVINIFSVASGHLYERFLRIMMLSVLKHTETPVKFWFLKNYLSPTFKEFIPHMAKKYGFQYELVQYKWPRWLHQQTEKQRIIWGYKILFLDVLFPLAVDKILFVDADQIVRADLKELRDLDLEGAPYGYTPFCESRKEMDGYRFWKSGYWANHLQGRKYHISALYVVDLKKFRKIAAGDRLRGQYQGLSQDPNSLSNLDQDLPNNMIHQVPIKSLPQHWLWCETWCDEASKKRAKTIDLCNNPMTKEPKLEAAVRIVPEWQDYDQELKQLQKLFQEGKLNGLSHADTDDITSTEGHTPHGEL

SEQ ID NO: 4582 - protein, 1543 aa, Tuber aestivum
MRLPNFGGRLSVGLLLLSPCVRLVSCGPAVSVALKASWNGAPFLLELLETAADEVGPSYFPLLDRIAAGDFADIDSDEALYHAFLRVAREEGFLVGQEELASFDFALSIHAAAPRIEAHYHYYENSLEPMMGRLYDATCQVWLQWSQKQVCGTGGDFKDMLKSWERYQKYGILSFDRRKLQFDRVLETREDKPAAILYADIGAPNFKQFHEVLRDYAKQGVLTYRVRYKPRTNGKGRPVILGGYGVELALKKTDYIVMDDRDVSGEGDVSKGKETQIPVGELDDQEVQDIKPLHPKDMSFLGMKAASFVMESGDPLTMLLKLLQDFPKHASSVAAIDVNPDVADALQENWDSFLGPGQNALWINGVQLENSDVNAFALLEHLRRERRFVNSFKALGVNSSEAVQLLSHQILASSRQDEAPQRFDYRDSIEGGKAIIWLNDLEKDLRYREWSSAVGTLLRRVYPGQLHPLRRNVHHLVVPVNLASKEDLALIAEQLRLFVDRKIALRFGLVPLTGTPEAVAQAKVFYYLNDAYGLPVALGYLELALESGQFSMPNAKVLEQVIKGAEVIEGWTALPLEEVLSSEAVGEHIKASKSWAGRMGANSLIPPVFINGLSVARDEQWMQIMSARLQGDVQLTQRVVYEEIANDETDFAALLLGNAATRRNSYIFPEGEESIRTINVGKLLKEYPHVFDRLPTIISDRPDRLVESTIWVIGDFDEKDGYELLQGASELQKLAPGVNLVSINNPQLVSGNPALSTLLHQLHQVGFFKGPEQLQQLLEEVPPLKEHADIPKAEALLQMQIPDAKPSSWRFPDHIESGNFWRESQMMLEAAGFKPGQRGVIINGRVVGPVPVDEEFGAEDFMQLLEYEHSRRILPALKAANEMGVLEKLKGSQSSACLTNLVALSNVPEAPTSVFQGPSLARTDAFDRLWEQEHVAIESGDKGKAIFQAVASIDPASELAQKWVPILKVLSEMKGVYMKIYLNPQRVVAELPVKRFYRHVLNSAPIFDENGNLADPQARFENIPELPLLSLSMDVPPSWLVTPKESPYDLDNLRIQSLKDRLKGSDIEALYELRSILIEGHSTDIVNGGPPKGAQLVLGTEKEPHFADTIIMANLGYFQFKANPGYYKMELKEGRSKEIFRIDSTGTKGFQQGKRAVTDEDSEIALLSFQGATLFPRLSRNPGMEVEDVLEQSTGAPKNVGDFATKFLKKAEGVLVNFGFLAPAADLKPRADINIFSVASGHLYERFLYIMMLSVMKHTGKSVKFWFIENFLSPSFKDFIPIMAKEYGFEYELVTYKWPHWLRGQKEKQREIWGYKILFLDVLFPLDLDKVIFVDADQIVRTDMSELVDLDLQGAPYGFTPMCDSREEIEGFRFWKQGYWKNFLKGLPYHISALYVVDLKRFRQIAAGDRLRQQYHQLSADPHSLSNLDQDLPNHMQSMLPIHSLPQEWLWCETWCSDESLKTAKTIDLCNNPMTKEPKLDRARRQVPEWTAYDEEIAALARRSLKKEGGEESEAARRAEKEEETMEAPEERESEQPTIKEEL

SEQ ID NO: 4583 - protein, 1246 aa, Apteryx rowi
MFSKHKSGTNDTTEEEEEEEESDVQGFVFGRLKQMHPNLKNNLKEFKKHLIETTNNMEPLKVWELQDLSFQAAARIMSTPVYDALKVMKDIAQNFPIRARSLTRVPVDKQMRNEIEENQKHFYEILGLQPGEARLFLNGLHIDMDFHDPFSILETLKLEGKVMHGLHELGIKEEILSKFMRLHIHSADDSYALDIRHSSIIWVNNIEKDHSYSTWPASYQELLKPAFPGVIQQIRRNLYNLVLFIDPIQEDTNDYMKLTELFSHHNVPLRIGFVFILSTQEEIDGNEDAGVALWRTFNYVAEETDTSQAFTSIINMYHEVKDGNVLTVNHVKNVLRHEFPHADVQSILGVHSEYDEGRKAGATFYKKTGLGPLPQALFNGVPFNREEMDGTELETVILQRIIDATGFFQRAVFMGLLNDHINAIDFLMEQQNVVSRINPIILGAERKYIHFRSTSVPFDVQDFSTFSFLDSQDKSAVISDDMKYLTKKDEDILYAVTMWIIADFNKPAGRRLLSNALKYLKTSRHTRLGILNNPSSKIKEBNTAIARGILTAFLTQNNSSLKSFLSKLTKEETAKSLATGTKIVKFLIPGMDDDTFEKKYNTLGLDIIKTHQMFCQEVLKLLPGQMAVMSNGRILGPLDENEFYAEDFHLLEKKTYSTSAEKIKTIVKEMGISTKSGSDLIMKIDALLSSLPKTEMRQDAELLKEQHSVVKIDPQQNQPFYDVIAIVDPLTREAQKMAHLLIVLKDIINMKLRLFLNCRSNLSEVPLKSFYRFVLEPELTYGINKHLPSEPLAKFLELPESPLLTLNMITPESWLVEAVNSSCDLDNIHLQDIKGTVTAEYELEYILLEGHCFDMTTGQPPRGLQFTLGTKNNPVRVDTIVMANLGYFQLKANPGAWTLRLREGRSKEIYHVFSHEGTDSVADLADVIVVLNNFRSKIIKVQVQKKSDKMNEDLLTDGVTEEKGNWDSVTRIMMLSVLRHTKTPVKFWFLKNYLSPTFKDVIPHMAKKYGFKYELVQYKWPRWLYQQTEKQRIIWGYKILFLDVLFPLAVDKIIFVDADQIVRSDLKELRDLDLNGAPYGYTPFCDSRTEMDGYRFWKSGYWASHLGKRKYHISALYVVDLKKFRKIAAGDRLRGQYQALSQDPNSLSNLDQDLPNNMIHQVAIKSLPQEWLWCETWCDDKSKKKAKTIDLCNNPQTKEPKLQAAARIVPEWIEYDSEIRELITKIEEENKNRTSFFQKGLKHDEL

SEQ ID NO: 4584 - protein, 1528 aa, Debaryomyces fabryi
MQIGCCLAICQFFLLSVIAFQDKDVNPVENKFEVDLEATWKSSPFQLNLLESITGYNESLFISTLSSIIGFSTEENESDEESNEEVESSLLSDSQMYNKVIDALNLDDTSKSFIGFNLVNKVFTPRIQAHYEYYNNVVDPQYSPRLNKECSTDSFGNKILSGESDKHRAWILYNDKLYCSSDEVFALKTNKKAISADDILPFDRVIGSNQDSPLLVLYGDIESEIFKSMFINLYESAKIGKLRFTWRYIPTSNSNQREQLSGYGADLTLKRTDYIVIDDRDVNKVESLNERNTANNNYRLDKDLLKIAKLDELKPISKDNTTDLGLKLTSFVLSNDYSDISNYELLNTILQDFPKFAYYVSHLDPENIESVKENVDANVKLGMSEESNGIYINGSPINKLELDIFKLVDKVRDELKLVNELKALGFTTSQGKKLLYKFALLSAVKESQFRTGNTIMGGNENRFKVYNYQFTPMSRHKKGGIVFFNDLEKDDVYESFPSSRKEAYLGFAAQHLRPGQIPLLRENIHDLIFALNFSDKEQLKVFFTFSKIILDKSLPQQIGLIARGGNEKDKTLAKIFYFIVDTASLKEGLAFLYQYFDAKDEETEREILAAVNIPTTYNFDESIYQDVLDKFSINTPSVICNGVIYELTSTWQVLMGKQLSQDIRLIQNHIQKGNDINKSLKGFLFENAKSERNLRIIPEDASLIKYKGINQELIDNSITFKSKKKENGVSATFWLIGDINSVNILSQFIEILRIMKVERSYSVQLRIMNKSTNGDILDEIQSLFSINLLSNNNIENMISLLSDKLQKSDNYMPDKNVIQLLEDNGLPPNHPILLLNGRYFRLDKKFSFKELQQLLEYEFSQRLNLFSDIISAYPQEFPKSFCEYYSSSHDCFDWFDLVSSYVTKSFHIDDNMFFTDVARFDFSSLNLNNILKVNKDEASSKAVDVLLIIDPIDENSQKLVSIINAIGSFPFVDIKILLQPQIEATEEVKIGRFYRGVYPPPIPQFDRKGRLEVRNKAEFEMVPSQELFTTNIDSPVRWQIVIDDSPPGVDLDNVKLSNYANSLIYGTYVLKNILIEGFAKNVKYGMNLSGLTLDLIKDKSHTDTTVMSNLGYFQLSANPGIWEFKIKPESKSQKYYSLLSASENVFISNTDPLDRVRVAVMNLNGLVLKPRFTTNPRYENKSIFEEDDNTESKEENKIGNFMKSLLKSKAPTKKQADINIFTIASGHLYERFLSIMTASVMAHTNKLVKFWIIENYISSHFKKLLPLLAQEYNFEYELITYKWPNWLRFQREKQRTIWGYKILFLDVLFPQDLKKVIFVDADQVARTDMKELVDIDLEGAPYGFTPMCDSRKDMEGFRFWKQGYWAHVLKDGLKYHISALYVVDLDKFRAISAGDRLRAHYQKLSSDPNSLSNLDQDLPNNMQNKIKIHSLPQEWLWCETWCSASEFNNAKTIDLCNNPLTKENKLERAKRQIPEWTTYDDQIKRLVDQINENENRKISTKESETTSHDSLHYEYDQSQSDDDVHDEL

SEQ ID NO: 4585 - protein, 1543 aa, Morchella conica
MRLTDFRRSLPTGLLLLTPYLRLALCSPTVNVGLKASWNGAPFLIELLETAADENEASYYPLLDRIATGEFSNVSSDKALYESFLRAVQEEGFLKDAVELASFNLALSIHAAAPRIEAHYHYYENQLEPQMGKLYKPGCETWLQWSHKQICSTTGDYKEMLGSWERYPNERRKLQFDRVLESKDDVPAAILYADILSPSFKEHHRILKEFANVGKISYRVRHRPSTTRENRPVMLSGYGVELALKKTDYIVMDDRDMDSSAEERKSDSEAPALDDEEIQHITPIHPKSLPDLGLHAASFIMNSEDPLSTLQKFLQDFPKHSGRIGQIEENLEMLNELRENREAFSAVGTNSLWINGVQLAESQINAFALLEHLRRERKHVGSLTALGLNNSEAVQLVSHHIIADSKLSELPQRFDFRDDIDGGNVIVWLNDLEKDKRYKDWSSSVSVLMRRIYPGQLHPLRKNVHHLVLPVDLTSRDDLVLLSEQLRMFVDRKIAIRFGVVPLGKTDSAIAQAKVFYHLKNTYGLAAALRYAHESLANTDFSKPSAKVFKNVLKDAEPRKEKPVLTLEEILTNEDVEAWHVKAKSWGSRLGVNPSAPPVFINGQSLPRDEAWMQNMASKLQADVQVTQRAVYEELIDDNSDITGLLMTGAVIRRNTHIVPEDDASVKLVNLVELESAHADIMAKLPRISTDKLAPLEAATIWVVGDFDEKDGYQLLQGAVELQKEASGVDLVLINNPQLSASTPSLSTLLHQLQQVDFFTSPERLEQLLEEVKPVQDFVDLPKVEALVGSQADAKASGWTYPTHMESSKFWEGARVLADKSGFKSGERGLVVNGRVIGPIPRTEDFVGDDFKQLLEYELSRRIAPVLNAAQDLGVMEKVKSPAALTNLVALTMASDVPAGLFEAPVTGRTDAFLRLWKGEHTAIESGDKDSAMFQVIANVDPASESAQKLVPILKVLGEMDGVYLKIYLTPQRMISEVPVKRFYRHVLESKPVFDEAGSIIDPKARFENIPGAILLSLSMDVPPSWLVNPEECIYDLDNLMLDSLKDRLQGSDVEALYQLRSILIEGHSRDVSTGGGPPKGAQLVLGTEKEPLFADTIIMANLGYFQFKANPGHWNMGLKEGRTSEIFHIDSAGTTGGYSSMLPRAGEQEQEDSDITLMSFQGATLFPRLSRKPGMLEEDVLDQESISSGSFAKKWIKKAEGIMVDAGLMAAPKRAVQKGQAEINIFSVASGHLYERFLNIMMLSVMKHTDSTVKFWFIENFLSPSFKDFIPVMAKKYGFEYELVTYKWPHWLRAQKEKQREIWGYKILFLDVLFPLDLDKVIFVDADQIVRTDMKELVDLDLHGAPYGFTPMCDSREEIEGFRFWKQGYWAKFLKGLPYHISALYVVDLKRFRQIAAGDRLRQQYHQLSADPASLANLDQDLPNHMQSILPIHSLPQDWLWCETWCSDESLKTAKTIDLCNNPMTKEPKLDRARRQVPEWTAYDDEIAGVERDTRMRRMMEEKEKAGEVEEKVEEEVEAEEGRWKGTKWDKTKKEVEEKDEL

SEQ ID NO: 4586 - protein, 1273 aa, Octopus bimaculoides
LNSEFLFRENEDYFWRFVDDVSQRTSEEIKSSSKETSYNLLLEMAAKYLSSLQLNLLKLTLSLRVHSPDVEMYSQMAQEEKKSLIVSQKKLADNCDVFVNIHGEIACNINDIDALIKSAPKRLKAATYTFDHHYPSPVQADVSVILYAQLGDTSTAEFHRHLKKLAVNKKINYVYRHYIPKPSNEKVYLSGYAVELAIKSTEYKAKDDTKVEDEKAKASEENANWEEELKGFNFKKLSQLYPDLIPKLREFHDYLLDTATELTPMKVWQLQDLSLQAAQKAILTPPKDALNVLQTISQNFPVQARSLVRTSVSSDLRKEILKNQKHFENYHNLSPGECALFLNGISIDVEVYDIYTILDLMRSEAAVMEGLFSLGVREESLNKLVKLDLKNSGDDYVLDFRHPSVVYVNDLEKDVKYRRWPNSIQEMLRPTFPGMLRHIAKNIFHMVFVLDPSKSSSRDLLKIAEAFFVHSAPVRIGLVFAVNASREANGYSDAGVAIARAFQYIKIDQDAASALSFITDLYDKQKDDLTSKFISTEFASRFNDEDLNKVFGDDDDYDDLRKSADDFLSRSGLSDFPQVLLNGIPLKKKYLNADMLEEAVVTEILQGTHEVQRAVYNGELSDSMTILDWMMEKDNVLPRINSRILSAPLMYLDLTESAAKDVFHDADLFGALSNKEMSSQMAKNILYMSRKVTTSRFSSSLRVGIVFNPTDSKAKNAINKAIHVALTTLSGNMLRNFVTKLVKEENIKELNDGTKTLRDLDVSGMDIDQYMATLERQDDTFLKVHHMFVERVLSLPPGSHAIIGNGKVIGPLKDDEVFIQEDFSLFEKHLMQTSAKKIQAHIESANANSDKASDLVMKIASLLSAKTLSESRKDINYHADGHSVIKIPADPNAPSFEVEVIMDPVSRETQKLIPILITLQKVANMNIKIYMNCKDKLSELPLTNFYRYVLDPELKFSVDGNAISVPYAKFESLPQKSLLTLNMHPPESWLVEAVKSPYDLDNIMLEEASNGVSAEFELEYLLLEGHCHDSSSGQPPRGLQFTLGANNSAFLVDTIVMANLGYFQLKAYPGVWLLKLREGRSLDIYEILSHEMTDTPAGSKDLVVAINSFKSKTIRIKVGKKSDKVNEELLKDDEDESMGIWDSISSSFGGGKKEKKEDKDSTLNIFSLASGHLYERFLRIMMLSVLKNTKSKVKFWFLKNYLSPTFKDFIPHMAKEYQFEYELVQYKWPRWLNQQKEKQRIIWGYKILFLDVLFPLNVKKIIFVDADQVSSSD

SEQ ID NO: 4587 - protein, 1442 aa, Candida maltosa
MLWLITLCSFIGITNAIVHNDVSIGLEASWNRIDFLPNLIESVASFNESLYLPTIETIYGLGDGVDEELDEESSDKDIYTSLINTLELDEYSKNFINFNVVYKKYLPRVVSHYAYYESVLAKYGNRLKTECAHDSFGNEVDTKNGELQTWLLYNDKIYCSANDLFALRTDKSVQEPLMFDRVIGSNEDAPLLVLYGNPVEQSTKDFLKILYPDAKAGKIRFVWRYIPSGTKNPVSLPGYGVEMKLNNFSYFDSVNSPQSSKLDLTKDLTQINDSVSIIPLQKQDTFQLGVKFTSFILSNKYKLPKYELLSTILNNFPKFVHYIAKLPKQLNHEKVKTKVTGNEDVGFSAQSYGIYINGSPIHPLEMDIFKLANKLKDELKIIQSLVKLGFDAVQSKLLISKFALLSAVKQTQFRSGNTLMGNNENRFRVYDNAFRKIDPSKGGVVFLNDIEKDVTFSEYTTDRQEAYLGASSYKLKPNQIPLLKENIHDLIFALNFANKQQLRVFFTLSKAILDSGIPQQVGLIPVIGEDPLDEVIARKFYYLAAYSTAPEALALLYQYFESATAEEAEKLLEKVPVPENFQVSFDGILNKFSITEASVICNGVIYESRSPNWQIAMSKQISQDVSLIKRFLRESPSDDKLKHSLYSNAKNKRDLRIIPLEPSEIIYKSIDRELMSNSVVFKKLDKETGVSGTFWLVSDFSDVVMINQLIDLLTVLKKQPIQVRVLNTGNGDFFDNLQGKFKLSALSNSQIEDIIELLSELEPSKGVNQSMKNLLESKHLAVHHSFLLFNSRYFRLDTPLDVSDLQQIIEYEFSQRLNLFNDVISAYPDEFDSKNIGDFNSIISGLDNMDWFDLVSSIVTKSFHTDDKMFVVDVNRFDFSPLDFSNSVDVNKYNNDNLVDVLVIMNPMSELSPKMINIVNSIRDFPFVNIRILLQPRVESDEEVKISSFYRGSYPSSTLKFDSHGKWIQNYDIDIENLPENFKYSTELDSPNKWIVTSNKATTDMANIDINAANTQVKAKYLLKNILVEGYARDIHTGKAPDGLKYFLTCNNDNFHTDTNVMTSIDYFQLKAIPGVCLLSSNPEYGLLSASENKFASNDQPLENVTIPIFSIDGTTVYPRVIPSDGVTVKDKKKHADINIFTIAGGQLYEKLASIMIASVRAHNPNATIKFWILENFLTPQFKKLLNELSDKYGIEYELINYKWPNFLRKQKTKERIIWGYKILFLDVLFPQDLDRVIFIDADQTCRTDLTELTNLDLQGAPYGFTPMCESREEMEGYRFWKQGYWSEVLKDDLKYHISALFVVDLDKFRSIRAGDRLRTHYQKLSSDPNSLSNLDQDLPNNMQRSIKIFSLPQEWLWCETWCSNESLKSAKMIDLCNNPVTKENKLVTAKRLIPEWTDYEKEIDELMNDIGKDVIEEEDNNEEENDNEVESDIEEDYHDEL

SEQ ID NO: 4588 - protein, 1514 aa, Trichogramma pretiosum
MLLFVLLCPFFMNLGPIAAEKKINKFVSTLIDAKWKDTPLVLEVAEYLNDESQDYFWRFVDQVSDASNDFQNVTEKEQYDLTISMASKFLSPSEINIMKLGLSLRIYSARVEMFSQMAENKNASDLDCANFIDVGGKYFCTLDKFNQFIEDDEWNPEGIDTYNLDHFYLGKQQTDKTIVLYGQMGTPSFSELHNELKSLAESKKINYVLRHYIKDRPDRKLRLSGYGVELQMKSTEYKATDDSDIKENQAQSEESVSENEDEVDGINFSALKKLYPDHSKKLEKMQSYLLENSHEVEALKVWQFQELSHQAAERIMNSPAGEAIDVMTDIAQNFPLQTKSLVKTKVSNEMKKEIKLNQEIFSTTLRIQPSETALFINGLFFDLDTVDVLTLLESLRSELRVMESLHKIGLQGQKISNLIALDLSDNVNNQDFAIDIRDSAVIWINDIENDFRYNRWSPSLTELLRPTFPGMLRNIRRNLYNLVIIIDPISEDSAPLITLAESLYAHSAPLRVGFVFKTNFNMTETGLSDPSIAINNAFHYLMESKTSKDAINFLSSLKNYDTSNGLSVDNVRKALKAIDSKANANYIFGEESEYDVGRHLASDFIKRTGFKNVPQVLLNGVPLPSNQLTAELFEEAVLSTIMSQTPVIQKAVYKGEITESDDVIDYLMNQPNVMPRLNERVLKTENNIWLNLIGSIPDNTDYHKWSSQDKSVWLMDNMQYICVSRKNVPSHLYTIWITVNLEEHSGRMLLKETLNYLESNADNRATILINSENSKHSVTNINQIALAAIKVLPVEESFKYLRKLMKEETYTQIRNGEFDIQDEILAEMKQQEFLLQVQSDYCKNVLGINENARTIVYNGRVIGPLENDEEFSSEDFSLLGRFSHSTYGEKLYKFLLKSQFFTDEYSEGNSIPDDTIMRITSLLVPRPQTRSRFEVPFHGDEHSAIKLPAKNLDEPIFNIVAVVDPVSRGAQKLGPILKVLYKSLNSNIKVFLNCIDKNSDMPLKSFYRFVFDSELQFNNDGEIIGSVAKFTKLPTSSLLTQYIHAPENWLVEVVRSVYDLDNIKLDNVAMGVHSEFELEYLLLEGHCFEALIGNPPRGLQITLGTERNTATVDTIVMANLGYFQLKSNPGEWLLKLRAGRSSEIYDITSVDGADVIHKGKTVKVLISSLRSNVLKLKVTKKPDKIGVDLLADDDKESGIWNSISRTFSNSEDSEDADEKLNIFSLASGHLYERFLKIMMLSVMKNTKMPVKFWFLKNYLSPTLKDFLPHMAKEYGFEYELIQYKWPRWLHQQTEKQRTIWGYKILFLDVLFPLDVKKIIFVDADQVVRADLKELATMDLGGAPYAYTPFCDSRKEMDGFRFWKQGYWKNHLQGRSYHISALYVVDLKRFRRIAAGDRLRGQYQALSQDPNSLSNLDQDLPNNMIHQVSIKTLPQEWLWCETWCDDKSKKYAKTIDLCNNPMTKEAKLQAAMRILPEWIGYDEEIRALQVKLENENRQVEKEDDVSEKHAKHQEL

SEQ ID NO: 4589 - protein, 1456 aa, Paralichthys olivaceus
MDAGSSGAGVVFSDTGLRMWLLWFLLPSLLSAVSGGTDSKAVTTTLTTKWADTPLLLEASEFLAEESQDKFWDFVEANENIEGEHDDTDQAYYDLIVKKASALLSSVQVNMLKFALSLRAYSATVHSFQQIASNEPPPPGCSAFFSIHGVKTCETESLEQLLKTASERPKPYLFKGDHKYPGSNPDGPVVILYAKLGEPDFQRLHHFISSKVREGLVTYVFRHYLANPSGKKVYLSGYGVELAIKNQEYKAKDDTQVQGTGVNATVIGENDPVDEVQGFLFGKLKTLYPELKEQLKELRKHLVESTNEMSPLKVWQMQDLSFQTAARILAAPAVEALSVMKDLSQNFPTKARSITKTVVNSEIRKEIGENQKFFKGTLGLQPGDSALFINGLHIDLDTQDIFRFFLVLVIILDPTQENAAELMSVAEMFYANNIPLRIGLVFVVSDEEDIDGMQDAGVALVRAYNYISDEVDSQSAFEAVISMFNHVPIGGQLSVGDVVKVLEKRFPYVEVSSVLGADSSYDSNRKDGRAYYQQTGVGPLPVVMYNGVPYQREQLDPDELETVTMQKILETTSFYQRAVYLGELATDHDVVDFIMNQANVVPRINPRVLSTSRTHLDLSDTNNFFVDDYARFSTLDVKQKSTAVANSLNYMTKKGMTSTNRHDDGYIRPVTFWVVGDFDKPSGRQLLYDAIRHMKTSNNVRLGMINNPSVALSSETSHVARAIWAAMQTQSANNAKNFITKMAKEETATALQRGVDIGEFAVGGMDVSLFKDAYDSPKFDFLLSHAAYCRDVLKLKKGQRAVISNGRIIGPLEEEEVFNQDDFLLLESIILKTSGERIKSKVQQFGIEEDRASDLVMKVDALLSSQPKGEARVEYDFADDRYSAVKIRPKEGDVYFDVVAVVDPVTRDAQKLSPLLLVLKQLVNVNLRVFMNCQSKLSEMPLKSFYRYVLEPDVTFQSDSSFSPGPMAKFLDMPQSPLFTLNLNTPESWMVESVHTRYDLDNIYLEEVDNIVGAEYELEHLLLEGHCFDVSSGQPPRGLQFTLGTASDPVIMDTIVMANLGYFQLKANPGAWILKMRKGRSDEIYKIYSHDGTDSPADSDDIIVVLNNFKSRIIKVKVQKKPDKFNEELLSDGTEENDTGFWESLTRGFTGGGKMEEVKQEKDDVINIFSVASGHLYERFLRIMMLSVLKNTKTPVKFWFLKNYLSPTFKEFIPHMAKEYGFQYELVQYKWPRWLHQQTEKQRIIWGYKILFLDVLFPLAVDKILFVDADQIVRTDLKDLRDFDLEGAPYGYTPFCESRREMDGYRFWKSGYWASHLAGRRYHISALYVVDLKKFRKIAAGDRLRGQYQGLSQDPNSLSNLDQDLPNNMIHQVPIKSLPQEWLWCETWCDDSTKRSAKTIDLCNNPMTKEPKLQAAVRIVAEWTDYDQEIKRLQTKVQEGGTHRAKHQDTDGHTEL

SEQ ID NO: 4590 - protein, 1455 aa, Brettanomyces naardenensis
MLFLFSILPLIAGVLSLAARQTNNSIDLSIVGSWKTTPFKLNVLESVSSEEPTLYEPLVEKLLGLEVTNEDGEIEVGLKDEYCLTDQQYYSYAMSLVQSNITRSFIDVNLANRVDSPRIEAHYKYFRDFIAPKKHCSSGKAFIIQGSEVYCNPTDVFALKTAESSLDLEPMDHLLGDSKNFYVLYGDFSVDSFREMFSYLYQSMLSGKLSFIWRYIPDETVQDYELLGGYGIDLTLKRTDYIVIDDRGFTEEQQKKLKFEGSDKVVTREEVDEEEDFWEEYKPDVPKLKADDLKDLAIRVSKFVLDLDSSDGKKLELLTGLVEDFPKFAANFAGLHYNDSDLRMLALESLQDSQIDIPDGLYINNAVVPAIKSDMFAVLKILKRELKYTEIFREIGINSSSANSILSTFASYEYNFAKMPYRRYDYSDFSSSIVYFNNIEEDYPYSSLVSAREAYSEEPPLGQIPPARENIYETVFIFDLTDPAKLYYSLAMINQVLSKGVPERVGIVPIASSDLGKRAAEEFLKVSATSGSNAALKFLHELNHYVSTDKLDPKALESLEQPDTKDVKHILRSIRSFQNNFKLGLEPRMVVNGVIFPFDENWQLAIRQLSFDVYHLYESFQRDMIPANMPFRDYLLSGSLKQRVPYLIPDNIQSSQTNFLSVPSLQHILLLDNFTNGVATIVNHKCKSATCYRTLSPKTLTLVGGFDDRNFRHQISEAIKYVEGSNNIKLRIVDLGHTKEFEAFKERLASEGITTALQFLSIVESVGIVASGAENVGKIFGISRNSGIHLILNGRSMDITGYPTVTPEQFDILMEFEGRLRLTPLWKMLKRQKSAQSVGKSVFKDKYDWFEYTTWLLSDTQFKSDEEFVYEGLPRYGTDVLNEALSLHIPAKSDPLIYVSLVIDPVSEGAQKYLSMLSLFEEMDFVDIRIHLRPAAEIESVDIKRLYRGMFKSKARFNGTGAIDRDSLKVAFNDVPEKTLFTLNVDDPQSWTVSIKEANADLDNVKLDLTGPVSGVYELQNILVEGYASDITAPGMRPIGLPVELVNELGQASSDTNIMANFGYLQLKANPGRWTFRIKPDSQGSRIYSLIGLENKDSREVAVQGYPLYILSLNGPTMFPKFTKKPGKEDEYLVEVGEQEDEGKKSLFARIKNSVSFGSKKNNQADINIFTVASGHLYERFLGIMTASVMAHTRHTVKFWLIENYMSPQLKRDLPILAEHYGFKYELVTYKWPSWLRHQREKQRVIWGYKILFLDVLFPQDLDKIIFVDSDQIVRTDMKELVDLDLEGAPYGFTPMGDSRDEMEGFRFWKQGYWKKLLGDKYKYHISALYVVDLDKFRRIAAGDILRHHYQQLSNDPESLSNLDQDLPNNLQDVIKIHSLPQNWLWCETWCSDDSLKDARTIDLCNNPLTKEPKLDRARRQIPEWTTYDDEISLLIRQSTENDSVISEATTHDEL

SEQ ID NO: 4591 - protein, 1476 aa, Aspergillus calidoustus
MLQNPGHVASWRLSYAVITALLASVVHSSPSVNVALQASFDSAPYLVELLEVAAEENPTSYFPLLDRLAEGAFDDAVTDKELYDRFLQVAVDDGHLANPESLSSFKLSLSIRSASPRIAAHYQFYNASVQHSLMAAQDAACPVWVHSDGKQYCSSTMERAQQDVLGELDGQELPFDRIMGHGSLPPAILYADVASPMFRDFHQTLSALAKEGEISYRVRYRPPQHWSSRPLFVSGYGVELALKRTDYIVIDDRDAEQRDSSGEATLAETEESPDDLRPLSSSEVARLGYNTVGFVADSADPLDTLVKLSQDFPKYSSTIAAHNASVELLQEIRTNRLEMLPSGANALWINGVQIDPRQIDAFSLVDHLRRERRLIESFRSLGLSAQEAVALLAHETVAESAAQDTPQRYDYRDEIEGGGVIIWLNDLEKDAKYESWPADLAAYLRRTYPGQLPAVRRDLNNIVFPIDLSSPQDVDLVTTTIQVFVKRKIPVKFGVVPTSYSPGSTAQLKVAHYLQETYGLASLMAYLEESARKGKLATPDKATFLAATQGRTTRAEKQALSLDEVLSSEELASLVSRTIHYQDRLGIKSDASVTLVNGIPISRGENWPQEMSAKIDKDLRVIQQGIIEGQFEEETWLPGLFLAQAFARRVPWIIPEDPKDVKLVDLTKVSKLLDGVPRIASQVEPLESVHMIVIGDFDSEAGLKLLTSALDLREKQAKTEILFLHNPDELSEQKASAVVYRALNGKKEVNAEQLLTEVTSAPSEEAPEASDFWTRLQPLVETLGLSPGETGIVVNGRVAKPTQDVTPEDFGQLFLYEDINRIGPVTKAAKDLSLTSKVSDPLSFAKLTSLVALSTVSDVPEGLFETSSDVRVDFYKNWTGSGSIITVAGSDDPAITIAASIDPTSEHAQRWLPILKVLSSLDGVTLKLLMNPRDELRELPIKRFYRYVLDPEPSFGDEGSVLRPTATFSGVPVEALLTLGMDVPPSWLVAPQDSIHDLDNIKLGSVKGSNVDAVYALEHILIEGHSRDLTTKSPPRGVQLVLGTEDNPYFADTIVMANLGYFQFKAQPGLWNINLKPGRSERIFNLDSLGILGYSPQPGDDSNQVALLSFQGKTLFPRLSRKKGQENEDVLETGSKPGSATNFLSKGLNFASGVLSSVGVNSKNLEEHADINIFSVASGHLYERMLNIMMVSVMRNTKHTVKFWFIEQFLSPSFKSFLPHLAAEYGFTYEMVTYKWPHWLRAQKEKQREIWGYKILFLDVLFPLSLDKVIFVDADQIVRTDMHDLVTLDLEGAPYGFTPMCDSREEMEGFRFWKQGYWKNFLRGLPYHISALYVVDLNAFRAMAAGDRLRGQYQMLSADKNSLSNLDQDLPNHMQHHIPIKSLPQEWLWCETWCSDEALGQARTIDLCNNPQTKEPKLERARRQVPEWTEYDREIAELARKVQGAGEEVIEDVPVEEEEEEEEEEETAAEWKKDEL

SEQ ID NO: 4592 - protein, 1610 aa, Fistulifera solaris
MAKHSIIFFNALLCPFLLIVIWVVDGNNDELHTIVSPLVNRELETSVVANHWPSTPQNIFCEAFVYHSQEEKGIDFLDRLAEENLDRVMSDAMAEELVMKVTPLMGAAKQLLQLSLALRAQSPHCELYRGLARETLQQQQAHQLFLDPPEAFAVVDGEIITVDTLSSVLATKPQTAVKTIPNETIIPAFGENAYGILYGNMGTPLFAATYRLLRNSEIPFVVRHMGAVDYEERNQSNATGLPLQGYGVWLDIRNVEYKVFDDRGNDSLHSDDEIMVDLTKDDLDVPPGFLAGVNLTALGLDTEKTLVRKLWSAHHNQNLHSSIIPPVWRRRQLPLQATTAILNSATDPLVTLQQISQNLPSMVSSLVQLEVPDNLRKAVEVLEESGDLRPGLLYINGKPLPIDMASFNLFDILNVIQKEQRNLDEMSEMLKDLPSAALRDVQAAWMNGKRFLEGAAGDNGDRKAQTLRIDVARGWKNAVIYLNDVEKDSLYSRWPTSLHHMRMNMEYGGPPSVRRNLFTLLAVVDPIQDPESVALNLGLQLMQAAYPVRIGLLFVDTEHFQECSTFLSKQGTTTSEPCPIPTLFDTKSKLDISKAKATSQTVHLLILTALRDLRAYPGGIFTYIEYIMSFLRDARSNSESVSIGQLLDFHGKLYQSLNLKSAEQAVSDATTIMKAGDKNDDVMAYGHSIKFAVQRGLKPGMGFVNGRPLPANTADEGINRLFGQEQNHVLSLISHGKITDTSPKSVYAYLLEGDNVYAKIHPLLVDPSSGSVPKFLNLDDSFGEEAMCSPNKMVTDVADQVNATKFVIDGIFDFSTELGMAHAAAFLSVMKSLPDKPERVAYRILPSNAKAASTAICPLFAHASVLESGALQKIMDHKYKSLTTKQLLDKLVGISPEVAEIMLSNDGLCSSQRYLHRKLPADNLIVGNGRIILLHDELVTQSDLEMLLSVQMASSRAVTRMLSPYFPVESPKFLISVARVVALLSEHAESSSRTRLSNTIRDLEATSEEDLKEVLLSWNNGPDDREALKVHLGAVLDPLSEAAQRLSSILLIARDHLRLAIDLVLLPKSVLDNESKIPLTSYYRFVADHRSFSNSENPVASFTNLPETHTLTVRMDVPEPWDVQQSWALQDTDNLLCDVKTRCGDGPILNGEGNTKVVYELKSLLVFGQCFETKGAPPNGLQLTLNRDTELGVQIKQPIVEVGIDGSITESSANQYIPRNRTEVNYSDTVVMKTVGYWQLRANPGIWELAIAEGSKGATMFDMVDGTARGGRLVVDPNSIPQEVRMRIVVQDFSNRGELLVLQRKPGFAETTSLFHGEDNGVDEADDTIHVFSLATGHLYERFLKIMMLSVTKRTTSKVKFWLFENFLSPTFKQSAQAMARKIGCEVEFVTYKWPQWLRSQSEKQRIIWGYKILFLDVLFPQSVKKIIYVDADQVVRGDLKELWDMDLKGAPYGYTPFCSSRKETLGYQFWKEGFWKNHLRGKPYHISALYVVDLEVFRRNLVGDTLRSIYQQLSADPNSLANLDQDLPNYAQHSVPIFSLPQEWLWCESWCSDESKANAKTIDLCNNPMHKEPKVSMAKRVIQGDLFQESWVELDAAVKQYEEEYALTE

SEQ ID NO: 4593 - protein, 1493 aa, Podospora anserina
MLRLSQLPLGLAAILATCLSPAHVGASPSVNVALKAAFPAPPYLVELLETAASDNATAYFALLDRVAKGDFVEATTDKTLYEKFVEVLQDDGHMDAEALSTFKLALSMRTAAPRIEAHYQYYSTAVEPSLAEDQVGCVQWYLLDGKQYCTPSLDKAHADVKQSSQERTLPFDHKFGAGAKDIILYADITSSSFGKFHETAKEIAQKGEGSYRIRYKRSAAHPEETLSVNGYGVALTLKRTDYIVIDDRDTGAAKAQDEAQKPIGASDVVLDDEEEITDIKPLEKSELTPLAMKAASFIMKSDSPFETLLKLTQDFPKYSTSLGAHNVSEEFEEEHRLNRQVLAPEGVNVLWMNGVQLIDRQIQPFGLVDLLTRERKLIHGVLDLGLTGEQAVSLLGHSEIAQAKSADDEPRRFDWRDKIEDGEVIVWLNNIEKDKRYQEFSPSIWTILQSFGGLPQVRKNMFNLVAPVDLTKPEDVTVIVEQLLVFMKRLIPVRFGFVPLTPTGEAIDQAKVVYYLLDTYGLSATVAYLENSLESKKTSKADEGVFKQAIKDRKPKEDATVLAFKDIFTSEHHEKQIHLAKHWVERLRADTEVPPVFFNGFPIPREENWLRAMNQKLGAELQEIQQGVYFGQIGDETNIEAQFAEKAIARRNTFIYPEDARDITILNFNKVYTENAYLFDKMPVVEADKDSTKEDWAALTVITDLSTPDGQKLAYFALKFRKDSPGVRIDIVHNPKDTSQSASALTLHIKKQEDSLATVNTLLDLETVLDNVSAEADRELDAALASFLSSVNLKAGNSALILNGRLVGPIPSAEDFKPEDLETFLETERAQRIVPVHKAIEDLGLGDKISGPLDAAKLTSVTALSGISDLPQGIFDSAPSVRISQFSEFKKEYTSFEVGDASKATIFFTAIINPASEGGQKWAAILKVLSELEGVHLRVFLNPTENVQELPIKRFYRYVLNSAPTFDQDGKVASLSANFAGVPQDTLFVAGMDVPPAWLVTSKVSVDDLDNLRIKDIKAKRGTEHVEAIYELENILIEGHSREMPSGAPPKGAQLVLGTESNPHIADTIIMANLGFFQFKANPGVYNLKLKEGRSSDIFTMVSVGAQGWALAPGDENAEVTLMDFQGTTLYPRLTRNPGMEGEDVLEPTDPEPAPSGSAMDYLNKGLKFAEGILGKSKPATKSLSETEHAEINIFSVASGHLYERMLNIMMVSVMRHTNHTVKFWFIEQFLSPSFKDFIPVLAEQYGFKYEMVTYKWPHWLRQQKEKQREIWGYKILFLDVLFPLSLDKVIFVDADQIVRTDLYDLVQLDLEGKPYGFTPMCDSRTEMEGFRFWKTGYWANYLRGLPYHISALYVVDLKKFREIAAGDRLRQQYHSLSADPNSLANLDQDLPNHMQFQIPIFSLPQEWLWCETWCSDETLGDARTIDLCNNPQTKEPKLERARRQVPEWTEYDEEIAELARRNREGKEKKVKGANTKSRRFEEETKGHVVDEL

SEQ ID NO: 4594 - protein, 2112 aa, Gambusia affinis
MLEMGAGELPVTMAMANVAVVTCSSSAQRTDGPVQEFHPSGFYVFPLSDQSVAGGAFLPPTEDRPQNHDPGKQLVPVSNDGRSPVKSDLQPNSACRRTLTAEHSRTLTNIPPSSAVAARCRHLPLPLLFPHFTSSNTSSFNSDPWRQGRMMIYMDSGSKMKWEEVRQCNRLAGGLSYVTNLPQRDCLQTLGKDEQEDHRIKQQMSPQPDAETIVPANAADSKAITTTLATKWADTPLLLEASEFLAEESQDKFWDFVEANQNIEGEHDDTDQAYYELIVKKASSLLSSVQLNMLKFALSLRAYSATVHSFQQISSTEHPPSGCSAFISVHGEKSCAPESLATLLKTATERPKPYLFKGDHRYPGSNPDTPVIILYAELGTPDFQRFHQVLTSKVNEGSAAYVLRHYVAEPNENKVYLSGYGVELAIKSQEYKAKDDTQVQGAEVNATVIGENDPVDEVQGFLFGKLKTLYPELKEQLKELRKHLVESTNEMAPLKVWQMQDLSFQTAARILAAPAVDALNVMKDLSQNFPTKARSITKTVVKSEIRKEIEENQKPAPLSREVLSPPGFSLQEKYLKTRPAPPVAFFKGTLGLQPGDSALFINGLHIDLDTQDIFSVLDVLRSEARVMEGLRSLLIETPYIHDILKLNVQPSDSDYAVDIRNPAICWINNLETDHRYSSWPYNVQELLRPTFPGVIRQIRKNFHNLVIIVDPTQENAAELLSVAEMFYANNIPLRIGLVFVVSDEDDIDGMQDAGVALVRAYNYITDEVNSHSAFEAVVSMFNRVTIGGKLSVGDVVKVLEKRFPYVEVSSVLGADSSYDNNRKEGKAYYEQTGVGPLPVVMYNGIPYQREQLDPDELETTTMQKILETTTFYQRAVYLGELATDHDIIDFIMNQPNVVPRINSRVLSTSRTYLDLSNTNNYFIDDYARFSTLDSKEKSTAVANSMNYMTKKGMAATNSHDDGYIRPVTFWVVGDFDKPSGRQLLYDAIRHMKTSNNVRLGMVNNPSSDPSAETSRVARAIWSAMQTQSANNAKNFITKMSKEETAEALEKGVDVGEFAVGGMDLSLFKSAYEGPKFDFLLSHAAYCRDVLKLKKGQRAVISNGRIIGPLEESETITTGTSGVLDITYNFRSAVKIRPKEGDVYFDVVAVVDPVTRDAQKLAPLLSVGLDSVIGLDEPSLSVQLTTVLCPAANLFPLYHVSVFHSEGSEAARKRQPEGFHELPVKTVRYASEKTECTVCSFYRYVLEPEVAFQPDASFSPGPMAKFLDMPQSPLFTLNLNTPESWMVESVRTRYDLDNIYLEEVENIVAAEYELEHLLLEGHCFDVSSGQPPRGLQFTLGTAAEPVIVDTIVMANLGYFQLKANPGAWMLKLRKGRSDEIYKVYSHDGTDSPSDSDDIIVVLNNFKSRIIKVKVSSSLRRGAPTCPQSPIRVQKKPDKFNEELLSDGTEENDSGFWKSLARGFTGGGKAEEPKQEKDDVINIFSVASGHLYERFLRIMMLSVLKNTKTPVKFWFLKNYLSPTFKVGLVLPPFVVEEDRLGFVLDAFCFSCSWFKTRAGEFIPHMAKQYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHIRCCFSSTIAHRLRRVLHSALYVVDLKKFRKIAAGDRLRGQYQGLSQDPNSLSNLDQDLPNNMIHQVPIKSLPQEWLWCETWCDDSSKRTAKTIDLVTMLVSNRCNNPMTKEPKLQAAVRIVAEWTDYDQEIKRFQTSRARDGASRSTLPDVQQRVTGNRTSSADELCVRTVDRLRSDDPLLLSSAQRTVRSGGQTDADQMLGKAALSVPDRLTVASDLRSVFSVAALLGDNCRPSGPDSSSSTVSTWASNGAAKPSCRKKKKKRKFLDHPREGERERERERPLPHSIQGLAGRHGDQLQRDLLIGYKVVGGGGLEDERGSVGGDDGVGGGWRGGGGRAALFVLMSLYVLGQSNTWGNQQRALQGLACVCPPVSLKLVAPGEPLPAVHPVANEGPLSAVPAQVSSQVRRFPVDLPAAGDVADVLLLLSHARAPERQRGGGGD

SEQ ID NO: 4595 - protein, 1648 aa, Tilletiaria anomala
MMLWIRSLQRLLPGLLLVALVPSVLCSGSDLTGTPSIRVDLRAPWSAPPPLLEILEAVNSLDSTAFFDAVTQLTVSGIAQNTSAKKASYKEIYETSLEVLQKQGIFKAPGAREILDLSLALHSESPQVEAFWHLYRTTGVEKLYREQVVGEEAQQACRSWALVQGKVICSAPALDEALAAGSPTNQEGMIEVPFDHSLSPTSASSLVPMPTVVLYADLSSPNFAELHGSLYRHAVGKSSLPLRYILRWRPSEEDQRETVYLSGYGAALDLKKVDYLVIDDRKLRDDANVTVTGAAAAAAAADTVASYEQLSAESALSDRRWLQAQIGGKKGSTGAEDIGAKISEENTLKLGYKAAQVIAASSDPLRALRELSQNFPFHAKQLSGVKLKKNFLDEITHNQDVRVEAGSNDVWLNGKSIPHKDVTPLGFLKKMRSESILVHSLTDRSRGVGLSPKAAVDLLSNSTLGKAFIGSASEPIAVDASDRIERGLRMLSGALVNGASTSKPSAITWWNDLEKDDVFAHWPRDFKTLLQPLWPGQFPQIARNVFHVVLALDLSRKESCRFLAESVFPASTRIGLRWGLVPIWGSGDGQTIALTRMFYHIFDSLGPDGSARYLRRVGLSGVPESTTINLEEAKKEFAAALGTVASQNEIQEILKRIDPSDSDFMQDRLNTAVSYAQRVGAKLSKGRLGHAFVNGYHVPFDNGISQSIGQQVQAQLQALAPLIYYNTLSTDADLSNHFYDQEDTLTYRSPLLSADGASNLTTRMINLATLEPELLNEGPLSRYFAARPDSVNVTMYIAGDFDSAGGQEMLAASLGALEAGSFRLGLLHQPSSAQGNRTVSTALYTLLNSHEGTKLQPSSILSVLPARPELTPGEVSEENVAKVHALLAAEDSDAAKRAHDWWGRASPMLEALGCGAKSICLVANGRVLSGFRAADVIPADIQAVAQLEGSKRARKVQASLIELAGRPSGASQDSHRVALAASALAADYAPDEAAEGLFRTPPALRLSAFDRIDIMHSGFEIGNRDKASFRYTAIIDPLTETAQRWSSILEMASQWPNTYIKVILNPTPKLREVPLRQFYRYRAPGKVTFEEDGSIRRDSILFTGMPEDAVLTLGLDTPSVWLAMAEDAVYDLDNIRLSSLPSASRSSGVSATYELKRILIEGHARDGQLNSIPRGLQLLLDTADGQERLDTIVMENLAYFQFRAKPGLWHLKLREGKSNGLYEMLSVGNLGWNSPNVNVTGNVVTLASLEGLTIYPQVRKRPGMEDEQLLEDIDKGPEAQDRAGSRVADAAKSLLGSVFSKIASSTPSLTKPQSPHADINIFTVASGHLYERMTYIMILSVLRNTQHSVKFWFIENFLSPSFKEFIPHLAKEYGFAYELISYAWPHWLRSQKEKQRVIWGNKILFLDVLFPLDLDKVIFVDADQIVRTDMIDLVNVNLEGAPYGYPPMGDDSEDMEGFRFWKQGYWKQFLRGRPYHISALYVVDLVRFRQIAAGDRLRGQYQALSADPNSLANLDQDLPNNLQFSLPIHTLDKEWLWCETWCSYEWLDRAKTIDLCSNPKTKEPKLDRARRQIPEWTKYDDEISAFAARLSDEKRIGTNVVSSKESEQVPSAVQEGGASALILQGGDEPAQNQDALHVDTLKHKHDEL

SEQ ID NO: 4596 - protein, 1479 aa, Exophiala xenobiotica
MRTSTLPWRLATCGLVSVAVLSRLVNASSSINVALETSFSAAPYLVELLETAALENSSSYFPLLDRVADGTFVDLQTEQELYNKFIDVLQHDGHLSNSEALSSFKFALALHAAAPRVEAHFQYYNASVRPHLMAAQDAACPVWVYLDGQQYCSPALDRAQQAISLPGADEVLPFDRVLGSSGEGPSSILYADITHPFFGQFHNIVSQTASDGRSNYRLRYRPSSLSASKPLYVSGYGVELVLKRTDYIVIDDRDALKTEAAGVEQISLQQVENDDITDLKPLTSSEVVNLGLNAASFIASSSDPFESLLQLSSDFPRYSSVLASANASNDFLAEHRRNREQFLPSGYNVFWINGVQIEPRHINAYSLLEHLRRERHIIGDLQKIGLTSSEAISLISSEVIAETQANESPQRFDWRDDDEADNVLMWLNDLEHDKRYASWPSDLRTLFQRVYPGQLPQVARDIHNLIVPIDMADIKDIELVTTALQNLVRRAVPIRIGLVPTGSGEIANLYSRLSYHILDTYGLSTLMSFFTQVVSSKKLQANPEKAFMTVIKGLVPREGKEELSYEDVLKAVHLHQRLKARDNYVERLALGSSNHPFIVNGVVLPRSDNWFEVLSSRVFSDHQLLQQAVYEGAVAEDDWIPRVFLFQAAIRRNELVFPSDPKNVQIVDLSRLTREYANEFASIPRIRGADATLLSDRAHVLVVTDVDTESGRSFLTQALQFQKRHPESDLLILHNPPSKAGSHGLAAALSVLTQDNNDFTLEQVQQLLEAETTSLDQDEAASEFWASYEPLIKDLGMALGETGLWLNGRVIAPVDGFLTVADLESLLDYERRERIAPVTTAITVLGLEDQFGDALDVAKVTSLVARSLKSDLPEGLRESAPLIRMDRFKIWNEAYTSFQVSNSENPTIQVVAVVDPASETVQQWVPILKTLSQLSGVSVKVFLNPKDRMTELPVKRFFRQVISAEPTFGPDGSLQKPTASFQRIPRDTLFNLGMIVPPSWLVAPKECIYDLDNIKLSSLGEEENIEALYELEHILIEGHARDVTAGPPPRGVQLLLGTEQEPHFTDTIIMANLGYFQFKANPGFWHISLKPGRSSKIFHIDSVGPKGYAAQPGDETTSVALLSFQGATLFPRLSRRPGMEEEDVLESSGGALDYLNKGASYASSALSSLGFKKTTSTNADINIFSVASGHLYERMLNIMMVSVMKHTKHSVKFWFIEQFLSPSFKSTLPNLAKHYGFEYEMVTYKWPHWLRGQKEKQREIWGYKILFLDVLFPLDLDKVIFVDADQIVRVDMMELNKVDLKGAPYGFTPMCDSRTEMEGFRFWKQGYWETYLRGKPYHISALYVVDLKQFRQLAAGDRLRQQYQALSSDPNSLSNLDQDLPNHMQHVLPIHSLSQEWLWCETWCSDESLSVAKTIDLCNNPLTKEPKLDRARRQVPEWTEYDEEIATVLKEASSKDNQQPEVEHVAEEVVADERKRDEL

SEQ ID NO: 4597 - protein, 1632 aa, Prosopis alba
  MOD_RES (1244)..(1244): Any amino acid
MGALYRSGFRVLIVLACLGLLGIGPAFADTRGPKNVQVALRAKWSGTPLLLEAGELLSKEQEDLFWDFIEVWLRTEKDAVDSQTAKDCLKKILEYGKPLLSEPLASLLEFSLLLRSASPRLVLYQQLADESLSSFPLGDESYSNNNKVEIGETTKGNETTKSDILHDDVNLKSPVGKCCWVDTGAHLFFDVSELNLWIHRPVEPVSDSFQQPEIFDFDHVHLDSSIGSPVAVLYGAPGTNCFKEFHFALVKAAKEGKVKYVLRPVLPAGCEANSGHCGSVGAGQTLNLGGYGVELALKNMEYKAMDDSTVKKGVTLEDPRTEDLSQDVRGFIFSKILERKPELTSEIMAFRDYLLSSTVSDTLDVWELKDLGHQTAQRIVKASDPLQSMQEINQNFPSIVSSLSRMKLDDSVKDEIMANQRMIPPGKSLMALNGALINVEDVDLYLLIDLVHQDLLLADQFSKLKIPHSTIRKLLSTLPPSESNTFRVDFRSTHVNYLNNLEEDAKYRRWRSNLNEILMPVFPGQLRYIRKNLFHAIYVLDPATPCGLESIDMILSLYENNLPMRFGIVLYSSNYVTKQIENRSSKENGDNSEDDISTKIMRLFFYIKENLGIQMAFQFLSNVNKLRTESDGSEDALEAHHVEGAFVDTILPKVKSPPNEILLKLGKEQKLKEMSQESSMFVFKLGLSKLQCSLLMNGLVIEPTEEALINALNDETPRIQEQVYFGHINSHTDVLDKFLSEAGIQRYNPRIISDSKPRFTSLSMFNFGEGSLANDISYLHSPGTIDDLKPVTHLLAVDITSRSGMKLLRQGLFYLMEGSKNARVGVLFSANQSADLSLRFVKAFGITASSYSHKKNALDFLDQLCSFYEQNYILPSVVAADSTEAFIDKVCELAESNGLPSKAYRPALHEFSTGEVRKHLIKVGTFLYRVLGLESSVNAVITNGRVTYPIDEHTFLSDDLHLLESVELKHRTKHIQEIIEEVKWQDTDPDLITSKLISDVIMILSSSMASRSRSSESARFEILHDQHSAIILNNENSSIHIDAVLDPLSPTSQRLSGVLRVLWKYVQPSMRIVLNPLSSLADLPLKSYYRYVVPTMDDFSKADSAINGPKAFFANMPLSKTLTMNLDVPEPWLVEPVIAVHDLDNILLENLADTRTLQAVFELEALVLTGHCSEKDQDPPRGLQLILGTRSTPHLVDTLVMDNLGYWQMKVSPGVWHLQLAPGRSSELYIVKEDGNESHGKQSXKLITIDDLRGKVVQMEVMKKKGKEHEKLLVPDDEDDMQDKKKGSSWNSNLLKWASGFMASNEQAKNTDSSRPEKGKGGRRGKTINIFSIASGHLYERFLKIMILSVLKNTNRPVKFWFIKNYLSPPFKDLIPPMAREYGFDYELITYKWPTWLHKQKEKQRIIWAYKILFLDVIFPLSLEKVIFVDADQIVRTDMGELYDMDLKGRPLAYTPFCDNNREMDGYRFWRQGFWKDHLRGKPYHISALYVVDLKKFRETAAGDNLRVFYETLSKDPNSLANLDQDLPNYAQHTVPIFSLPQEWLWCESWCGNATKSKAKTIDLCNNPMTKEPKLQGARRIVAEWPDLDAEARRFTAKIVGEDQEPAQAPEQSKDSTSEDLSKDDSESKAEL

SEQ ID NO: 4598 - protein, 1503 aa, Ascochyta rabiei
MRASTPLLSAKTLLALSAFTQIGVIADSSINVALRASFDPAPYLVELLETAAEENATAYFPLLDRISEGYLDELDTERQLYEKFVELLKSDGHITDPETLASFNLALSVRSAAPRIEAHYQFYKTSVEPSLESEQGKNCQLWVSLGSQQYCTPHIDDGEPIGSIKNERTHELPFDRVLGNSSALPTIVYADISAPRFKKFHKTVSKTAKEGKTSYRVRHKPSLKGPQTPLVVNGYGVELQLKRTDYIVIDDRQAAQDEKPADQKPIGTELDEEAADLKPLAKDDVAGLAEKAASFVLQSDQPMDTLLKLVRDFPKYTTTVAAANATADFLTEHYSNRELLLPTGYNVIWINGVQIPARDVNPYALLVHLRREKRLINGIRSQGLSGPDTISLLSHSAIAQGQTGDEPQRYNFRDEAEGGKVIVWVNNIEKDSRYESWPTELRALLQRTYPGQLPNVRRDIHNAILPIDFTSPDHVSNVIETVIGLVRRGIPLRWGLVPQTPTPNAVEQAKVVYYLQHTYGLSSVTKYLLAAMEAKKLAKPDKASFETAIKTATVRKDRETLEFEDILASEALGERVDQAKYYLERLSANGPNAPAFVNGVPVAQGDNWLSELSQRISMDLRQIQKAVYEGNLKEDSWVPQQFLVQAATKRNPFIIPENEKEIKLVNMAEFEEKYGEIFAKYPCVEAAPSASKSEWAHLTVFGDFDTKSGLTLLKSVAQYRQTNPNLEIVMVQNSDADQSGVSEELLDTYVRAGRQLDSDGLLAVLAQEVATSPMPARSTRMRKAAQPLFEELELKAGELAVLLNGRFVGPIPKDKVFSSEDIGTLVSYEMNKRIEPLSNALEDLQLTAKIATPFDAAKIQSLVALSTVSDVPEGIFETVSTLRTSGYKNWTAEHTAIVKGNRETAIFQIVASIDPATEQAQKWIPILNTLSEMDGTHLQLFLNPKQMLQELPVKRFYRYLLGSKPRFNADGSVESFKAHFTGIPKKALLNLGMDVPPSWLVAPEESIHDLDNIKLSTLPADANIDAVYGLESILIEGHSRDTTNGGQPPRGAEVVLSTERDPHFADTIIMANLGYFQFKANPGFYSIQLKKGKSQDIFSLDSAGAKGWAAQPNDESSELVLMSFQGTTLFPRLSRKPGQEEADILAEEESLASELASKGTEKVNKFLSKIGLNLNTEKVFKKGAELLAGAKPVKTQADINIFSVASGHLYERMLNIMMLSVMKHTNHTVKFWFIEQFLSPSFKSFLPAMAAEYGFQYEMVTYKWPHWLRQQSEKQREIWGYKILFLDVLFPLDLDKVIFVDADQIVRTDMYELVTHDLQGAPYGFTPMGDSRTEMEGFRFWKTGYWANFLRGKPYHISALYVVDLNRFRKLAAGDRLRQQYHSLSADPNSLSNLDQDLPNNMQFNLPIHSLPQEWLWCETWCADADLATAKTIDLCNNPQTKEPKLDRARRQVPEWTVYDDEIAALAKRIRGEKEQQAVVDVQAEEQVREKREKDEERKRDEL

SEQ ID NO: 4599 - protein, 763 aa, Verticillium longisporum
  MOD_RES (16)..(16): Any amino acid
MAYGAMSAGRNRRSSXIVHNSASTTTGPLINAALRKGERALTEVETPEQLKAILDAAETGSDGDYTIALASFLSAATIAPGANALILNGRVIGPITADLPFDEDDFQLFLEFEQTARILPVYAALEDLSLGDRLSGPLAAAKLTSITALSTISDVPEGIFESASTVRVNAFEAWDSKYTAIEVGNAETASIHLIGLLNPVSEQGQRWAPILKVLSELDGVYVKLFLNPKEEISELPVKRFFRYVLDSAPSFDESGMVRAPGATFKGLPSEALLTTGMDIPPSWLVAPKVCVHDPDNIKLSSTKGDVNVIYQLENILIEGHSREGKAGQSPRGAQVVLGTEKEPLLADTIIMANLGYFQFKANPGFYNINLKDGKTTEIYTVESIGAQGWAPVPGDEGTEVALMDFQGTTLYPRLKRKPGQEKADVLQEDEGEEDGGIISQGLKFAESLLGGSTKSLSAQEHADINIFSVASGHLYERMLNIMMVSVMKNTKHTVKFWFIEQFLSPSFKDFIPHLAEEYGFKYEMVTFKWPHWLRQQKEKQREIWGYKILFLDVLFPLSLDKVIFVDADQIVRTDMMDLVNHPLEGKPYGFTPMCDSRTEMEGFRFWKQGYWANYLRGQPYHISALYVVDLRRFRDLAAGDRLRQQYHALSADPNSLANLDQDLPNHMQFNIPIHSLPQEWLWCETWCSDESQAEARTIDLCNNPQTKEPKLDRARRQVPEWTVYDDEIAALDRRRRGVPEEVIEKNPKSRTWEEPKSIGKDEL

SEQ ID NO: 4600 - protein, 1487 aa, Aspergillus sclerotialis
MPGIVTSWRFYALVVTTVLARLVYASPSVNVALQASFDSAPYLLELLETAAEENATSYFPLLDRVADGTFDNIPTDKELYDRFLKVVYDDGHLKTPEGLSSFKLSLAIRSAAPRIEAHYQFYNTSVQNSLAAAQDAVCPVWVHSDGKQYCSAEMERAQQDVAGDLDPRELPFDRVLGDTSSTPAVLYADISSPMFKEFHQALSTLAKEGEVSYRVRYRPPQHWSSRPLFVSGYGVELALKRTDYIVIDDRDAENRDQKDPEVDSPSDPEQWKEDSPDDLRPLSSSEVARLGLNTVSYVADSDDTLDTLIKLSQDFPKYSSRIAAHNASSSLLKEIRTNRGRMLPPGVNVMWINGVQVDPREMDAFSLLDQLRRERRLIEKFRDIGLSAQETVNLLSHEFLGEALSSDEPARFNYQDELEGGRVIIWLNNLEKDAKYRSWPSELMAYLQPTFPGQLSPVRRDLHNIVFPVDLASTEDMELVVETIQVFVKRKIPVRFGLVPTASSPGSIGHLKIAHHIQETYGLASLIRYLEQSTSKKKVTSPDKSCFEAATKDQDVRPEKERLSFEEVLKSEDLETLVKRTVNYQNRLGVEPGKPLVFVNGIPIARNDKWVQGMSLQINKDLQSVQRSIMDGIFEEDTWLAGFFLSKAFDRRNSLLIPEDPKDVRIVDIAKVYEARKDVLSSIPHLESGGNVLDSVHMVVVGDFGSEHGKGLLSTALNFHKEHNEADIIFLHNPEKNEGSTSGPTHLYRFLQGDSKMDITKVVTEMAVSNDDNSAVSDAEAKEISQFWAAQKPLVENLGFSPGASGVMVNGRAVGPIPVDTPLTVDDLVQLLAYERTKRISHISKAIVALELDSKLSTPIDLAKLTSLTAISTTSDVPEGVFESTPDIRVNLYDTWNTSRSVITVANSEDPTINVVASIDPTSETAQRWLPILRVLSNLAGVRLKIFMNPREEIQELPIKRFYRYVLDPEPVFSSDGSLSRPKAFFSGVPVEALLTLGMDVPTSWLVAPKDSAYDLDNIKLSSLKGGSDVDAIYALEHILIEGHSRDLSTNSPPRGVQLVLGTDENPHLIDTIIMANLGYFQFKTQPGLWKINLKPGRSERIFNIDSVGSLGYHPQPGDDNNDVALLSFQGKTIFPRLSRKKGYEEEDVLETGPKPGSAMDYVSKGLNFASSILSSASPRGSTAEKHADINIFSVASGHLYERMLNIMMVSVMRNTKHSVKFWFIEQFLSPSFKSFLPHLAKEYGFSYEMVTYKWPHWLRAQREKQREIWGYKMLFLDVLFPLSLDKVIFVDADQIVRTDMYDLVTTDLDGAPYGFTPMGDSREEMEGFRFWKQGYWKNFLRDKPYHISALYVVDLNRFRALAAGDRLRGQYQMLSSDPGSLSNLDQDLPNHMQHTIPIKSLDQDWLWCETWCSDESLATARTIDLCNNPLTKEPKLDRARRQVPEWTEYDREIAALAARVAHEQQEVPLSEVDEEEGSFKWRKDEL

SEQ ID NO: 4601 - protein, 1595 aa, Punctularia strigosozonata
MRTRNRRWKTAICALSILNGRVLASPSVRVALRTSWPATPLLAEILESIDSESPDSFFGVLDAITDPEHRIIFQDMTPEATYQATLQTALDAGYLSESGLASAVRLNLALHASGPKIQAYYQHYEHGPSQLGSVCDGQSWVDWYGVPVCDLETLVRLVGHETVEPAQSNNTSLVPPSRPKTLAFDHIYPSVSPAAERPPHTAILYGSPASDNFRELHSYLLSLASGRDHRIEYVFRHMPVHARSGRTLHKTYLSGYGVTLDLKKMDYLAIDDRRTRGQESGSVDDDSGIKEAEGTLLTKDPILQLLEAYPLNSTADNNSPLTEDELLQIGFQTAQLIADSEEPLATLKQISQNFPRYATSISRRVNVNESVAMEIQANMARAQPGMSMIWINGKTVPETDINPFSLLRLLRKERGFVHSLTSLGLTAEQSIDLMTHSAVGSLQGEKDVLDGIFDASDRLEGGNTIVWWNDLEKDSRYASWPSSLNTLLRPLYPGQFHNVKLNLYNVVLVLDLSKTSSHGFIGNAVWNIINRNFPLRFGVVPMVETEDGEKMAKIFYYLIQTVGRAKTIEFIRMNAQTRMPSDMVTPTVNWNIVRQEFQALINGVELAEGQEPLLTFEEVVNSPSLDKVRAYTQRLQADASSSPTGHAFVNGKHFDIDDEFLRNMQNEISQQMLHLQQRIYTTELSDENAGDMSTYFYDLPTTAQTRNRYIHQTGFEAIRVFNLHELFRDVELGAAYVYPNSAAESQTPLTEVIIADFDSEEGLTLAREALISMDGTARIGFLHNPSAASGLSEDTVHASAFRKLLLKHHTSIPKSDLLRSLGFDVEDAQQVPTPPQNVLGELAGDERSDSEDDQHTTSAEASKTILSRLGLSAGAQAVLINGRLIGPFKAGEFHAADFRTLASYELRKRVGPVLAALADVTPSFLQKDRVSSADILNIASSILSTIAMPEPTESGLYNVPAQPRRRNYNLLDNTYTSFESGDISTALYQIAILVDPLSEAAQKWSSIAEWLSSIPDVFIKIIIHPPGFREVPLKRFYRFQVLPSLVFDVNGDEVPAMVTFDDLPTQPIYTLGMDVPKAWLARPREAFHDLDNIQLNGLSSEEVVEATYELDYLVIEGHARDTLTNSPPRGLQLQLKTDNSSSVGDTQIMANLGYLQFRATPGIYHLEIRPGRGKELFEMESVGNEGWDSPTVQQIGDEITLTDFEGLTVYPRLARIPGKGHYDVLADLTFEDDEPDGLLDSIASRIKSWFRPEPAPSTDLVAVSQQAEINVFTVASGLLYERFLSIMVLSVLRNTNSTVKFWFIENFLSPSFLEFIPHFAAAYNFQYELVTYKWPSWLRAQKEKQRIIWAYKILFLDVLFPMDLKKVIFVDADQIVRADLKELVDLDLHGAPYGYTPMGDDNTDMEGFRFWKTGYWKDFLKGLPYHISALYVVDLDKFRKMAAGDILRGHYQQLSADPNSLANLDQDLPNNLQREVPIFSLHEDWLWCETWCSKDRLHRAKTIDLCQNPLTKEPKLERARKIPEWEEYDAEVARLTRHLTEAGLLRSSSIASDVNALAGEVPPPPSAPSNAEVAGMQGEGDTAADVEGVVTHEEL

SEQ ID NO: 4602 - protein, 1428 aa, Actinidia chinensis
MEAQFRSGFWVLIVFVIFFSLSGDLASVESRRPKNVQVSLQAKWSGTPILLEAGELLSKEWKGLFWEFIEVWHHSEVDDDSHTAKDCVKKIVKNGQSLLREPLASLFEFSLTLRSASPKLVLYRQLAVESLSSFPLSDDINSHSINGGVSEASENMESKKAESLLVGMNPRGIEGKCCWVDTGGALFFDVAELLMWLDNPKEQSGDAFQQPELYEFDHVHVDSSIGSPVSILYGALGTDCFREFHAKLVAAAKEGKVKYVVRPVLPSGCQSITGHCAAVGTSDPVNLGGYGVELALKNMEYKAMDDSAIKKGVTLEDPHTEDLSQEVRGFIFSKILERKPEVTSEVMAFRDYLLSSTISDTLDVWELKDLGHQTAQRIIHASDPLQSMQEINQNFPTVVSSLSRMKLNDSIKEEIIANQRMIPPGKSLMALNGALINIEDVDLYLLADMVHQELSLADQYLRLKIPPSIVRKLLSTLPPPESNAIRVDFRSAHVHYLNNLEVDAMYKQWRSSLNEILMPVFPGQLRYIRKNLFHAVFVLDPGSTFGLESIDMIISLYENNLPMRFGVILFSTKFIKTIEMNGGSATVENDSHIGEDLSSLIIHLFIYIEEHHGTQMAFQFLSNINRLRIESADPTEDAPEIHHVEGAFVETLLPKATSPPQDTLLKLEKEKTFNDLSQESSMFVFKLGLTKVQYCLLMNGLVTDANEDALMNAMNDELPRIQEQVYYGQINSHTDVLDKFLSESGVPRYNPQIIADGKVKPKYVSLSRAILGKDSVLNDVSYLHSPGTVDDLKPVTHLLAIDITSKRGIKLLREGIQYLIEGSKNARLGMLFNVNPSVGIPSLLFVKVSEVTASLYSHKEKVLDFLNQLCTFYEHEYVLASSVVAEINQAFIDKVCDLADANGLPSKSLRIALSEFLVDELRNHLNKVGQLLYSQLGFESGTNAVITNGRVVHVDDNTFLSHDLHLLESVELKSRIKHIVEVIEEVTWEDVDPDILTSKYISDIIMLVSSSIAMRERSSESARFEILNAKYSAVVLNNENSSIHIDAVIDPLSPSGQKLSSLLRVLWKSIQPSMRLVLNPLGNQNGWNSNFLKWASGFIGGSEQSKKIESTSVERGNGVRHGKIINIFSIASGHLYERFLKIMILSVLKNTNRPVKFWFIKNYLSPQFKDVIPHMAQEYGFEYELITYKWPTWLNKQKEKQRIIWAYKILFLDVIFPLSLEKVIFVDADQVVRADMGELYDMDIKGRPLAYTPFCDNNKDMDGYRFWRQGFWSEHLRGRPYHISALYVVDLVKFRETAAGDNLRVFYENLSKDPNSLSNLDQDLPNYAQHTVPIFSLPQEWLWCESWCGNATKSKAKTIDLCNNPMTKEPKLQGARRIVSEWADLDFEARRFTAKILGEDVDPLEQVASPSQTQNSDSTVASEDKAEL

SEQ ID NO: 4603 - protein, 1497 aa, Chaetothyriales sp.
MPASMLTSSLAGLGLLAYTLLLSGSVQAASSVNVALKASFNSAPLLVELLETAAAENESSYFPLLDRIADGAFAESSTDKELYDQFVHVLRDEGHLQSPEALASFNLAFSLHASAPRVQAHFQYYNRTISPHLPAAQDAACPVWVQLDGHQYCSPTLERAQQSLSLDEAEEVLPFDRVLGPEPGEAPSTILYADVANPLFPDFHKAASAAARAGESSYRLRYRRSAGEHTPLYLSGYGAELSLKRTDYIVIDDRDAAQADGANQAALKEPSDAEELEIKPLTSSEVLNLGFNTASYIASNQDPLQALVQVTANFPKFSSFLAGQNASTAFVDEHKANRKLLLPAGYNVLWVNGLQIEPRQVNAYSLLAHLRRERKLIEEMKAIGLAATEAVSLLSSDVIAQAQADEVVQRYDWRDEAEGGNVIIWLNDLEKDKRYSHWPKYLVGLFQRGRPGQLPTLARDIHNLIIPFDVTNPKDLELVVKHLQNLVNGKVPIRIGLIPTGSSPTAETYARLSYYLLDRYGVGTLTAFYQELAKTKKIASNAAKQLSAAIKDAELLEGKQALSYNEILQSEAIGEYASKAQEYLDRLELRADDPHFIVNGVVLPRGETWFELLSGRVFLDLQILQQAVQQDAIEENTWVPHFFLFQAVARRNAWIVPSDSKDIKIVDVPALTSAHPDAFAQLPKSDGEEATLLSDRAHLLLATDLDSPAGRELLASALELKAARGEVELLIAHNGAPGAAAGLSKHFPAFWAAYQQQAKDLTAAEDLRRLIQQYADAPEADDAASSAAATLWEHGKGLIRDLGLESGQTALWLNGRLIGPLPGPFTLPDLLLLLDYERSSRIAPVTTAITSLGLEERFANALDLAKITSTVARSHKSELPEGLRDAAPLIRTERYKSWNDSYTAIAKEPAADPLVQVVAVIDPVSEVGQSWVPILKTLSELDGVNTRIFLNPKPALKELPVKRFYRQVLSSAPTFSQNGSLEAPGAVFTSVPKDTLFNLGLVLPPSWLVSSEEANADPDNIKFNPAGNEADVDVVYRLDHILIEGHARDVTAGPPPRGVQLLLGTTEQAHVTDTIIMANLGYFQFKANPGFWKISLKPGRSSKIFNIDSVGPNGYSAQPGDETSSVAVLSFDGLTLFPRLSRRPGMEGEDVLAEGGGGKGQVAEIVNKGASFLSSLGLTKDISAGRTGKSRTNAEINIFSVASGHLYERMLSIMLVSVMQHTKHTVKFWFIEQFLSPSFKSTLPILAEHYQFEYEMVTYKWPHWLRGQREKQREIWGYKILFLDVLFPLDLDKVIFVDADQIVRTDMIELTRVDLQGAPYGFTPMCDSRTEMEGFRFWKQGYWKNYLRGKPYHISALYVVDLRSFRALAAGDRLRGQYQALSADPASLSNLDQDLPNHLQHNLPIFSLDQSWLWCETWCSDDALASARTIDLCNNPLTKEPKLDRARRQVPEWSVYDDEIAAVVRDARAQQQAQAGGGDGGDGDDNTQSTAWQKKEL

SEQ ID NO: 4604 - protein, 668 aa, Camelus ferus
MPQSYAALGRGRIGFVFIVNTDDEVDGTADAGVALWRAFQYIAEEYDTTQAFISIVNAGANFYKMTGLGPLPQSLYNGEPLQDEDFVKLEVAILQRMVDTTVELQKYVLTGMDKNAFEKKYNTIGLNIFQTHQLFCQDVLKLLPGEIGVVNNGRFLGPLDENFYAEDFYLLEKITLTSLGEEIEDFAQSTKSIDLKVMSDFVMKFDALVSSLPQSASRYDITFLKENHSVIKINSLEDDMVFDVIAIVDPLTREAQKMAQLLIIFTDLLPVQSFYRFVLEPELMLTANGIVGPAAKFLGIPEAPLLTLNMITPEGWLVEIVRSNCDLDNIHLKDVEGAVTAEYELEYLLLEGHCFDVTTEQAPRGLQFTLGTKNRPVMVDTIVMANLEVIPHMAKEYGFQYELVQYRWPRWLHQQTEKQRIIWGYKILFLDVLFPLAVDKIIFVDADQIVRHDLRELRDFDLGGAPYGYTPFCDSRKEMDGYRFWKRGYWASHLLRRKYHISALYVVDLKKFRRIAAGDRLRGQYQTLSKDPHSLSNLDQDLPNYMIYQVAIKSLPQDWLWCETWCDDESKQRAKTIDLCNNPKTKEPKLKAAARIVPEWVEYDAEIRQLLDHLDNKKTSATLLAAAQLQSPLLSDAAAPVPHKLRGQNPSEALLTEGTTSMHPPVLQ

SEQ ID NO: 4605 - protein, 1476 aa, Wallemia hederae
MRGVAISLAALLVTASASTHASAVNVQLQTEWAEPPYCQTALEAAYRLHPDAFESLLERISCSDTPEDIYSRIRAQLPQTKRSLFDMHMALRSTTPAIVASYSIAADEGFAYDPQCPNFINYQGRRVCDANELDTLDQLAWPGSDTTFDTPIDHVISQPTIFPTPRIIHYADPAASDFSVFYRFFKSRKNELEYVIRWAPTSAEASQPLKLAGWGVKMDLKKREYLSHDDRASSDLGAAENDIGDTKWEDEYGSLPEDLQEALGGSLVDVEGSANIKKLSTNLIAQVLDSQNQLQTLTTITQNLPLLAHKLSQSTFDQTEQISNEVHSNQEKYIQSGQNAVWLNGRRLYDSDFEPFTLLRQLEIDNGLVSSITKLGFSKADAIRLLNHRALYATQVARPDAVTEGLVDASDRSEDGGVIRWMNNLEKDKQYKNRIWSPYLRGLLSPLGKVARNYLNGILVVDLSNKQAIEMLSTNVRAFIDRGIPVRWGVVPYTNALNRDSLKAAKLFYSLVDRRGVEACLDFFAEVSVGSATFSERAETAYLNLSAVNGLTPQEDFDSIMDSSDGIALHKAQKFASRLGVSPGEHEADFAGEMFMNGRPVHFGDDMILSLQEHISAQTDALTKAVFSGEVDERDDVSLYFYDKPSTIKRRNKYLQSSQKDNQFIQIPSSLLDGPFITPETSNGLDVTFWLISDFNKPESLELIKHALSGMIISPTFRLGFVHNPSELETPTGSINQMLQLLPDKISPLEFLEALQDRGEIADDVDGMNAAESWIGGTGIEPGESGLIINGRVVGPIPPDGLTEEDYVQLFQYDHAQRVLPVVKAVEETAPHRLQADPDDVATLLAKLGSLLWTNVQNEQPQGIYEPPHTPRARVWNRLDTKHTSIHIGKESTAQYAFDVVLDPLSEQGQKLSKILSVLAETGDAHVRVAFNPDMSAETLPINRFYRYAIDSKPAFDRDGKPADQTARFVQMPSDALFTLELDPPQSWITRPIYAPVDLDNLNLAMTSPGDVNVAFQLDKIVVDGHARDSRTSLPPRGLQVSLKDSNIDTQIVANLGYLQMAVTPGAWSLEIREGYGRQVYALESIGSEGWNSPTVADGVTSFVVDSFEGIKLFPRFAKRQGMEAADVLAEPRETGLIPYVKKSVSSLAKLVGLAKEPEHADINIFTVASGLLYERFASIMILSVLKHTDHSVKFWFIENFLSPSFIELLPHMAKEYGFKYELVTYKWPSWLRPQKERQRMLWAYKILFLDVLFPMSLDKVIFVDADNIVRTDLKKLIDVDLHGRAYGYPPIGMDREEMDGYRFWTKGYWKDYLRGRNYHISALYVVDLKRFRQIAAGDRLRGQYQGLSADPGSLANLDQDLPNNFQTEVPIFTLDKSWLWCQTWNSDESLAHAKTIDLCNNPMTKEPKLERARKIPEWTDYDNDIQHFSDRIAKEHLVNSLIVTETEELAQGPKVAASDGDSADHAEDHHTKDEL

SEQ ID NO: 4606 - protein, 1405 aa, Chrysemys picta
MAAAAALLLLLCAWSLPCGAPASPKAVTTRLAAKWPATSLLLEASEFIAEEGNEKFWQFLETVQELTIYKKRDSEHSYYNLILKKAGQFLSNLQINLLKFALSIRAYSPTVQMFQQIAADEPPPEGCSAFVVIHEKRTCKTNEIKKLLKKAAERPRPYLFKKEHKFPTLNENVPVVILYAEIGTKDFVKFHTVLSEKVQKEEIVYILRHYVQKPSSRKMYLSGYGVELAIKSTEYKAVDDIQIKATNDTTEEEDDEEGEVQGFLFGKLKQMYPDLKDNLKEFRKHLIESTNNLEPLKIWELQDLSFQAASQIISTPVYSALKVMKDIAQNFPIKARSLTRIPVNQQMRNEIEKNQKHFHEILGIQPGEARLFLNGLPIDLDFHDAFSILETLKLEGKMLHGLHDLGIKEKAFSKFMRLQIHPVDDSCSLDIRHSSIIWVNNIEKDHIYKKWPTSFQELFKQTFSGVIQQIRRNLYNLVLFIDPVQEHAADFVKLAELFYHHNIPLRIGFVFILNTNEEIDGNEDAGVALLRAFNYIAEESDTSQAFISMINMYHKMKDGDIFTVNHVRNVLRSEFPHADIQSILGVDSEYDEKRKAGATFYKKTGLGPLPQALFNGVPFNGEEMAAAELDTVILQRITDAMGFFQRAVFMGLLNDHMDAVDFLMDQRNVVSRINPTILDTKRRYINFISMSVPVGVEDFSTFSFLDSQDKSAVISQNMKYLTKRDEDVIYAVTIWIIADFDKPAGRHLLSKALKHLKTSSHTRLGIVNNPMSKITEDNTAVARAILTAFLTQKNSSLKSFLSKIAKEETAKALATGTKIKKLLVPGMDDSTFEKKYNTLGVDIIQTHQMFCQEVLKLLPGQMAVVSNGRVLGDIVNMKLRLFMNSRSKLSEVPLKSFYRFVLEPELTSGANNLFPSGPVAKFLEMPETLLLTLNMIIPESWLVEAVNSSYDLDNIYLQDIEGIVTAEYELEYLLLEGHCFDVTTGQPPRGLQFTLGMKNNPVMFDTTVMANLGYFQLKANPGAWTLRLRKGRSEDIYHIFGHEGADSPVHLEDVIVVLNNFKSKILKVKVQKKPDKIGEDLLTVEVTEEKGSWESITSFSDLQTEEKEKKNDVLNIFSVASGHLYERFLRIMMLSVLRHTKTPVKFWFLKNYLSPTFKEIIPHMAKEYGFQYELVQYKWPRWLHQQTEKQRIIWGYKILFLDVLFPLAVYKIIFVDADQIVRSDLKELRDIDLNGAPYGYVPFCDSRTEMDGYRFWKSGYWASHLGRRKYHISALYVVDLKKFRKIAAGDRLRGQYQALSQDPNSLSNLDQDLPNNMIHQLAIKSLPQEWLWCETWCNDESKKKAKTIDLCNNPKTKEPKLKAALRIVPEWVQYDSEIRKLIKQIEKGKKNLTQSSRKVFKHDEL

SEQ ID NO: 4607 - protein, 1506 aa, Hesseltinella vesiculosa
MTRCISIGLAIGLLCSWTVASQEPSPPVELTMTAPWAAPDALVEIAETLAKVAPQSYWDYVQDLTSIDQDALTPQQQYNRAMTLARHHVADPQLLSLIQLHLGLHAAAPLIEAHHQVYQHSVQPTISSFDASCPVWVQVGNTQACTVDTLLLQELDSRHVNPVQLPSDHVYGRLNRTDTQLPLLHLYTSSFSTPEFAAWYQYLRTRVDLNHDLSFTLRYKPASSAPSPLYLTGYGVELALKNTDYLVIDDRQSQTTPAVLDKDTSKDSFIKNIGKKVNQILFTDETPTIKPMTQDEIKHLSLKATQFILEAKNPLAALAQLAQDFPKYAHKISTVALQDEVIQELTKNQRQHVRAGMSQMWLNGLPVENSEANPFYFARALIREHRIIEDLVSEGLTHQQALDLVSVDVLPDETNDGATQAFDTRDDPSSPSVIWLNDIERDNLYSSWDEDLGQFLRPGYPGQLKAVRKNIFNVLFVENLASTPSLHRIVEEIGSVIQQGTPLRFGLVPVVDDHNGVASLMAKTALDLHENKGLAPTVAFLEKVLALVSANKAEAPTKEIIAEAYSSVTNSDAWTAIETQPIPSGLTHYLQRLGLDEPSEGDVLFLNGQLLEYSNEQPWSRILMNALHMQTQLLTRDIYYGNIKNEDNVYDYFLDQDNVASSRNPYIGITEQRPLTMISNNVHQDIHYVSSDGPNYANLWIVGDMDTPQGLKLALNALEFMNQDTSEHARLSLLHMPSKKDVAHDTVLFSDVLFTHMFFNKPTVDSLKQLVEAQYQHWQNNGQGLAPGSPTVDSDKQDEAIDYWHTVRTHLTLANARPVLTSPDQAAIILNGRVVGPFSASKGFTASDFNTLWQREWHDRISPMHKRLTDLSFSHCSQTAMADVMTRLMVVLQSVKANTVRNVLLTNNKQGSRDRYYHHLAGDKSRLRIGSTDKVYAEVGVLLDPLSEQAQAWSGLLLALSELEGVVLDIRFNAVQSLEKLPLTRFYRSVVDADWHFDAQGQLNVPTAYFDALPLEPLYTLGVHTIEPWQVTVKAANGVDLDNIRLTSLPAKETSVKAGYELEQILIEGHSLDSSNQQPPRGVQFHLAPVHAPAVTGTIVMANLGYLQLKAGPGLWQLSLRPGRSSDVYHLESIGTHGQWNASEAADKPLFLDSFEGLQVFPMVKKNPGMETVDVLEATDSAPQDTGILSSLSQRFFGKKDTTEQDLAATHGPKHAEINIFSVASGHLYERFLAIMTASVMKHTESTVKFWFIENFLSPAFKDFLPELAEAYGFDYELVTYKWPSWLNAQKEKQRTIWGYKILFLDVLFPLDLEKVIFVDADQIVRTDMKELVDLDLKGAPYGYTPFCSDRKEMDGFRFWTQGYWQDHLSGRPYHISALYVVDLVRFRQLAAGDRLRAQYQQLSADPNSLANLDQDLPNNMIHAVPIFSLPQEWLWCETWCSDESLAKAKTIDLCNNPLTKEPKLDRARRQVPEWETYDTEIESIRTRFLQKHVETEASTSFHDEL

SEQ ID NO: 4608 - protein, 1553 aa, Trametes versicolor
MLRLLPLLTWPLLRTLAGSPPVNIELRTSWPAAPILLESIEAVSIEDPDAFFPLLHAVTDASVFPLPSDKSSPAHAHQHVLETALALDFLAEPGAYVSAEMHVALHSASPKLEAFYQYYTDHHATRTEGRTSCGSWVDWYGEVVCDVETLANLVQTASIDAPGAAESHTAPASPRLLAFDHVLPDPARVPSSPPHTAVLYASLESPNFHALHSYLYAAASAPTPRVAYVFRPVPPADRDLAVRSHLSGYGVALDLKKMDYLAVDDRLQGGSGSSSDEGSTTKVQEDEADIIVTRLQQYPADESVDVTAPLTDTELLDIGLQATQLVYDAEEPHARLATLKQLAQNFPRFAGALARRVTVNESLLNEVAENQAKAPGGANAIWLNGAAIEEKDMNPFGLLKAIRKERGTILSLMALGLNSTQAVDLLTHRTIAQAQASGGVLDGLFDASDRAEGGEVIGWLNDIENDERYASWGGNLKILLRQLYPGQFPTVKYNLFNIVLAADLSQASSVDFIGGTVNSLIRRGLPFRWGVAPLVETEDGARMARLFYYLLEVVGADDTLGFLLSISQRGVPMDQVSPSVVWSQVRTNFEDLLAAKENLPEGIETDFDTIIAGGEGDLDAARTYATRLSATLSTAPQGHVFFNGKHFDLDDTFLQALQMEFSPQLQHLQYKIYKNELTEEQAKDMSTYFYDLPTTAKRRNTYIHPTQKAGSLRIYSLPELIERNGLNSTAGVFVYPTDSELVPLTTYVVADFDSEKGREFVKEAIKSVTPGSLSRLSFIHSPSSQTPILSGPSSILARLITADALFKISPERLLSILGLNEATEDAAQQPLIDSADSVLADLPESVDAYEKYVDACRLVVRSLGLKSGELAVIVNGRVVGPIAPGEFIAGDFESLAAYEHHKRVQPVYEALLAVHEPISEATKEDAAEIISIVSSVLSSIQQPDPSEAGLFDAPQKPRLRNYRRLTGEYTAFTIGDEETALFQIGAIINPLGQEAQKWTSLLEWLSGMPGVYIEVHVNPMRHTEIPLKRFYRYNLLPRLAFDEEGNEIHAKTQFTNLPTEPIYTLAMDAPQSWLIRPKEAVYDLDNIQLGLLSPQDRASGLNAVFDLDALVVEGHAREGDTSAPPRGLQMQLVTSDATPIADTLVMANLGYLQFRTKPGVYRLEIRPGRGREIFEMESVGNEGWNSPGIDEAGDVVTVTSFEGVTLYPRLARLPGMEREDVLRTHAVDAGDEHAGVIDHLVNKVSSLFGGKKEEKALVAVDDGQADINIFTVASGHLYERFASIMILSVLRHTKSSVKFWFIDNFLSPSFLEFLPKYAAEYGFQYELVTYKWPTWLRAQTEKQRIIWAYKILFLDVLFPMDLKKVLFVDADQIVRADLQELVDIDLRGRPYGYVPMGNDNPDTEGFRFWKTGYWKDFLRGMPYHISALYVVDLVRFRQLAAGDMLRGHYQALSADPNSLANLDQDLPNNLQREVPIYSLPEDWLWCETWCSKDRLDRAKTIDLCQNPLTKEPKLDRAKQIPEWEVYDAEISAFAKRLTASESDAERPKPHDEL

SEQ ID NO: 4609 - protein, 1317 aa, Fundulus heteroclitus
  MOD_RES (651)..(651): Any amino acid
MTMEKVLLLSLLLLMLHRVPAAPKGVTASLKAKWSMTPYLLETSEFIGEDGNEKFWHFVDTVKELTVYKQGETVRSYYNLIIKVPAQFLTHLQVNLLKFALAMRSYSPAVHASQQIASDEPPPEGCPAFVSVHGQRSCSTKDIKKLMKAAAGRLTPYLYKNDHTYPGLNKTDVPVVILYAEIGTKKFNSFHKVLSEKAEEGTLVYVLRHFVAVNLSFQAAARIMSVPKFDALKVMRDLSQNFPSRARSLTRVAVKQEMRKEIEKNQKHLGETMGIQPGDGELFINGLHIDLDVHNPFSILDILRGEAKVLEGLHNLGIKGEQKAKLLRLPVNTVDDSYALDIRHPAIMWMNDIENDQMYRSWPASVQELLRATFPGVIRQIRRNFFNLVLFLDPLQEETVELVKLAELFYKHKIPLRIGFVFVVNTKDEIDGFSDAGVGFYRLLNYIADEYDLSQSVMSIVSLYNKVDVWEGLSADTISAYLKRQYPKADQERILGADSEYDYKRKDGALFYRKSGLGALPVALFNGVPLNPDEMDPEELETIILQRIMDTTAGFQRAVFMGQLTEGSNVVDYIMEQANVVPRMNPLILSTDRKYLDLTGTPVVNEWEDTTMFSYLESKDKTAVVAKRIKYFTNSDEDGLTAVTISVILLXGMDLDAFEKKFNTLEVDFIRSQQMFCQDVLKLRPGQRAVISNGRILGPLEEQEEFTVEDFHLLEKITLSGSAEKVKAKVKQMGMKPKQASDLVMKVDALLSAAPKGEVRRDVSLKDTQSVLQLSPRENEVFYDVVAIVDPLTREAQKISSLLIVLSQVVNVKLQVFMNCRAKLSELPLKSFYRFVLEPDVAFLANDTASPGPVARFTELPESLLLTLNMITPESWMVQADHSLHDLDNIHLQEVNRVVAAEFELEHLLLEGHCFDLSTGQPPRGLQFTLGMSQEPLMYDTIVMANLGYFQLKANPGAWILRLRKGRSEDIYQIVTHDGTDSPPDAEDVIVVLNSFHSKIIKVRVQKKAEKINEDLLSETSESKGIWDSIVSVWSTFEKSITGGGSKKDEGEKKKEDILNIFSVASGHLYERFLRIMMLSVLRHTHTPVKFWFLKNYLSPSFKETIAHMAKSYGFQYELVQYKWPRWLHQQTEKQRIIWGYKILFLDVLFPLAVDKIIFVDADQCDSIMPCTTQRGELVSFGVSSSALYVVDLKKFRKIAAGDRLRGQYQALSQDPNSLSNLDQDLPNNMIHQVAIKSLPQEWLWCETWCDDASKVTAKTIDLCNNPKTKEPKLMAAARIVPEWVEYDEEIKKLLRQVQEQTPTPSLHKKENRRDEL

SEQ ID NO: 4610 - protein, 2361 aa, Pteropus alecto
MAKKATILVQLLLGSTILWLSLLGSGTASESKSVTARLAAKWPETPLLLEASEFMAEESNEKFWQFLDTVKELAIYKQTESDYSHYNLILKKAGQFLDNLHINLLKFAFSLRAYSPTIQMFQQIAADEPPPDGCDAFVVIHKKHTCKINEIKKLLKKATSRPRPYLFKGDHKFPTNKENLPVIILYAEMGTRAFGKFHRVLSEKAQNGEILYVLRHYIQKPASQKTYLSGYGVELVIKSTEYKALDDTQVKTVSNTTVEGEIETNEVQGFLFGKLKERYSDLRDNLTAFQKYLIESNKEMMPLKVWELQDLSFQAASQIMSTPVYDAIKLMKDISQNFPIKARSLTRIPVNQHLRKEIQENQKDLNNRFEIQPGDAFLYINGLRIDIDAYDPFSILDMLKLEGKMMNGLHNLGINGEYMSKFLKLNSHVWDNTYVLDIRHSSVMWINDLENDELYVMWPTSCQELLKPILPGSIPSIRRNFHNLVLFIDPAQEYTMDFIKLAERLYYHKIPLRIGFVFIINTDDEVSGMNDAGVALWRAFNYIAEEHDVSQAFVSITHMYQKVKKQNTLTVDNVKSVLQNKFPSANVQDILGIHSRYDDERKAGANFYKMIGLGPLPQALYNGESFNREELNIKELEMAVIQKMIDTTIYLQREVFMGTLNDRTNAVDFLMDKNNVIPRINPLILHSKRQYLNLISTSVTADIEDFSTFFFLDSQDKSAVIAKNMYYLTQEDDNAISSITLWIIADFDKPSGRKLLWNALMHMKTSFHSRLGVIYNPTSKINEENTAISRGILAAFLTQKNTFLRNFLRKLAKEETATAVYSGDKIITFLSEGMDKNAFEKKYNTIGVNIFRTHQLFCQDVLKLRPGERSIVSNGKFLGPLDENFYAEDFYLLEKITFTNLVEKIKGIVENMAISSKNMSDLIMKIDALVSSLPKRASRYDVTFLKENHSIITINPQENDVFFDVIGIVDPLTREAQKMAQLLNVLGKIINMKIKLFLNCRGKLSEAPLKSFYRFVLEPELKFLGNDIIGPEAKFLDIPESPLLTLNMITPEGWLVETVHSNCDLDNIHLKDIERTVIADYELEYLLLEGHCFDIMTEQPPRGLQFTLGTKNQPVAVDTIVMANLGYFQLKANPGAWILKLRQGKSEDIYQIVGHEGTDSQPDLGDAVVVLNSFRSKIIEVQVQKKPDKIKEDILNDKGGKKGMWDSIKSFTRSLHKEKDEIETDVLNIFSVASGHLYERFLRIMMLSVLRNTKTPVKFWFLKNYLSPTFKEVIPHMAKEYGFQYELVQYRWPRWLHQQTEKQRIIWGYKILFLDVLFPLAVDKIIFVDADQIVRHDLKELRDFNLDGAPYGYTPFCDSRTEMDGYRFWKTGYWASHLLRRKYHISALYVVDLKKFRRIAAGDRLRGQYQALSQDPNSLSNLDQDLPNNMIYQVAIKSLPQDWLWCETWCDDESKQRAKTIDLCNNPKTKEPKLEAAARIVPEWVEYDNEIRRLLDHLENKKKNAAHPANIPKISKRSTNSKQADRYHLTPVRMATINKSTNNKCSRGCGEKGTLVQCWWAGTLVQPPFQKQVYYSLGSGLEGPDGPAAAAAGAAAMACVPPSAASGHLPFFQFRPRLESVDWRRLSAIDVDKVAGAVDVLTLQENIVNITFCKLEDEKCPHCQSGVDPVLLKLIRLAQLTIEYLLHSQEFLTSQLHNLEERLRLSLADCEQSKNLLTKQAGEIKLLKEECKRRKKMISTQQMMIEAKASYYQCHFCDKAFMNQAFLQSHIQRRHPEDSHFEYKKKAQTDKLQNEIDMLKEQLQLTKSQLEAAQHAHAVRFSKEYEMQKTKEEEFLKLFDRWKEEEKEKLVDEMEKVKEMFMKEFKELTSKNTALEYQLLEIQKSNMQIKSNIGTLKDEHEFKEERPQYPQDFQNVMQLLDSQLLSHIEKLRTSMIDDLNASNVFYKKRIEELGQRLQEQNELIITQRQQIKEFTSKPFNSVIEPKVNVPAPQTLDAKSSLTMAHEQAFSSHILEPIEELSEEEKGRENEQKLNNNKNHLRKALKNNPSLTKEIRTVLEQSLVEKLETLGINADIRGIPSDHLNRVLKTVESARHDRERQIPNIQQIREYLEHEVSCKIEERTLLSSDKYSAAQMDTLSTGEIPKAIQLPPKSRQLIRQRPVFTDRTSVPKTSPFSSEEELDGDDLIQAYTSPDLPPVQSSKSKSSFGKNNVKSDTDWTEGSEIEDSDISPKPTGTSIKTLTEKVEKTVSNHRNVNKPVGGINVAEAFTRRELKEELKYADVDDDDWDISSLEEEKSLGKKTGKEQKEPPPVKNESNATQVPSAWGAPNLKGPKGEGLQDESSTLKSSLVTVTDWSDSSDV

SEQ ID NO: 4611 - protein, 1601 aa, Heterobasidion irregulare
MRASFALSTTFAAALSIVGTKAASPPVTVSLRSSWPSPPFLLEAIETIALEEPDAFFPLLDVLTNPETLSSREPLRPEALHQLALQAALSLNFLSKHGALTSVEMQFALHAATPKIEAFYQHYLDTAASFAESRNRDECESWVDWYGEVVCDMERLVHLAGPETIDPINATSQSSDSFVRPRTLPFDHIYPLPAEILDRPSRTAIFYASIDSSNFRELHLCLLRLSSGPAPRLEYIFRPIPPAAGTKEKTYISGYGVTLDLKKMDYLALDDRHSNSRDTHDDETIEKVESPAVNIDPIVSLLSHHPLNTTLDASEPLTEEELMEIGIQATQLIHESSTPFETLKQLAQDFPRYASSLARRVVVNSDLRDEVSRNSMKAQPGVSAVWFNGATVSENSMNPFGLLKLIRKERDIMSSLSSLGIEPSQALDLITHPAIQAAHGSSGSLLDGVFDASDRLEDGGLIVWWNDIEKDSRYARWPTGIHALMRPTYPGQIPVTRLNLFNVVLVMDLSQSSSLYYIAGTVANIINRAFPVRFGIVPSIESEGGARMAKIFNYLVDNYGRARTMIFIKKVIVLQLPAIPQMTSETVDWDRVRFELADLIKVEEPKEGGVALDFDTVVNDTPQELQAKVDKARAYAKRLGATMASSAQGHAFFNGKHYDLDDTFVQSLQMQFPKYLQYLQERLYEGALDQVVDVSAYFYDLPGSHKSRNRHIFPSSNADSLEIHNMVELTESAGLNTQSTNFVYPPEVDLVPFTTYVVADLDTENGLSIVQAALSYVVSIDGTSRARLSFIHNPKSSDVGEGQRRVSALLSHLVSKEKLWTVQPTRLLKALGLKDVITTNDHEQIVLSPDAVFQDLIGGIALSDLDASEYEDYVRSCRMMVRSLRLRRGETALVVNGRLVGPMGPGEFSTEDFKVLEDYEYVRRVEPVISALGDVLSAEIQYDRHTFAQTISMISPIISSIHIADPSEAGLLNQPVMTRNQNYKLMESQFSGFDFGNTSTALYQFAVVLDPLSEQAQRYTSLFEWLSSFPSVHVAFYINPAQYHELPLKRFYRYNLRQSLTFDESGQEIPSNVQFSGLPIDPIYTLGLDEPSSWLVRPREALYDLDNIQLGALSGDERQRGVEVIYELDYLIVGGHARDTFTNAPPRGVQLQLSTTNLECIPIDDTLVVANLGYLQFKAKPGVYRLEIREGRGRDIFSIESVGNDGWDSPTVEEVGDEITLTSFEGLTLYPRLTRLPGMEQEEVLNVVEEEKEPTNIIDTVISHVHSFFHPKDLTDVKPASPHGDINIFTVASGLLYERFASIMILSVLRNTKHSVKFWFIENFLSPSFLEFIPHFAGEYGFKYELVTYKWPTWLRQQREKQRIIWAYKILFLDVLFPMDLDKVIFVDADQIVRTDLKELVDLDLHGAPYGYTPMGDDNHDMEGFRFWKTGYWENFLRGRPYHISALYVVDLVRFRQMAAGDILRSHYQQLSADPNSLANLDQDLPNNLQMQVPIYSLHEDWLWCETWCSKDRLHRAKTIDLCQNPLTKEPKLSRARQIPEWEEYDTEIAKFARLLAEDGRIHSSAATADVNALARAGSTPAVGDVGLEDETSRIPIRDEL

SEQ ID NO: 4612 - protein, 1413 aa, Wickerhamiella sorbophila
MQYSGFLTNRPMLLSVLLAGLAVAKPVTVQMDTNWHAVPYYAHVLETISVHNSSAYFPLLSVYLSAEESDGRFSSEEEASTFLLDTAVSRDFISASQLPIVKAQLANSHRAAYVEAMCQHFINDIVPTYGAEIAECDNVFVYNGKATCEATDVFALETTSSTAAPMDLIDTDHVIGGASADVPWAILYADFNSEEFPVFHANLLASALQQKVSYVLRYKPSKGYNPVSQIGGYAATVQLKRTDYIVVNDRNAEGEDSPELKIDYEANVVESNAIPQLDQRAAGYILDAEDQLEALVDTSLNFPGRIADIKEHPINEDLTQDIEANDAAGFFTPGTNVILANGRPVFTTERNVYKLLDVINEEQHYINGLEVLGFSTEQAKGLLASGIVVADGNTTVDATMRYNLMSDAILWLNDVENDVRFKKWKRSPRTLLMNTPMGQFPPIRRNINSIVLAVDFSNPSWLQMIGQLLQILARGAPVQVGVVPITTAPAAKQFVKLAGETGSLIARQIYIAGLLKGLTPNEAFSEALETPFPDSEASLIDPNDVWTSVAEWANKFEIYQPAVFSNGVLVPLSQSWLIDATNQFGIDLDLARSWVEDGELEEDDLTTSLRDKLFGLGISRRSEIVDPINPAAVVYVDPSGVLADAPGAAVQWAVGNTSQTIWLVAEFNTQEAYTQLAELLEVAGTTKRFSVGVLPITSTEVDDRYGRAYAALQKLGNLPALAAINSVEALRAWHHADGPAPKIVEEEGSGALVTFASQAAQTHLFKEVIPRRLNLVVDGRLVVLTKKIDGEIIEQLVERERPRALRLSKAAADLGIENASAFTARLTKAWYGSETSRLITEQWFGLERGIKKNVENAKVDIMAIVDPASEIGQELVALLKLVSDLNVACINVLLSPRLLKDADVPSRFYKPVFPLAPNFDSHGHLVTPAAEFEGLGDDTLYIAGVDTPSAWVSMAKECEYDLDNILLNSVSGDRLEAIYELKHLLLEGHASDITNRQSPRGVQLVIGNTATPHLSDTMVMANLGYFQLQTDPGFFTVSLADGPSSDIYQFNGEGMSSNSIALWITEMDGTTIMPHLVRRPGKETADVLEPPKKKKSWFGGKPKTEGADINIFTVASGHLYERFLSIMTLSVMRHTKHTVKFWLIENFLSPSFKKFLPTLAEEYGFEYEFVTYKWPNWLRGQSEKQREIWGYKILFLDVLFPQNLSKVIFVDSDQIVRTDMIELVNEDLEGAPYGYTPMGDDREEMEGFRFWKQGYWKDHLQGAPYHISALYVVDLDRFRELGAGDILRQHYQQLSADPRSLSNLDQDLPNNLQGLVKIHSLDKSWLWCETWCSDESLANAKTIDLCNNPLTKEPKLDRARRQIPEWIEYDDAVSALRKKAAQAAKSRVQAAKEAVEAAMGVAIGHENDDHDEL

SEQ ID NO: 4613 - protein, 1415 aa, Hondaea fermentalgiana
MSARAAAVTLRSLAFAAVTSLVLAAHGAQNALEVRLEVPWPTHKLWPLLETSEALGEDNVVFWGFVDQACKTTWEGTEVSTTLSQAVDLASRISQTASNDSTDSAATVDEFTRDLLRLSLELREFAPAIEQQRQLGLALRALTNAGADFPDDGRAWVALTVRGSGQGTIVTDFDKLPAAITSLMEDLANPAVQERCKANDNNEESRPGPLDIFNQDHVHPQSSTSSGAGTSAIAILHGILGRADFVAAHQKLSEAVEYHKDLVYVVRHMPGADAAQDPLAMNRTALQGFGVALDIKNMEYLTVDDDGGNKASEEKRDTSSEREADLSSPVAGIHFDKMIDRLPESKDALVDLHTELEGEALEAASKSGELAQIKVWDMVNLGLQATAKVLADADPLNRWEDLSQNFPSRARALINMRVPDGLLEEVERAARSLEVPDGTVLVNGVSVDAKSESFNIFSLMESIRAEIRARETANAIVSGGGALIEPLAVRMSNAGASDSSGKTNEADAMIRASGTRVDVRADAKGAVIFLNNIEKDKAWTLNGLFYEGSADFQSQLVQEAFREQRILMYQVHLRRITSSTNVLKYMLEHGQAIPRYNRAVFQETAESAFLTIPADLVGENTVIHYMLDSKTADVTVFLALDEASMITSQGRSLLRSLVAFTESKPSRTRIAVLPVGLSEGDAPSQLAALLHALRIDDLDAVDALLSDDTEAAEPARVTEAWMATLSAQVASWKGLQPLNVVFNGRVIAAASPSVTMTVEDFDLAVSHERKIRADFVRSALGSTRATPDAIMQLSPLVAGQASSPRRKLPMINMRKHFPGLCYSSTTGSTNNAQTLTVQAVIDPLSEAAPRVSAVVRLLRDKLGAHVDLVFTPKSSVSAFPLSSYFRFLASNNEPDPALGGIYPADEQPAVRFYGMPQEQLLTLKVYTPEPWIVYPTYTAGLDTDNIRLSRAESRRSTVTFALSKLLVTGHCVDEQVGSPPAGLQIELQPLYPRDAVASDTLVMQNLGYMQLQAGPGLWELGLAKGPSRDIFSLHQEHDTRQGSTWVALRSFTSAPLSLQAARRPGHETDSLLASMETLDGEMGPTGATRAAQALGLGQNPLSWLFDAARRLLGMETSPTPVAPIDGTAIGTKSGGTNETIHVFSLASGALYERFLRIMMVSVTKATQNPVKFWLIENFLSPDFKAGLGALQNEYGFEVALVTYKWPHWLRRQTEKQRIIWGYKILFLDVLFPLDVPKVIYVDADQVVRADLKELWDMDLEGKPYGYTPFCTSREETLGFQFWRSGYWKDHLRGNPYHISALYVVDLQRFRHMMVGDRLRAVYDQLSRDPNSLSNLDQDLPNYAQHMVPIFSLPQEWLWCESWCSDESKRTAKTIDLCNNPLHKEPKLDMAKRVISGELFPQSWVELDAEIKNVLV

SEQ ID NO: 4614 - protein, 1570 aa, Salmo salar
MAAASITGRMRNILLLLSLLLLNVQYVQSASKGVSASLKAKWSMTPFLLETSEFIAEDGNEKFWDFVDTVKELTVYKNGESVRSYYNLVIKKAGQFLTALQVNLLKFALSLRSYSPAVHASQQIGSDESPPEACLAFVSVHGQHGCSTKDLKKLLKAAAGRPKPYLYKNEHRYPGLNKTDVPVVILYAEIGTKKFGSFHKVLAEKAAEGKLIYVLRHFVAEPRPQKMLLSGYGVELAIKSTEYKAVDDTQVKDKGTVNTDEDDIDEVQGFLFGKLKNSHPDLQEQLEELRKHLLESTNDMAPLKVWELQDLSFQAAARIMSVPTFDALKLMRDLSQNFPSKARSLTRVSVNQEMRREIEENQKRLSETMGIHPGDGGLFINGLHIDLDVHNPFSILDTIRGEAKILEGLHNLGIKEENLSKLLRLPMNPVEENYALDIRHPAITWINDIETDSMYRSWPSGVQELLRATFPGVIRQIRRNFFNLVLLLDPVQEESIELVKLAELFYKHKIPLRIGFVFVVNTDDEVDGSTDAGVAFFRLLNYIADEYDLSQALMSMVSMYNKVEIGEALSVDTVSAYLKKKFPKASAARIFGEDSEYDDKRKAGAEFYKKSGLGPLPLALFNGVPLNAEEMDPDELETVILQRIMDTTNFFQRAVYMGQLTEGTDVVDHLMDQANMVPRINPLILSTDRTYLDLTASPVVDDWDDATMFSYLDSKDKTAVIAKRMNYFTKNDEDGINGVTVWIVGDFEKASGRRLLLNALKHLRASAGVRVGVIDNPSGGVPSEDSTVLYRAVWAALLTQKNKAAVEFVQKILKEETVQLLQQGTKMKNLLVKGMNADAFEKKFNTMEVDFIRSQQLFCRDVLKLHTGQRAVVSNGRILGPFEDEEEFNVEDFHLLEKITLSTTAEKVKARIKQMGIKGKQASDLVMKVDALLAAAPKGEGRRDFRFVKDEHSVLHFAPREDEVFYDVVAIVDPVTRDAQKMSPLLIVLSQVVNVKLQVFMNCRAKLSDMPLKSFYRFVLESDVSFLANETVSAGPVAHFLELPDSPLLTLNMITPESWMVEAVRSPYDLDNIHLQEMKGVVTAEYELEHLLLEGHCFDLSTGQPPRGLQFTLGMSQDPLMQDTIVMANLGYFQLKANPGAWILKLREGRSEDIYQILAHDGTDSPTDSPADSGDVKVVLNSFHSKIIKVRVQKKSDRISEDLLSEATENKGIWDSIASRRDGALGARLRYYSVKSIAKKMCYCRPSIAGGGSSSEDGEKNREDVLNIFSVASGHLYERFLRIMMLSVLQHTKTPVKFWFLKNYLSPSFKESIPYMAEAYGFQYELVQYKWPRWLHQQTEKQRIIWGYKILFLDVLFPLAVDKIIFVDADQIVRADLKELRDLNLEGAPYGYTPFCDSRKEMEGYRFWKTGYWASHLGNRRYHISALYVVDLKKFRKIAAGDRLRGQYQALSQDPNSLSNLDQDLPNNMIHQVAIKSLPQEWLWCETWCDSASKTTAKTIDLCNNPKTKEPKLSAAVRIVPEWVEYDNKIKQLLRDVQEQKDNDRATQTQSPMPEPSSSPEKTGSERDEL

SEQ ID NO: 4615 - protein, 1541 aa, Ascobolus immersus
MRLQSGVARFVVAAAILGRTNILGVLASSSPSVKVGLRTSWQGPPFLLELLETAAEENSTAYFPLLDRIAAQDFVGYKTEKQLYDRFIEVAHSVGTLLKPEDLASFNFALSIHASAPRVEAQYQYYEQTLVPMMGRMFRPECPVWLLWSSKQVCDTDWSTMLDEFQRFPNNPKALPFDRILNRNDELPTAILLADIESPEFGKFHRQLSERARKGKLSYRVRYRAPIDREARPLPLSGYGVDLALKKTDYLVMDDRQAAEGKEAGTDEVQKAKENLQSGESSEKATIKALHPKDIAFLGTKAGSYVMSQANPLDSLISMLQDFPKHSFAIANTNVSEEFTEELGENVQQGYQLEYGPGANTLWINGLQQGDTQVNAFALLQTLRRERRNIHSLQQLDLTAPEAIQILSHKAIGESKSDGLPQRFDASDDIEGGGVITWLNDLEKDEQYENWSPSLQTFLRQMYPGQLPQVKLNLFNMIVTVDMSKKADVSLVVEQLLMFIERSVAIHMGFVPITNTPESKAQAKVFYYLRDTYGLTAALRYISFATELGDSGPVKKVFEDIVATQTPIEGKQVKEWADITGGEAPLVSAATQWSNRLGMKANPEGAFLNNQFIPRSDETWLRQMSQRVTIDAQVLQRALASQLVSSKDEFFKVLYENIAKRRNKYVYPDDEDTLNLIDIAKVEADHSSVLENLPKVTTLDEDSSYQFDIWVIGDVDESDGHDLLSAAAEAQATIPGIRLSVINNPEIVNDKPALSTLLNRFKELLKSHEQLKQILAEAPPLKHFAELPQVTELAMKVQPGVKTEGWAIPDHMEAAKFWKSAAPLVAKAGLEPGQRGLVINGRVVGPIGREDEFSAEDFIDLIKLEKRKRIDPVIQAATDLGVLEKLAKKDAIPRLANIVLLTSQPLDGVAGIFDPVSPVRSSDFENWTCKNTCIERGDKEKAVLRITASLDPVSSTAQKWAPILKALSAMDGVYLQIFLNPSRVLTELPIKRFYRYVLEAAPTFDSTGTMVAPEATFSNLPEDALLTLTMDVPPSWLVTPSESIHDLDNIKLSTMKSRLNGGDVTAIYSLRNILIEGHSRDLTVGGPPKGAQLTLGTEADPHAADTIVMANLGYFQFKANPGFYELGLKEGRTEEIFEIKSAGIDGYNVRNADPSKHITVLSFEGATIFPRLIRKPGMETEDVLAPTTHKNRSPAALFKKGLQGADNLLTKWGFLAPAPGTKLLRPANAEINIFSVASGHLYERFLNIMMLSVMKHTKSTVKFWFIENYLSPSFKDFLPHMAEKYNFQYELITYKWPHWLRPQTEKQRQIWGYKILFLDVLFPLDLDKVIFVDADQIVRTDLKELVDLDLEGAPYGFTPMCDSREEIEGFRFWKQGYWKSYLRGLPYHISALFVVDLNRFRELAAGDRLRGHYHQLSADPNSLSNLDQDLPNHMQNQLPIFSLPQDWLWCETWCSDESLGTAKTIDLCNNPMTKEPKLDRARRQVPEWVDYDGEVAELARELKGKGAGGDHLEAGKKEEKEVKVEEKPVERVEEKKGHDEL

SEQ ID NO: 4616 - protein, 1500 aa, Coniochaeta pulveracea
MIRLSQLPWGLTAALLATTYLPCFHVSAGPSVNVGLNAAFPAPPYLVELLETAAQENETSYFPLLDRIAAGSFSTATTDKDLYEKFLEVLQEDGHITHPEALSTFNLALSMRSAAPRIEAHYQYYATAIEPVLRKQEGEEYTENKCDPWVLIDGKHKLCNSDQLDVDSASTVPHGASQQRTLPFDRAYGVGARDFILYADVTSSSFPVLYKWVKSVADDVGGTYRVRYKRSAAQPAAPLTVNGYGVELSFKRTDYIVIDDRQASEATTGSDAQKVMLDEDEEITDIKPLEKSDLSSLGMKAASFVLESDSPFDTLLKLTQDFPKYSTSIVAHNVSEGFETEHQANRMQMVPAGANVLWMNGVQLIDRQIQPFALADMLRKERRLINGVLDLGLTGKEAVALLGHDEVAQAKAEPDATRFDWRDEIEEGKVIIWLNNMEKDKRYEKFSKSLMTLLQPTMPGQLPHIRRDMFNLIVPVDFTKIEDLQIITQQLLAFMRRLVPIRFGLVPLSPTTEAAEQAKVVYHLLENYGLGAVASYLEALVEEKKASKPSKTLYEQAISDKPARADATPLPFHEISTSEHHEQQIKLAKHWAERLNANAEVPPVFFNGFAFPRSEGWLGVMQTRLGQDLRALQEGIYYRLIEEDTWLPSHFLENAVTRRNVYIFPEDAKTLNVLNINKIYTEHSDLFSKVPVLEADERSTKEAWAALTVIADLDDAEGRKLLFHALQFRQANQGVRLDIVHNPTVTSHSAAMMNERVKIRQENLLSVYRQVELEAMLEDSRQAPDPIFDAALARFLAAIKVKSGENLLILNGRVVGPVTSDDSFKLEDFELLMEVERAERILPVYKAIEDLSLSDKVSGPLAAAKLTSVTALSTISDLPEGIFESAPSLRISHFKVWNTTHTSFEVGHESTATIHFVAVINPASEQGQKWAAVLKVLSELEGVYLRVFLNPMDGLSELPVKRFYRYVLDSRPSFDDDGKVKALSATFAGIPSEALLTAGMDVPPAWLVTSKVAVDDLDNLKLREIQARRGVDRVEAIYELENILIEGHSRELPGGNPPRGVQLVLANANNTHFADTIIMANLGFFQFKANPGVYNIHLEEGRSSEIFSIESIGALGWAPVAGDENPDICLMDFGGVTLYPRLTRNPGQEDADVLEEVVKPTNAAKEIVSKGLNFLKGKGALSKSATEHAEINIFSVASGHLYERMLNIMMVSVMRHTKHTVKFWFIEQFLSPSFKSFLPVMAETYGFKYEMVAYKWPHWLRGQREKQREIWGYKILFLDVLFPLSLDKVIFVDADQIVRTDMYDLVTLDLQGAPYGFTPMCDSRTEMEGFRFWKQGYWANYLRGLPYHISALYVVDLRRFRELAAGDRLRQQYHQLSADPASLSNLDQDLPNHMQFQIPIHSLPQEWLWCETWCSDETQAQARTIDLCNNPLTKEPKLDRARRQVPEWNVYDEEIEAVRRRRLEGKEGTGGEERKGKGGKMLTRLPNGEIAKTLHVKDEL

SEQ ID NO: 4617 - protein, 229 aa, Poeciliopsis prolifica
MMLSVLRHTNTPVKFWFLKNYLSPSFKETISHMAKSYGFQYELVQYKWPRWLHQQTEKQRIIWGYKILFLDVLFPLAVDKIIFVDADQIVQADLKELRDLDLQGAPYGYTPFCDSRREMEGYRFWKSGYWASHLGQRKYHISALYVVDLKKFRKIAAGDRLRGQYQALSQDPNSLSNLDQDLPNNMIHQVAIKSLPQEWLWCETWCDDASKATAKTIDLVSPGAVTFKV

SEQ ID NO: 4618 - protein, 732 aa, Aethina tumida
  MOD_RES (192)..(192): Any amino acid
  MOD_RES (455)..(455): Any amino acid
  MOD_RES (460)..(460): Any amino acid
KLNKIILAALEHLPSDKATTFALSLLLDNQKVKDIKEGKQVTIPNEITRNIDAQELNLKMLRVYAQRVLNLKAGQIAIVANGRVLGPLAEEENFTLEDFNLLMRFSGASYLDKIIEAMGKDADEEDDVCSDTLMKVVSLLISKVQGRSRFDISYSGTDHSVIRTIPPRNADQVAFDLVAIVDPVSRGAQKLXPILQVLHEVLNCKIRLFLNSVEKNSDMPVKSFYRFVLEPEIQFSEDGRQLPGPIARFNNMPTSPLLTQNYHVPDNWLVEVVRSVYDLDNIRLENVESNVHSEYELEYLLLEGHCFEQSSGSPPRGLQITLGTESKPVIVDTIVMANLGYFQVKANPGAWILRLRQGRSADIYNIVSHDGSDTPENSDDIKVVISSLRSHIVKLRVQKKPDKFNMDLLSEDEGNSGIWNSITSSFSGNEEGEEEKLNIFSLASGHLYERFLRIXCCLFXNTKTPVKFWFLKNYLSPQVKDFLPYMAKEYGFEYELVQYKWPRWLHQQTEKQRIIWGYKILFLDVLFPLDVKKIIFVDADQVVRADMKELQQLDLGGAPYGYTPFCDSRKEMDGFRFWKQGYWRNHLQGRRYHISALYVVDLKRFRRIAAGDRLRGQYQALSQDPNSLSNLDQDLPTTYDDQVAIKSLPQEWLWCETWCDDASKASAKTIDLCNNPQTKEAKLTAAVRILPEWKGYDDEIRELQKKIDSGLLDEEAEQDAPTIRTTDIHSEL

SEQ ID NO: 4619 - protein, 1512 aa, Pneumocystis carinii
MRVNRLKKAWYIISVCFLGVLCQSVEFPIINAYLASSFKAPSFVNIYLETVSTYGELYFFELLDAISKTGNNRLAELNEENYKYLHKIVYDSGIIKDNITLSMLDYELGLHLLAPRIETYYHYYNYTVIPEMKNKKFMYECKNWILFNGKQYCDVEEFLRAKECIYEERESVILLPFDHIFDIYKDYDAPVAILYADLSSDDYKTYHSCLYEEAKKGNLKYVFRYKPENYSSDILYLNGYGVQISLKKTDYLVIDDRNIVDEIGGNHTLSIDSDDFLSNIQNDEIKPLTNAELKRLGISIVQFVTQSKTPLETLNFVLQDLPKYASYLSSIEVTRNLSEMLKMNYEYINPGMMLFTINGREINPAKINGFSLSRYLRNDYDLVISLKKLGLSAKEARFFVDESIFNIFNKFFDNRFDFRDKHENSMAIIWLNNLEKDSSYLHFSNDIYQYLNDLPSQQLHMVRRNLHHIIMFLDLSGRIDFMFLRIIFSLLHRSFPIRIGVVPIWNDSEVMFFFEIIYHIDFNRYIYRTRNDRNILYKNFKIIASKYSFSKNMGYMSIDEIMKSKKLNKYVLKTKEWAMRLNIKNDNYILVNGKFIEKKNWQHSILYVFPNDVNIIRKKIIKNSPGNDVDILDYLLEDAIFIRKFYMQPTNKLIKFQKFTNFIQNQENMEFSSINENLDTEQSIWLIADFDTKKGIKYLKSALKYITKYPHTSLRFLHNPQLDDKERSNNISSFLYLLKEREIDVAQPTLNYIRKIFNNYGSAGIDKNIEYPDFILNNYNSSQLELNSMKAKLYWKEIGNSLNKLGFMPGEFGLLINGYSVGPIPESDDFLLDDFESLGNFCNLSMVSKLKVIVNELSIKNSKKLKIFFPLFSSVILSYMVLEKHDDFDNSSPNKRYNLQDFFKKLTPSFAYGDENDCLFNVKVILDPLNEISQKLVSILKALKQLESVCLKVYLNPLKEIHDLSINRFYRYVLHSSLKFDSNGNLIYPNAVFEKLPMSHLYTVDYDFLESWIVTQKESIYDLDNLLIQDLSSKKISEVRIAYELKHILIQGRAEDITLKNVPAGIQLALKTKNNNFVSDTIVMNNYGYFQFKANPGVFKMDIMKSHSNIFEISKISGEFESNNDQFSKQIILDSFEGLTIYPKLVRNPEKENASIFGMNDSDSDGFTSGTVLNSTHSQQTDEFKSNSSMQRSHAEINIFSIASGHLYERFLYIMTLSVLKHTKHTVKFWFIENFLSSSFKNFLPHVANEFGFEYELITYRWPHWLRPQKEKQRQIWGYKILFLDVLFPLDLDNIIFIDADQIVRTDLKELVDMDLKGAPYGYTPMCDSRKEMEGYRFWKNGYWKSYLNGKPYHISALYVVDLKRFREIAAGDLLRHHYQSLSEDPESLANLDQDLPNNLQHLVPIFSLPQNWLWCETWCSDETLKDAKTIDLCNNPMTKESKLKRARRQIPEWNKYDKIIADLIARILEQKKANESSEYVVDNIAISVDMMQNIQFNFDDKNKKKDTHDEL

SEQ ID NO: 4620 - protein, 1523 aa, Scophthalmus maximus
MRLTFIVLLLLLLNIHQVTSAPKGVTASLEAKWSMTPFLLETSEFVGEDGNEKFWQFVDTVKELTVYKQGESVRSYYNLIIKKAGQFLTDLQVHLLKFALALRSYSPAVHASQQIASDEPPPEACPAFVSIHGQHSCSTKDIKKLLKAAAGRPKPYLYKNDHTYPGVNNTDVPVVILYAEIGTRKFTSFHKVLSEKAQEGKLTYVLRHFVADPKPHKMLLSGYSVELAIKSTEYKAVDDTKVKDPKTVLNTEDDDNDVQGFHFGTLKKFHPELQEKLVELRKYLLDSTNVMAPLKVWEMQDLSFQAAATIMSVPKFDALKLMRDLSQNFPSKARSLTRVAVKQEMRKEIEENQKHLSETIGVHPGDGELFINGLHIDLDFHNAFSILDILRGEARVLEGLHNLGIKGEHQGKLLRLPVNAVDNSYALDIRHQAIMWINDIENDPMYRSWPTGVQELLRATFPGVIRQIRRNFFNLVLFLDPVQEESVELVKLAELFYKHKIPLRIGFVFVVDTKDEIDGFSDAGVGFYRLLNYIADEYDLSQALMSMVSMYNKVGVGESLSVDTLSTYLKMKFPKANAERILGVESEYDYNRKDGSLFYKKSGLGALPLALFNGVPLSPDEMDPDELETIILQRIMDTTNAFQRAVYMGQLNEGSDVVDYLMDQANVVPRMNPLVLNTDRKYLDFTSKPVVNDWEDTTMFSFLDARDKTAVVAKRMKYFTNYDENGMSTVTIWIAGDLETVSGRNLLLNALKHMKASPGVRVGVMDNPGGKPREDNTVLYRAIWASFLTQKNKATVEFVQKLLREESSQLLQQGTKMKDLLMQDMDVDAFEKKFNTLEVDFIRSQQLFSRDVMKLRPGDRAVISNGRILGPFEEHEEFTVEDFHLLEKITQGGSAEKVKAKVKEMEMKPKHASDLVMKVDALLSAAPKGEVRRDVHFIKDSHSVLQLSPRENEVFYDVVAIVDPLTREAQKMSSLLIVLSQVVNVRLQVFMNCRAKLSDMPLKSFYRFVLESDVGFLANDTVSPGPVARFMELPESLLLTLNMITPESWMVQSVRSPHDLDNIHLQEVNGIVAAEYELEHLLLEGHCFDLSTGQPPRGLQFTLGTSRDPLMYDTIVMANLGYFQLKANPGAWILRLRKGRSEDIYQVVTHDGTESPADAGDVIVVLNSFHSKIIKVRVQKNAEKINEDLLSETSESKGIWDSIASLTGGGSKKDEGEKKKEDVLNIFSVASGHLYERFLRIMMLSVLRHTKIPVKFWFLKNYLSPSFKETISHMAESYGFQYELVQYKWPRWLHNQHEKQRIIWGYKILFLDVLFPLAVDKIIFVDADQIVRADLKELKDLDLEGAPYGYTPFCDSRREMEGYRFWKSGYWASHLGHRRYHISALYVVDLKKFRKIAAGDRLRGQYQALSQDPNSLSNLDQDLPNNMIHQVAIKSLPQEWLWCETWCDDTSKVTAKTIDLCNNPKTKEPKLTAAARIVPEWVEYDNEIKQLLRRVQEQGDAATEKQTPSPSQQEKADSLRDEL

SEQ ID NO: 4621 - protein, 1326 aa, Cephus cinctus
MKILITFGDSLMQSLVEPMIWLIMDRLDRRLRLSGYGVELQMKSTEYKATDDSDIKDNSGKDDEDENDGVEEIDGLNFAILKNLYPDKRSELDELQMHLLDTSHEIGALKVWQFQELSHQAAERIMNSPSSEAIKALTDISQNFPMQAKSLIRTKVRSDMKKEMKLNQELFAASLNIQPTDTALFINGLFFDLEAIDILTLLESLRGELRVMEALHKIGFNNKRMSKLLSLDLSGNTDNQDFAMDIRDSAVIWVNDIENDSRYSRWSPVLTELLRPTFPGMLRNIRRNLYNLVLIIDPLSEESTPLIALAESLYAHSAPLRVGFVFVTNFNTSITGLTDASVAVNNAYHYFAESKNSKEALNFLSDLENYIGVHGPDVSDIKKAIKARDSSADINYILGEESEYDVGRHLASDFVRRTGFKKFPQALLNGVPLPSNQLNSESFEEAVLSTIITLTPSMQKAVYRGEVTEGDDVVDFIMNQPNVMPRLNERILKVDKSTWLNLVGVPPEDQEYVKWSSQDASAWLMENMRYVSASRRDNMHHLYSLWIVADLKESMGRQLLREALEYVESNADVRASIIINSADDVGSEIDINKIAIAALNTLPSDKILGYLKKLIKEDTVTLIAKGDYDIENEAVKEQVEQQNFILSVHRHYAKAVLGLEKGSRAVICNGRIIGPFDENEEFTNEDFSLLERFSHSTYGDKLFKNLFKSQLFDDDEYEKNDISDDMIMKISSLLVPRPQTRSRFDIPYHGDEHSAIKVPAANPDGVAFNLVAIVDPVSRGAQKLGPILNVLQQTLNCEIKVFLNCVEKNSDMPLKSFYRFVLEPEIQFTPEGHIIGAVARFTKLPTSSLLTQYIHSPENWLVEVVRSVYDLDNIKLDNVAIGVHSEFELEHLLLEGHCFEALMGNPPRGLQITLGTENQPVMFDTIVMANLGYFQLKANPGDWLLRLRQGRSAEIYDISSVDGQDVIQDGNNVKVLISSLKSHVLKLKVSKKPDKAGMDLLSEDDKSSGLWNSISRTFTTGEESEDQDEKLNIFSLASGHLYERFLKIMMISVMKHTKSPVKFWFLKNYLSPTLKDFLPHMAKEYGFEYELVQYKWPRWLHQQTEKQRTIWGYKILFLDVLFPLDVKKIIFVDADQVVRADLKELATLDLGGAPYAYTPFCDSRKEMDGFRFWRQGYWRNHLQGRSYHISALYVVDLKRFRRIAAGDRLRGQYQALSQDPNSLSNLDQDLPNNMIHQVAIKTLPQEWLWCETWCSDESKKYAKTIDLCNNPMTKEAKLQAAMRILPEWIGYDEEIKALHQRIENENRQLEREDVDISDDSPKHEEL

SEQ ID NO: 4622 - protein, 1485 aa, Pneumocystis jirovecii
MPPFVNLFLETVAAQNESLFFPLLDIISKEKHMILSKLNFDNYNYLRNLVYDYKIMRDNISLSILDYALALHSSAPKIQAYYNYYNDVVVSEMISRNFTSECKNWILFNGRQYCDIDKFLESKDIEVDQNRPVTLLSFDHIFDNNKNGDSPLAILYADLSSNNYITYHSFLYEKAKLGDLKYVFRYKPEDFNSNDSLYLSGYGVEASLKKTDYLVMDDRKIIEDVHEKMPSQSYSSEVNSSFFFSNIQDNEIKSLTNTELKELGFSITQFVMESKTPLETLNYILQDFPKYASYLSTIKINKKTLKKLTLNYKYLNPGETVFSINGLKIKLDKINGFSLLKYLRKEYDLISSLQNLGLSLEKAKSLITDKAISELFNMFLNIRFDFRDSYDDGNVILWLNDIENDPTYMHFSQDIYQYLDELPNGELHMIRRNLHHVIIPLDFSKKFDMIFFRDIFFFIQRLFPIRFGILPVWQDPKDIFLVKIFYHLFSTYGINSAIEYILYLDPDSRHNETILSRNYNFILFKYEQDIEIEDLDINNIIKSKKIEQYILKTKEWSLRLGIENDDFLIVNGKFLEKKQNWDDLSFNIFMNDVDVIRKKIVEKSLNNNVNILDYLLEDAVYRRDSYVHPMDSLPLTVVFFKIFTKNLFSIENLNTELSFWLIADFDTKKGLEFAKFALEYMIEHPYTSLRFLHNPKLSNKNNFDYFSSFLFLLSEKNIDVTESVLNYIQKLLNSYDSDGIINREIEYPYFILNIYNSTELLLNSVKAKLYWEKMKDQLDKLEFSPGEFGLLANGHVIGPFPESYDSLFDSFKLLGDFHNFSIISQLKTITERLDIKNSRCKMFFPVLFSILLSHIVFEKYDFTYFSQFGRDKIYTLTQKLTPSFTSGNQRNSAFEVKVVLDPLNEISQKLVPVLKVLEQMEGVYIEVYLNPLQKISKLSINRFYRYVLQSSLKFNIDGDLIYPSAIFERLPISHLYTIDYDFPGSWIVTQKRSIYDLDNLLLSDLFSKKIKEVVVIYELKYILIEGHAEEIGLKTPSGIQLALKTKNNIFITDTIVMSNFGYFQFKANPGVFKIDIITKESNDILKILKISDKLGSNNFKKEIILESFEGLTIFPTFIRYSGKNRILNLEELNKFEDNDFELENTTLKFMQSKHSSGSTFDIPVQKFHAEINIFSIASGHLYERFLYIMILSVLKHTKHTVKVWFIENFLSSSFKNFLPYVANEFGFQYELITYRWPYWLRSQKEKQRQIWGYKILFLDVLFPLELDNIIFVDADQIVRTDLKELVDMDLQGAPYGYTPMCDSRKEMEDYRFWKKGYWKSHLKGKPYHISALYVVDLKKFREIGAGDILRQHYQALSQDPESLSNLDQDLPNNLQDLLPIFSLPQNWLWCKTWCSDESLKDAKTIDLCNNPMTKESKLERARNQVPEWNEYDKIVANLIARILEQRNNEASESSVDNIAISVDVMENIQFNSGEENKKKSIHDEF

SEQ ID NO: 4623 - protein, 1489 aa, Nannizzia gypsea
MSPIRPWPIRPLSLFLASLALFPNVAQASPSVNVALSASFNSAPYLMELLETAAEENSTSYFPLLDRIADGRFVDAITEKDLYEQFIQVLSEDGHITDPVALSSFKFALSIRSTAPRIQAHYQYYNSSVENSLMAAQDAVCQVWAHYDGSQYCSPTLERAQQPLIAGRDESLEKLLPFDRVLAVPNGDDDESQQSLVLYADITSPLFSEFHKAVSKRARDGEITYRVRYRPSTIASGPSKPLFVSGYGVELSLKRTDYIMIDDRAEEKGGSTGSTSDSKPTLAADGLSGSPTADLEPLSSSEVSTLGLNAASFVLNSDDPFDTLIKLSDDFPRHSKTIAGVNATSEFLDEYRENREDGLQPGINTMWINGVQMSPRNIDAFSLLAHLRQERKLMNSLNELGLPVTEAVKLLSNPAIAMAQKVHGSQRFDYRDDIEGGGVIIWLNDLEKDPRYEGWSEDITTLLQPTYPGQFHELRRDVHNVVMPLDMADKEDITVFVEEIQAFVLNKVPIRFGLVPTQGSDLSKQQAKIAYYLLKTYGLESMFSYFPRGAYVHALDMLCSEILFPSKLDFEMAIKDKEPKDDQPTILSEDRLAADGENPPIYANAIPLERDERWVHFLIDKLFKDVQGMQQRIYEGEYKEDAWLPGFYLEEASPKRNALVIPEDPSDVTVKSINDAYSKHKEAFETIPRIPGNSESTIEKWAQLALVMDLDDEHGAKLLANAVVFHKMNPEVEILILHKPSTPAKEPGLSTELHSLLNGGRDLDTDAINALFDREAKRKGASADAQGFYSTIQPVIAELGADENCMHVLLNGRLIGPLNDTTILDVQDLELTLQYERSKRLVPVVKALESLKETEKIRDHLAFSRLTSMVALSTISDIPQGTFQSAPMIRTEIFNSWATKHSAITISNTEAPLVKIVATLDPATEIVQRWVPILKLLSELHGVSLKIFLTPLENIKELPVKRFYRHVLEATPSFHEDGSLKRPGASFHGLPQEALLNLGMDVPSSWLVAPKDSVHDLDNIKLSSLKEGTNVDAIYELEHILIEGHSRDMPKNKPPRGVQLLLGTERDPHFTDTIIMANLGYFQFKAQPGHWQITLKPGRSENIFNLDSVGGMGYTPKPGDDNNEVSLLSFQGKTLFPRLSRKPGHESDDVLEDGAKKQGSAKSILSQGLNFASGVFSGVAKTRKEKHADINIFSVASGHLYERMLNIMMLSVTKHTKHSVKFWFIEQFLSPSFKTFVPHLAEKYGFSYEMVTYKWPHWLRPQREKQREIWGYKILFLDVLFPLSLDKVIFVDADQIVRTDMYDLVSLDLEGAPYGFTPMCDSRTEIEGFRFWNQGYWKRFLRGRPYHISALYVVDLNRFRAIAAGDRLRGQYQSLSADPESLSNLDQDLPNHMQHSIPIKSLPQDWLWCETWCSDESLKTAKTIDLCNNPMTKEPKLDRARRQVPEWTVYDEEIAQLARTVGAKDVEAEHTAPKETEETEPEDANKDEL

SEQ ID NO: 4624 - protein, 1532 aa, Debaryomyces hansenii
MQLGCCLAICQFFLLSVVAFQDNDLSSAENKFEVNLEASWRPSPFQLNLLESISGYNESLFINTLANIIGFSIEENESDEESNEELNDVDGTLISDSHIYMKVVDALNLDDTSKSFIGFNLVNKIFTPRIQAHYEYYTNVVDPQFSHRLYKECSTDSFGNKILSGESDKHQAWILYNNKLYCSSDEVFALKTDKKSTSTDDVLPFDRVIGSNQESPLLVLYGDIESEVFKNMFINLYESAKIGKLRFVWRYIPSNNPDQREQLSGYGADITLKRTDYMVIDDRDINKIEFKNEKRIENKNYHLDKGFSRIARLDELKPISKDNLTDLGLKLTSFILSNDYSDISNHDLLNSILQDFPKFAYYVSQLDPENIDSVRESVNANVKLGMSEESNGIYINGSPINKLELDVLKLVDKVRDELKLVNELKELGFTTGQAKKLLFKFALLSAVKESQFRTGNTIMGGNENRFKVYNYQFTPMSRHKKGGVVFFNNIEKDDVYESFPSSRREAYLGFSAQHLRPGQIPIIRENIHDLIFALNFSDKEQLKVFFTFSKIILDKSLPQQLGLIACGGNEKDKMIAEIFYFIVDKASLTEALAFLYKYFDAKDEEAEKEILNAVSIPSTYSFNESIYQDVLDRFSINSPSVICNGVIYELTSTWQVLMGKQLAQDIRLIQNHIQKGDDVNKSLKSFLFENAKSERNLRIIPNDASLIKYKGINQELIDNSISFKCKKKDNGASATFWLIGDFNSINILDQFVEILRTMKVERSYSIQVRILNKSTDTDLLDKIKALFPINELRTKDIENIISWLSDRLHNSVNCKPDKNIVQLLEASGLPPNHPLLLLNGRYFRLDKNLSFKELQQLLEYEFSQRLNLFGDIISAYPDEFPRSFCEYHSSRYDCSDWFDLVSSYVTKSFHVDDNMLVSDVARFDFSSLNMDNILKISEDETSKEVEVLIIIDPIDEMSQKLVSIIYAITSFPFVDIKILLQPQLEATEEVKIGRFYRGVYPSSIPQFGKDGGLEIKNKAVFEMVPSQELFTTNIDSPARWQIVIHDSPSGVDLDNVKLSNYVDSLIYGTYVLKNILIEGYAKNVKYGMNLSGLTIDLSKDNSYTDTTVMSNLGYFQLSANPGIWEFKIKPESKSEKYYSLLSASENVFISNTDPLGSVRVAILNLNGLVLKPRFTTNSGYENKFIFEEDDNIESEDDNKIGSFMKSLLKSKAPTTKKHADINIFTIASGHLYERFLSIMTASVMAHTDKSVKFWIIENYISSHFKKLLPLLAQEYNFEYELITYKWPNWLRFQREKQRTIWGYKILFLDVLFPQDLKKVIFVDADQIARTDMKELVDLDLEGAPYGFTPMCDSRKDMEGFRFWKQGYWAHVLKDGLKYHISALYVVDLDKFRALSAGDRLRAHYQKLSSDPNSLSNLDQDLPNNMQNKIKIHSLPQEWLWCETWCSDSEFRNAKTIDLCNNPLTKENKLDTAKRQIPEWTTYDNQIKRLMDQINDNENPKISTDVLENTPRNDLHDEDNQSQYEPDYIHDEL

SEQ ID NO: 4625 - protein, 420 aa, Beauveria bassiana
MANLGFFQFQANPGIYNIHLKEGRSAETFEIESVGAQGWAAVPGDEGTSLALLDFQGTTLYPRLLRKPGMEEVDVLEQADQVTENIVSKGFKLAESFLGNVLGKKSTANLQHAEINIFSVASGHLYERMLNIMMVSVMRHTKHTVKFWFIEQFLSPSFKEFIPHLAEEYGFKYEMVTYKWPHWLRHQKEKQREIWGYKILFLDVLFPLSIDKVIFVDADQIIRTDMMDLVKLDLEGAPYGFTPMCDSRTEMEGFRFWKQGYWANYLRGRPYHISALYVVDLRRFREIAAGDRLRQQYQALSADPNSLANLDQDLPNHMQFQLPIHSLPQEWLWCETWCSDESQGKARTIDLCNNPETKEPKLDRARRQVPEWTKYDDEIAAFAQRVKAAKSPDEDKRRTNLARNTKSRNFEERLHTKDEL

SEQ ID NO: 4626 - protein, 1065 aa, Diaphorina citri
LRELYPDQKASLSKFRNHLLESTNEMAPLKVWQFQDLSQQAAQRILDAPVEDQLHTLIHIAQNFPVQARSLVSVKVTPEFRAELKHNQDLYMNTLSLGVSEGAMYVNGLYFDVDLIDMAKLLETVRHELSVMQGLYSIGITDDALQKLLCLDLSPSSKTEYGLDIRDSAVQWINDIEQDKKYSRWSYSLMDLLRPTFPGMLRNIKRNLYSLVIICDPSKKESIPLLKLIESFYVHSAPLRIGLVFNINPSDEVTGLQDAGVAMLNVFNYIGEIKKPHEALATDMTSEKLPQIYSSTDKDRYERALGEASRILSNSQLNLLKLSLAMHSDSPRVEMYNQIALQRGVKCPVALDVGDALLCTLDSLENTINSYLKKDKSSLVRMDTFRIDHQYPGCDNSSLTLILYGELGTPEFAQFHAVLEKYAKRKEINYIVRHFVKERQPRKVRLSGYGVELQMKSTEYKGHVCQRAKVKPQEDVSVEDVINAFAKEYSSVDVDEIFGPDYFINNCITDDGIPSKADVFGPLALLRIVLNFNVISPHQVYAKVKPQEDVSPEDVINAFAKEYSSVNVDEIFGLDCDYNTGRQLSREFIARTGLVRKTPQVLMNGIPLPETSLTAEDFEEAILTEIIRQTPKFQKAVYKGELTDSMDVAEYVMTRPNVMPRLNERVLNKDRSTFIDLTLPPSDEMLNLVQYVHAGKKSKADSDTLYMITHWVVVDLNSTDGRQLLDSTVEYLKSEPGSRVAFLVNPASSSDEVKGQHFAFLAALHAGLDVEKSVTIATQALTQAPASIPELKVLSYDLNNIKLKNVDSNVHSEYELEFFIIQGHCFESVNGNPPRGLQMTLGTEQDPVQVDTIVMANLGYFQLKANPGAWILRLRQGRSSEIYDITHHAGSDTPVNSTDIKILISSFKSHILDVKVTKKPDKLNVDLLAEDSAENGGLWNSITSTFGGKEDSESGEERINIFSVASGHLYERFLRIMMLSVLKHTKTPVKFWFLKNYLSPTLKDFLPRMAKAYKFEYELVQYKWPRWLTQQTEKQRIIWGYKILFLDVLFPLDVKKIIFVDADQV

SEQ ID NO: 4627 - protein, 1502 aa, Stegodyphus mimosarum
MIMMNMSRWYILLLILCTVYINFSQTLQKSVSVVLDSKWLDTPLHLEASEFLAEENPELFWKFLKDCSKLESNFFHKKSAKLQYEAVIDISSNYLSSTKIALLKFSLALRTYSPAVELFHQIAYDQKFPVKCEAIADVGGSYACDAENLKSLLSSSIRNASVLYQVDHIHPNTAQTADVILYGEIGTSSFHKLHEILEKEAEKNAITYAVRHFVLKRHKRKVRLSGYGVELAVKSTEYKAQDDTKVKEEKGPEQEEIDKYEELEGFIFSKLKELHPSKAENLEQFKAHILESSKEIPTLKVWELQELSLQAAQKILDSPIEETLRIMKDISQNFPVQARSLIHVSVSSEVKKEIDRNQQMFMHHHNLGPTDTAMFLNGMFFDMDTTDIFTLLQVLKQETRVLESLYKIKIPEQLLTKLLKMDFALDKEEYAVDIRDTTIQYINNIETDRQYRSWPGSVQDLLRPTYPGMLRSIKKNIYHLIIAADPSKSNAKDIFKLAESFYVHKAPVRIGLLFAVNPNASVDGFHDAGVAFLNAYNFISQDKSPYDGLSFITDVYANTEEKDISVDSIISHFKSLYSNEDLDLVFGIESDYDSGRKAAWNFINRTGIGKPPQVLLNGVMLKQLQLTADMFEEAILTEIMRQTPFLQKSVYKGELTDSHNILDFLMDQKNVMPRLNQRVLSSESTYIDLIAEKSEAEIIMKNMKYFVKRDDDEFRPLTMWVVADVETAEGRALLLSGLSHLKTSLHIRLGIIHNPAAKITGSILRKAIQVALDIFDCHTAKLFITKLLKPVNAMQVINNEKSVTDFAVSNMDTELFLKKMNAFDEKSLDFHKVFCKKILKFSPGQRAVVINGRVIGPFEENEDFAQEDFHLLEVYSDGLFGEKLVSQLKDGFEKSKLDSEIVMKVTSVLLSQPQPKIRHEIKYFGDKHSAVKIPAADTDEPAHEVVIIVDPVSKGAAKLSSMLMVLQRVINAHFKIFFNCVDKHSAMPLKSFFRFVLNEEPVFGPNGEFGIAPIAKFSSLPSSPLFTLGMVTPDNWLVEVVKSPYDLDNIHLEQVESTVHADFELEHLLIEGHCFEQSSGNPPRGLQFVLGTNTAPTMMDTIVMANLGYFQLKANPGAWHLNLRQGRSSEIYEIVGSENTDTPPGSSDLVIIISSFRSHIIKVRVSKKPGKQFEELLYDENDNNNGIWSTITSTFSGNKSELDGSDDKINIFSLASGHLYERLLRIMMLSVLKNTKTPVKFWFLKNFLSPTFKDFLPIMAEKYGFEYELVQYKWPRWLNQQHEKQRIIWGYKILFLDVLFPLDVKKIIFVDADQVVRADMKELCDLDLGAAPYGYTPFCDSRKDMDGYRFWKSGYWASHLAGRKYHISALYVVDLKKFRRIAAGDRLRGQYQGLSQDPNSLSNLDQDLPNNMIHQVNIKSLPQEWLWCETWCSDETKETAKTIDLCNNPKTKESKLTSAMRIIPEWKDYDAEIKQLFQEYESNKTIQRVQQLKQKTDDHDEL

SEQ ID NO: 4628 - protein, 1483 aa, Melampsora larici-
SPPISVSIQATWPEPPLLIQIIESAAIERSDSFFPILTAVSKHWRTIDSLSLTPQQIYNQTLNQITLNGLLNDQGEIESLETSIALKEASPKIEAFRAWYRDRPAPRILSFDHICPPGSHIPPPSVPVVILYASNDPRSFGPFHDVLHQASSSSPIRATYIFRWQVSSDDSQSSSIGPSHLSGWATRLDIKKSDYLTVDDRPVETNSRESRDSESESTKENTKEDAPETSTVIIPLQADEFSTIGLKATQHILTSPNPLSALRVLSEDFPRHAYNLVKNWVPGEINADLDRELKENAAEGVVKPGQSAIWINGLDISSVLPVANINFFKLIQLMRDERRWIKSLTSLGLSVSEIRKLVTDEQLNSALSGEGGARSDDLEIDPSILGERFDASDRLEHGEMILWLNDLEKDTRYAAWPKSLRDFLRPTYPGQLHAVARNTITVVLALNVTHTANLRILTESVETFITRSVPIRWGLVPLDDPNASGSSEALKGIFPIYSSGTSTGSTSSDMVDALDFKQRADAYRAAHPESDSDDQKDTASFGEGDFNSWSEKTQSYIRRLALCSGSGEVPGCMFVNGKFFVLDDDFRMNLQQTAMLHIQFLQHQIYYGLIQGSVDVSHYLYDLPGVYPARNEFVFPSPGRPVRVVNLVQAFVAAKLGSCAVEADHETNEPPISAIWVIGNLDSKSGAASVLALLELMVNTDMCFPLLEQCGDMLHLTFTLQAFPSDQTRGSVFVGFVHASSQQTDAHIDPRLSDSLGQLIHSPEHPGILIKNVTDQFAHFGLQPSKPFPESFSLSKMPSEWRRSTEDGEDVWAGAQSLITELDITEGHVAVVINGRVLDVPHSQVLQASDLRMLIDYEIQKRTNPLQVALRSVLGPERFTTIKSMVPYIASVISSVLVSSDDEAGSKTRGRAVSNALTERKHSSISYGDHDAAVIQFRVILNPASELAQSWSALLETLSGRKDVAIKVWFNPMQHVEELPIKRFLRTSFHSRIQFDQDGSSVSPSVVFKHMPTDVLLTLSIEAPPAWLALPLESVHDLDNIMLSKIGSTERERGVEGVFQLEHIIIAGHASELPSEVPPRGLQVVLTNLLTSASVDTIIMANLGYFQFKAEPGMFVMKIRPGRSSELYTLERVDLKTGKDRLSTDKNKTDEDHQFSLTTFDGLLLFPRFRKRPGKEKEKLIQPVAAMSESEDAHTSTTQKLIGHKPSDVIPGKKRNVINVFTVASGLLYERMAYLMCVSVMRHTKSDVKFWFISNFLSPSFKRFIPHLARKYEFEYELVTYRWPPWLRAQKEKQRVIWGYKILFLDVLFPLELDRVIFVDSDQIVRTDLQELVDLDLRGAPYAYTPMCNDREETKGFRFWDTGYWKDSLRGRPYHISALYVVDLRVFRAVAAGDQLRQHYQALSADPNSLANLDQDLPNNMQEVLPIYSLDQKWLWCETWCSDDGLKTAKTIDLCNNPLTHEPKLTRARRLIPEWDVYDKEVA

SEQ ID NO: 4629 - protein, 1408 aa, Kazachstania saulgeensis
MNALFKGMTAIMFWFYIVISLSLVNGITLSNKYGIPDSLRILSALKHVLRFDDSKLSIFNELYPFVTGLDSLDLVDDAFALGLEIDELPTNIAISKLLSIMYKKNDLANMFEMYYNLYPMGITTESSTSSLTTNLDGSSYFMLNGKSYNKPDDVFYLKSKELTKQANIPDKYMVVSPSELVIGTKKDAPLIIFYGCPADDQFEDFHRNLYAEAVQGDGKFRFLWRATCKLNTPAKLNNEFPLSLSLTDNSDLSLLLTNPHFPLDTPNDFITPGGKLLHLSKKDLEKLDLKVTSLIANHYYNTKNVSDVLSYASSIINNFPLYVSQLVEMDLHPKEEEKILSYNKILAKRGIDYNLLGLFLNGQHLKLSTLNEYTLLNMIDKEYNSLQKLSQVVESIDSKYPMKNSRALLNEFSTISLPHLQASQPIKIDLHRIPGFSDTVIYFNDISSDKQYSELSEDVSVFFEKSTFGELPEYKQNWNEVIFVIDFNKLDDPNNKAALAGLNRALTIVDQGYPQRIGLLPFNSENNFRATSMNTQEDESETAKIINKIYDLKRYDIEELSKFLEMLQEKGTNLKFKDPTLASVMKMPNYAKQVRDLQIYETSLIVNGEVYPFRRNTWNYLISNVVKKDADFIRQQLNAQSSRQDKSSSGFVDVRGILHLKSASSRHLKYMPEYYADALYSSEVLEALSEIEQDRVITYTFDHNYNVLHTITVVDDFDLNDTIRRVYNLLKTKFKGVRVRLIHTGDIKSAQWKNLKKLDSREHVLKLLKKIAMTKTDKKSSHSESKILRNIDSNTLKRWLPQIPTLYLERQSFFVLNGRFIQFEEGEIISKREFDDLIQKEAVRTLDSIASLEKVFPSFSNSPISSDAVEIISSILTKMYYHSKQLGDYGIEYTTETILPRMDLAHFFKENDFTIFGSPYSNTDVIELLLVVDPLEERSQKLINLLSRFEHFNFVRIKIVLFPTEKLTITPIERVYITDPVDHELIDDKISKLFDVDVDAPRIFTLTETNDIQDILLDIHVFGEKDSISEGTVDGVGGVSLELVSSSGDVIDHTITMQTFGYGQFHLANLGKNFTVRIGHDSTDYEIIGISSYGSSDFKTTPTFNVLDFSPHKLFVKVRKLSETTTDTDNESSINIFTVLMNNGEEEPFKKMILGILSRIDYSKTEKKTTFWVLDSPFLSRSFKDFIANFNENSSELGAHINLLKYEWPNWLRPQRFRNRKIAVSKLLFVDVLFPKNIDHVVYMSPTTPLLDPVKLLEETKNSRASFSLFKMKGGGYWNEGYWKKMLEDNGLSFYSVEPGFIINLNRVRELHAGDKLRLHYQRLSTDINSLLNIDQDLINNLQIEVPLGMLKTKAEINLQEHDKYIIDWLPKLEKSREELNTKHSVIFQEEAYDIAMEDDQLIEHDEL

SEQ ID NO: 4630 - protein, 1513 aa, Rhizopus delemar
MPRISTAILGLVALGVFLVKAESPTVDLTLVAPWSAPDFLLEIAETVALSNETNYYKLIDELVQIQQNASSWTHQEIYNKAVERVTILDKDDVNFFKLSLALHEAAPKIEAYNQYYQQAILPSLVEYDDQCDVWVQVDNKQACSLEALIEVLKNTNSESVNHALLPFDHIVRPMNERPQKTLVLYTNTFSANFNEFYTWLKSKVEDQDLMFVIRYKPSSTEKTPLYLSGFGVELALKKTDYLVIDDRDDKSENTIKEKISRKTNQNLFEGAESTNIEPLTSSEIQSLGLKAAQYIARSNRPLETMSHLAQDFPKYSKSVSALELDTEFAQEVLRNQRFAVQGGSNAVWVNGKALEMNQIDPFYLSRILRSEKKLIKSIQNIGFSSKEAIELITDPVLSEGEGKGDVISGIFDVRDSPETPFITWWNDIEKDKRYHGWPSDIMEILKPTYPGQLHPIRKNIYSLVLVEDLASQESLNRIVNEIQAMIKRTIPIRFAIISFVDHDDSATTLAAQALHYINQNHSKSAGMEFLETMLDLMASNGLTRATEEIVEVSFLHATKEFEVEKLSFKEAIDAQKPFTAATREFMSRMGIKGLGSKEGIMFFNGKLLEFNEDKPWIHTLMPHLSEQTRIVQKMAYNDEFDPKLNFYDYILSQSNVATRRNPYILTSHANPLRIHTFDTTTELLELKYFQSENSTIPSVNFWVVTDFDTLTGLKLATEAVLFAESNPKVRIAFVHKSSRFNIQLVKDSTGPKFSDVFCKLIHSDETTLSTIKDILQNTNLPSETSSNNGEMNIQSEFEPLPILPGIPIIDIDVKEQGQKWSKIHTALQKDGLESDFIGVVMNGRVIGPLSLDDNLQFTKQDFDMLFEYENVKRISLVEQAILHRLEATTADTIMKLTAIVENDKAQVVQDVMEDHVPVNRNKVYENIDAADHTRIVAGDVDNTFLEIGLILNPLSEMAQKLAPMVQTLSEMEGVSVIVYLNPVSELNELPLKRFYRYVFDKEVHFDPHSGEQQIPTAYFANLPTDPLYTLGVETTNAWHVTVKEANMDLDNILLKQQAAVSAVYELQSILVEGHCLDSVIKSPPRGLQFELVSFGSEKRDTLVMANLGYFQLKALPGLWRLGLREGRSSMIYSIQDVGANGKWNWSAQGDQSDVLALTSFEGLTITPLVHKKPGMENEDVLEPSQPKEKEASQSGLWSSINQKIFGKKQDKSLTVTKSDNAEINIFSVASGKLYERFLSIMMASVMKHTQSTVKFWFIENFLSPEFKDFLPHMAEQYGFEYEMVTYKWPAWLRAQQEKQRTIWGYKILFLDVLFPLSLDKVIFVDADQIVRTDLKELIDMDLHGAPYGYTPFCSDRKEMDGFRFWKDGYWKVHLGEKPYHISALYVVDLVRFRQLAAGDRLRAQYQQLSADPNSLANLDQDLPNNMQHIVPIYSLPQEWLWCETWCSDESLKKAKTIDLCNNPLTREPKLDRARRQVPEWENYDNEIDELRKKVKTMSPSDFEEKKRPLKDEF

SEQ ID NO: 4631 - protein, 1621 aa, Cephalotus follicularis
METRFRSGFFCVFAILLVCVTPFASVYGGDNSDRRPKNVQVAVRAKWSGTPILLEAGELLSKERKDLFWEFIDLWLRTEMVDADSYSARDCLKRISKVGRSFLSEPLASLFEFSLTLRSASPGLVLYRQLADESLSSFPLADDSASNDLSGEVLEKDENVRNEKTDRLLVGLNPKCPGGKCCWVDTGSQLFFDVAELLLWLRRPPDVTEDSFQHPELFDFDHIHFDSSFSSPVTILYGALGTDCFREFHVTLVEAAKEGKVKYVVRPVLPSACAVKTGLCGAVGARDSINLGGYGVELALKNMEYKAMDDSTVRKGVTLEDPRTEDLSQEVRGFIFSKILERKPELTSEIMAFRDYLLSSTVSDTLDVWELKDLGHQTAQRIVHASDPLQLMQEINQNFPSVVSSLSRMKLNDSIKDEIIANQRMIPPGKSLMALNGALINIEDIDLYLLIDLVHQELSLADQFSKLKLPHSTVRKLLSTLPSPESSMFRVDFRSTYVHYLNNLEEDAMYKRWRNNINEILMPVFPGQLRYIRKNLFHAVYVLDPATICGLESIDMITSLYEDNFPMRFGVILYSSKFIKKIELTGGELHSSAAENDLQLQEDASSLIICLFIYIKENHGTRTAFQFLSNINKLRTESADSADDVPEIHHIEGAFVDTILPKAKSHPQGILLMLEKEQTFKELSQESSMFVFKLGLFKLQCCLLMNGLVLDSNEEALIAAMNEETSRIQEQVYYGHINSHTNVLDEFLSESGISRYNPQIISDGKVKPKFVSLASSVHGGEPVLNDVNFLHSPDTMDDVKPVTHLLAVDVTSKNWMKLLREGIRYLIEGSKGARVGVLFSAHQDADLSRLFFVKVFEFTASSYSHKKNVLEFLDQLCSFYEQKYILAPSAVAESTGAFIEMVYELAEANGLSSKPYKSSLTEFSDEKVRKHLNKVAQFLYRQLELESGVNAVITNGRVTFPTDESTFVRHDLHLLESVEFMRRIKHVAEIIEEVIWKDVDPDMLTSKFISDIIMFVSSSMAMRDRSSESARFEILTAEYSAVVLNNDHSSIHIDAVIDPLSPSGQKLASLLRVLGKCVQPSLRIVLNPLSSLVDLPLKNYYRFVIPAMDDFSSTDYTVNGPNAFFANMPLSKTLTMNLDVPEPWLVEPVIAVHDLDNILLENLGDTRTLQAVFELEALVLTGHCSEKDHDPPRGLQLILGTKSTPHLVDTIVMANLGYWQMKVSPGVWYLQLAPGRSSEIYILKDDGDGRRDKSLSKRITINDLRGKVVHLDVLKKKGKEHERLLASTDDNNLQEKKQGNSWNSNLLKWASGFIGGNQQSENSENTLERHGKGGRHGKTINIFSIASGHLYERFLKIMILSVLKNTTRPVKFWFIKNYLSPQFKDVIPHMAQEYGFEYELITYKWPTWLHKQKEKQRIIWAYKILFLDVIFPLSLEKVIFVDADQIVRTDMGELYDMDLKGRPLAYTPFCDNNKDMDGYRFWRQGFWKEHLRGRPYHISALYVVDLAKFRETAAGDNLRVFYETLSKDPNSLANLDQDLPNYAQHTVPIFSLPQEWLWCESWCGNATKSKAKTIDLCNNPMTKEPKLQGARRIVSEWPDLDLEARQFTAKILDDTESRAEL

SEQ ID NO: 4632 - protein, 1537 aa, Tieghemostelium lacteum
MKRLLLIFTLVTLLSINIQCSDLESSKLVHVSLLSNWGFTPLHYESAEFINKQDKKLYWKFIDSFVDTINSKKREQLRDKDIYELILQSSRDVVDSNTFEFLKLNLAQRTMSPKVEVYRQLSIAEKPKDGVHSDWFVYNGKMYTDSKDIDSLDLSESLVGDNDHQILYEFDHVYSGNVDSTLPILILYGDITTEKFQKLHQKAKKFSDEKKVNYVLRYVISESSDKVYLQGYGFELALKNLEYKVMDDSSIKKDADGQSQKSITIPNEDVSGFNFFKLSTRKPELLQKLSTFRSFLLAHSQQFDELKVWELKDLGIQTAQKVISSSDPLRSLKYISQHFPTLANSLARISVNETLKKQMESNQKFINPQESLVLLNGRVINTETINTLTLTDMLQEELQPLTQIQSLGIQTEKISQLCDKASVDPDIRYRVLPEDLDAIIYLNNMDSNVAKGWTKSLEGLGKDTLDENGIQIARNLLTTVMVVDPSNTDAVSLLSDLSEFNQQVTSPSRFGFIFSTFNKPKQLDAASPKEIARLFIYIKNKAGLNPTLFLFRAMNYYRRMFSPGYISKAVMTHSIQAIAQQYRSVDTRSMNQAMQSVDHDITLQEMNNFVQNQMSIASDSAPLVFLNGRVIDLTNPKMEFSDQLLLQLANEFNQLKPLYTSGDITEDSSNLYKDILESKHWISVQGSKLLDTMSSDLITPEPTQYLKLLFNSKDSQLEKDYGKLLKDAIYYPAESKDTIYPITHLIIGDFDQKASRDLVLNMIEYQLNPENQEISSNVRFSIINCPMESSPNIFGKYLLSVRSQIKSLEDLKREFEKKLTDIIYKYSESNENLFHLQTRYARDYLRVNITENVPVVIVTNGRLTEIKNPSQSIKTIHNLNVMELKKSKTSLEILTGTEKLDNNLMMVAQSMVSNHMKNPNIERRSIPNSIEFSFRVINTQSPMKFTLVLNPFTKVAQKIVPIVEAFSKTLNISVDVLVNPPVSISEFPMKNYYHYVMQLDMKFDDKTGKLLSSQTSGTITNLPESRVLTLAMDIPGSWLVQPIVAKYDLDNIRLKDLGQENVLNAVFELENLVVEGSCLDVTLRGPPAGLEIELTPVGNSLTETQDTIVMSNLGYYQLKSNPGIWKLSLKPGRSSDISQIYDSDKEITLDHQSVIIDQLYVPTGNLYIRRKKGKEYESLIQEDEEPKQPQATKEPPSLWSSFFPKKKSIEEKKKEIQTVKNSDPELIHVFSVASGHLYERFLKIMMLSVTKNTDSPVKFWFLKNYLSPGFKEFIPKMAEELGFQYELVTYKWPWWLRKQTEKQRIIWSYKILFLDVLFPLDVKKIIFVDADQVVRTDMKELWDMNLQGASLGLTPFCDSNKDTEGFRFWKTGYWRDHLRGKPYHISALYVVDLQKFRRITAGDQLRATYDQLSRDPNSLANLDQDLPNYLQHQVKIFSLPQEWLWCETWCDQSSKSKAKTIDLCNNPLTKTPKLQNAVRIISEWTSLDNEAKDLDLKFDKEKEKNQQKQQIQKDLEKSKIDLADLISDTLNEAQKLI

SEQ ID NO: 4633 - protein, 413 aa, Aphanomyces astaci
LPDQHVIYVNGRPLELVAPVTPSLFDGLVAYESATRSKVVSKAYVSQFKHHVLTAEDAADKTLQLNVVLSMVDSYLKTPRVAAVLPDDVQRPTYSYVTPSGSSSLDVVAYLDPLSDTAQRASGILRMLHSVLHAKITLVLVPPPSYDEFPLKRFYRFLWGGTSSSLVEFDRLPRHPVLTLNIETPELWNVQMVQSDVDIDNIQQNASATFTIKDVLVYGQCVDKTNAQYPTLPNGLQLVLERSVAKLHSHKDTVVMKNLGYFQLQAAPVPVIVYDFLSKTLQLEVKKQPGQEGVRLLDDGPEAPKAPAQPEETSVWTSLVQWGAGNFKNSVAALQAEFGMDIRLVTYKWPNWLRRQTDKQRIIWGYKILFLDVLFPLGVDKIIYVDADQVVRADLKELWTMDLQGKAYGYTPF

SEQ ID NO: 4634 - protein, 2233 aa, Volvox carteri
MNATRPLKVGVVGGSISWGTGATMRGERDWFSLFMSWLASVSSYPVTGRNGCIPGTPSHYMVLCLEHSVDVDLDLVLVEYVFNDGLDDCDCIRNNGVVKSVEQLLRKLMDLPSRPAVVMVQVPHVRSKDFDPFFRTSEDLEGALAAYYDIPTVSLRDALYPLNVHRPTEGFLWNQTYNEHHPGDAGHKALADIVVHLIQETALGLLSYPPSREEAAKLERPLLPPMYTGNLPPSTSVCLVGHTFTSLVTYAQGWSWVNEGTEEKPKWGYVATEPGSRLVVRLPDTLPPGGRHAAAAAVPVLLHYLQSYAGMGKARVECGGGGCNCSTVVVDALHLGRSSQTYMALVMVEGLGLMAGEGEAGTKREGDDGAAAPAGCELSVTVLEETSSILDGGHKFKAEEDAALIWPFLDRMSSLSPDATGTDLDDAACWRSITETAAELVSPSVGKLIPLTLGSRQYGAKLQMVRQLAEQFHPHEVSTATASCCFVALEGQVATTPQQLADLLTSSSSSPSSSLSTSSSSTNPDSEQLFSFEHIYRGKATGSLGGAETSRVAILYGSPGLPCFGPLYEQLKTAVDEQSVGDGSGGGNGLMFAFRPLLTTTCEPLSGCARAGTGGQLLLPGWGVEAALKNTEYSAMDDKEVARQRQQQQQQGGTEGSGDDEEGAAEEADFGSGDDAVVKGFRLDVLAARRPDLRSELLTFRDQLLAADDEESAELKVWDLRDVGLQATQRILGSSDPLALLAEISQNFPGIVSSLSRQVVSSSLKNAVTHNQQMVSAGANFLLLNGLAVDVNNLDFFGFLSRLRSEMRLRDSLVGAPLELSPNLAKQVLAARAEDGAAAGAGGGGAGGEGEPRLSLGSTSSAMSKHVAFLNDLERDPRFQRFGRNLAELLNTFPGRLRPLARNVFTSVVVVEPLCSESLELVANIDRMWQGGYPIRFGGERFGRGFATLKEAFGPAAAWRMWIDAAEAVTSGYYSDPQEVVEAAFTSAWGAAARSPPPGTRAKTAARKSTSDALKMLKEGSGYAAEVGMQLMETASWLMIKGLVAPPPAAAVAAAATPAADRDEDAERCTAPPVVWMNGLTAKAGGSSPAEDIMYKVMGEMQRLQEAIYFGRMDDNSGGGDALAAVLEMFGAVERLNQRIVGPKARNAQVLNLVPLLRHPAHETLRMLYRESGSEDGDGTPYVAPVTHYVAADLANEEGRQLVAESLRLLSEVLPSSSSRDCRLVLVANPSQPAAAPSLLEALVEGGMRQLESGGRDKPLAPLHSTHPGSHFPISTSSNMHGLDVVSYLSRLMSDSALAAGSGGEAAGGGGEVEEQTQEAIKYAEEAGLDGEAIKSFLAKAVDESLTYRAVQADLCRTVFKLEPGAAAVISNGRVTPVYKPSEEHSLPNIFVPTKPSFQIHLELLAEDLSLLQRVTSGGMAGSVAKAVERAYSEGLQRLPADLPSGVSASDALSEISSTVVSALSAASRAAASAGSQEGSGGASRLGPGASLQLQQMMAMLKRKAVEVSGGPDPPFHLEAVLNPLSRSAQRLTSLLLVLREALGPSMSLTLNPQKDITEMPLKSYYRRVQEAGLGGQGGKLRGAARVYALPSGLAPGSGPPGPPTAYFSRLPARRVLTLNLDAPEAWLVEPAAALYDLDNLRLEDVAGEVAFAEFELDALMLTGSCVDVTASGRMTPPRGLQLHLGTPTQPHTVDTLVMANLAYFQLKAAPGRWLLSLAPGRSRDLYLLQSSTGTSRDVFAEEEEGSGEAERVAGALVRTGGGGGGDDVSTQVLISSFMGKHMILRVRKRPGMEAEDVLQADGTADDAYDTWDPDLEDDEYADDDDDKAPPAPSSGGLLGKVSSLLSGSAKGGSGGAGGELAASKKQRQLRGGDTINVFTVASGHMYERLQKIMILSVLRHTKSRVKFWIIKNYMSPQHKQVIPAMAEQFGFDYEFVTYKWPHWLHKQTDKQRLIWAYKILFLDVLFPLGVDRIIFVDSDQVVHADLAELYHKDIKGAPYAYTPFCDNNKEMDEYRFWKGGFWRDHLQGKPYHISALYLVDLKRFRQIAAGDQLRVLYDQLSKDPNSLANLDQDLPNYAQHSIRIFSLPQVWCGVVWVGDFGAGFRNRDVMGMCEEWLWCESWCGNVTKAKAKTIDLCNNPKTKEPKLTAARRIIGPLWEELDRQQEEVTRMVQSMLEAREEAGPPGSALPPPQPPAVGEPAGHGQEEEGLDMSWEAADQRHESHHASDRTEL

SEQ ID NO: 4635 - protein, 1324 aa, Lachancea thermotolerans
MLLWTLLVWSYAIFASCTTVRLSNASSGVKLRLWNAVVGLVNDEQLVQDLYFLIAGVSDELDELKTDSTPLDQIVEALARHNPELASLLSLRYALEPGFSNDTSNQNYFLLNNKRFENADDIFYLKTDDLNAQKSACINDVLDNEDVVMGSNRDAPVILFYGCDRVEDWEEFNRNLYMEAQAGKVRFVWRSTCPNDLPFEFEPSAVALTVKGSQWNTEFGHALDVPESLVLGTEPSFRAQQVSDEQLQDLDMKVGTLVYDFYEKSQNATETIRYFRQIVNNFPVLARSLAEQGDITIDNRWEAALKKLAKEGIDNTMLGLFVNGQFHKLSNLNKWSVLQSVILELQRVNFLMDLLQKYQNITPGESLVLAKKLLNTFSKRSLTTQQLLQPVKYDLHRIPGFSESIIYFNDIELDSDYAEKLKDDIAMFFEESEFGELPAYRENWNEIVFVIDFSDLRSKDTWEALQGLLRALQVVKKGYPQRIGLLPFSTSAQDHGVLGKIYELKQNKPLETLVSYLEDLSPIERPQQSVFQKLPPVLEIINDRLKINETSIVINGEIYPFKSNLWNYLVSKVLKKDVSFIKSELLRINTKNFKAREILHAKSFIERNKKYAPDYFEDATYSNTNVTALLSLAHRIVETSTGGGLNTIHTVTIVEDFNTPLGLQRLIHLLQIKLHGVRVRAVHSGLLGKNWDKLKFTISNADTSKLQNYLRSLKSNGECNYIEPAIVGQWLLDLPRKILQRTSYLAVNGRFIHFEQGELPTIYEYEMIVQREATRVLDAVASLQEVFPDSLKEPLDPNYVEMVSAVLAKMFYDGERLYNNGIDFTAEASISRINLGELLPSESFGAFQTSEEPRKVEVTLILDPLEERTQNLLALASYLGSLDFLKLQVVLMPTTDLKVFPNHRLWIEGEKDLSIIDTRKFYVDVEVPPYLHVGERKDNVFELEYIKVEVNAFENKEEPSKGLVEGIGNVCLNLLNANHEVIDTATTTDTFGYTQFRLRRLEQGLTIESCSSNYRVSSFTSNSKADYIASDHFDVTSLAPTRLYVRLEKTQGMLPEVSEDNRIINILSIIENAEDEVSFEKQASSVMRSRGSFDTKFWIILGEEPSASFLSFVEFMTAESAGEVTFEYLTVDWPRWLRPQRFRPRQLAAAKVMMLDTLFPKGVTKVVYMSPGARVPNITELWEYDFDSVFCAPRAYQRDGTPYWKQGYWRNFLSKNNLKFHATEPLFIVNLGKYRQEHAGSKFRIHYQRLSPGINFLVQLDQDLLNDMQTLFPISSLNKRLLKVAPHLQTLDDNLYQSLQEKFNAKKSGQKLEDLSETIVHDEL

SEQ ID NO: 4636 - protein, 1472 aa, Neonectria ditissima
MLRLSKLPWSLAAALTVALQAAAAPSVNVGMDAAFPSAPYLLELLETAAGENETSYFPLLDRIASGHFATAATDEELYNQFLQILQQDGHISSPDALSTFKLALSLRSAAPRIEAHYQYYSTAVEPAVSVQNPEQCPDWALLDSKQYCSPSLTTAIETGLTSTQLKTLPFDRILGVGKEAILYADPTSPSFGSYHDALSKAAQKGELSYRLRYRRSVDASDTPLSVSGFGVELALKRTDYIVIDDREAPQDSEQKPVAESVVLDGDEEVADLKPLSTTELASLGLKTASFILNSENPIEALVKATQDFPKFSALIATHEISEDFAAEQQVNVANGVPTGIGILWMNGVQLIDRQIEPFQLVDMIRRERKLINGVRELGFNGQQAISLLGHPTIAGAKSEDEPMRFDWTDRSEEGKVLVWLNDLENDARYASFQKDLMTLLQRSYPGQLPKVARNIFHLVTPVDFTNVEDLAAAAQFSSFMARGVMLRFGLVPLTSTPEAVAQAKIVYHLIETYGVETLLAYLQKYQDSSSNGPDAKSFAKAIEGQETDLPKLTFAEVLEAESYAHQVKLSQAWVNRLKADTPVRPLFANGLAVPREKSWVQTMSMRLTEDQQTVQQGVYLGTIDDETWLPGVFLQNAMATRNTYIFPDDDKAVRILDVGKLYNEHADLFSSIPVLESSKESTKEDWALLTVIADLDTEAGQDLLLSALQFRHGNPGVRLDVIHNSASSSSSSVNSGLKTAGPELANVRSKEELKTLFTSRDDAHETRHAKALAKFLPYAKLLPGTQALILNGRLVGPIRSGDSLGVDDFQQFLSFEQKSRILPIYAAIEDLGFGDKLSDPVAAAKLTSITALSTISELPEGIFDSAPAVRNTLYNTWDSTHTAIEVGDPETASIHIAGLLNPTSEQGQRLAPILKVLSELDGVYLKLFINPREVVAELPVKRFFRYVLDSKPSFDESGNVKGLRATFKGLPSEALLTAGMDVPPAWLVAAKASVQDLDNIKLSSAKGDVDATYELENILIEGHSRDGKRGAPKGAQLVLATEKDPLVTDTIIMANLGYFQFKANPGFYNIQLKEGRSAEIFDIESVGAQGYSAVPGDEGTDVALMDFQGTTLYPRVNRKPGMEEADVLDESESDGGIVAKGLKFAESILGSSKSAKSISAKEHAEINIFSVASGHLYERMLNIMMVSVMRNTKHTVKFWFIEQFLSPSFKEFIPHMAAEYGFKYEMVTYKWPHWLRQQKEKQREIWGYKILFLDVLFPLSLDKVIFVDADQIVRTDIMDLVNHDLEGAPYGFTPMCDSRTEMEGFRFWKQGYWANYLRGLPYHISALYVVDLHRFRQLAAGDRLRQQYHALSADPNSLSNLDQDLPNHMQFNIPIHSLPQDWLWCETWCSDEAQASARTIDLCNNPLTKEPKLDRARRQVPEWTVYDDEIAALDRRRKALPLSSEADKSAPERNTKSRSWEDDRQGHAIDEL

SEQ ID NO: 4637 - protein, 1516 aa, Colobus angolensis
MAPAKATNVVRLLLGSTALWLSQLGAGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYGEMGTRTFSAFHKVLSAKAQNEEILYVLRHYIQKPSSRKMYLSGYGVELAIKSTEYKALDDTQVKTVTNTTVEDETEANEVQGFLFGKLKEIYSDLRDNLTAFQKYLIESNKQMTPLKVWELQDLSFQAASQIMSTPVYDAIKLMKDISQNFPIKARSLTRIAVNQHMREEIQENQKDLRDRFKIQPGDARLFINGLHVDMDVYDSFSILDMLKLEGKIINGLRNLGINGEDMSKFLKLNSHIWEYTYVLDIRHSSIMWINDLENDDLYITWPTSHEKLLKPVFPGSIPYIRRNFHNLVLFIDPAQEYTLDFIKLADLFYSHKVPLRIGFVFILNTDDEVDGANDAGVALWRAFNYITEEFDISEAFISIVHMYQKMKKDQNILTVDNVKSVLQNKFPHANVWDILGINSEYDEERKTGASFYKMTGLGPLPQALYNGEPFKHEEMNIKELEMAVLQRMMDASAYLQREVFLGTLNDRTNAIDFLMDKHNVVPRINSLILYANQQYLNLISTSVTADVEDFSTFFFLDSQDKSAVIAKNMYYLTQDDDSKISAVTLWIIADFDKPSGRKLLFNALKHMKTSVHSRLGIIYNPTSKINEENTAISRGILAAFLTQKTRFLRSFLGQLAKEETATAIYSGDKIKTFLIEGMNKNAFEKKYNTVGVNIFRTHQLFCQDVLKLHPGEMGIVSNGRFLGPLDDDLYAEDFYLLEKITFSNLGEKIKDIVENMGINSNNTSDFIMKVDALISSLPKRASRYDVTFLRENHSVIKMNPQENDMFFDVIAIVDPLTREAQKMAQLLVVLGKIINMKIKLFMNCRGRLSEAPLKSFYRFVLEPELMSGANDVSSLGPVAKFLDIPESPLLTLNMITPEGWLVETVHSNCDLDNIHLKDTEKTVTAEYELEYLLLEGHCFDKVTEQPPWGLQFTLGTKNKPAVVDTIVMANHGYFQLKANPGAWILRLHQGKSEDIYQIIGHEGTDSQADLEDIIVVLNSFKSKILEVKVKKETGKIKEDILTDEDEKTKGIWDSIKSFTIRLHKEDKKEKDVLNIFSVASGHLYERFLRIMMLSVLRNTKTPVKFWLLKNYLSPTFKEVIPHMAKEYGFQYELVQYRWPRWLRQQTERQRIIWGYKILFLDVLFPVAVDKIIFIDADQIVRHDLKELRDFDLDGAPYGYTPFCDSRREMDGYRFWKTGYWASHLLRRKYHISALYVVDLKKFRRIGAGDRLRGQYQALSQDPNSLSNLDQDLPNDMIYQVAIKSLPQDWLWCETWCDDESKQRAKTIDLCNNPKTKEPKLKAAARIVPEWVEYDAEIRQLLDHLENEKQDTILTHDEL

SEQ ID NO: 4638 - protein, 1512 aa, Ochotona princeps
MAPAGHTVRLLLRSALLCFSLLGAGPASAAKAVTARLAAKWPETPLLLEASEFMAEESNEKFWQFLETVKELAIYKNAESDYSYYNLILKKAGQFLDDIHINLLKFAFSIRAYSPAVHMFQQLAADEPPPDGCNAFVVIHEKHTCKINEIKKLLKKANSRPRPYLFKGDHKYPTNKENLPVIILYAEIGTRAFAEFHKALSKKAQNAEILYVLRHYIQKPSSRKMYLSGYGVELAIKNTEYKALDDTQVKAVTNTTVEDETGADEVQGFLFGKLKEIHSDLKDNLTAFQKYLIESNKEMMPLKIWELQDLSFQAASQIMSTPVYDAIKLMKDISQNFPIKARSLTRVPVSQQMREEIKQNQKDLQERFEIQPGDSRLFINGLRVDKDIYDPFSILDFLKSDGKMMNGLRNLGIDGENMSKFLKLSSHDLDNSYVLDIRHSSIVWINDLENDGLYVSWPTSCQEYLKPQFPGSVPSIRRNFHNLVLFIDPTQRYTSDFIKVAELFYFHELPLRIGFVFILNTDDKVDGNSDAGVALWRAFNYIAEERDVSEAFDSIVDMYQNVKDKNILTVDNVKNVLQSKFPHAEVGDILGTYSQYDKERKAGASFYRISGLGPLPQALYNGQPFNHKEMNRKEMQLAIIHKMMTTSIDLQKDILTGTLHDRQNAIDFLMDKDNVVPRINSSILNIQQQYLNLIPSTVTADIEDVSAFSFLDSHDKSAVIAKNMFYVTQEDDVISSVTLWVIADFDTPSGRKLLSTALKHMKTSVHSRLGVIYNPSSKINEDNTAICRGILVAFLTQKSNSLRNFLGKLAKEETATAIYSGHKIKTFLSEGMDKNAFEKKYNTIGMNIFRTHQLFCQDVLNLRPGETGVVSNGRFLGPLDKDLYVEDFYLLEKMTFSHLAEKIKGIAETMESNSKNVSELVMKIDSLVSSLPNFGTRYDITFLKEDHSVVKINPQESDMFFDVTAVVDPLTREAQRMAQILIVLGKIINMKTKLFMNCRGKLSEAPLESFYRFVLEPEVMSGPSDSPSLGPVAKFGDIPESPLLTLNMITPEGWLVEIVQSNCDLDNIHLKDIERAVTAEYELEYLLLEGHCFDSVTEEPPRGLQFTLGTKNQPVVVDTVVMANLGYFQLKANPGAWILKLRDGKSEDIYQIVGHKGTDSQPDLGNVTVVMNSFKSKVLEVQVRKKQDKIKEDILSDKEEKKKGMWDSIKSFTRRLHKEDDKNKDVLNIFSVASGHLYERFLRIMMLSVLRNTKTPVKFWFLKNYLSPTFKEVIPHMAKKYGFQYELVQYRWPRWLHQQTEKQRIIWGYKILFLDVLFPLAVDKIIFVDADQIVRHDLKELRDFNLDGAPYGYTPFCDSRTSMDGYRFWKTGYWAAHLLRRKYHISALYVVDLKKFRRIAAGDRLRGQYQHLSQDPNSLSNLDQDLPNNMIYQVAIKSLPQDWLWCETWCDDESKQRAKTIDLCNNPKTKEPKLKAAARIIPEWVEYDNEIRQLLDQLEKKKENAILGHDEL

SEQ ID NO: 4639 - protein, 1625 aa, Sesamum indicum
  MOD_RES (258)..(258): Any amino acid
  MOD_RES (1271)..(1274): Any amino acid
MGTLFRSGFCFLILVILCICLSGHSVSAQNRKPKNVQVALRAKWSGTPLLLEAGELLSKEWKDLFWDFVESWIHSTNVDSDSNTAKDCLKKISRYGKSLLSERLASIFEFSLTLRSASPRLVLYRQLAEESLSSFPLADDVISNTIDGGISEPNDTTKTANSEAFLLGMNPESPGNKCCWVDTGGSLFFEVGELQMWLQNSDDVKDGAFQQPEIFEFDHVHPDSTAGSPAAILYGALGTECFKEFHIALSNAARKVQXIVRSVLPSGCEAKSASCGATGTGEPLNLGGYGVELALKNMEYKAMDDSTIKKGVTLEDPHTDDLSQEVRGFIFSQILERKPELTSEVMAFRDYLLSSTVSDTLDVWELKDLGHQTAQRIVQASDPLQSMQEINQNFPSVVSSLSRTKLNDSIKQEIIENQRMIPPGKSLMALNGALINIEDIDLYLLVDMVHQELSLADQYRKFKIPPSAVRKLLSVLPPSESYAFRVDFRSPHVHYINNLEVDAMYKRWRSNINEILMPVFPGQLRYIRKNLFHAVYVLDPASLCGLETIDMMISLFENNLPMRFGVVLYSTKLVENIEANDGELPVAHLKDDQEDISSLIIRLFIYIKENHGTLMAFQFLSNVNKLRTESAADDSPEVHHVEGAFVETILPKAKSPPQDTLLRLEKEQKWNELAQESSLFAFKLGLTKLECSLLMNGLVSEPNEEALINAMNDELPRIQEQVYYGQINSHTDVLDKFLSESGIQRYNPKIIAEGKTKPKFVSLCASVLAKESVLNDLYYLHSPETMDDLKPVTHLLVVDITSKKGMKLLREGIRYLIGGSKNARIGVLFNSNVDATLPSLFFMKAFEITASSYSHKKGVLRFLDQLCSFYEQEYILASGVAESYQALMDKIFEIADANGLPSKGYETSLSGFSAEILRSYLNKVTQFIYRTFGLEFGANAVITNGRVIRLSDGSTFLNHDLHLLESLEFKQRIKHIAEIVEDIKWEDIDPDMLTSTFISDIVMAISSSISVRERSSESARFEILSAEYSAVILQNEDSSIHIDAVIDPLSPSGQKLAALLRILSKYIQPSMRLVLNPVSSLVDLPLKNYYRYVVPTMDDFSGTDHTVHGPKAFFANMPLSKTLTMNLDVPEPWLVQPVVAIHDLDNILLENLADIRTLQAVFELEALVLTGHCSEKDQEPPRGLQLILGTKNTPHLVDTLVMANLGYWQMKVFPGVWYLQLAPGRSSDLYVMKEDGEGAQGTTLLKRIIIDDLRGKLVHMEVMKKKGMEQXXXXQPGTQNSWNSNILKWASGFIGGKDQSQKEKSSSLEPGSGGRHGKKINIFSVASGHLYERFLKIMILSVLKNTNRPVKFWFIKNYLSPQFKDVIPHMAHQYGFEYELITYKWPTWLHKQKEKQRIIWAYKILFLDVIFPLALEKVIFVDADQIVRADMGELYDMDLRGRPLAYTPFCDNNKEMDGYRFWKQGFWKDHLRGKPYHISALYVVDLVKFRETAAGDQLRVLYETLSKDPNSLANLDQDLPNYAQHMVPIFSLPQEWLWCESWCGNTTKPKAKTIDLCNNPMTKEPKLQGAKRIVAEWPDLDFEARRFTAKILGESIEPQEQPPPPPKIETTSDNSSEDEESRAEL

SEQ ID NO: 4640 - protein, 1731 aa, Nothophytophthora sp.
MSLERTQIKIGAGTRGSRQSKDNEEENDDGAGEKRRLGGAAVVFTDIVGVGEGDQREPDGQLAQLAVFPASGDQVRPSKRESSPSYLSRACWSHVNRCLRVSSEFLAEENPLYFWQFLEKLETRTASIQQLNGDVDALAKLAIAVAEDIAPESKNVCLPLYLVLPILELMLATRTYSVKVEMFRQLALDSGVRPCGADAETWAVFYREPHCVEAVACSVDELEALLHGENQTKTGEEACVAAGVNDVELAVDHKYPHLAPSAGPLPVSGILYGLLGTPTFHTFHEKLAALARINEMQYMVRHYPRDSPLETLLQGYGVALDIKNMEYKTIDDSKKTGEDAELQGHADEEEDEDDDDDIDDEEVEGFLFKPLMQRHGAISEELKRFYDVLIKQGDDDQQEIKAWHLKDLGVSAARAILDAKNPLKKMQTLAQDFPLQAKKLAFSRKTLSVAFRDEIETRRQQAANKKLKNKFILNGIAVDPMERSFNVFDLMKTLKEEWSVAKQLGGLPLEQSELDAMLANVRDTSQEQPAVRIHVRGALDGSTPLYLNNIEMDPNSARWSPEVDTLRRPAWNLIFLRKNMYEYVLAFDPLTSAGRTALGHVGFMRMRGAPIQWGLLVSSKELMASKTSEDRRALVEAYKTLTTDDKATAWHFTKLLMLAQSKDAAEGDIANGVGEETEGQEAETETRKDQIRPTTIAAAFLQGVADDGSPDVLISGLLSAYAEATSSVGTIAENGVKALELLQSERFDDEVLAMTEFIHLKHLSLGWSLFNGVLQKTLDVQKSVMGHFGRDQPLYVAMAHQDALNDDMDLVEELMASQGVYPAYLSIFEKPEAKHPGDAEIPAPKHLLADDVDGRLEAALRSAVSYLHAPGSRALPKKQTVLFPADLSDPRDAGHVYRVIKAVLENSEQDLRVGVVHRVKPETSTADEKDEPEVGELVAAILAAVGDSDQESHLKFILEALNCVAKQKTVDATRAKLMATLNKMTKDKDAVFEKVRALLKSNPGKWLTSDQRDAMVQCNMLLHSRFPPATADESDDETAALLVPHLFINGRRVDLPPQSLSDEDVATIVSFDLKYRTQPVAKALIKRSATLSISEADELSFTIVRTTGIVDKYVKTPRTSRLDVGEDSLNSVRLSGDPSLQVAAYVDPLSEASQMMSSMLLMLHSQLNATVELVLLPAAELTEFPLQRFYRYLFEKQPSLAATNVEFRKLPVQPILTMKIETPEAWNVQILHAGDDLDNLRVDPDSPVEVKATTSAVFRLESLLVYGQCRDMTFNMYAPPNGLQLVLERELGVKRMHRDTLVMKNLGYFQLQATPGVWSLHLARGRAAELFDIIDPDSDLPLEAQDVSVYDFGSHIMQLMVRKKEGMELEELLESVDQEEQSKKVKKTKEDVEPIAEDAGVFGSYWNSMLSLMGKKSEDAAKPQQEAAMEGDSVSDEETALVPSGARSGETIHVFSLASGYLYERFIKIMMSSVLKRTNNPVTFWLLENFLSPDFKSSIPVLREQFGMDIRLVTYKWPNWLRQQTEKQRIIWGYKILFLDVLFPLGVQKIIYVDADQVVRADLKELLELDLQGKPYGYTPFCDSRNVGFQFWRQGYWKEHLRGKPYHISALYVVDLTLFRQMAAGDMLRAVYSQLSADPNSLSNLDQDLPNYAQHQIPIFSLPQEWLWCESWCSDETKATAKTIDLCNNPKHKEPKLDMAKRVIAGELFNESWIELDQEIKDAEARFATTA

SEQ ID NO: 4641 - protein, 1622 aa, Eumeta japonica
MNNTGFLKTAFIFSTFLISLVTAEPDTLKKSKSVTTFVNAKWESTSLVLELAEYLALESVDLFWAYVDDVNSLKTSLELLKTDKEKYDSCIGVASGLLAPAQLRIAKLALSMHITSPSVQMFMEIANNNGARDVQCDTFVAIASRLICDNDVLRDVLKSSTYYDPEEHKLETYRLDHYYPSSNNKSLTAILYGELGTTDFSTKHKILADYADRGIINYIVRWNVKPQGKPKLRLSGYGVELQLKSTEYKSQDDSTPKDSEGNETFTTSEEEDENDPQNQIDGFNFGRLKNLFPALRTPLERFRRHLSEASEELAPLKVWQMQALSMQAAAAVLDAHDAGGDEALKVLTSIAQNFPMQTKSLIHVNVPRAFREEVLYNQDIWASSLGLRPAEPLLLVSGAQYDAEEVDILALLAALREDIGPMNTLHALGISKKLINTLMSLELGESYTWEEYGLDIRDTAITWLNDLETDDRYRRWPSSYMEMLRPTYPGMLRNLRRNIYNYVIVIDPISKLSIAPLKLGDTLLKHATPVRVGLVLAPIPDRSHDDAIIEAAVRSAFNFVAQEKNSNKEAFYFLSQLLDSSEQNLSLDQIRKQLRRYINSQDIDDIIAEDSEYNFGSQLTQEFVSKIGSNKFPEVLVNGVPLADEGGNSVTQSVELLEEALVGALSRHTGRLQRAVFRGELSDPDDAVEYLMKQSHIMPRLNRRVLASESSQYLDLSGTAASSEFFSEDKIHRLLHLTGRDALATALPLLRYFSKPGKPDKVTQTIWVIGDLNQKQSRDLLKNALIFMRESGAVRVAFIPNVDGSRTVDQSFNKVILAALAALEPAKATSYVVKLLDDEGCHERQDCDILPEIVPALNKYEWVLKAARVLCARSMHLRAGSRAVVHNGRIIGPFEDNEDFGLDDFTLLERYSNQVYADKIADVLDVKKKLRNEVTDDDDIEADAVLTPDTRLKLTAVLASRNPRVRTPLPVGLRTEHSMIDLRPIYDNEAAIEIVVVLDPASTAAQRLAPLLLVLRRVINCHVKLFLNPQDKNSDMPLKSFYRYVLEPELQFTQSGASTGGALARFSRLPHAPLLSMELRTPANWLVECVKSVYDLDNIRLADVETLVHSEFELEYLLLEGHAWDTTLGTPPRGLQLILGTRDRPDLMDTIVMANLGYFQLKANPGAWTLRLRPGRSEDIYEIVGHDNTDTPVGSTDIQVLMSSFRSHVIKLRVSKKPDKQHLDLLVENDDKNSGGIWNSIASSFGGGEESEAGDDTINVFSVASGHLYERFLRIMMLSVLKHTKSPVKFWFLKNYLSPSLKDILPYMAQEYGFEYELVQYQWPRWLHRQRDRQRTIWGYKILFLDVLFPLQVKKIIFVDADQIVRADLKELVDLDLGGAPYGYTPFCDSRKEMEGFRFWKQGYWRNHLQGRSYHISALYVVDLKRFRRIAAGDRLRGQYQALSQDPNSLSNLDQDLPNNMIHQVAIKSLPQEWLWCETWCDDDSKTYAKTIDLCNNPMTKEAKLSAAMRIVPEWREYDTEVKALMARVRRGLYQHQDHDQEFEIVHHEDTTSSEKDSNSVTVVLLGHESAELAIDAATPMIAAVAALEPLRAHRAPAAPAAQPRAPARVRAQRRVTPPKFK

SEQ ID NO: 4642 - protein, 1489 aa, Daldinia sp.
MIRRLFQLPCGLAATLLATLCLNSGHVIAGPSVNVAMRAAFPAPPYLVELLETAAGENATSYFPLLDRIADGAFADAKTDKELYEKFLQILKQDGHMESAEALSTFKLALSMRSAAPRIEAHYQYYDTAVAPSLEKAKTDCAEWVLMSGNQYCSASLAHVDGHISGDSQTRSLPFDRALGAGSEAILYADITKPEFGPFHKSLSEKARKGEISYRLRYRVDETEERESLPVSGYGVELQLKRTDYIVIDDREAESETDSAAKSTPTEVILDGEEEVTDLKPLSSSELVSLGLKAGSFIMQSEDPFETLIKLTQDFPKFSTSIAAHNASDAFVKEHRQNRALSVPAGMNVLWMNGVQLIERQIDPFTLVDSIRRERKLIEGVTSLGLSGKEAVSLLGHREVTSAKSSDEPRRFDWRDEIEEGRVIVWLNNIEKDKRYADYPKSLMALMQRAYPGQIPPIRKDIFNLVVPVDLSKPEDLSLVVEQLQTFIKRLLPIRFGLVPLTPTKIAEERAKIAYYSLENYGLSSFMSYLEACSNRDNSEQAHLDKAVKNRTLKDEATALSLKEILESENYAKQLKLANHWVERLNANTEVPPLFLNGLAIPREDNWLQIMSMRMSTDLQLVQQGLFMGTIDDDMWVPQLFLEGAATRRNLYIYPDDENTLIVLDVNKLYTEHKDLFEQVPVIEAGEETSKETWATLTVVADLSSQQGLRLLLSALSFRRNNPGVRLDIVNNALKSSSAHEINAALKQDVAKLLEIENLETLEILLSGPVDVQDDGYNAALSRFLTAAAVAPGAQFLILNGRVVGPFVDDSEFKESDFELLLEFEQETRILPVYKAADALGLADKITSPLTAAKLTSITALSTISDLPEGIFESAPTLRTSLFDKWNSTHTMIDVGDASTANIHFVAVINPASEIGQKWAPILKVLSQLDGVYMRIFLNPREKIEELPVKRFYRYVLESAPSFDETGKVKALGATFKGLPSEALFNLGMDVPPAWLVAAKISVHDLDNLKLSSIKTDVEAIYELEHILIEGHSREVTGGPPRGVQLLLGTERDPHFDDTIIMANIGYFQFKANPGYYNIHLKEGRSSEIFNIISVGAKGYNPVPGDEGTEVALMDFQGTTLYPRLERKPGMELEDVLEESSSSGGDDLISRGLKFAEGILGTKPKPKSVSDEEHAEINIFSVASGHLYERMLNIMMVSVMKNTNHTVKFWFIEQFLSPSFKEFIPHLAKEYGFKYEMVTYKWPHWLRQQKEKQREIWGYKILFLDVLFPLSLDKVIFVDADQIVRTDMIDLVNLDLQGAPYGFTPMCDSRTEMEGFRFWKQGYWKNYLRGNPYHISALYVVDLRRFRQLAAGDRLRQHYHQLSADPNSLSNLDQDLPNHMQFVIPIHSLPQEWLWCETWCSDESQKEARTIDLCNNPQTKEPKLDRARRQVPEWTVYDDEIAALDRRRRGLATDGDSQKVLTIGGDEKNTKSRTLEEKSDVKTRTKDEL

SEQ ID NO: 4643 - protein, 1481 aa, Purpureocillium lilacinum
MRPPALSAVVAAALTALPLAAASKSVNVGMNAAFQAGPYLLELLNAKKDLSETAAGENSSAYFPLLDRIASGHFASASSDNELYQKFLDVLRNDGHVSSPDALSTFNLALSLRTAAPRIEAHYQYYTTAVEPAVADSKCSDWILLDGKQYCTPAMDDVVKHDLSKSAIKDLPFDRALGAGREAVLYTDPASPTFGEFHAALSKAARAMTLSYRVRYRRSSVVDFRPLPVSGYGVELALKKTDYIVIDDRESDHGSQKPLGSDAVLNEVEDVADLQPLSASELGPLGLKTSSFIQRSTDPFATLVKLTQDFPRFAASLATHNVSQEFVAEAERNRANLIRGGINFLWMNGLQLIERQIEPFNLVEMLRRERKLIRGVRSLGLDGKQAVSLLGHESVSSAKGDDEPLRYDWTDREEQGRVIIWLNDLENDARYADYPKELASLLRRTYPGQMPPIGLNIFNLIIPADISRPDDIQFLSQVISIMSRGIPIRFGIVPSTSTPEASAHAKVLYHLIKNYGAESIVGYLQVLGERGTLTADEKILSAALASQELLPGGQTLSLQEVLATDSYAAQADLAASWTKRLRADTPTAPLFINGILTPRDKKWMQTMSMKIGEDLQNVQQGIFHGLVGEDTWIPGIFLKGAATRRNPYISLEDDKSLRMLDVSKIYEEHGRLLGQLPVFGAYADSSKENWAVVTVLADVTSDDGQDLMLAALEFKRNNPGIHLELLHNPADISTASRVNSLLKADTETVATIETKEALSKMIDSTADASGDEDFSAALSSFLSMARLGTGTQSILLNGRVVGPIAPGDPFTSDDFHHLLDFEQQRRILPVYKAVDDLGLTDRLSSPIAAAKLTSITALSTISDLPEGIFESAPTIRSTLYDSWNTTHTAIEVGDAKSADIHIVGLLDPVSEKAQRWVPILKVLSDLEGVYVKLILNPRDNIGELPVKRFFRFVMEPKPSFDASGNVAGLRATFKSLPSEALLTVGMDVPPAWLVAPKESAHDLDNIKLSSAQTDIDATYELQHILIEGHSRDDDGSPPRGAQLVLSTEREPLVTDTIVMSNLGFFQFKANPGFYKIQLKAGRTSDIYTIESIGAQGWEPAPGDEGTELALMNFQGSTLYPRLKRKPGMEEEDVLESSDRSASDSLVSKGMKFAEGLLGGSKGKEVSAQVHADINIFSVASGHLYERMLNIMMVSVMRNTKHSVKFWFIEQFLSPSFKEFIPHLAKEYGFKYEMVTYKWPHWLRQQKEKQREIWGYKILFLDVLFPLSLDKVIFVDADQIVRTDMMDLVNRDLEGAPYGFTPMCDSRTEMEGFRFWKQGYWANYLRGKPYHISALYVVDLRRFRELAAGDRLRQQYHALSADPASLSNLDQDLPNHMQFQIPIHSLPQEWLWCETWCSDDSLASARTIDLCNNPQTKEPKLDRARRQVPEWTVYDEEIAALDKRRKQAQASQPDPKDGTKAVNTKSRTLEEEPTSSHIKDEL

SEQ ID NO: 4644 - protein, 1488 aa, Hypoxylon sp.
MMRLLQLPCGLVATLLATLCLIPSYVVAGPSVNVALKAAFPAPPYLVELLETAAGENATSYFPLLDRIADGTFANAKTDKELYEKFFEILRQDGHMENPEALSTFKLALSMRSAAPRVEAHYQYYDTAVAPSLAQARDDCAEWVLLAGKQYCSAALAQSEGQITGDSQLRSLPFDRTLGNGPEAILYADIAKPEFGAFHNSLVDMARKGEISYRLRYRVDQMNEREPLPVSGYGVELQLKRTDYIVIDDRDSETETDSAAKSAPAEVVLDGEEEVTDLKPLSSSELAPLGLKASSFILQSEDPLQTLIKLTQDFPKYSASIAAHNTSDTFVKEHRLNRGSGLPPGMNVLWMNGVQLIERQIDLFTLIDSIRRERKLIEGVTDLGLTGKEAVSLLGNREVTAAKSDDEPRRFDWRDEIEDGRVIIWLNNIEKDKRYADYPQNLMSLMQRTYPGQIPPIRRDIFNLVVPVDFSNPDHLALVVQQLQSFIKRLLPIRFGLVPLTSTKQAEERAIYAYYLLENYGLAGLMSYLEALSTGGQSELSNFNQVIKDRTPKAEASPRPFEKIRESEDLTKQVELAKHWVERMNADTQSPPLFLNGIALSREGTWLQAMSMRMTADLQLVQQGIFTGQINEETWIPGLFIEGAPTRRNLYIFPEDDNSLAVLNVNKLYSEHSDLFNQVPVIEANEETSKETWATLTVVADLTSQQGLDLLLSALAFRRNNPGVRLDIINNPPASIKSHDINALLKKDVAKLLEVENLETLEVLLTGPVEAQDSGYATALSRFLATAAITPGSQLLILNGRVVGPFASGSVFKEADFDLLLEFEQATRMLPVYKAADALGLADKISSPLAAAKLTSVTALSTMSDLPEGIFDSTSTLRTTMFEDWNSTYTTINVGDASTANIHFVAVLDPTSEVGQKWAPILRILSELDGVYLRIFLNPKDRLEELPVKRFYRYALDSAPSFDEAGKVDPQGATFKGLPSEALLNLGLDVPPAWLVAAKISIHDLDNLKLSSIKTDVDAVYELEHILIEGHSRETMGSPPRGVQLLLGTERDPHFDDTIIMANIGYFQFKANPGYYNIHLKEGRSSEIFDIVSVGAKGYGAVPGDEGTEVALMGFQGTTLYPRLQRKPSMESEDVLEESADAGGDLLSRGLKFAEGILGGSKTKTKSVSDEVHAEINIFSVASGHLYERMLNIMMVSVMKNTNHTVKFWFIEQFLSPSFKEFIPHLAKEYGFKYEMVTYKWPHWLRGQKEKQREIWGYKILFLDVLFPLSLDKVIFVDADQIVRTDMMDLVNLDLEGAPYGFTPMCDSRTEMEGFRFWKQGYWKNYLRGNPYHISALYVVDLRRFRQLAAGDRLRQHYHQLSADPASLSNLDQDLPNHMQFVIPIHSLSQEWLWCETWCSDESQKEARTIDLCNNPQTKEPKLDRARRQVPEWTVYDDEIAAVDRRRKGLVADSEAQKVLQGGEEEVNTKSRRFEEESDPKTRTKDEL

SEQ ID NO: 4645 - protein, 1290 aa, Trichinella murrelli
MWVFPLIVVCFVSPVLVSPRKAHKNVIVSVRSKWPSTSLIMEASEFMSKESNEKFWQFIEAVIDKHQNSLGNKTDREVYNGILQIGDQILKSKARLEFLKLALTVRVHSATVEMHRQIAATSLDVQNGKSVYAVVHGKQISDLQQLDTILKHAEALARPVTYEFDHIYPGSKQGSVCVLLYADIENPHFKPWHLQLKKLVQRDGISYILRHYPKMNDDMVALSGYAVELAIKSTEYKAVDDSDKQTGSESGVSSSEEEVTDLNGFNLHLLEADELTPLKVWQLQHLSFQAGQRVILAPKEEALRVLRDISQNFPIMARSLTRMSINPNFKNEVEENQADAFSKLNIEPGDSAFFIDGIVIDLEEKDIFNLIELLKNEEMLISGLLKLGIRRKDFTLLYAMKGNDPNAEYAVDYTQWSPEYINNLESDAAYRNWGNSIHAILQPYFPGMIRPIAKNFFTLIFVLRLGDRASQNLLSTAYQMYEHVLPIRIGFIFVVNNDKSVSGYDDAGVAMLNAFNFIKEDRSVSKAVMFLIKIYNTSMRETISVEDVHKLFKSSYRDENLKSVFNSEEYNQGRSSGVDFIKESGLSMVPMVLMNGYPFTAEEISPEHIEEAILSKVMRFTVDIQKDVYEGNLKENMDVQQHLLKKPTVLPKLNYNILQMENIFLDMTDTSKYGAMSVEKFSHLDSSGKTQFIIESILYLTKNDDDILRPVTLWIVADVESDDGQQFFLNAIKYLKYSVDMRIALIHNPKSEAQATKGTASLVQACIQFLPLYQSKAVIGKIFANKITTLEDLINVSPSGISWPEFKKAYNSMSDIWMQLHVHYAKFVLNLDPGVGAIVANGKVLAPLSASDFNSLKDFNFIERYLLTSGCNDIAQHLKIIPYLDKSPKALSDLVMRLYAFLRRYNANEKRHWPIIENYHHSCIQIEASDPTAAQFDIVAIVDPLSPAAQKMSHLLVILSSVLNVHMKVCMNCKSKLSEIPLKNFFRMVLPRELEFADDGSLKAQPSARFSALPQKQLFTLNIIAPQSWMVESVEAVYDLDNIKMEEVKGDVVAKFQLEYILLEGRCFDERSGSPPRGLQFTLGTFHEPFMFDTIVMANLGYFQLKANPGAWILALREGKSAEIYEVKSVDGVVQNQTTSVVILDGFSGRMIHVKVAKKNDQLENELLAESEDAESESLWQSISKTFQSGEKYDVINIFSLASGHLYERFLRIMMLSVLKHTKTAVKFWLLKNYLSPGFKEFLPYMAGHYNFSYELVQYKWPRWLHQQTEKQRIIRSFLSMRIKLYERTC

SEQ ID NO: 4646 - protein, 1839 aa, Symbiodinium microadriaticum
MDHLAALGKLGELGCGPNEVLQRHPGRGPPARMSSEGWSHEAVKMLMAGQHVASMQLFPQYEIDALLAGLVDALAELHRSAGKVRLLQVQMPRQGDGCLSTRVPPALADRFHEVLVLFHMLPMFVLGTLSGQISGSGLVLCSTFDAVVTVQASFDFSSLSLDFPGVTDFLCPRLNQVVLPSSGIPLSAVQAKELGLVYDALHSEEQLQDLLARICSKLSECAPNAVAQSKAFIQKIGSMPMEPKVLGDLACHIAKRMQDPEFQDSIRQIVDKGHLPAHTRPANRVVPENLLSESQAPGPLIQQPIGAHVVQRCHATPLVCTGCPVSVRVLCLLLACGLQPTSVGLEVEVTVQAAWPAASLAAELLEGLAEVGRGATFLRALSGSSSSQWRQDAAKHADAALCCQGKSAYGRLLSLRARHSFSSAVVEAARGMERADRAILEEQGRLDAATCPIGQPWVMLHSKGGYTEVVCGKELAKLSKLVLTGSKPGTSMGRLSGAPRRSGLDHVLYEFIAEEDSCPELIGYGDLGDPSGASELLKALLEAADALATASSCGRVAFRHATPAGDAPPAVLGGYGLELMTRSADEVAKSKDDDSPQEAEEEVDGRCLREVSDPAESFHGIDIAAIAKHFPDSASALCRLRSDLVTQAEKPLLPWELTRLGARAAMRAVRLSNESSLEGLVSLGEVAQDYPSGWGRALSAGTSEDSQTARELMEDAEAIKGDDTLQVNGWQVPEKQRGLLPVLRAQLPLFRSAELLASSGISQSGAFALLRDARSGPAVPSRVNTGDPRTEKKGKVPSFLLDKQNPLLLGLGFVIDPCSRKQLKIFNAIIKRTLPAMAWLRLQSSTHSAATRLLVRFAEDHASEEENLCSEDAVKRIKGLYKKAFQQYQYEKAKKLKTSDDSSSLDLRFPSPSVSVNGKMIVGLENIEKLLEPEIQQEVQQISFAFQMMRTRPSMVPEKQILNFAYSSKHLHPSSFRIQPKLLTAWYPGISTSPIRHVPLRPDMLRKVPGGQLQGKSTRPYPAVHLAVLSSGQGGDSKLLQDLREVLGAFAALSSLSGSHPTPKRYLHIAITAGCSQPVGSPLPVSGALRRCVAAASTGGFDQLTQLLDALRAADVTAEMLLTACGASLPQKVLQEKAVTVVQEDVELCQAHLPILRDLGVLDGTMLLVNGRLFGPLELDGQSFTAGIVAHAEELELDFGPVQLQDGLVLAEDAVVKMLKQRAGSTEDYLLAFALAVRARSVVESFAARSGETTEEKSEEGEQLQDSHRKGVAEVMYERAPPGLRMHLAPREVSFGSPIRVYALLNPLGKGAQRLPPLLALLHQELNAEVFVTLRPVRLAESPLTGYFRTAAAPTAPEGGLAALGEWNGTMKGVRIELPPRRGQLLSVQLVAPDDWLCSPVDSAADLDSIPAHAPRGSPGAKVHVRYEVEALFLEGVAEDARGSPATGRQLALAPLRGVAETAGSNSVVVKSGYFQLRQKPGVYQLSLRSNEERLLRPKGLVQLADLAGRGSLLEARVGKMGLGEDAQASFFKANDSESTQNFEGAGGDPAECSETIHIFSVASGLRYERLLRIMMLSVRKHTKCKLRFWLVENFLSPRFRRILPGLAEQVGFAVSRVTYKWPTWLRGQTQKQRVIWAYKILFLDVFFPAEVKRILFIDADQIVRANVEELWRMDIKGHVYGFVPFCGSGPPESLTSHIWGSLTGKAAKQEDLKNPDTVGFRFWEQGFWKNHLAGRHYYHISALFVVDLEVFRQTGAGDTLRDVYQSLTADPHSLANLDQDLPNYIQANLPIYSLPQEWLWCESWCSESSKTNAKTIDMCQHPSKKEQAKPNDVVIAAL

SEQ ID NO: 4647 - protein, 1081 aa, Drosophila persimilis
MDLLRPTFPGMLRNIRKNVFNLVLVVDALQLTARSVIKLSESFVIHQAPIRLGLVFDAREAGKDNSEDYIAITCAFNYVSQKKDARAALSFLTDIYAAVGETKVVKKEHIVKQLTKEFSTLTHAKAEEFIEEDSTYDYGRELATEFVQRLGFSDKGQPQALLNGVPMPSNIVTADSEFEEAIFTEIMTHTSTLQKAVYKGEMTDNDVAIDYLMNQPHVMPRLNQRILSQEDVKYLDINGVAYKQLGNVAALNRLSNRDMTATVMENLKFFGGKKSTERIGRASLQFLTIWVFADLDTQEGRSLLTHALEYVQGGESVRLAFIPNTENVPAGDSKNLNRLAWAAMQTLPSAQATEQVLKWLKKPKEKIEVPSKVQDILGSTELHLKMLRVYAQRVLGLNKSQRLVIGNGRLYGPLSADESFDSADFALLARFSSLQYGDKVRQVLKESAQDVGADFTSDTLLKLYASLLPRQTKNRFKMPTDLKTDHSVVLLPPKQEKLPHFDVVAVLDPASRGAQKMAPMLILLRQVLNCQLSLYMIPVPQHSDMPVKNFYRYVVEPEIQFEANGVRSDGPLAKFSGLPANPLLTQQIQVPENWLVEAVRAVYDLDNIKLSEIGGPVHSEFDLEYLLLEGHCFDASSGTPPRGLQLVLGTKSETTLVDTIVMANLGYFQLKANPGAWSLRLRDGKSTDIYGISHIDGDNTHYDAGSSVVQVLITSLRSHVIKLRVSKKPGMQQAELLADDTDQAAQSGIWNSIASSFGGSNGNQAANDEDTETINIFSVASGHLYERLLRIMMISLLKHTKSPVKFWFLKNYLSPQFTDFLPHMAAEYNFQYELVQYKWPRWLHQQTEKQRTIWGYKILFLDVLFPLNVRKIIFVDADAIVRTDIKELYDLDLGGAPYAYTPFCDSRKEMEGFRFWKQGYWRSHLMGRRYHISALYVVDLKRFRKIAAGDRLRGQYQALSQDPNSLSNLDQDLPNNMIHQVAIKSLPDDWLWCQTWCSDSKFSSAKVIDLCNNPQTKEAKLTAAQRIVPEWKDYDAELKTLLARIEDHENSHSRDIDDDPVDDHVVVTTLPPPPEPKHGEL

SEQ ID NO: 4648 - protein, 1183 aa, Galendromus occidentalis
MFRDLCHNFPSVARSLSSIKVEDDLSSAMERNKRYFQGYLNLEPTDTALFINGLYFDLEVSDLFVLLDSVKQETKLLEGLHDAGFSAETIQKMMKLDLNSKNSIYAVDIRDSAVQYVNDIESDPEYRTWPKSLKDMLRPTYPGMLRSVRRNMYHLTIVGDPASPEAQDMFKFAESFFTHRAPVRIGFVFAVNQDLQVNGLNDGGVAMLNAYNYIAQNKKPIDGLAFITEVYASQADGYIEAESVCKLFRSKYPDTELDSVFGSESEYDTGRLLAWDFINRTGIGGDSPSAMLNGVLLKRENLKGEVFEEAVLTEVMKQTPKIQKAIYKGELVEDDNVIDFLMTRENVMPRLNERILNAPDKDLTTFVSLVGRETDIDASSLAELSSADMGASFAAKLKYVGQAKLSPLSVWVVADLESERGREIFGQALEHLENSHDARFAFIYHNKDHKVGELVESALDSLRPTEATSFLTKLFRNWKEIESGSLRAEQLVKNDKLNLLGEEAVRKTVQLHAAFATTLRLAPESRAVIINGKLLGPLGEDEAFTAGDFNLLEKYSMSLYGSKLRDLVKNSDSAMRASSVLQKYAQNKVRHDIKYATDKHAVIDTPAKLPQQAAHEITAIVDPASRGAQKLSQVLILLQRVMNANVKVFFNSAQGQKELPLKTYYRFVAHAEPQFGPSGELSAPRAVFTGLPSKPVLTLAMATPENWLIGATRSLYDLDNIRMADVETRVNAEFELEHLLVEGHCFDAYSGSPPRGLEFTLGSPADPVMYDTIVMANLGYFQLKANPGIWFLRIRDGRSSELYDVTSTENTEKCGEEVAVLVTNFRSKVLKVRVQKKSGKANEELLVEDDGDEDGIWNSITSSLGGRSKGDKENEEEDVINVFSVATGHLYERLLRIMMLSVLKNTNTKVKFWFLKNYLSPSMKDILPFYAEKYGFEYQLVEYKWPRWLNQQTEKQRIIWGYKILFLDVLFPLSVKKIIFVDADQIVRADLKELRDLDLGGAPYGYTPFCESREDMDGFRFWKRGYWSQHLGSRRYHISALYVVDLKKFRRIAAGDRLRGQYQGLSQDPNSLSNLDQDLPNNMIHQVAIKSLPQEWLWCETWCDDASKPQAKTIDLCNNPKTKEPKLVAAARIVPEWTSYDEELKSLIDTFELRRAKPTTPGEKTHKERAESDRKDAVFHSEL

SEQ ID NO: 4649 - protein, 1490 aa, Glarea lozoyensis
MAISSFPWGLTKALLASTYLHSLCASASPTINVGLQASFTASPYLLELLETAADENSTSYFPLLDRIADGYFSKSSTDKELYEKFLEILKEDGHMPDTESLSSYQFALSMRSAAPRIEAHYQYYYTAAEPSLAGARTESCPSWVLLNNKQYCSPALDTANADIEGNQQVQELQFDRIIGNISAPASILYADITSPTFGHYHKTLVKTAREGKTSYRIRHKKALSQNSDSHIFPGYGVELALKRTDYIVIDDREGEQETVEIDSEKKEVKFEDEEFADLKPLSSSELLGLGLKASSFILESEKPFDTLVKLSQDFPKYSSAIASHNPTKEFVAEHEYNRAQLVPAGYNVWWMNGIQMVDRDIEALKFLDMLRKERTLINGVRNLGLTGQEAIQLLSHENIANVKGENEPQRYDWRDDEEGGKVIVWMNDIEKDKRYEDWPTSLQALLQRTYPGQLPTVRRDCFNLVLLVDFTSPEDVHLIVEQLRGFVQRKLNIRIGLVPIVQSVHSLEQARVVYYLVDSYGLSTAILYLEKSLAAGKLSAPSKSVFEAAIEGRNPKPEKVTRAVSEVLKSDDYQDHIEAVKQWTVRLSTDSTIPPLFINGVVLPRTENWLQIMSQRVTSDLQAIQTAIFQDFFEHDSWVPSLFMASAAKRRNSLIVPEDEKNLKIFDVNELLVDNQDLFHVMPHIDVGTESAKEDWAHMTVVADLESEGGVKLLATAAIFREANPSIELAIMHNPSDGIVDTGFSYDLFARMEEQPAKIQTVNGITDMLSSEKSVEVEPIEQAAKAYWHQAAPFIKSLNLLAGENAILLNGRLVGPIPSSVDISNEDMIQLLSYEKSKRGVPVYSSMEALGLAEKISSPQDAAKVISMVAISTISDTPDGMFEQASTVRMAKFDIWNSTYTMIEVGDISSATIQMTVLIDPASEQSQKWIPILKTLSELDGVYVKLYLNPKDRLQELPVKRFYRYVIDSKPSFNEDGSLKALKASFTGVPQEALLTLKMDVPPAWLVAPKVSIHDLDNIKLSSVKSDVEALYELEHILIEGHSREVPGGAAPRGAQLVLGTERDPHFADTIIMANLGYFQFKANPGYYKIKLQEGRSEEIFNIDSIGAKGWSPAPGDENSEVVLMSFQGTTLYPRLSRKPGMGDEDVLESKTDSPMDFVSRGLNFAQGILGKGKSIETKTSENAEINIFSVASGHLYERMLNIMMVSVMKHTKHTVKFWFIEQFLSPSFKDFIPYMAEEYGFQYEMVTFKWPHWLRGQTEKQREIWGYKILFLDVLFPLSLDKVIFVDADQIVRTDMIELVNHDLKGAPYGFTPMCDSRTEMEGFRFWKQGYWKNFLRGLPYHISALYVVDLHKFRQIAAGDRLRQQYHQLSADPASLSNLDQDLPNHMQAMLPIHSLPQEWLWCETWCSDEALKEAKTIDLCNNPLTKEPKLERARRQVPEWTVYDDEIAAVDRKRKGLPVEGKNEKSRTMEVMIETPETKKKGDKDEL

SEQ ID NO: 4650 - protein, 1567 aa, Ostrinia furnacalis
MRFTGFLFSVITLFYVNNCLATNNDLPKREEKKAKSVTSFVSAKWESTPIVLELAEYLAGESSDLFWSFVDEINSLKSSLESLETDKEVYDACVGVTSTLLAPAQLRMAKLALSMHLTSPTVHMFDQISTQNGAKSVQCDTFVDIASRKVCDNDALRDILKSYDQYDPEEHKLETYLLDHSFPSSDNKSLTAILYGELGMTDFATKHKILAAYADKGAINYVVRWNVKPRGRPKLRLSGYGVELQLKSTEYKSQDDSNPKESEGADAPTASEEEDENDPQNQIDGFNFGRLKNLFPALRTPLERFRRHLSESSEELEPLKVWQMQALSMQAAAAVIDANDAGGDESLKVLASIAQNFPMQTKSLIHVNVPRSFRDEVLYNQDVWAQSLGLRPAEPLLLVSGAQYDAEEVDVMALLAAIREDIGPMNTLHALGLSNKLINTLMSLELGESFTWEEYGLDMRDTAITWLNDLEADERYRRWPSSYMDLLRPTYPGMLRNLRRNIYNYVIIVDPTSLTSGPPIKLGETLLKHATPVRVGLILAPGSEDSRLEAAVRSAFNYVAQERNSNKEAFYFLSQLLHPSQEETLNLEYIKKQLKKYASSGADLDDIIAEDSEYNFGSQLAEEFVSKLGTNKYPQVLVNGVPLSDEGSTPVTSSVELLEEALVTALSRHTGRLQRSVFRGELSDSDDAMDYLMKQPHIMPRLNRRVLGSEPSQYLDLSGVPSSTELFSEDKIHRLLHLSGRDALATALPLLKYFTKPGKPDKITQTIWVAGDLNKKDSRELLRNALTYMRETGGVRVAFLPNVDGDPETDQSLNKVVLAALTALEPAKATKYVAELLENEGCHERQDCDILPELVPALNKYEWVLKATRVLCARSLRLRASARAVVHNARLIGPLNDGERFTVEDFLLLERYTSQVYGDKMSEVFDKKKTLTNDVNDDDDDLSVDMSNEDRLKVISVLASRSPRVRTPLPVGLRTEHSLVDLPPRMKNEPSIEIVAVLDAASLPAQRLAPLLLVLRKVVNCRLKLFLNPQDKNSDMPLKSFYRYVLEPELQFTSSGALTGGALARFSRLPHAPLLSMELRTPPNWLVECVKSVYDLDNIRLADVETVVHSEFELEYILLEGHAWDTTLGTPPRGLQLILGSREKPELMDTIVMANLGYFQLKANPGAWILRLRPGRSEEIYEIVGHENTDTPAGTEDIQVLMSSFRSHVIKLRVSKKPDKQHLELLVENDEKNSGGIWNSIASSFGGGEEEAQDETINVFSVASGHLYERFLRIMMLSVLKHTKSPVKFWFLKNYLSPSLKDILPYMAQEYGFSYELVQYQWPRWLQKQRDRQRTIWGYKILFLDVLFPLHVKKIIFVDADQIVRADLKELVDLDLGGAPYGYTPFCDSRREMEGFRFWKQGYWRNHLQGRSYHISALYVVDLRRFRRIAAGDRLRGQYQALSQDPNSLSNLDQDLPNNMIHQVAIKSLPQEWLWCETWCDDSSKKYAKTIDLCNNPQTKEAKLSAAMRIVPEWREYDAELKALQARVRRGLYQAADTEQEIDSGHDEETAPSDSQPKKDHEEHTEL

SEQ ID NO: 4651 - protein, 1516 aa, Aethina tumida
MKLITVILSVILSSHLTYNVAAKSKKSKSVTTLLDAKWETTPLVLEVVEYLADENVDFYWRYIDAISQLKKPLVEIENERERYNVVIEQASKLITPSQLSVLKLGLSLHIYSPKVQMFGQMAVERNLPNCETVADIGGHLTCDINEISNLIQKATKQEQKGVEVFKIDTHYPGSENRSVVVVLYGELGRKSFSDFHAVLQQKAQEGIIDYIVRHYVKNSSGIKQRLSGYGVELQMKSTEYKSQDDTEVHEKASSEENSQEEEDGEVEGFDFGKLKKIYPDLKNELNKFKQYLEETSNELAPLKVWQFQELSLQAAERIMNAPKEEALKVFTNIAQNFPMQAKGLVKTVVNANMKKEMKKNSEIFASTLNLQPSDTALFINGMFYDVDLVDVYGILDVLRQELRTMEGLHKLGIGNKRLTTLLGLDLSDSSGSQEFAIDIRDSAINWINDIERDSKYNRWSTSIMELLRPTFPGMIRQVRKNLFNLVLIIDPTDSESRGILKLIESFVIHTAPIRVGVVLHVNSSTSLTGLEDAGVAMLCAFNFVSQKKDPTGALTFVRTVMGKAGENRVTVDDVKAELKRQFTEDYDDIIGEDSDYDFGRQLSADFIQRTGLGSSPQALLNGIPLPKNQLNLDDFEEAVLHEIMAQTPNFQKAVYKGKLTDGDDVVDYVMNQPNVMPRLNERILNKDKSFYLDMLGEPSSTTNIQQLLTLSPRDMTATAIENIKYFVGAEKNKAKPYKAMTYWILGDLDCPKARNLLVDALTHMKDEPDVRVSFLPNVNGDKPNKLNKIILAALEHLPSDKATTFALSLLLDNQKVKDIKEGKQVTIPNEITRNIDAQELNLKMLRVYAQRVLNLKAGQIAIVANGRVLGPLAEEENFTLEDFNLLMRFSGASYLDKIIEAMGKDADEEDDVCSDTLMKVVSLLISKVQGRSRFDISYSGTDHSVITIPPRNADQVAFDLVAIVDPVSRGAQKLGPILQVLHEVLNCKIRLFLNSVEKNSDMPVKSFYRFVLEPEIQFSEDGRQLPGPIARFNNMPTSPLLTQNYHVPDNWLVEVVRSVYDLDNIRLENVESNVHSEYELEYLLLEGHCFEQSSGSPPRGLQITLGTESKPVIVDTIVMANLGYFQVKANPGAWILRLRQGRSADIYNIVSHDGSDTPENSDDIKVVISSLRSHIVKLRVQKKPDKINMDLLSEDEGNSGIWNSITSSFSGNEEGEEEKLNIFSLASGHLYERFLRIMMLSVLKHTKTPVKFWFLKNYLSPQVKDFLPYMAKEYGFEYELVQYKWPRWLHQQTEKQRIIWGYKILFLDVLFPLDVKKIIFVDADQVVRADMKELQQLDLGGAPYGYTPFCDSRKEMDGFRFWKQGYWRNHLQGRRYHISALYVVDLKRFRRIAAGDRLRGQYQALSQDPNSLSNLDQDLPNNMIHQVAIKSLPQEWLWCETWCDDASKASAKTIDLCNNPQTKEAKLTAAVRILPEWKGYDDEIRELQKKIDSGLLDEEAEQDAPTIRTTDIHSEL

SEQ ID NO: 4652 - protein, 1515 aa, Hyphopichia burtonii
MYTFLWRVVVFSLAVVVSASKENTEDNNNFGIDLQASWAQIPFKLNLLESVASRNESLYLQVLPRIIGFVDSNDSDDDREPDVDGGNEISDAAIYDEVLRSLNLDSIQESFVNFNLVNKIYSPRVQAQFKYYNDVVMPKYQGKLTESCSVDSFGNEVDGVKDGKFPSWVQYNDKIYCSPDELYALQTDSKSLNEEILPFDRVIGANGEAPLLVLYGDINSDSFISMFENMYLSAKEGKLRFVWRYIPTQDLGPEYLGGYGVDLTLKRTDYLAVDDRNIKEIEAKSSKKTSNSKKLKLENDLNAIAQSNADLHPITKDQLKDLGSKLVTFIQSNSYKAIKKYDLLKTVLNDFPKYAYYISKLKNQKQFPFVNDVIEQNRKIGASEDSNGIYINGLSIPKEQFDLTTLVHQIESELKVSNELVEYGFTIPQAKKLITKFALLSAVKESQFKTGNSLMGDNENRFKLYEHEFVPNAKDKKGGVLFFNNIETESSYLLYSANRQEMYIGPGAYQMPHGQIPALKENVHDLIFVINFSHKEQLKVFFAMAKFFLDRGIPKQIGILPLIGSDPRDEKLAQLFYFLAEKGSAKESLALLYKYFETTNVDEENALFETINIPEDHIHSYAEFRDTLHKFSIDSPSVIFNGVINDLQGSTWQKDMKNQVAQDVRLLQHHIRQETDQGKKLKDILYENAKSERNLRVIPKDPANILYKRISNEMYEKSVGFKKDLENKELSGTFWLIGDFNEKKLIDQFIIILKVIAKSSSPNSMQIRVINTSQNNDLLDQLQEKFSNKPLNKSNTKNLIDYIKDYKSGSLESLRSESVSKLLEENEFQLHQPSLIFNSRYFRLTEIFKAKELQTLIEYEFKQRLSIIKDLVEAYPEDFSYRTLFDFNRNSGSDNIDWFDLVLSSITKSFYVDDFLILLDDVARFDFSSLNMNNTIDVVDYDNKKPIDILLIIDPTEEYSQKLVNVIGSILDFPFVNIKILLQPNEKSDEDVSIKRFYRGVFPASRPQFDSEGNFDVKYQANFTNLPEDQLFTTDIDGPHKWIITSHDTAPENVDLDNIKLSNYEYTQISGSYELKNILVEGYANDVRIAFPTTGLELELISTNDKIDTNVMATYGYFQLPADAGIWTLSIKSDSISSKHCSLLSASSNRYVANDTPLKSVQVPVFDLNGKTLSVRVTKNPGYENKNLLIELANGGLEHKDETKGSSWFGSLINSGKKEVKPKQADINVFSIASGHLYERLMGIMIASVRAHTNKLVKFWIIDNYISPQFKKLLPKLAQKYDVEYQLITYKWPVWLTKQREKQRTIWGYKILFLDVIFPQDLDKVIFVDADLIVRSDLSELVDFDLEGAPYGFTPMCDSREEMEGFRFWKLGYWTQVLQGGLNYHISALYVVDLNNFRALTAGDRLRNHYDRLASDPNSLSNLDQDLPNNMQKWIKIKSLPQEWLWCETWCSDQTFSSAKVVDLCNNPLTKENKLDRAKRQIPEWTSYDDQIHALQHPVSDSSDRPVSEHAHDEL

SEQ ID NO: 4653 - protein, 1449 aa, Meira miltonrushii
SPPVQVQLRSPWPSPPLVLEILEAVHEENGDAFFDLINHLLNPWVLNVNPRNHEGDYEPISLIDATDEDVFRRAQNVISQHHMLPTLAQELNWNTSLALRTQVPKISAFWQLYQTSGVLDRHASRQKSEEECGSWVDFEGKVICTDAELIEAFEAFTGHKNDFQPFPPITASDHVLKTGSKSGPIAILYADPYTSNFWPLHHRLTEYTLGSRPDHAPLQYILRWKPSKHLGDETLPGYGAYLDLKKVDYLVIDDRKLVEADGRTTESHTVPEDALQSADVQDRDWLNKQLHATADDQTQSMGNLSKEEISSIGFKAAYNIMKSSDPLRALHQLSQDFPSHAVALARSADAPKSEFLEEMEMLHMTRIEAGGEDVWMNGRSMSGKEFQAFGLLAAMRNERTLMQSFTLLNLSNQQAFELLTSAEVSSAYTTDDSAPPPFFDASDRIERKDGDNDTVGAISYWNDLEDLDDQRYGFWPVELASLLRPMYPGSFPQIRRNVFNVILALDLRQVDAVKFLSETVQMASSKVAIRWGIVPFLSSSPESSQLADLFWLALEQLGPTDTAKYLRRVAFAAQQIQSDKVNVRRAGEELDKMLHTTSTEREELLKSTESISLKRQKAAKWTKRLRADETATGTVFVNGQLMPFHPQLLQILHQVVAIQLQSLAKLIYYGEINDEETDVSTFFYDLPTTHTARSILLFPPEEGPIKTKAIELTGEIGVVCRNALSTGPEASSLAVWQVGDVESERGKKLFDILSTLSETQEFRLGSLSLSSFGLGQNDGTFGILINGRLLYNLDPSEFTQTDFEALIKQEKAKVDSIPSEGQDPWQTVAVSSIVHSANFVEKSKQGFFVSSSTARSTIMDAIEAEQFSFSFGDRNSSALRFSVLVNPLGKSVQQWSGVLSMLATQPDVYVRVILNPKQNVTEVPLKRYYRDSTPSQLQFNPQGQVLSSSLTFNDMPNEAVLTMGLDAPPTWLTMPVDAIYDLDNIRLRDAVTPTVRAVYELKYVLIEGHVRDDKSKSVPRGLQLVLESLDGTQTLDTIVMANLAYFQFRAAPGVYRLRIRNGRSSELFDMISVGNAGWDSPTVEETGDEIILNTFQGLTIFPRMSKKNGKEKEQLVEDGEASTQNGDSKSGISPGSILQRAQSIFSSASSSITGGSSAQVNVFTVASGHLYERMTYIMILSTLKHTKASVKFWFIENFLSPSFKRFIPLLAKEYNFDYELVTYAWPHWLRGQSEKQRSIWGMKVLFLDVLFPLDLQKVIFVDADQIVRADLLELVETDLHGAPYGFPPMGNDSIDMDNFRFWETGYWEKFLRGKPYPISALFVVDLNRFRLVAAGDKLRGHYQALSADPNSLSNLDQDLVASMIHNVPIFSLDKEWLWCETWCSRSWYDDAKSIDLCSNPKTHEPKLDRARRQIPEWTPLDEEVAEVARKLEKEGRLDANVVATTSAID

SEQ ID NO: 4654 - protein, 1496 aa, Byssochlamys spectabilis
MMLAARLCQLWHSSLVLITIVLPLLAQASPSVNVALQASFNSAPYLLELLETAAEENSTAYFPLLDRIAEGAFEQPVTEKELYDRFLEILKEDGHLINPESLSSFKLALSIRSAAPRIEAHYQFYNTSVQPLLAVAQDAACPVWAHLDGEQYCSSALERAQQGVDGELDPRALPFDRVLGDTSAPPSILYADITSPLFNEFHLKLSALAREGQVSYRVRYRPPQHAEAKPLFVSGYGVELALKRTDYIVIDDREAEPKEQKSSAGKKAPIAGIDALKEESPADLKPLSASELSSLGLSAASFIMNSANPLETFLKVTEDFPKHSSAIAAHNATTEFLTEFRANRAGLSLPSGYNVMWINGVQISPRQIDVFSLLEHLRKERKLITRFKDLGLSAQDAVNLLWHPAFTEAQTADEPQRYDYRDKTEGGDVIIWMNNIEKDKRYEGWPTALVALLQRSRPGQLPPVRRNIHNIVVPVDLTDIDDVRLVVETLQTFVKRKIPVQFGLVPTVNSPDAISQLKIVHHLHNSYGLAATLQYLEELLSKNIASPDKSSFQSATKERKLRPDAQALVFEDVQADEIENIVSRTTRYLKRLDALDGRPPTFVNGVPLARDENWIQGLTMRVNRDLQAILQGVFEEIFEEDAWLGEYFLSQAAQSRNKLIIPEDAKDIRIADLTSVYEKHEDSIKDLPRWSSASGQGNSLESQHIIVVADLGTRPGLDLLATILRYRRLHREAEILFIHNPSAGSQSDISAKLTKILQDDNIDTTALVADIDSDNLKREVSETEADEISKYWSTKQPLARELGFEPGARGLVLNGRAVGPIPSFATLDAIDMEQLLAYEKSKRIDPLAKAVKSLGAESKLADPSSFAKVASLVALSSIPDIPEGLFDTQSTARLNVFTKWEDTYTAITTSTSEDAVINVVATIDPTSEAAQRWVPILYVLSKMDGVNTKIFLNPKEQIQEIPIKRFYRHVLEAEPSFDSNGSLARPGASFSGLPVEALLTLGMDVPAPWLVAPKESIHDLDNIKLSSVKDGSDVDAIYELKHILIEGHSRDMTTLSPPRGVQLLLGTKNNPYFDDTIIMANLGYFQFKSQPGFWNIELKPGRSQRIFNLDSVGSLGYTPQPGDDNNEVALLSFRGKTLFPRLSRKPGHEDDEVLDIGPAPGSAMDYVSKGFSFASSVLSSVGMKGGSSEKHADINIFSVASGHLYERMLNIMMVSVMRHTKHTVKFWFIEQFLSPSFKSFLPHLAEEYGFSYEMVAYKWPHWLRGQQEKQREIWGYKILFLDVLFPLSLDKVIFVDADQIVRTDMYDLVTLDLEGAPYGFTPMCDSRESMEGFRFWKQGYWKTFLRGQPYHISALYVVDLNRFRALAAGDRLRGQYQALSADPNSLSNLDQDLPNNMQHQIPIKSLPQEWLWCETWCSDESQTQARTIDLCNNPMTKEPKLDRARRQVPEWTEYDEEIASLAKRVAAEKEKDQAAREETQPEKEAENEAAWKKDEL

SEQ ID NO: 4655 - protein, 1486 aa, Phialocephala scopiformis
MGPFNLPWGLTGALLATTYLHSICVSAAPSINVGLKTSFSSAPYLVELLETAVDENATSYFPLLDRIADGHFSKASTEKELYDQFVQLLRDDGHMQAESLSSYKFALSMRSLAPRIEAHYQYYHTAAEPSLKAEQDTFCPVWVLFNGKQYCSPSLKDAHGDVNSETQTQELQFDRIVGNSSAPASILYADITSPIFGKFHKTLIKTAREGKTSYRVRHRKPLNSEPKQLIIPGYGVELALKRTDYIVIDDREESDSKPSAVPEKEVKFEDEELADLKPLSTSEVFSLAVKASSFIMQSETPFETLVKLSQDFPKYSSAIASHNATKEFLAEHEYNRGQLVPAGYNILWMNGLQLIERQIEALDLLDLVRKERRLINGVKDLGLTGPEAIQLIAHNEIASVKGESDAQRFDWRDEIEGGNVIIWMNDIEKDKRYADWPTNLAAFLQRTYPGQLPTVRRDSFNLILPVDFTDAQDVLMIVDTLLSFVKRKLTLRIGLVPITTTPHQVEQARVLYYLLDTYGLQAVIAYLQSSYSAKKLSVPSKSSFNSAVEDRKLRAEKIARPMEDLLKTEDYQEQVKASQKWIRRLSADSKIPPMFVDGVALPRDENWLQSMSQRVNTDLQTIQQAIFMETFTEESWLPLHFLSQASVRRNSLVVPEDEKTLKLFDINKLLGEDQESVNQLPSMKADLSLPKSDWAHMIVIGDLDSEAGVNLLATAAASQEANPSIEVVFLHNPAPGASKSGLSTDIFAYMRDNSFKPLPDVAQLMTILTKDEQSSSDAFHDAKDYWHAYDNIVKSLALRPGENAIVLNGRLVGPIPAVPDFDTDDFDQLLSYERSKRITPTFTAIEALGLSEKVVDPLSAAKISSIVSISTMSDTPDGIFEQASTIRMGQFNMWNSSHTVIETGDASIATIQITALLDPASEQGQQWIPLLKVLSELDGVYTKIFLNPKERLQELPVKRFYRYVLDSKPTFDESGALQPLGASFSGVPQEALLTVGLDIPPAWLVAPKVSVHDLDNIKLSSIKTNVDALYELENILIEGHSREIPGGQAPRGAQLVLGTERDPHTADTIIMANLGYFQFKANPGFYKIDLQEGRSSEIFNIDSIGSLGWSPVPGDETTEVVLMSFKGTTLYPRLSRKTGMETEDVLEAKLEGKMDFMSRGLDFAQGFFGGKQKALAEKEVQADINIFSVASGHLYERMLNIMMVSVMKHTKHTVKFWFIEQFLSPSFKDFIPYLAAEYGFKYEMVTYKWPHWLRAQTEKQREIWGYKILFLDVLFPLSLDKVIFVDADQIVRTDMIELVNHDLKGSPYGFTPMCDSRTEMEGFRFWKQGYWEKFLRGLPYHISALYVVDLVRFRQLAAGDRLRQQYHQLSADPNSLSNLDQDLPNHMQSVLPIHSLPQEWLWCETWCSDEALKDAKTIDLCNNPLTKEPKLDRARRQVPEWTVYDDEIAAVDKKRKGLNGAEKNTKSRTLEEPMVTESTASKKDEL

SEQ ID NO: 4656 - protein, 1517 aa, Xenopus tropicalis
MLSPLILCFFSLTLASALAQVPTKGVTASLAAKWPASPFLLEASEFIAEEGNDKFWQFLATVQELTIYKNKDTEYSYYSLILKKAAQFLSDLQIALLKFAFSIRAYSPTVQMFQQIAADESPPEGCSAFVAVHGMHTCKPSQIKKLLKEASERPRPYLYKTDHIFPTLSKTAPVVILYAEVGTKEFAKFHKTLAEKAESGEIIYVLRHYIQHPGTRKVQLSGYGVELAIKSTEYKAMDDTKVEANNSSPKTDDGIAEEVQGFYFDRLMQMYPDLKENLVDFRKHLIESTHEMVPLKVWELQDLSFQAASKIVSTPVYEALKVLRDTSQNFPIKARSLTRIALNQEMKKEIEENQKHLSETFGIHPGDASLYINGLHIDLDVHNSFSILETLKNEGKTLNGLSALGINNEDLSKFLRIQVHSGDENYALDIRHSSITWINDIETDHMYSPWPSSVQELLRPAFPGVIRPIRRNFFNLVLFVDPVQEYAADYVKLAELFYRHNVPLRIGFVFVVNSDEESNTGEDAGAAFLKAFNYIVEESDSAQAFSSIINMYNKVDDGETLTVDMIKSVLKYDLPKMDIEQVMGLHSEYSNKLKAGATFYKKSGLGPLPQVLFNGVPFNSEEMDIEEMETVILQKILDATGFFQRAVFMGLLSDQLDAVDFLMDQPSVVSRINPSILTSEKNYINFISTPVAAKYTLHEFDTFSFLDSQDKSAVIAEHMKYLTKEDEDVIHGVTIWIIADFDKPSGRQLLAKALKHMQKTSITRLGILNNPTVKMTEENTLISRALWASLLTQKSQNMLKFFKRLAKEETAEALLNGRKIKDFIVSEIDDDAFEKKYNTMGLDVLRTQELYCREVLKLLPGQMATVSNGRLLSSIDADEFSEEDFHLLEKITYSTSAEKIKNLVKKTTTLPNRAASDLVMKVDSLLSSVPKGESRQDVNLIKQKHSLVKVEPEDAGPFFDVFAIVDPLSREAQMMSHFLIVLGRLINMKLTMFMNCKSKLSEMPLKSFYRLVLEPEVTFLRNNSLSMGPSAKFLDMPESALLTLNMITPESWIVEAVQSSCDLDNIHLQDIDGIVTANYELEYLLLEGHCFDVTTGQPPRGLQFTLGMKNDPVMVDTIVMANLGYFQLKANPGAWTLRLREGRSEEIYHIFSHMGTDSPSDQEEIIVVLNNFNSKIIKVHVQKKPDQIHADLLSSEPEEKSGLWNSLMSFTGAGNIEDKEKKHDVLNIFSVASGHLYERFLRIMMLSVLRNTKTPVKFWFLKNYLSPKFKEIIPFMAEKYGFQYELVQYKWPRWLHQQTEKQRIIWGYKILFLDVLFPLAVDKIIFVDADQIVRADLKELRDFNLGGAPYGYTPFCDSRKEMDGYRFWKSGYWASHLGHRKYHISALYVVDLKKFRKIAAGDRLRGQYQALSQDPNSLSNLDQDLPNNMIHQVSIKSLPQEWLWCETWCDDKSKEKAKTIDLCNNPKTKEPKLKAAARIVPEWTEYDTEIRQLLKDIEEQSKNITASSGNGLKHDEL

SEQ ID NO: 4657 - protein, 1451 aa, Anopheles sinensis
MDSTVPPSMRRFIRSNFGIFVILVASFLAFPSVRGESKSHPITTQLSAKWGITPAQLEIAEFIDEESSNSFWDFVELLNNVPGGLYRLETEEKRYQKSIELASEILGDGQINLLKLALSLHSFSPKVQAHLQVANEVLLKGDCETTIFASVNGKVACEVADLRSILQAGGRDSSTVETFAIDHIYPGSENNSLTVVLYGEVGTREFKEFHDAIRLATDRGTVRYVLRHYVRKVSSRKVRLSGYGVELHLKSTEYKSQDDSPRAQDPATASGDDAASEEELEVEGFDFAQLKKRFPHLTHSLDRFRNSLLEKHEEIAPLKAWEFQELGLQAAQRIAEMQGDEALQMLQFTAQNFPTQAKSLLSQTVSEDFKKEMRHNIEVFGRNLNLQPPDSALFLNGLFFDAETIDTITLLDTLRSEMRVLEGLNRIDIRGRSATPLLGLDLSSSSKEFAIDIRDSAITWINDLETDAQYRRWPGSLKDLLRPTFPGMLRNIRKNLFNLVLIVDPIAEDGAGRDIVKLAESFVVHMAPVRIGLVFKSGEGEDYRALTCAFNYVQQKKSATEALGFLTDLFAATVDLNVIRYADVRAVLRKKFNRLKLEEVDEILGEDSDFDYGRQLAQEFIDRLGLKTVPQALLNGVLLPQSTLNSEEFEETILTEIMQQTPSLQKAVYMGDMHDGEPVIDYLMKQPHVMPRLNQRILSQDEPQFLDMSGRAHPDLEDITALGQLSNADLTATLMKNLKYFGGKSTYEKFLGYRVHFLTVWVVGDLQEEATRKQLKNALKFMKSSSGTRVAFIPNVDGKDAARSELKKDLNALVWASINTLEVDETYDLVMKLLDRYTDTAGSSDFPGTLVPDSVLGFLPATQMHLKMLRVYCQRVLKLKASTGTVMANGRLLGAFEAGEFFDEEDFSLLESFNGLQYTDKIRAAMKQATAADSDSEVPPITSDTIMRLVSILVPRQQSKSRYTIPSDVQESRTVVKLPAKRSDQPFFEVVAVLDPASRGAQKLSSLLLLLRDVVNCQMKIYLCAIDKHSDMPVKTFYRFVVEPELRFTGDGRLSPGPSAKFVGLPANPLLTQSLNVPENWLVEVVRSVYDLDNIKLSEINGPVHSEYELEYLLLEGHCFDSATGSPPRGLQITLGTEDRPIIVDTIVMANLGYFQLKANPGAWILKLRHGKSADIYDITSADGPNTVHAGESTRVIISSLRSHVLKLRVTKKPGMAGVDLLGDEKDGAGGGGVGGGIWDSISSIVGTGDGGTGGAGETEVLNIFSEMEGFRFWKQGYWKNHLQGRRYHISALYVVDLKRFRKIAAGDRIRGQYQALSQDPNSLSNLDQDLPNNMIHQVAIKSLPQEWLWCETWCSSETLQYAKTIDLCNNPLTKEAKLTAAQRIVPEWKDYDAEIKRLQAKVDDKEHEEQTAAAAAAAAGAGERITKADAGSNVHSEDDGSDPETRHTEL

SEQ ID NO: 4658 - protein, 637 aa, Carlito syrichta
FLGPLHEGIYAEDFYLLERITFSNLVEKITDIVANMEIDTKNMSDLVMKIDALVSSLPKRASRYDVTFLKENHSIIKMNPQENDMIFEVIAIVDPLTREAQKMAQLLVVLGKIINMKIKLFMNCRDKLSEAPLESFYRFVLEPELILGANDMSSLGPVAKFLDIPESPLLTLNMITPEGWLVEIVHSNCDLDNIHLKDIEKTVTAEYELEYLLLEGHCFDTRTEQPPRGLQFTLGTKNKPVMFDTIVMVNLGYFQLKANPGTWILKLRQGRSEDIYQIVGHEGTDSQPDLQHVIVVLNSFKSNILEVQVHKKPDKIKEDILSDKDERKGIWDSIKSFTLRLHEEDKKEKDVLNIFSVASGLLYERFLRIMMLSVLRNTKTPVKFWFLKNYLSPTFKEVIPHMAKEYGFQYELVQYKWPHWLHQQTEKQRIIWGYKILFLDVLFPLAVDKIIFVDADQIVRHDLKELRDFDLDGAPYGYTPFCDSRTDMDGYRFWKTGYWASHLSRRKYHISALYVVDLKKFRRIAAGDRLRGQYQVLSQDPNSLSNLDQDLPNNMIYQVAIKSLPQDWLWCETWCDDESKQRAKTIDLCNNPKTKEPKLKAAARIVPEWVEYDTEIKQLLDHLENEKKNAILTHDEL

SEQ ID NO: 4659 - protein, 1514 aa, Ctenocephalides felis
MRLSVLLLLVGSTHLWTTGILAKDIKSKTVTSLIHAKWKSTPIVLEASEYLADENPDYFWKFINVICNLTTPLSKLPNDEARYNAILETAKTMLTQSELGLMKLALSLHIYSPKIEMYAQIAIDRNIPTDCAIVLDINNNLFCNLEDVDKYLKNEVENVVELFKIDHYYPNSCNCSNMVILYGELGTPEFSKYHKIFSKKASDGQINYIVRHYIKDRGNRKLRLSGYGVELQMKSTEYTSQDDSLQLVNDTHSEMNPEEDDEIDGFNFKQLRNLFPEISQNLSKYREYLSESTEGFSSLKAWQFQDLGLKAAARILSSSIDEVLAVLTYTAQNFPTQARLLLRNQVTVPVSEEIKYNSEIFLANLNLQPTDTALFINGLFCDIDTMDIFALVDVLRSEVRTTERLFKIGITSSAIPLLSLELSSNSESQKGFALDFRDSAVWWINDLENDRHYSHWSSSLMEMLRPTFPGMLRNVRRNLFNLILIMDPTELSSRPLLKIIESFVIHKAPVRIGIIFFLASEEDKERHSSGLALLCAYNYITEKRDSREAIGFLTDVFARIGEGEDLTISDIRSELERKFKSFDLKDVFDEESSYEYGKQLAAEFISRAGMTTRQQALLNGVPLPTAQLNSDEFEEAVLTEILHQTPIIQKAIYKGDLQDHHNVVDFLMSKPHVMPRLNQRILSTEDNIYLDMSGTSYTNITNVPFLLQLNNADLTATLIDNIKYFFPGKRNEKDSLMYTTLWVVADLNTNSGRKILLSAMKYMKSSGVVRLAFIPNAEVKEKYDINKLVLAALETMAPVEAEDYIMKLLQQRPQEYSVDDLGFSTFFKKAIVEQDANLRVLRVYCQRVFNFPISARGIIYNGRLIGPLNDNEQFYIEDLALLERFSNMMYGDKLKAILKNGKEFQDGRLTNDVIMKTVSLLGSRTQVKSRFEIPKVKEHHSVIKIPAKDNENIAMELWAIVDPVSHGAQKLGPILNTLRKILNCNIKIYLNAAEKYSDMPLKNFYRFVLEPEIQFTSSGKATPGPMAVFNRIPTTPLFTQNMQVPDNWLVESVKSIYDLDNIRLQDVDSVVHSEFELEYLLLEGHCFDSGGSPPRGLQITLGTSDEPLLMDTIVMANLGYFQLKANPGAWLINLRAGRSKDMYDMISVDGVDVSKSSDFRILLLSFQTKVIKLRVAKKSSMVHLDLLGDDDSQHGLWNSLTSSFSKGEADETLNIFSLASGHLYERFLRIMMLSVLKNTKTPVKFWFLKNYLSPAFKDFLPLMSKEYEFEYELVQYKWPRWLHQQSEKQRIIWGYKILFLDVLFPLSVKKIIFVDADQVVRADMMELYNLDLKGAPYGYTPFCESRKEMDGFRFWKQGYWKNHLQGRRYHISALYVVDLKKFRRIAAGDRLRGQYQALSQDPNSLSNLDQDLPNNMIHQVAIKSLPQEWLWCETWCDEDSKSEAKTIDLCNNPQTKEAKLSAAVRIIPEWSSYDNEIKTLQNKIDASHLAEDIDGNANQLYDTDDFISSWHSEL

SEQ ID NO: 4660 - protein, 1408 aa, Tupaia chinensis
  MOD_RES (909)..(909): Any amino acid
  MOD_RES (1141)..(1141): Any amino acid
MPSGLPVTVSHGLVELLAERRCLHVLNRAPKYRVRHSFKYRALVSIATLYRGNWQARHQLSFLRGVSVAEMGSGTDIHTPFQTRTCIFTADDMGFRSINALHIKQFENLSFQAASQIMSTPVYDAIKLMKDISQNFPIKARSLARIAVNQNMREEIQENQKDLQDRFEIQPGDARLFINGLLVDMDVYDPFSILDMLKLEGKMMNGLHSLGINGEEMSKFLKLNSNIQDYTYVLDIQHSAIMWINDLENDDLYVTWPTSYQELLKPTFPGNIPSIRRNLHNLVLFIDPAQEYTLAFIQLAELFYYHAIPLRIGFVFILNTDDEVDGTNDAGVALWRAFNYIAEERDVSEAFVSIVHMYKLVDDQNILTVDNVKAVLQNEFPHANILDVLGIHSKYDAERKAGASFYEMTGLDLLPQALYNGEPFSLEEMTTEELQMAILQKMLDASIHWQKEVFMGTLNDRVNAIDFLMDKNNVVPRINSLLLSTEQEYLNLISTSVTADVEDFSTFFFLDSQDKSAVIANSMYYLTQEDDVISAVTLWIIADFDKPSGRELLYKALKHMKTSVHSRLGVIYNPTSKINEENTAISRGILTAFLTQKNRLLRSFLMKLAKEETANAIYSGEKIKTFLTEEMDKNAFEKKYNTIRMNIFRTHQLFCQNVLGLLPGEIGIVSNGKFFGPIDEDFYVEDFYVLEKITFTNLVQNIKGIVENMEINSKNMSDLIMKVDALLSSLPTRVFRHDVTFLKENHSIIKINPLENGTFFDVIAIVDPLTRGAQKMAQLLVVLGKVINMKIRLFMNSRGKLSEAPLQSFYRFVLEPELMSGVNNVPSLGPMAKFLDIPESPLLTLNMITPEGWLVEIVHSNCDLDNIHLKDMERTVTTEYELEYLLLKGHCFDTLTEQPPRGLQFTLGXKNKPVMVDTIVMANLGYFQLKANPGAWILKLRQGKSEDIYQIVGHKGTDSEPELEDVIVVLNSFKSKILEVQVQKKPDRIKEDILTEKDEKRKGMWDSIRSFTIRLHKENKDEKDVLNIFSVASGHLYERFLRIMMLSVLCNTKTPVKFWFLKNSLSPTFKEVIPHMAKEYGFQYELVQYRWPRWLHQQTEKQRIIWGYKILFLDVLFPLAVDKIIFVDADQIVRHDLKELXAFDLEGAPYGYTPFCDSRTEMDGYHFWKTGYWASHLLRRKYHISALYVVDLKKFRRIAAGDRLRGQYQALSKDPNSLSNLDQDLPNDMIYQVAIKSLPQDWLWCETWCDDESEHRAKTIDLKWNGTHSILLCVLLGLVDIHWLCTELCQSLKMALRFGDALERFTGCRTQLYLWLSVSTVKECKANSSKEESKRAALSRLVQFMLSLIISVSVNGNFILSVAEANELGFSILTARIRPSADPVSVAFSWFIYVYKQKEEAQPRWHSL

SEQ ID NO: 4661 - protein, 1283 aa, Rozella allomycis
MSFLLFATLLFQLFLLISAYSVNSRLEAHWLNSLTLEAYHFFSFDQESFISFLSTAHNQKQEYENILTFTRKKYPLLEPYLNFTLSSRLFAPLVSSSLITCNNNSLIAAKCNDDWNCYSSISDISNLKCTDIAGRFNNIEFVDFIKQNSHLKLHLLNNLNSEFNDALNPSKFALSGYGVELVYLVLDDLKFKDFINDKEFNKLIENKDEKIDENVNELLSDPEIHTLNSTENETAINGIFSILKDSDNFLNDLTTISHNYPIVLPHLIKCSKRKKIRKYERDVLFLNNIPLDMNQINLFHYLNSIKILEVWNKDIGRIIKEFRGMKLISPRFDIPVEKCITISDVERDKRFKHFSRDISRIFYPFNGPLIPIRFNMATLVYVFDISDNQKYKEILDSLVFLVQNTIPLRISILPFATNDFDLINLVSISEISSPKKIIEILKDLKSNKGKEEINEKIKKPNSIYSSVANAFEKDLEFFQSRFESLDLKTNFYELILNSDKKFYFNYPLFFKSINYLEFSNLKHVLWIKEKSLPGKIMIFANSKISFKFELKKEFNLILDEFLDYKLAINSFAINGRIFELEDSELTREIFDLALEIYLYETRENNFGDEKWCTKSGEKWCIKNECVDCGCDYRDEESVITSTIPANDSTIPANDSTLNNCKSNSLIAVALGTLQNQFKLLPTTDERNKEIKFDLFVNQKCLFCFKWISTPLSKSTLSLSKIFKELTTSDEIGVSFGFNANNLQKFESNRIYRFVFTSKPQFDLENKLIIDYAKFEKVPMETLFTLNYDVIHEWIVVPEKGEDDFDNIKLSLLRRNVYSIYKLSNILTQGQAIDETNMDYPKGLEIQMGINKIKNIQASNGESVNTSNIDTIVMYNLGYFQLKTNPGSWFISLCNGKSSDFFSITFPTNILVNKFHGSSVLLKLKRNKGKEYLDFNKEPSNVSIWKFLANKIPFLKNENKSKAEINIFSVASGHLYERMLRIMIKSVVSNTKSSVKFWFIESFLSPTFKKTIPFLAKEYNFIYEMVAYKWPTWLRDQKEKQRKIWGYKILFLDVLFPLDLDKIIFVDADQVNFSFYLYLDYLHGAPYAFTPFCDSREDMQNFRFWNHGYWKSFLGDNLKYHISALFVVDLKRFREIAAGDLLRQTYHSLSLDPNSLANLDQDLPNHMQQFGLKIHSLPQEWLWCETWCDDKSLSTAKTIDLCNNPKTKEPKLDRARRLIPEWNIYDNELTNLLLFIQKALEIYPQNYLLENWNYIRQNKFHLELYPAVYNFKPHLSHFLRWTRD

SEQ ID NO: 4662 - protein, 1521 aa, Macrophomina phaseolina
MRVGQWLLSSQTALLLAALSPHSVTASPPINVALQARFNSPPYLVELLETAADENSTAYFPLLDRIANGYFDSQSTEKELYESFLKLLQDDGHITDPDALSSFQLALSIHTAAPRIEAHYQFYNTSVEPSLEAEQGEECDSWVLLDGKQYCSPELDKEHGLVTDARTADLPFDRPLSLERRSVASILYADITSPSFRKLHKTVIKTAEAGASSYKLRHKPPKNFRYEPQAVHGYGVELALKRTDYIVIDDRQAEEAADKPASDAAQTILQDQEVTDLKPLSESELKGLGLKAGSFVMGSEDPLDTLLKLSQDFPKHSSAIAAHEVSEEFLKEHKENRAAILPPGYNILWINGVQVMPRDVDAFALLEHLRRERQIINGVRKLGFAPPEAIGVLSNNAIAKAKDNDEPQRYDWRDAIEGGNVIMFLNNLEKDKRYAEWPESLRALLQPTYPGTLPSVKRDIQNVIIPLDLTHPLDTTLLVETLQNMVKRKLALRWGLVPSTKNIRAERQAHVVYYLQEYYGLGAVLQYLEHSLKLKEITEPSKTAFYTVTEGAKIRGNRVAKTFEEIFEEKSVVDRVKGASDWLRRLAADGNSPPFFVNGVALRRNDEWLSTMSMRVSQDLSMIQKGVFEEQFDQDGDDWLPEVFLANSTLRRNPLVIPEDEKDIKHLNLAQIYAEHGDLIERLPRFNAADDSEWFQWAQLIVLGDFDSNAGANLLADAYQFSSNHGDLETIFIHTGDVDHRSRMAYLLYKNAGKTEMEDLPEDFEPTAQEIKEVEEFWSSMKPLIRALDGDAGRESLVLNGRTIGPLRKRRPLTEDDLENLLKYERKKRIEPAARAIIDLGLEKKIQSPASLAQFTSLVALSTVSDIPEGIFDSPPTTRRDVFKFWNDTHTCIKTGDIDKATIQIVASVDPSSEAAQRWLPIFKVLSELSGVHMRLFLNPKERLDELPVKRFYRYVLDSKPSFDEDGSTKTLQAKFEGIPSEALLNLGLDVPPQWVVAAKESIHDLDNIKLSQLKGQSSIDAIYELEYILIEGHSRDMTTGMYPRGAQLDLRTASNPRYADTIIMANLGYFQFKANPGFFSIELQPGRSQEIFRIDSAGTLGWSPQPGDRTQEIALMDFKGVTLYPRLSRRAGKEDEDVLETPSSMVENLAAKGAALADGILSKVGLKGVKTGGMIQKTLRSVGLSTDLKAASSPHADINIFSVASGHLYERMLNIMMVSVMKHTKHTVKFWFIEQFLSPSFKSFLPTLAAAYNFDYEMVTYKWPHWLRGQKEKQREIWGYKILFLDVLFPLDLDKVIFVDADQVVRTDMYDLVTLDLGGAPYGFTPMCDSRTEMEGFRFWKQGYWKNFLKGRPYHISALYVVDLNAFRRLAAGDRLRQQYQQLSADPNSLSNLDQDLPNNMQAVLPIHSLPQEWLWCETWCSDESLKDARTIDLCNNPQTKEPKLERARRQVPEWTVYDEEIAALARKARAQGEAGAAAGVVVDEEDRELLEKVERQAQEVEREREEEKKKKEEKTHDEL

SEQ ID NO: 4663 - protein, 1587 aa, Arthrobotrys oligospora
MWFSTLRTQQSSRRALLSGALALASLQGVYSRSQPQDIEEPGTVKQWEGVNLSLKTPWNGGPYILEILECAGLEEPAFYFTLLDLIKSGTIKLVDSDKEMYESVVNYVETHQLLDHRFIPTWKFCISLRETSPRIEAQYQFYSNKVTFPKGKSCPVWFDDGETQSCNSGDISKVKPESSSASKLIPFDRQNKEDTRKGLVTFYIDIIDKGFPTAFSEMSEAADKAGIAYKIRYKPSPSLKNPKPVGLSGYGVGLSLKKTDYLVIDDRDAQEGSAPASDASSTASSAKPSPTYKFRTPENLKPGEKRFPLWDLVDVDDPVRDLRDLLPLSQTNIGDIGFKTANFITKSGIFPPDMLMKILSDYPKYAHTIGTMGGVLNEWVQEHSDNREKFVPAGYNLMFLNGLALDPSEVNAASLIKLMRRERHHGIQIRELGLNQEETHDLIGHANITDAKLSPEQPRFDYREQAGEENAIIWLNDLAVDERYKDWAPSIQEIMVHQYNGELAGIRKNIHTLVMALDFSNREDLKVITERLNIMVTREFALTIGIVPIVRNNLGSANSRIFRALLQSYDLETAVSYIRDGLEADKNGVRYPAPEYVHHAIKGRTRLEGAPEVSLSAVMESKQFQEYARAAGNWEARFGIVDRPYPFLVNGLLDYYNNEWIRTLTQIFPKDVQRMQEAIEDGKLTDDDDIREFLLNNPLPKKSAAIFPLSGKLDLFNLADLFKSNPEIFEKLPHFPGKLVEETETSSADVWVIGDFDTEDGHNLLAEAAKLQASRPGISITAISNPGGKTKVQTTSALLHSLVGNTEILKITGFLQKIIEEIKPEKDFMDLKVEGQSVFGGDAKTEGWAIPNKVAAEKFWSEAAAVVERIFGVKPGQKAVLVNGRLVGPFNEEVKWTKDDIETLVRVELQTRINPILNAAKSIGVLERLRAANYKGRLTSTLTELLEGEKTNLAISGMSVRTNRAMGWKRSKTVLTAGDPIWSTFRFIVSLDPVSEVGQKWAPILRVLMSMDGVGVYTFLNPNDNLREVPIKRYYRHVLSSQPKFDENGDILDPKAQFVGLPDQTLYSLSMDVPPSWLVTPSETIHDLDNIKLQTFKERFGTSDLNATYVLKSILIEGHSRDTTHNQPSSGAQLELGTSENPLMQDTIIMSNVGYFQFKSNPGHWQIRLKPGRSSDIYTIQSLGGDGFNPSSNAEDDVKDITLMSLNGVTLFPRLKRNKGYEKVDVHSSLGSTDGTVEKAASFAEGLLSKLGLGKKKETAVAKAPAEINIFSVASGHLYERFLNIMMISVMRHTKHTVKFWFIENFLSPAFKDFLPVLAKEYGFDYELVTYKWPHWLRGQKEKQREIWGYKILFLDVLFPLNVDKIIFVDADQIVRTDLKELVDLDLNGAVYGFAPMCDSRTEMEGYRFWKTGYWKQMLGELKYHISALFVVDLKVFRQLAAGDRLRQQYHQLSADPNSLSNLDQDLPNNMQRQLPIFSLPQDWLWCETWCSDESFKTAKTIDLCNNPMTKEPKLDRARRQIPEWTEYDDEVAALAKKVKAKGVENMREALVQKEALGEQEKGVKEEKTEEKKDEKAADAEKPKDEL

SEQ ID NO: 4664 - protein, 1525 aa, Boleophthalmus pectinirostris
  MOD_RES (860)..(872): Any amino acid
MRMWLTCVLLLSLLCETSGSVDSKGVTTTLTTKWTETPLLLEASEFLAEESQEKFWDFVEANENIEGVHDDTDQAYYELIVKKAGALLSSVQINMLKFALSLRVYSATIHSFQQIASNEPPPAGCSAFFSVHGVKTCDTESLGDLLKTASERPKPYLFKGDHRYPGSSPDAPVVILYAELGRQKFSELHQTLVSKVHKGEAAYVLRHYVAKPSNKKVHLSGYGVELAIKSQEYKAKDDTQVQGVEVNATVIGENDPVDEVQGFLFGKLKTLYPELKEQLKELRKHLIESTNEMAPLKVWQMQDLSFQTAARILAAPAVDALNVMKDLSQNFPTKARSITKTVVSAEIRKEIGENQKFFKGNLGLQPGDSALFINGLHIDLDAQDIFSVFDVLRGEARVMEGLRSLLIETPYIHDILKLNVQPSESDYAVDIRHPAISWINNLETDHRYSSWPYNVQELLRPTFPGVIRQIRKNFHNLVIILDPTQDNSADLLNVAEMFYSNNIPLRIGLVFVVSDEDDVDGMKDAGVALVRAYNYMCDEVNSQSAFETVMSMFNRVPPGGQLTVTDVVKVLEKRFPYVEISSVLGADSTYDTNRKEAKAYYAQTGVGPLPVVLYNGIPYQREHLDPDEMETVTMQKILETTTFYQRAVYLGELATDHDVVDYIMNQPNVVPRINPRVLSTSRTYLDLSDTNNYFIDDYARFSSLDVKEKNTAIANSMNYMTKKDDGYIRPVTYWVVADFDTPSGRKLLYDAIRHMKSSNNVRLGMINNPSSAVSTETSRVARAIWAAMQTQSANNAKNFITKLAKEETAAALEKGADIGDFAVGGMDMALFKSAYEDSKFDFLLSHAAFCRDVLKLKKGXXXXXXXXXXXXXNGRIIGPLEDEEVFNQDDFLLLESIILKTSGERIKSKVQQFGIEEDRASDLVMKVDALLSSQPKGEARVEYGFADDRYSAVKIRPKEGDIYFDVVAVVDPVTRDAQKLAPFLMVLKQLVNVNLRVFMNCQSKLSEMPLKSFYRYVLEPEVLFQADSSFSPGPMAKFLDMPQSPLFTLNLNTPESWMVESVNTRYDLDNIYLQEVDTIVGAEYELEHLLLEGHCFDVSSGQPPRGLQFTLGTASEPVIVDTIVMANLGYFQLKANPGAYILKLRKGRSDEIYRIYSHDGTDSPADSDDIVVVLNNFKSRIIKVKVQKKPDKFNEELLSDGTEEVDTGFWKSITRGFTGGGKTDEPKPEKDDVINIFSVASGHLYERFLRIMMLSVLKHTKTPVKFWFLKNYLSPTFKEFIPHMAKEYGFQYELVQYKWPRWLHQQTEKQRIIWGYKILFLDVLFPLAVDKILFVDADQIVRTDLKELRDFDLEGAPYGYTPFCESRREMDGYRFWKSGYWASHLAGRKYHISALYVVDLKKFRKIAAGDRLRGQYQGLSQDPNSLSNLDQDLPNNMIHQVPIKSLPQEWLWCETWCDDHSKKSAKTIDLCNNPMTKEPKLQAAVRIVSEWTDYDQEIKRLQNRLHEKTAQDHGPQKSTDEHTEL

SEQ ID NO: 4665 - protein, 1510 aa, Phyllostomus discolor
MAKAANVVRLLLGNTVLWLSLLRSGTASASKAVTAHLAAKWPETPLLLEASEFLAEESNEKFWQFLDTVKELTIYKQTESDYSYYNLILKKAGQFLDNLHINLLKFAFSIRAYSPAVRMFQQIAADEPPPDGCDAFVVIHKKHTCKINEVKKLLKKAASRPRPYLFERDHKFPTDKENLPVVILYAEMGTRSFGKFHTVLSEKAQNGEILYVLRHYIQKPASRKMYLSGYGVELAIKSTEYKTLDDTQVKAVANATVEDEIETNEVQGFLFGKLKERYSDLRANLTAFQRYLIESSKEMTPLKVWELQDLSFQAASQIMAAPVYDALKLMKDISQNFPIKARTLTKVAVNQQMKKEIQKNQQDLLDRRDIHPGDARVYINGLRVDADAHGPFSVLDTLRLEGKRMYGLQKLGLGREDMSKFLKLNSRVRDSNYVLDIRHSSIMWINDLENDGFYAAWPASCQELLKPVFPGKIPSVRRNFHNLVLFIDPAQEYTLDFIKLAENLYYRRVPLRIGFVFVVNTDDQVDGTSDAGVALWRAFSCIVEEQGALQAFKSVARMYQKVKNPNILTVDNVKSVLQNKFPHANILDILGIYSRYDDKRKAGASFYKTTGLGPLPQALYNGEPFKYKALGIQELESALFQKMTDVTVYLQKEVFMGTLNDQTNAVDFLMDKSNVVPRINHLILYTEWQHLNLISTSVTADVEDFSTFSFLDSQDKSAVIAENMYYLTQEDENAISSVTLWIVADFDKPSGRKLLLNALKHMKTSFHSRLGVIYNPTSKINEESTAISRGILAAFLTQKNSFLRNFLRKLAREETATAIYSGDKIKAFLIEGMDKNSFEKKYNTMGVSLFRTHRLFCQDVLHLHPGEMGIVSNGKFLGPLDENFCAEDFSLLEKITFTNLAENIKDIVENMAINSKNKSDLVMRVDALVSSLPLRASRHDITFLQEHHSVLKTDPQEADVFFDVVAVADPLTREAQMMAQLLIVLGKIVNMKLKLFLNCRGQLSEAPLKSFYRFVLEPELTSVANGIIEPGAKFSDIPESPLLTLNMITPEGWLVETVRSNCDLDNIHLKDMETTVVAEYELEHLLLEGHCFDVVTEQPPRGLQFTLGTRSQPVAVDTIVMANLGYFQLKANPGVWILKLRHGKSEDIYQIVGHEGTDSQSDLGDVIVVLSSFRSKTLEIQVKKKPDKIKEDILTDQGEKKGMWDSIKSFTRSLHKEKDETETDVLNIFSVASGHLYERFLRIMMLSVLRNTRTPVKFWFLKNYLSPTFKEVIPHMAREYGFQYELVQYRWPRWLHRQTEKQRIIWGYKILFLDVLFPLAVDKIIFVDADQIVRHDLKELRDLDLGGAPYGYTPFCDSRTDMDGYRFWKKGYWASHLLRRKYHISALYVVDLQRFRRLAAGDRLRSQYQALSQDPDSLSNLDQDLPNNMIYQVAIKSLPQDWLWCETWCDDESKQRAKTIDLCNNPKTKEPKLKAAARIAPEWVEYDAEIRRLLDRLDTGKHALLTHDEL

SEQ ID NO: 4666 - protein, 1568 aa, Cavenderia fasciculata
MYIVLVVFVTLLAATQLASAEDEHQKKSTYVALDSNWNSTPLYLEAREKVDESLYWKFIQSFNDACVKANKDSTQMTDKEVYDIIIDTSKEILGDDSAYLLEFLIADLSIRTYSPRVQTYRQLYETNSKYNNKQNEFIQLNDITLNIKDKESITTIEYDKSKENEVYSYDTIYPSTLTHSFDHITMMQEEEKDKRVVIYYADITSKDFSAVHKYLIKLYQEKKIIYVVRFYVPASTDHVRLQGYGYSLSIKSLEYKVMNDAVIQNEGGDSNTAASIPNEDVGGFNFHVLQKRHPDLTKKLTTFRSYLLAHQQQAELKMWEIQNLGLQTAQKIVTSSNPMQSLVYISQAFPSYASSLSRISVNSTLKQSIANYQKIFTEGENQLYLNDRVIDITEEFDLNPLGLSETILNELKSMMNVKKIGIESNLISKIASTFMAPNLVRFNMLPENKDVLITLNNLETDPAFSKWEKSLSDLKNEAISYSSIFKKKNLFTLVFVVDLDNADAFQTIAYAQNLANNNIPCQIAIVFKTSNSDRLRDNLTSEKIAKIFLTFRSKMGIKAATFFVNALNYYKRSYGMDQVTMQLVSSAFNTVVSQMGNNVGRLQTIVEATTYNDLLKEANDFIQQKAISVFPQIFMNGLLLDAKKSIAESINHICFEELRQVRKLYLEGIITDLDQDYYSIMMDYHATHESLLESLNPLVVPSDINPVEFRSLSPPNSNKKIEKLGQDLLAEQLHWISATGAEDEVKLISHMIVGDFDHDTTVQLAKNAMDRLQKGSPKDVRVAFVNANTKSKLGRQLTFANTVEEATSILSGVTGDSKSLDETKIENISVFSKSVLGLACQFNSYILTNGRLITVSHNEEDIFNDFFMLEKFEIGKARSVKDILPENPKVRGVELTKPRDKSNLIMTLVSVFGMQSSNTDVVRKQVPTTVTPSFRYEPKANANITPLLRFTMVVDPLCKTAQKMVSIVNSVASHYGIAVDVFLNPLQQLGELPLKSFYTYVSQLHLNFDDAGKLSKHYASGVSSNLPDNRVLALAMDTPSTWIVKPLVAKHDLDNIRLKDLGVKEPTLNALFQLEYLLLQGFAYESRIGVSPPAGLELVIDSLGTLQHQDTLVMGNGYFQLKANPGYWKLALLGRGKNIMNLLNSDSKASDTDQVHPVSYLTVATDSYRGNSIYLKLSRKAGQEHTPILPPVTDQPKNTAPQKVAEEEAEDDKGFLSSIGSLFGGNNNNKPSARVENKKLPASNETIHIFSVASGHLYERFLKIMMLSVKQNTNSPVKFWFLKNYLSPEFVEFVPYMAKQYGFEVELVTYQWPTWLRAQTERQRIIWAYKILFLDVLFPLSVNKIIFVDADQVVRADLRELWDMDLNGAAYGYTPFCNSNPDTEGFRFWKTGYWRDHLRTKPYHISALYVVDLNRFRRIYAGDQLRMTYDQLSRDPNSLANLDQDLPNYLQHNLRIHSLPQEWLWCETWCSQSSKGKAKTIDLCNNPLTKTPKLENAVRIIDEWTDLDNEAKECEKKWKLEKESKKQQVLPNPTTSETQTTTDKPTTTTIDPEQAIEAIDSASIYMDQ

SEQ ID NO: 4667 - protein, 1500 aa, Elaphomyces granulatus
MASVRGFIVPWPLIFFVLNVALPLLALAGPLVNVALQSSFNAGPYLLELLETAAEENSTSYFPLLDRIAEGVFEDVVTEKELYDRFLKVLLGDGHLQDAESLSSFKFALAIRSAAPRIEAHYQYYNTSVQSSLMSAQDAACPVWVHAGGKQYCSSTLERAQQDVSGQSNPRDLPFDRILGDISAPPSVLYADVASPMFNEFHQKLSSLAREDQISYRVRYRPSQHSDLRPLFVSGYGVELSLKRTDYIVIDDRDAQAKDERGSKKNQATSSVEEELKEESPADLRPLSSSEVARLGVNAASFIMGSADPFDTLVKLCQDFPRHSSTVAGHNASENFLNMARSGSSQALPAGYNAMWINGIQIGPRQIDAYSLLEHLRRERKLIGDFNKIGLSTLEVIDLLSHPSITESEVNDEPPRYDYRDDVEDGGVIIWLNDIEKDKRYEGWPTSSLAILQRMFPGQLPNVRQNIHHVVIPVDLANSDDVHLIVEFLLIFIRRKVPVRFGLVPVIHSQSAISQFKIVHHLHETYGLSALMKYLEESMSKKKFTTADKSAFQAAITDREIRSGATSRRFEEIMQTNEFENVMSRTSAYLKRLDCDGKAPLALVNGVVMSRDENWMQEMPMRLTKDVQSLQLLLTDGVFEEDTWLAGHFLSQSALSRSEWIIPKDPNDIRIINLAMIASSNGDVLNTLPRVASGDDENGTIKMVHIIVISDFNTKQGLEFLTATLNFCQAHPEADVILLHNPDTGSSKSGTSSRLYHLRDKGQIDAAQLLGEINALPDVSGWNLDEDAADEISSFWEGMRPLVMDFGFAPGKSGIVLNGVAVGPPPSNVVVSVREFEQLLAYERLKRIDPVSKSLTALKLDSKISDPFDFAKITSLVALASISDIPEGIFESGSKLRVNILTEWIHDFAVIDVTDSLDAKINVIAAIDPTTEQAQRWIPILKVLSKLVGVNVKILLNPRDQIQELPIKRFYRHVIEAEPRFDSVGALRRPGASFTGLPEEALLNLGMDVPPSWLVAPKESVYDLDNIKLSSLKEGANVDAIYALEHILIEGHSRDTTKKSPPRGVQLLLGTENDPHFSDTIIMANLGYFQFKAQPGFWKIGLKPGRSQRIFSLDSAGGLGYTPKPGDENTEVALLSFQGRTLFPRLSRKPGHEEADVLETGPKPGSAMDYVSKGLNLASGVLSSVGVNPKSESAEKHADINIFSVASGHLYERMLNIMMVSVMQHTKHTVKFWFIEQFLSPSFKEFLPYLGKEYGFSYEMVTYKWPHWLRGQREKQREIWGYKILFLDVLFPLSLDKVIFVDADQIVRTDMYNLVTLDLEGAPYGFTPMCDSRESMEGFRFWKQGYWKTFLQGLPYHISALFVVDLNRFRAIAAGDRLRGQYQTLSADPASLSNLDQDLPNHMQHVLPIKSLPQDWLWCETWCSDEALTTAKTIDLCNNPQTKEPKLDRARRQVPEWTEYDDKIAALMKHVATAESRTQGSEPQESHTGRENVEEQKDEL

SEQ ID NO: 4668 - protein, 1529 aa, Melanaphis sacchari
MAKFNEYNGYISSRYNNRSMNHSVRRKRRNKKDDTSIFYFIIGLLFVFLLFGRESENKNSKKGKYVTTMIDTKWSMVPLVLEMAEYMAEENSYSLWSFVDSISQLNPALSELENDQIKYNIALSKAGLLLSNSKLRLLKFSLSMHTYSPRIEMYAQMAADRGVQCSTSVEIDGELVCSIKELKKVLQRISAEGSKHLCETYHIDHHHPSSKNKSNIAILYGELGTAEFASYHTVLKQYAQEGFIDYVLRHFVKEKSEQKVRLSGYGVELHMKSTEYKAEDDSVVKDKNDMNRNEIEEDTSEIEGFDFKRLIELYPDKKLDLLKFRNHLSESSSELAPLKAWQFQELSLQAAQRIMSGPPQDAIQTFIHIAQNFPTQARSLANVKVSKELRAEVSKNQDSFSMGLNLQHTDTVLLLNGMYFDIDITDMSTILDSVTQELSIMEGLYSIGITDKKAISSMLALDFGSVKGKSYAVDIRDSAIQWINDLETDALYKRWPSSVDDLLRPTFPGMLRSIRRNLYNLVIVCNPASKSSWPLLKLTDSFLNHQSPLRVGIVFNVSPKTAIGLNDASVALLNAYNYIVEQTSKPLTAFKFITKIYTSISEDRDVIVDDVLSEFKKQYPKAFIDEIFGEDSDYDTARVLAKEYVAKTGFRKLPQVLLNGVPLQEKSLVEEDFEEAVLVELVTQTQTLQKAVYKRELTDTDNVVDWLMTQPNVMPRLNSRVLNTDSSKNLQLSDKHESVLKSINYITFAKKSSINPITHWIVGDFSKLSTFKLIKNTFEHLKSDSESRIGVIPNPSNDDEHTIKINKIVFEAFKQEDKLNILVKHLSQAIKVDKNHIEIINSLPEEIHFEASKIDIQSYSSFAIEALNFESGQCGVITNGRILGPFDEDEDFLTDDFALLEQHTLKGSVNKILNILKESDVLDITSDMIMKASALISSRSQTKNRHSMPDVSTKHSVIKLSANNEDEPVFEINVIVDPVSRGAQKVGSIISVLSRVLNANINVYLNCVDKNSDMPVKSFYRFVLEPEVIFDKSGHLSPDPIAKFSNMPTSPLLTQILHVPDNWLVESIESPYDLDNIRLEDVEMGVYSRYELEYLLLEGHCYDSVNMNPPRGLQMTLGTKSSPVMVDTIVMANLGYFQMKANPGAWMLRLRQGPSADIYDIISHEGSDRSPNSMDIKVLISSFRSHIIKVKVAKKPGKQSLNVLGDDDTENKGLWNSITSSFSSGSPDKSTDETINIFSVASGHLYERFLRIMMLSVLKHTKSPVKFWFLKNYLSPTVKNFLPIMAQEYKFEYELVEYKWPRWLHQQTEKQRTIWGYKILFLDVLFPLDVKKIIFVDADQVVRADMKELVDLDLGGAPYAYTPFCESRKEMDGFRFWKQGYWKTHLQGRRYHISALYVVDLKRFRKVAAGDRLRGQYQALSQDPNSLSNLDQDLPNNMIHQVSIKSLPQEWLWCETWCDDASKKTAKTIDLCNNPLTKEAKLTAAMRIVSEWKDYDNEIKKLQIKQSQHEDEVFNVETQSKGTEEHTEL

SEQ ID NO: 4669 - protein, 1876 aa, Smittium simulii
MFKTKPNSILASLWFWLTLLSLAALFSRINAESQKILSNPDVSSAQVDIINADNPIDLTNDKNYSTPPVKAIIRAPFSAPNILIELSQVIYKHDKTLFFNFIKHLNQNLDLFEKTDKDAYNAAISWIEIQLNPQIVKKNIKPDTKWLLSVINFELANHHEVPKIIAQYQYYSELVSEKFKADSKNIESSRSNYFKNGWVSWNGKSATNFNELEALVGTDTFYGDTYKDKNLNKSPILSFDHIYPAKTGNPTKIAENLAIFYSNLKEKDFGKIHDYLLHLSNLGNTVYVLRFIPDNPDVFQSQISKSSMGISGYSVELALKSTEYNVTNESSLFDIIDSEPEGSGSEWDFNLNKYNTVQTNMDKSKYLNFYDKQSSVTEDFSDDEKNTMSLKATQVILNSKSPIDMFNWIVSDFPKYAKFVSSQSSLKNLTYIAALRESSIETPLNEISLNGLVLKKKNLNIFSLINHIETERKAVVALMKLGFTTSQATGFISAPRNFDKNSKVNSGVIAYDVRDNSESKVVISWLNNLEKDSRYKTWSSNANIVYTIQSTGAAPLIARNILNVVVALDINTRFGIRLLFDTVFDSIKKNLPVRFGIIPILSSGSHTYNDQLKVCECSSISEALDASGGSKTTKQLDSPEMTVRLYYYVYHFYGIKKLSELFESIIKNAKSDHDIAKVAKSSYNSVIIKQKAQIKEKKVLKMISTLFPKSKKEEIDDFTTKFQSKYLEWDQLLSCPIVSAIMCKHRDYTSRLDLNNLNNINDLNQSKKDKASGDKTIKDVNSIVKIFASGYELSYSKDLINTLTRMYQQTCILLFRKMFMGFDINGIKDFFTYFLTEGNLKKYRSNLISSVSVLDGSVSETQKINKNTMIGVLDFSGSVDTINSKNDTPAQWINELLYIEQPQIKEASSESVKNHPLTIWIYTNLESEAAKKVIKESLQAAQQLLRSKSTSNFRVRLSLFHNLKAQDSNRNNKQKSSDDIDSEDGADDENADENTDLQDNFDNVTSDDKNNTRTKLYLLLSHFQKNQENSSSDNYILSLQYIIEYLENLDIDGITGELLIKKSSHEVDVDVANNVVSEFSNVLNNISEKDLLEINQYYLKSYQILSSMIVKYGARDELEYILRDEVSGDETAIIINGRAFPKLTASSYYNAEIAINLFKDQWENRVMGSQKLFNHLFKESENLLTRQLQDLYIVSGSIVDYYHYEYAFDDFIFNKISITRKDIFEEIYKSKETRFDIGNTDNYFAHFKAVIDPLSDDSQDWVPLLQTLSKMDGVKVSIVLNPLSSQNLQLRKFKRYVISHKPIFSSSKEGNRIELGAEFNDMPKDALLTMGMDVPSSWLVTAVSSKYDLDNINLRSIKSKYGVAALFSLKYVLIEGHASEPNKKAPPSGIQVSLSKLPASMTPSIENLKKKSNQNFDIYLGEIAKSPNDTLAGTIVMENLGYLQLKTHFGAYGFSVREGRSLKLFDLDCIGVGAYSDCLNNAGATEAQPVEDSLAKNYGIVVLDSFNGATVYPFFSKRKGMEDEPILLKELSKESGQDQKASDLNNNQLAGIWSKIKSFGSGVKAKNQINTDLDYSEEAQLNIFVVASGHLYERLMSIMIVSVMKNTKSTVKFWIIENFMSPAFKAFMPILAQNYNFKYEMITYKWPHWLNSEKEKQRTIWGYKILFLDVLFPLGLKRVIYVDADQIVRDDLQKLYDMDLKGAPYGYVPFCDDKKEIDGYRFWKVGYWKSHLQGKPYHISALYVVDLVQFRLLAAGDILRFQYQNLSQDKNSLANLDQDLPNHLQHSVPIFSLPQEWLWCETWCSEEGLKNAKTIDLCNNPMTKEPKLKRAKRIIEEWSIYDKEIEDIKLQNSKHSSVNGPNSSINESKNPEKVEL

SEQ ID NO: 4670 - protein, 1620 aa, Puccinia graminis
MKRSRGLRDRLGLLLTLGVDILAGSPPISVSIQATWQEPPMLIQVLESAALERPGLFFSSIDAVCSGWESSKRSTDQQTYEYLTSLLRSPGLLDGPGELESLAFSIALKEAQPKIEAFRVWYASLPSNLTGQSETQASESDDCKSWTLINNSRICDTSKLSELLDSNDPSEKIQSQPQVLPFDHQQGQSHENARLPIAILYASPDPSSFCPFHQVLHKASKELPSKATYIFRWKIPSAPSSSTKSQSASLLSGWGASLDIKKSEYLTLDDRPVESSSSDDPQLILDGTKQPAGRESQVDSEPAKLKPLKAAEIFDIGAKATQHVLSSPSPLTALRHLTEDFPLIAHTLVNEWVPGRISRELRLELKENMEDGIPPGRSVVWMNGLQLSSLVSLENLNLFKLVEIMRNERRWITSLTSLGINSLQARKLIVDEKLNSAMNPEAASASASGEMDASSLGARFDASDRQEGGGAIIWFNDLEKDERYSMWPTTLRAILRPTFPGQLHPIGRNLINVVLGLDLTQTQNLHNLGHVIEVFIARSLPIRWGVVPIPTKNPSQAEKMSRSFWNMIEALGPIETLKFIKEFTQDLEPESGAIDVEKFISKANQSVLSAEEESPEDPQSKEERFQVWLTKSQLYSSRLSLCSNDHSLPACMMINGRFFPMEENYRTHLQETATLHTGFIQHQVYFNLLKDDANVAEYLYDLPLVHRARNDLVFPSEARPLQFVDLVEALQSSDALAANVFFRNEAAPVKNGDPRPIASLWVVGNLDSNTGMSAVAAALGLLMKPFPNVSTQVSFVHVPSDDTEISTEISTDLSALITTSDVQKITIQDLLDKLSGHGHQAMTSDDGDSTKTEKNSELVLKKIQTKASDLPNIKNRAWFGAQEFGKAIGAKRDGIAIVINGRLLQVSSTSKLLSEDLVLLVEYETQQRINPLMEALKSLEEFDVKQHHANLPLIMSTVGFVLVGSNDGSTQTSSSEARSDKHLARNGVHSSYQHGDEAKALFDFSVVLNPTSEAAQRWSALLDTLSHRSDVAMKVWFNPSLEVSELPIKRFFRTAISNSLEFDKNGRVIPALVNFHGIPTETLFTLAIDSPPAWLALPHDSIHDLDNIMLSELPPAYSSQGVEAIFQLEHIILAGHAREVPSDIPPRGLQIVLSDLLRNQEVDTIIMANLGYFQFKSAPGIHRLSIRPGRSLELYQFEKTDSSADGNDESHQLLSLTTFNGLTIYPRVRKRPDKIGENLIQPLSTSPTTSKKGPAAEFSKLMGQNQGIDLANGASRSVINVFTVASGLLYERMAYLMCVSVMRHTQSPVKFWFISNFLSPSFKRFIPHLAREYGFDYQLVTYRWPSWLRAQKEKQRVIWGYKILFLDVLFPLEVDRVIFVDSDQIVRTDLKALVDLDLGGAPYAYAPMCNDRNETKGFRFWDTGYWKESLQGRPYHISALYVVDLRVFRTVAAGDQLRQHYQALSADPGSLANLDQDLPNNMQGILPIFTLDQSWLWCETWCSDEGLKTAKTIDLCNNPLTHEPKLKRARRLIPEWDAYDQEVAALAARIKKNNQGDLAAKITVQAGQKIEDDQDLSSDPLSESDHLEKEQEDVMLDSSGLNQENPSTLLDKEGVSRDEL

SEQ ID NO: 4671 - protein, 1450 aa, Monosporascus sp.
MKASFPEPPYLVELLETAAGENATSYFPLLDQIADGTFAGLTTDKELYEKFLEVLQKDGHISSPDALSTFKLDLSLRAAAPRIEAHYQYYDTDVEPATHDLQEKCPEWILLEGKQYCSPSLEGAGAIIAAESPFHKALAEKARKGDVSYRLRYRTDKRGELAPLPVSGYGVELQLKRTDYIVIDDRDAEAEAEAGEIQPTVPTEVNLDQEEDVTDLKPLSSSELASLGLKAGSFIMQSEDPFETLIKLTQDFPKFSASVAAHNSSDAFTQEHRHNRMAMIPPGMNVLWMNGVQLIERQIDPFTLVDSIRRERKLIKGVTDLGLTGQEAVALLGNREVTLAKSGEDQTRRFDWRDEIEDGQVIIWLNNLEKDKRYANYPKSLMALMQRAYPGQIPPIAKDIFNLVIPVDFSKPDDLSLVVEQIQSLIKRQLPIRFGLVPTTTTKVAEDQAKIVYHLLENYGLGGLMSYLEAGLTGKTVSGPQEDNFDSITKARTPRAEATPLPFKEVFESEHHVKQIELARHWTERLGADTAVPPVFLNGLAIPRDEGWLRVMSMKLSSDLQMVQQGIFMGTVDDDMWVPSLFLEGAPSRRNVYIYPDSDNPLSVLDVNKMYSEHADLFSLIPVIEASEDASKETWATLSLVTDLSKREGLKLLLSALAFRRSNPGVRLDIVNNPTESTRGYSVNSILRKDVGKLLEVENLETLEVLVAGDVADEDDGYDSALSRFLAKNAFKSGDHLIILNGRAVGPIAVASLFKEEDFQQLLEFEQSTRILPVYKAAEALGLTEKISNPIAAAKLTSITAISTISDLPEGIFESAPSLRTNMFDEWNSTYTMFDVGDASTANIHFVAVLNPTSEVGQKWAPILKVLSELEGVYMRVFLNPKERMEELPIKRFYRYVLDSAPSFDEGGRVRSLGATFKGLPSEALLNLGLDVPPAWLVAAKESVHDLDNLKLSSIKSDVDAIYELEHILIEGHSREGSSPPRGVQLLLGTVRDPHFADTIIMANIGYFQFKANPGYYSIRLKEGRSSEIFDIISVGAKGYNAVPGDEGTEVALMSFQGTTLYPRLKRKPGKEEEDVLEESDHESGGDIISRGLKFAEGLLGGSKKKALSPSAEEHAEINIFSVASGHLYERMLNIMMVSVMKHTNHTVKFWFIEQFLSPSFKEFIPHLAEEYGFKYEMVTYKWPHWLRPQKEKQREIWGYKILFLDVLFPLSLDKVIFVDADQVVRTDMMDLVNHDLEGKPYGFTPMCDSRTEMEGFRFWKQGYWANYLRGRPYHISALYVVDLRRFRELAAGDRLRQHYHTLSADPASLSNLDQDLPNHMQFVIPIHSLPQDWLWCETWCSDESLASARTIDLCNNPQTKEPKLDRARRQVPEWTAYDDEIAALDRRRRGKAGTKQEDAGHIVFGGEQPGQKVLQGSRGAGEEAVQRNTKSKTLEDPGSEPTKSEKDEL

SEQ ID NO: 4672 - protein, 229 aa, Rhizoctonia solani
MDLKKVIFVDADQIVRTDLKELVDLDLQGAPYGYTPMGDDNEAMEGFRFWKQGYWKDALRGKPYHISALYVVDLVQFRKMAAGDRLRGQYQALSADPNSLANLDQDLPNNMQDQVPIFSLDKDWLWCETWCDSARFDRAKTIDLCQNPLTKEPKLARARQIPEWTLYDNEIAEFARSLADSGKIRSRAISGSVDALASVGKKVTTSNTEESPAPTPDEQAEPHQAHEEL

SEQ ID NO: 4673 - protein, 1516 aa, Grosmannia clavigera
MALLPSGSTAASSVNVGMIASFPSPPYLTELLETAAQENASSYFPILDRVASGHFSQAATDRDLYESFLSLLQEDNRVSSAEALSTFKLALSLRSAAPRIEAHFQYYRTAVEAQVADSPESCDQWILWQGGQYCSPSLDKATATVRNHEAQRKALPFDTKLGDGVDAILYADITSPDFGPFHTFLAAKARKGELAYRLRHVRSASSAGREDSLERLPVSGYGVELALKRTDYIVIDDREAEAAAATTTASADEVVLDGSDEVADLKALSKSELAELGLKAADYIVQSADPLATLLKVTQDFPKYSSAMAAHEVSEAFATEHRANRALLVPSGMNVLWMNGVQLTERQMQAFALVDMIRRERELVNGMRTLGLSGEEAVSVLGHDAVATSKATDTPLRFDWRDELEEGRAIVWLNNLETDARYADFPSNIRALLQGGQRGQIPAVRRNMFHQVYTVDLANEADVQLVTEQLQGFVRRMLPIRFGFVPLTYSKASTRQAKAAYYLFEACGISGLTAYLEQTVRDHTAASGPDARAFAAVLEGHVEAGFKTEDTPLLTLDEVLRSERYEQAIRLAQHWTERLGAGSSTAAPAIFVDGVAMPRDGNWIQAMSARLGQHLRSLQEAVYYGQIGEDDWVAGHFLQGAVTTRNPYIYPDESSVNNKLSVVDVGRLHAEHADLFGDIPVLEAGAEAGPETWAAVTVVADLESDEGVKLLFSALQFGLNNAGVRLDIVHNPSGPRKSTTGPKAVNAALWKQLEQLAGAESWEALKTLITTSEAAAASYVAAVERFRTATTIEAGANAVLLNGRLIQPIKQADDFGPDTFAALLAFEQQKRIEPVYAALADLELGERVLTSALAAAKLTSMVALSTMADEPEGIFEGGPALRTTTFRKWQTDHTSFAIGDETTATIQLTAVVNPASELGQRWTPLLSVLAQLDGVFLRVFLNPANRLDELPVRRFYRAVLAATPTFDEVSGRLAIPRARFDGLPSEALLNLGMDVPAAWLVAPKTSVHDPDNIRLSAVRGDVEATYELEHILIEGHAQEVQTQKGQRPLPPPRGAQLVLTTESGVLGDTIIMANVGYLQFKANPGHYRIQLKPGRSASVFALQSVGAQGMTAVPGDEGDDVALMDFQGTTLYPRLTRRPGMEAEDVLEEGGSSVAEYMAKGIRFAEGILGKKDKNKMKEKKATQADINIFSVASGHLYERMLNIMMVSVMRHTQHSVKFWFIEQFLSPSFREFIPILAAAYGFEYEMVTYKWPHWLRAQREKQREIWGYKILFLDVLFPLSLQKVIFVDADQIVRTDLYDLVTLDLGGAPYGFTPMCDSRVEMEGFRFWKQGYWHSYLSRNSQGPPAPYHISALYVVDLQRFRAIAAGDRLRQTYHTLSADPNSLANLDQDLPNHMQFQIPIFSLPQDWLWCETWCADEALATARTIDLCNNPETKEPKLDRARRQVPEWTVYDDEIAALAKEHRERGGQGGGDRRQGMPMRAADETSELSGDLRGETAGETAAEVGTEPRVRDEL

SEQ ID NO: 4674 - protein, 1571 aa, Plutella xylostella
MMKATGVYILFSVLVLVAATIASNPDPPKSAEKKSKSVTTSVSAKWEATPLVLELAEYLSGESSDLFWSFLDGVNSLKVSLENLETDKQKYDACIGVATTLLAPAQLRMAKLALSMHITSPAVRMFDQIAVQNGVKDVKCDTFVAIASRKICDDEVLRDILKTYDQYKPEDHQLETYLLDHTHPSSDNKSLTAILYGELGTVDFKTKHTILAAYADKGIINYVVRWNVKPRGRPKLRLSGYGVELQLKSTEYKSQDDSTPKEEGGEAAETSEEEDENDPQNQIDGFNFGRLKNLFPALRTPLERFRRHLSESSEELSPLKVWQMQALSMQAAAAVADAHAAGGDEALKVLTSIAQNFPMQTKSLIHVNVPRAFRDEVLYNQDIWSTALGLRPAEPLLLGSGAQYDAEEVDVMALLAALRADVGPMNTLHAMGLSKTLINKLLSLEMGEQFPVEEYGLDIRDSAVTWVNDLETDERYRRWPASYMELLRPTYPGMLRNLRRNIYNYVIVIDPISYASGPPLKLGETLLKHATPVRVGLVLAPAAGRGGREAALEAAVRAAFNYIAQEKNSNKEAFYFLTQLLDNTESKSAEKLSLEQIKKHLKKYASAGADLDDLIAEDSEFNFGQQLAEEFVDKIGNNKFPEVLINGVPLADDAGNPTASVEQLEEALVTSLARHTERLQRAVFRGALSDADSPVDYLMKQPHIVPRLNRRVLGSESSQYLDLSGAPASVELFTEDKIHKLMHLTGRDALATALPLLRYFTKATKQEKITQTIWIIGDLNNKDSRTLLKNALTYMRESTGIRVAFIPNVDGSSSVDQSLNKVVLAAVTALPPPRAAQYVAGLLDDEGCHEKQTCDILPELVPHLHKYEWWVLKAARVLCSRSLHLRASARAVVHNARMIGRLAETDKFVLDDFALLERFTSQTYGDKLSEVFDKKKSKINEVTDDDDDEEDDFIDLSPDARLKVISVVAGRGAHSRTPLPAGLRTEHSLVDLPPLYPDEAAIEMVAVLDPASAAAQRLAPLLLVLRKVVNCRVKLFLNPQDKNSDMPLKSFYRYVLEPELQFTPSGSQTGGALARFARLPHAPLLSMELRTPPNWLVECVKSVYDLDNIRLADVDTVVHSEFELEYLLLEGHAWDTTLGTPPRGLQLVLGTRETPDLMDTIVMANLGYFQLKANPGAWILRLRPGRSEEIYEIVGHENTDTPAGSADIQVLMHSFRSHVIKLRVSKKADKQHLDLLADGDEKNSGGIWNSIASSFSGAEETDSEDTINVFSVASGHLYERFLRIMMVSVLKHTKSPVKFWFLKNYLSPSLKESLPYMAKEYGFSYELVQYQWPRWLQRQKDRQRTIWGYKILFLDVLFPLHVKKIIFVDADQIVRADLKELVDLDLGGAPYGYTPFCDSRKEMEGFRFWKQGYWRNHLQGRSYHISALYVVDLRRFRRVAAGARRRGQYQALSQDPNSLSNLDQDLPNNMIHQVAIKSLPQEWLWCETWCDEKSKTYAKTIDLCNNPQTKEAKLSAAMRIVPEWTQYDEEIKALMARVRRGLFHAGDVDQESEIQHEEHDTSPSHDTHTEL

SEQ ID NO: 4675 - protein, 922 aa, Phalacrocorax carbo
AARSYYEQTGVGPLPVVLFNGMPFQKDQLDPDDLETVTMHKILETTSIFQRAVYLGELSNDQDVVEYIMNQPNVVPRINSRILMSDREYLDLTGMNNFYIDDFARFTTLDSKDKTAAVANSMTYLTKKGMSSKEIYDDSFVRPVTFWIVGDFDKPSGRQLLYDAIKHQKSSNNVRISMINNPSEDPNSQNTRVAKAIWAALQTQTSNNAKNFITKMAKEEIAKAVEAGADILEFAVGGMDINIFKEAFESPNVDFILSHAIYCRDILKLKKGQRAVISNGRIIGPLEDGEMFNQDDFHLLENIILKTSGQKIKSQIQQLGFEEDLASDLVMKVDALLSAQPKGEARIEYHFFEERYSAVKLRPKEGETYFDVVAIVDPVTRDAQRLAPLLLVLNQLINMNLRVFMNCQSKLSDMPLKSFYRYVLEPEISFTADNNFAPGPIAKFLDMPQSPLFTLNLNTPESWMVESVRTPYDLDNIYLEEVDNVVAAEYELEYLLLEGHCYDITTGQPPRGLQFTLGTSTSPVIVDTIVMANLGYFQLKANPGAWTLRLRKGRSEDIYRIYSHDGTDSPPEASEVIVVLSNFKSKIIKVKVQKKLDMMNEDLLSDGTSENESGFWESLKWGFTGGQKNEDVKQDKDDVLNIFSVASGHLYERFLRIMMLSVLKHTKTPLKFWFLKNYLSPTFKEFIPYMAEKYNFQYELVQYKWPRWLHQQTEKQRIIWGYKILFLDVLFPLAVDKILFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDSSKKRAKTIDLCNNPMTKEPKLQAAMRIVPEWQDYDQEIKLLHSLFQKEKESGTPAK

SEQ ID NO: 4676 - protein, 595 aa, Trypanosoma cruzi
ENHLPSTSGLTSFVVKPANGDTVPRHTLTVVIDPVAQQSQFLISLCDYVTRSPLGVSCTVHMGATEHASKLMRNFYQFVSEMELRFDAVGRVVPPAAVFHRLPSKHLLTLGIEEPESWTVFSLDAKYDLDNILLDKLPSSSQYLHAVYRINSILLTGSARDAEQPNPSRGLPLLIRSTKTNPEAGVTRDTLVMAIMGYFQLQSSPGVWYLTVQPGDIAKIFYISQVDGIPVNDGANKNHHGRFNYTAGQNIPVVVSSFTGKFLMLGVSKTPGHEEVSIEDVNEASALHVDWPPKGPIKSKPDRPTLNIFSVASGHLYERFLRMMIHSVMRTSFDVHGANTTRIKFWLIENFLSPQFKTLVPLLAKHYGFDVGFVTYRWPWWLHKQTEKQRTIWAYKVLFLDVLFPLDVDRVIFVDADQTVLADLHELYNMDIGNAPTAYTPFCRKHPNPATKNFRFWDHGYWLEHLHGKPYHISAIYLVDLRRLRAIAGGDKYRLVYSRLSSDPNSLANLDQDLPNFIQDQVPIYSLPEEWLWCETWCGAESKARAKTIDLCNNPLTKMPKLDNARLIIPGWEETDTELEALSEKLLQQQKQQIS

SEQ ID NO: 4677 - protein, 1476 aa, Wallemia ichthyophaga
MRRLGFFLTACLAYVNADLHTPPPVHVDVQASWSQPPYCEIAMEAAYRLQPGMFGRLLDTIDCTNTPEKIYTQVRSEITKSKQSLFDLHMALESSSPAIIASRSILESEGFSFDPECPNFISYQGRKICDVDEVSTLDQQAWPESTAIVDTAIDHILSEPSSAAPPTIIHYADPTAHNFKSFYDFFKKRTKVLKYVIRWAPTNASSQPQKLAGWGVKLDLKKREYLSLDDRTVSKRADDIKTNVISSEDYNFLPRKLQEAFGQSLVNFEGNDNIKTLSSNLIALLQQSDNQLELLNTISQNLPLLAPALADGAFEGAENVLNELSFNQDKYLKAGQNAIWLNGRRMYDKDLEPFTLLRQLESENLLIGAITDLGFSRSDAIKVLSHRALYASQIIRPDSVADGLVDASDRIEEGGVIRWMNDLEDHKQYNGKFWSPYMRNLLNPLGKVARNYLNGVLVIDLSNKQAIEMLSTNVRAFIDRGIPVRWGVVPYINPLNHDSLMAAKLFYGLIDSRGVDTCLNYFAEAVAYTGTFAERAEAAYSNLPSVNGTLSQDEFDTTVKSKAVKNDLKKAQSYTRRLGVSPGEHEESFAGEIFINGQPVQFDDKTILTLQEHITSQTEAITKAVRNAEIDERSDVSVFYYDKSSTLKRRNKYLQPSKKKAHYIQTYPKLLDGPYVTPETQDRTDVTIWLVSDFNKPESLELIKHALSGMIISPTFRLGFVHNPSECETATGTISQMLRMLPDRSSPLEFIDALQNRGEIREDADGIVNAGAWISETGINPGDSGLIVNGRVIGPIPPNGLVEEDYVYLFQRDYAERVLPVVKALDETCPHLLQDDPDTVATLLSRLGSLLWKTNQNEQPEGIYEPPYTPRARVWNRLHTKYTSIQVGKELSSQYSFDVVLDPMSEQGQKLTKILIALAETGDAHIRIAFNPDISIENLPTNRFYRFAMNSKPHFNQYGQSINQAVQFVQMPADALFTLELDPPQSWIARPVYAPVDLDNLNLVTAPYKDLNVIFQLDKIVVDGHARDSKTSLPPRGLQVALKHGQIDTQIVANLGYLQLAVTPGQWSLEIREGYGRQVYEIESLGSLGWNSPTVDEGFETFMLDSFEGVKLYPRFKKKPGMEGVDVLSEQRETGLVPYAKAAISTLKSFLGFTYESDHADINIFTVASGLLYERFASIMILSVLKHTNHSVKFWFIENFLSPSFIEFLPHLAKEYGFKYELVTYKWPSWLRPQKERQRMLWAYKILFLDVLFPMSLDKVIFVDADNIVRTDLKQLIDVDLHGRAYGYPPIGMDREEMDGYRFWTEGYWKDYLRGRKYHISALYVVDLKRFRQIAAGDRLRGQYQGLSADPGSLANLDQDLPNNFQTEVPIWTLDGSWLWCETWNSEESITQAKTIDLCNNPKTKEPKLERARKIPEWTEYDDDIRQFSDKLAKEKLIKSLLVTETEELAQGPKAAAEEAPTAPDYFKDNHRKDEL

SEQ ID NO: 4678 - protein, 1467 aa, Drechmeria coniospora
MALAASLQVSASPSVNVGMRAAFMDAPYLLELLETAAGENSTAYFPLLDRIANNHFGSLTTDADLYNAFVDVLQLDGHITNPEALSTFKFALALRSAAPRIEAHYQYYSTAVEPVVQDLSCQDWILFEGKQYCTPTMDTVAQEGLFNSQVKALPFDRALGNGKEAVLFTDPTSPTFAEFHNILSKAARASALTYRVRYRRSMANNSQPLPVSGYGVELTLKRTDYIVIDDRETGSDSAQGNLGSEKVFSDFEEAAELRPLSTTELSTLGMKTASFIRGSNDPFDTLLKLTQDFPRFAASIAAQNVSKEFANEYEENLGLMMQGTNVLWLNGVQLIDRQIEPFSLIELLRRERNLISGIKELGLDGSQAVTLLGQAVSSVQGGVEVQRYDWTDRPEDGRVILWLNDLENDVRYKQYPKTLISLLQRTYPGQMPPIGRDVFNIVVPSDFTNAEDLAFVSQIVPIVERGIPIRFGLVPLTPAPGATSRAKVLYYLNELYGPHAVINCIEQWRGKDSTDADATVLHNVVAAQESLSKTKPLSLAELLKAESYAERTKLAARWVERLDADTPTRPLFINGIVTPRDENWMQSMSVKIGEDLQAIQKRIFEGVLDEDTWVAGVFLDGATATRNKYIVLENDKALRMLDVGKIYNDHAGLFSQFAALPPSSELTMENWAVVTVFSDLETSDGLELALMALEFKRNNPGIHLELAHNPQDPSTASQINAALRSATELLISAEEEALREIVAAGKGHVSQEDHSAALSAFLAVSKIGSGTKTILVNGRIVGPIASGALFTAENFQQLLEFEQRHRIMPVYTAISNMGLTDKLSDAISAAKLTSMTALSTISDLPDGIFDSASATRSTMYSSWSSLHSGIELGNSETANIHLVCLLDPVSEKGQRWGPIIRVLSELEGVYVKILLNPQGHITELPVKRFFRYVMESKPFFDERGKVAEHRATFKGLPLEALLTTAMDVPPAWLVAPKVSVHDLDNIKLSSIENDVEATYELQNILIEGHSREGQGTPPRGAQLVLATEKDPLLTDTIVMSNLGFFQFKANPGFYNIQLKEGRTVDIYTIESIGAQGWGAVPGDEGTELALMDFQGKTLYPRLKRRPGMEHEDVLEKNDNSPDSFVSKGLKFAEGLFGNSKRSALSGQEHSEINIFSVASGHLYERMLNIMMVSVMRNTNRSVKFWFIEQFLSPSFKELIPHLAKEYGFKYEMVTYKWPHWLRQQKEKQREIWGYKILFLDVLFPLSLDKVIFVDADQIVRTDMMDLVTLDLEGAPYGFTPMCDSRTEMEGFRFWKQGYWARYLRGRPYHISALYVVDLHRFRELAAGDRLRQQYHALSADPGSLSNLDQDLPNHMQFQIPIHSLPQEWLWCETWCSDESLENARTIDLCNNPQTKEPKLDRAKRQVPEWTVYDDEIAALDMRRREQKNKGKTDHLTASSATQLEADIKSQTSEEGDARDDAHNMDEL

SEQ ID NO: 4679 - protein, 1435 aa, Kuraishia capsulata
MFMLLRLLVISVIFQYCSADLPDHTIDIQLAGNWKKTPFALNLIESASNENESYFLPAVSIILGVSLPSGDNDDFDETELSLEDISELSDEQAYLNVFKLLKNDFERASFNVSLSSRLFSPRIQAQYSHYTQTAQSSARTACGSDSSSWAVLNGEFYCHPDDVFALKTTGSSSMELLPFDRVVGDKNKPTVELYGDYRSASFKQFFLNLYISARAGKISFVWRYLPDLSADEPEYLNSYGVDLTLKRTDYIVIDDRKFDNQVTAGSKKAEDANDYIDDIPPLNKEHIPDLALKLTSHVLSTSNSDADRLKVLRDLVQDFPKYSSKIAQSGDDYASILGAVNENLKVPVPDGLYINGVPVPEKKLNPLKIMSVLKRELGLQDLLSRLMGSAANAANLSEELSGRLNEFTGSVVRYDVSSIEGAIVYLNNIEKDPQYEHYSTSRDSYGDLQPGVFPPVKENVHDLVFAINLSDPAQLYYFLQTVTAILNRSVPQRVGVLPLIQSEADEIIANQFLYACNVYGLRNGISFLINLNEEVFSKGLETISLSDLYLLDIPENYDFDALLSHNRRFQNRFKIDSPHILVNGVFYSLLNPRWQYMINSQVSYDINLLHSAYLEGSIPDGMSLRAYLLSGSRSHRNTFIAPDQGNAENFEFLTYTSEGAREEILRAVQDDKIHSFEKLIENIPSDTLWFIGSLKNPQVAAQLRNIADWFESSASDNVRALIVNTDLEKASPSGKISDLLHGISSGDVHLDREVVQLVESTLGLEVQAESAFILFAGRLIDLKSKLLDVNDLSLLKEFEEEHRLAFIRDISAGIPSVTSSADVFEHFVMLLTQTYYYKQTDYISGGLPPRYKISDLNTKTSLRVGSDESSIQVTIVLDPITEYSQKLLAISTMFQEMPFVSLKVILRPHSDLEDIPIKRFFRGVYDYRLVFDKETGAIDESSKRALFESVPDKTLFTLDIDAPPSWIVMIKEANADLDNVKLELSGPVSGLYELKNILIEGHSFETGSEDSPSMGMVVDLRQNGELYSDTNIMANLGYFQLKANPGLWEFSIKDGTPSSDLYSLLEVTKEYSANVKALTPKRVENLAILDLSGLVVYVKVSKKPGKENESLISLDQPEGTTGGSLINKGFGFLKGAFDRTQKTKQADINIFTVASGHLYERFLGIMTASVRRHTGHTVKFWLIENYMSPLLKKSLPILAEEYDFQYELITYKWPIWLRSQREKQRTIWGYKILFLDVLFPQDLDKVIFVDSDQIVRTDLKELVDLDLEGAAYGYTPMCDSRTEMEGFRFWKQGYWKNLLGENLKYHISALYVIDLKKFRELAAGDRLRQHYQTLSADPNSLSNLDQDLPNNLQHIIKIHSLPQEWLWCETWCNDESLKKAKTIDLCNNPLTKEPKLDRARRQIPEWTEYDDAITNLLNQRLFGKDEQSENTHDEL

SEQ ID NO: 4680 - protein, 1391 aa, Diplocarpon rosae
MELFTMPWSLTRALLATTYLHSLSVSASPSINVGMKASFSSAPYLLELLETAGNENGTSYFPLLDRIADGHFSQASTDKELFDAFAKTLKEDGHMVEPETLSSWKFAVSMRVSAPRIEAHYQYYHTAAEPSLSSEHDTSCPVWVLFNGKQYCSPELDAASGHIVGESQLQELQFDRILGSPSAPPSILYADITSPTFAKFHKILVQTAREGRTSYRIRHRRSLADEEKPLIIPGYGVELALKRTDYIVIDDREESEIKTASATHKKELKFEDEEFADLKPLSSSELSSLGLKASSFIMQSENPLESLVKLSQDFPKYSSAIASHNVSSEFIAEHQLNRDHMVPAGKNIIWMNGVQLMDRQIEALDLLDIFRKERKLVNSLRNLGLTRSQAIQLLSHFEVSMVNAENAAPRFDWRDEIEGGNVIIWMNDIEKDRRYASWPTTLQAFLKRVYPGQLPTVRRDCFNVILPVDLTNPQDILVVADTVLSFVKRKLALRFGLVPLTSTPDSVAHAKVVYHLLDNYGIQAAMEYLEAAYTSQKLSAPTAKSFQTAIGGRTVRNEKTALTLQEVLESESYQGRIEASKKWIKRLAADSKIPQMFIDGAAIPREENWLQLMSQMVTNDLQAIQQAIFSETIDEETWLPSHFLLGASTRRNTLIVPEDEKTLKLFDFNKLLEENKDILNILPRIEADASSEKASWAHLILVADLESKAGEKLLATAAVFREANPSIELVIVHSPSSVNTESGLSIDFYNHMLGNGHKAFSHINDLTAVLTAELAAPGEEIQQQSIEYWRGADAVVKSLGLLPGQNALLLNGRLVGPIPADSDFDQGDFEQLLSYERSKRITPVYAALESLGLQEIVSTPLAAAEISSIVATSTISDTPDGIFEQASTLRMSRFDNWNSTYTAIETGDVVTASIQITVTLDPASQLGQKWVPILKVLSELDGVFTKIFLNPRELLQELPVKRFYRYVLDSQPTFDDAGALRPLSATFTGVPQEALLNLGMDIPPAWLVAPKVSTYDLDNIKLSSIKTDVEALYELENILIEGHSREIPGGAAPRGVQLALGTERNAYTADTIIMFNLGYFQFKANPGYYKIGLLEGRSAEIFNIDSVGSKGWGPIAGDENTEVVLMSFKGATLYPRISRKPGMANEDVLESKPESKMDFVSRGLNFAQGVLGKGKGVAEKEVQAEINIFSVASGHLYERMLNIMMVSVMKHTKHTVKFWFIEQFLSPSFKDFIPSLSAEYGFKYEMVTYKWPHWLRAQTEKQREIWGYKILFLDVLFPLSLDKVIFVDADQIVRTDMIELVNHDLHGAPYGFTPIDESLKDAKTIDLCNNPQTKEPKLDRARRQVPEWTVYDDEIAAVDRRRKGLPVMAEKNIRSRTLAAEAVTSRKKDEL

SEQ ID NO: 4681 - protein, 1484 aa, Mus musculus
MCSRGDANTADAAAARRVTGLRYNMRLLIALALPCLFSLAEANSKAITTSLTTKWFSAPLLLEASEFLAEDSQEKFWSFVEATQNIGSSDHHDTDHSYYDAVLEAAFRFLSPLQQNLLKFCLSLRSYSASIQAFQQIAVDEPPPEGCKSFLSVHGKQTCDLDTLESLLLTAADRPKPLLFKGDHRYPSSNPESPVVILYSEIGHEEFSNIHHQLISKSNEGKINYVFRHYISNPSKEPVYLSGYGVELAIKSTEYKAKDDTQVKGTEVNATVIGESDPIDEVQGFLFGKLRELYPALEGQLKEFRKHLVESTNEMAPLKVWQLQDLSFQTAARILAASGALSLVVMKDISQNFPTKARAITKTAVSAQLRAEVEENQKWVNNLEVDSRYNSWPSSLQELLRPTFPGVIRQIRKNLHNMVFIIDPVHETTAELISIAEMFLSNHIPLRIGFIFVVNDSEDVDGMQDAGVAVLRAYNYVAQEVDGYHAFQTLTQIYNKVRTGETVKVEHVVSVLEKKYPYVEVNSILGIDSAYDQNRKEARGYYEQTGVGPLPVVLFNGMPFEKEQLDPDELETITMHKILETTTFFQRAVYLGELSHDQDVVEYIMNQPNVVPRINSRILTAKREYLDLTASNNFYVDDFARFSALDSRGKTAAIANSMNYLTKKDDSFIRPVTFWIVGDFDSPSGRQLLYDAIKHQASVSDFILGGGGIVERLSTPVLKTSNNVRISMINNPSQEISDSSTPIFRAIWAALQTQASSSAKNFITKMAKEETAEALAAGVDIAEFSVGGMDVSLFKEVFESSRMDFILSHALYCRDVLKLKKGQRVVISNGRIIGPLEDNELFNQDDFHLLENIILKTSGQKIKSHIQQLRVEEDVASDLVMKVDALLSAQPKGEARIEYQFFEDKHSAIKLKPKEGETYYDVVAVVDPVTREAQRLAPLLLVLTQLINMNLRVFMNCQSKLSDMPLKSFYRYVLEPEISFTADSSFAKGPIAKFLDMPQSPLFTLNLNTPESWMVESVRTPYDLDNIYLEEVDSIVAAEYELEYLLLEGHCYDITTGQPPRGLQFTLGTSANPTIVDTIVMANLGYFQLKANPGAWILRLRKGRSDDIYRIYSHDGTDSPPDANDVVVILNNFKSKIIKVKVQKKADMANEDLLSDGTNENESGFWDSFKWGFSGQKAEEVKQDKDDIINIFSVASGHLYERFLRIMMLSVLKNTKTPVKFWFLKNYLSPTFKEFIPYMAKKYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQTLFQEEKELGTLHTEETQEGSQKHEEL

SEQ ID NO: 4682 - protein, 1523 aa, Habropoda laboriosa
NLQMRLIVPLYFLLLCAIHLEADKRVNKYVTTQIDAKWKETPLALEAAEYLNDENPSYFWKFIDTFANYDMRNATEKDNYNAVIAFTKKYLSSSEVALLKLGLSLRIYSARVEMFTQMAENKNISILDCYNVADVGGRFTCSLEELEELASQETWLIPDTYSVDHRYHASQQSEKIIILYGQVGTPKFSDFHEKLKALAETNGITYILRHYLKDRVDRNVRLSGYGAELQMKSTEYKATDDSDIKDNADKDSETANDSTEEVDGINFMTLKNLYPDKQTELDKLQTHMLETSHEIGALKVWQFQELSHQAAERIMNSPTSEAINVLTDISQNFPMQAKSLIRTKVNVEMKKEMKLNQAMFSTSLNIQATDTALFINGLFFDLEAVDALSLLESLRSELRVMESLRKIGFSNKEMSTLLALDLSTNMDKQEFAIDIRDSAIIWVNDIEQDSAYERWPSSITELLRPIFPGMLRDIRKNLYNLVLIVDPLSAESTSLITLAQSLYLHTAPLRVGFVFVTNYDTSTTGLTDASVAVNNVYHYFAEAKGSEHALQFLIDLGNYIGPEGVDVEDVKRAVRAQDSSANINYILGEESEYDVGRHLASDFVKRSGFKKFPQALLNGVPLPSDQLNADSFEEVVLSTIMSQAHTLQKAVYRGELTQGDDVVDYIMNQPNVMPRLNERILKPEKHTWLNLIGTVPSDEDYSKWSPQDLSTWLMNKMRYMYVPRRTSVHHLYTFWVVTDLNDSTGRQLLREALDHMESNGDVRITVIVNPLLDTNDVDNTVDINQIVLAALNGLPIEKAMRFIRNMIKEDVVSDIVSGTFDIEEEDVREELKKQTDELTVHRRYVKMVLNLEKGTRAIVCNGRLIGPLDVGEEFTSEDFSLLERFSQSTYDDKLFKKLIKGQLLENEDDEYERNEITDDMLMKITSLLASHPQTRSRFHVPFHGEDYSVIKVPAANPDQVAFNLVAIVDPVSRGAQKLGPILKTLQRSLNCYITVFLNCLDKNSDMPLKSFYRYVFEPHLQFSSDGGINGAIAKFTKLPTSSLLTQYIHAPENWLVEVVRSVYDLDNIKLDNVAIGVHSEFELEHLLLEGHCFEAVMGNPPRGLQITLGTEKQPLMVDTIVMANLGYFQLKANPGEWVLRLRQGRSAEIYDFTTISGQDVLQNGNDVKVVISSLRSHVLKVKVSKKPDKVGMDLLSEDDKSSGLWNSISRTFTATDDSDDQDEKLNIFSLASGHLYERFLKIMMLSVIKQTKSPVKFWFLKNYLSPTLKDFLPHMAKEYGFEYELVQYKWPRWLHQQTEKQRTIWGYKILFLDVLFPLNVKKIIFVDADQVVRADLKELATMDLGGAPYAYTPFCDSRTEMDGFRFWKQGYWRNHLQGRAYHISALYVVDLKRFRRIAAGDRLRGQYQALSQDPNSLANLDQDLPNNMIHQVGIKTLPQEWLWCETWCDDTSKKYAKTIDLCNNPMTKEAKLQAAVRILPEWVGYDEEIKMLQLKLENENRQMEKEENDILEDSEDFTKHVEL

SEQ ID NO: 4683 - protein, 1722 aa, Papilio machaon
MNSTGLIISLLVILVHAFVFVSTDSDLPKRDEKKAKGVTTFVTAKWESTPIVLELAEYLSGESSDLFWSFVDGVNSLKSPLQGLATDKEVYDACIGIASTLLVPAQLRMAKLALSMHLTSPAVRMFDEIATQNGAKDVQCEEYVHIASRKICDTDTLRDILKAHKQYDPEEHSLETYLLDHSYPSSDNKTLTAILYGELGTVEFANKHKILATYADMGAINYVVRWNVKPRGGPKLRLSGYGVELQLKSTEYKSQDDTTPKETDAGEAAEPSVEEDENDPQNQIDGFNFGRLKGGPKLRLSGYGVELQLKSTEYKSQDDTTPKETDAGEAAEPSVEEDENDPQNQINGFNFGRLKNLFPALRTPLERFRRHLSESSEELAPLKVWQMQALSMQAAAAVVDANDAGGDEALKVLTSIAQNFPMQTKSLIHVNVPRSFRDEVLYNQDVWASSLGLRGAEPLLLVSGAQYDAEEVDVMALLAALREDVGPMNTLHALGLPKNLINKLMSLELGEAYTWEEYGLDIRDSAITWLNDLETDDRYRRWPSSFMELLRPTYPGMLRNLRRNIYNYLIVIDPTSTLSGPPLKLGETLLKHATPVRVGLVLAPGSDAALTAAVRSAFNYIAQDKNSNKEAFYFLTQLISSCENDQMTLEHVKKNLKKYASSGTNIDEIVYEDSEYNFGHQLAEEFLFKIASDKYPLVLINGVPLWDDGSPTPATSSVELLEEALVSALARHTARLQRSVFRSELSDTDDALDYLMKQPHIMPRLNRQVLASEPTQYLDLSGVPSSPELFTEDRLHRLMHLTGRDALATALPILKYFLKSGKPEKITQTIWVVGDLNEKESRDLLRNAITFMRETGGVRVAFIPNVEGGSVDQSLNKVVLAALATLEPAKATKYVTTLLEDEGCHERQDCDILPELVPVLNKLEWVLKATRVLCARGMRLRVGARALVHNARIIGPFEDKLGFSMDDFLLLDRFSNQVYGDKIAEVLLKKKTTVENDVFDESITVDIPELSADEYLKVISVLASRSPKSRTPLPQGLRTEHSLVDLPPQYADEAAIEIVAVLDPASTAAQRLAPLLLVLRRVVNCRLKLFLNPQDKNSDMPLKSFYRYVLEPELQFTAGGALTGGALARFSRLPQAPLLSLELRTPPNWLVECVRSVYDLDNIRLADVDSLVHSEFELEYLLLEGHAWDTTLGTPPRGLQLILGSREQPELMDTIVMANLGYFQLKANPGAWTLRLRPGRSEDIYEIVGHENTEMTAGNSDIQVLLGSFRSHVVKLRVSKRAGSQHLDLLADNEDANAGGIWNSIASSFGGGGGGGEEAEGAEETINVFSVASGHLYERFLRIMMLSVLKHTKSPVKFWFLKNYLSPSLKDILPYMAQDTGSSTSWCSTSGRAGCSDNAIASAPSIRGGGGGGEEAEGAEETINVFSVASGHLYERFLRIMMLSVLKHTKSPVKFWFLKNYLSPSLKDILPYMAQEYGFEYELVQYQWPRWLQRQRDRQRTIWGYKILFLDVLFPLHVKKIIFVDADQIVRADLKELVELDLGGAPYGYTPFCDSRKEMEGFRFWKQGYWRNHLQGRSYHISALYVVDLKRFRRIAAGDRLRGQYQALSQDPNSLSNLDQDLPNNMIHQVAIKSLPQEWLWCETWCDDNSKKYAKTIDLCNNPMTKEAKLSAAMRIVPEWREYDDEVRALQARVRRGLYQHTDTDQERHLHDAGKEHEHTEL

SEQ ID NO: 4684 - protein, 1543 aa, Pseudocercospora eumusae
MAGNTIYKAAALVGLLVSAKAAPSVNVALRTAFDAPPYLAELLETAAEENATSYFPLLDRVADGYFDSSKTDEELYKSFRTLLEQDGHLGKEDLSSFDYALSIHSAAPRIEAHYQYYNTSIVPSLPDDAQSACESWVYVPFSGQRYCSADLDEATAQPFGKAEASVHQLPFDRVLGDTASDKPSILYADLFSDSFRKFHKTLSKTARDGSTSYRVRYKASVGHERKPLTVSGYGIELALKRTDYIVIDDRNAEEEKKDEPVSANDGTLSEEEVSDLRPLSQSELRRLGLRAASFVMGSEQPFDTLLRLSQDFPKHSSSIAATEISEEFIAEHSANREVLVPAGFNVMWINGVQIMPRDVEAYALLEHLRRERKMIKSVQEIGLSGTEAVELLSHEAITASQVEQEVQRYDWRDNAEGGDVIIWMNDIEKDKRYAEWPETVTMFLQRTFPGQLPAVRKDCHNLVIPIDFADYNDALLVVESLRGFVQRKVPIRFGMVPIIKTPDSETQAKVIHYLIDRYGLATALDYLETSLETAGRKYGPVIEKLFRTAVETGELRPDKEEMTLESINGDAYLQSRIKGAKEWVARIGSTDVTPPVLMNGAPFQRNDDWLQTMSARVSQDVRVVQQAVYLGEVTDEDYLPYLFLEKASLKRNPLVIPEDDKDIRHVNLGELPSFGDLPSLGASKDTIERELVHLTVAADLDSKEGFEQLMEALMYRREHDNVEVAWLHVPRDGTADTRLGSVFYKDTALEPLFENLLWQYDTLVAEDPASNREGDTALEFAARKRIYAELYKKAARTNSPELDEKVRSIWAPFRSTISAAGITPGKKALLVNGRVVGPIPDSIGLDVSDIETLLSYERKKRLLPAALAIEGLNLQEKASTPLAFARVSNLIALSMVSDIPEGIFEAAPTVRTGMFKSWNSSHTAIHLGDEKTATIQVYASIDPASEVAQKWIPIIKTVSEMEGVYTRLFLNPKERLEEIPVKRFYRHVLSSKPSFESDGSLQANTAQFRGLPADALLNMGMDMPPAWLVAPKITVHDLDNIKLSAVKSDIEAIYELEHILIEGHTRDVTVGPPPRGAQLVLGTDADPHFADTIIMANLGYFQFKANPGVYNLALQKGRSEEIFRIDSAGAAGYNEQPGDNTTEIGLMSFKGTTLFPRISRRPGMEDEDPLEPAKTALDFVAEGAESLLSQLGLGNQASKYLSKATKLGSGLLSGASKTDSITERKHADINIFSVASGHLYERMLNIMMLSVMKHTKHSVKFWFIEQFLSPSFKDFLPVMAEEYGFQYEMVTYKWPHWLRGQKEKQREIWGYKILFLDVLFPLDLDKVIFVDADQIVRTDMYELVTHDLKGAPYGFTPMCDSRTEMEGFRFWKQGYWKNFLKGLPYHISALYVVDLKRFRQMAAGDRLRQNYHQLSADPASLSNLDQDLPNHMQALLPIHSLPQEWLWCETWCSDESLKDAKTIDLCNNPQTKEPKLDRARRQVPEWTEYDNEIAAVAKRHKEKMAGGVPAVQGSDGEESMQERLQREDAERERKKKEHVRDEL

SEQ ID NO: 4685 - protein, 1530 aa, Gonapodya prolifera
MLSNRPSHSRSIVSLLLLCAVFLHASASDSPPVVAVVQSSWSATHPLLEALELVAERGYSAFFGALSKVAVTPPPSSPEAVYDYIYKLLADNELNPPESPAYLPLAKVALSLHAPSAAVQSHYHLYNTTLSSRFAGNPEFRHHCPSWADVGGRQACSVEELDSILVDSDWKSSAPEVFPFDHQTGDSDSPAILYGDIFSVDFPALHSRMLSLASEGRLAYVLRFRPPQPQDDRSGGARISLSGYGVELAVKKTDYKVIDDRKIASGSDEDDGTEEAFAREESESDDVLGLLDTPQIVQIKDEEAIADLGLKASQLILKNPNPLAALEQLTGDFPKLAHIVAEIPTDETLRAHVTANKGRSGPRGRQQMGGGALNTLEVNGVELDPVLLDPYQLLRVLKTEASVIDSLGRYSLAANETISILNAPMPLYTSGKGGASDRIPWGDSFDTRPKTVAIWWNDLERDRRYMAWPKGINELRRFSFPGQLKYVRKNLFSCVMMLDVSKRTSLDLVEQVFNFVRGEVPIRFGLVPAVDADLSGEASDMAKMIKFLVDGYGLKDARDFIVSVLQAARDKGEQDSIVALAKPIFQTVVHESAPKHQVRGDVTAPLDELLASLDDSLTETKEYMNRLGVSAKESIAFCNGKPIVLDESWSQTMVSVYFQQIDYLVRSLYEDRVNDETDVFEFFATLPGVHSRRNPYLFTGSETVPVIDTNQVPRENVIYIAKDPKKTYPVSIWVISDFSDEAGVKLLREALAAINDDTSNARIGLVTSRHFASTRAKSIALQLRKAPVDRTIPTVALDDAMIAIENALTEENLERINREHSATTESDISEFLADNELPTLQVNLIVHNGRVIGPLGPGHYLTSSDINIAISMDFHDRISPVAERIEKILSIRDNVPQGHVVSEMIMQCTSTASLGSTLNELHSGLYKAPKSRTGFDPLQPTPLEPSEFQIGDMTKAHFFFSATLDPLTADSQKVSAILHRLSEIEGNLVHVRIRLEPTPKLTEVPLKRFYRYVFNPRVEVNPSGRVVASSAIFHGLPENALLTLGLDAPERWLVTPIASLHDLDNIKLSDLDLRSRKRGIESTFALKNILIEGHSRDATTNAPPRGAQLILGTEDRREIVDTMIMANLGYFQLKANPGIWELNLREGRSTDVYNIDLVTDEAKKMMLQKVDRVSGNANPRHSVILRSLEGVTLFVRLSKKAGMEKEDVLAPEKVDPAKLIPKSSGGVFGSIKALFQRPLDAVPSKKNTAINIFSVASGHLYERFMSIMFVGVMRHTSSPVKFWLIENFLSPSFKDTLPRLAERYGFDYELVTYKWPYWLRKQTEKQRTIWGYKILFLDVLFPMSLDRVIFVDADQIVRTDLRELIEMDIRGAAYAFTPMGDSRKETEGFRFWKTGYWANHLQGRPYHISALYLVDLERFRQMAAGDILRSQYQMLSADPESLANLDQDLPNNLQDQVPIFSLSRDWLWCETWCDDESFKTAKTIDLCNNPMTKEPKLDRAKRRIPEWAVYDAEVAELLANLTSGRKRDEL

SEQ ID NO: 4686 - protein, 1631 aa, Medicago truncatula
MRFRSIHFSLLFISITSFSLLLLLLLVTADTRSPKNVQTALRAKWSGTPLLLEASELLSKQQQHYFWNFIDIWINANDDANPDANANAKYCVKKILEHGRSLLTEPLASIFEFSLILRSASPTLVLYRQLARDSLSSFPLFHNDNEIAEIKKNETQLDPLRVGVSVESPGGKCCWVDTGEHLFFDVDELRSWLQNNHDHQKVGNSFQSPPVFEFDHIHFDSATGSPVAILYGALGTNCFKEFHVALLEAAKQRKVKYVLRPVLPAGCDAQIGPCGSVGVSESVNLGGYGVELALKNMEYKAMDDSAVKKGVTLEDPRIEDLSQEVRGFIFSKILDRKPELASEIMAFRDYLLSSTVSDTLDVWELKDLGHQTVQRIVRASDPLQSMQDINQNFPSIVSYLSRMKLDDSVRDEITANQRMIPPGKSLMAINGALVNVEDIDLYMLIDLVHQDLLLADQFSKLKIPPSIVQKLLSTLPPPESDMFRLDFRSTHVHYLNNLEEDGKYKWWRSNLNEILMPVFPGQLRQIRKNLFHAVFVLDPATTYGLESIDMIMSLHENSFPVRFGVVLYSSKYITQLEDHSTKEDGDKFAGDISDMIIRLFSYIKGNYGIEMAFKFLSNVNKLRIESDDNVEDAHLEQHHVESAFVETVLPKVKSPPQEILLKLEKEPELKELSQESSKLVFKLGLSKIQCSLLMNGLVIDPNEEALMNALNDETQRIQEQVYFGQIKSHTDVLDKFLSEAGIQRYNPRIIADNKPKFISLSMFTFGEASILKRINYLHSSGTMDDLKPVTHLLAVDITSGSGIKLLRQGLNYLIEGSKDARVGLLFSGNQTTNLFSLLFVKVFEITTSSYSHKKNALDFLDQLSSVYLQKYIRTPALEVDGTQAFIDEVCKLAESNGLPSEGYRSSLSEFSADEARRHLSEVEKFLFTALGSESGVNAVLTNGRVTSPIDESTFLSADLHLLESIELKKRTKHIVEIIEEMTWDDVDPDMLTSKFISDIVMSVSSAMSMRERSSESARFEVLSDEHSAIILNNENSSIHIDAVLDPLSPTSQKLSGILRVLWKYIQPSMRIVLNPLSSLADLPLKNYYRYVVPSMDDFSNIDSSINGPKAFFANMPLSKTLTMNLDVPEPWLVEPILTVHDLDNILLENLGDTRTLQAVFELEALVLTGHCSEKDHDPPRGLQLILGTKTSPHLVDTLVMANLGYWQMKVAPGVWFLQLAPGRSSELYIFKEDDDGSKNKQSSKLITINSLRGKVVHMEVVKRKGKEHEKLLIPDDDDDLQHKKKGSGWNSNLLKWASGFIGSNEQSKNAESNSPENARGGRHGKTINIFSIASGHLYERFLKIMILSVLKNTHRPVKFWFIKNYLSPPFKDLIPHMSQEYGFEYELITYKWPTWLHKQKEKQRIIWAYKILFLDVIFPLSLEKVIFVDADQIVRTDMGELYDMDLKGRPLAYTPFCDNNREMDGYRFWRQGFWKDHLRGRPYHISALYVVDLKKFRETAAGDNLRVFYETLSKDPNSLANLDQDLPNYAQHTVPIFSLPQEWLWCESWCGNATKSKAKTIDLCNNPMTKEPKLQGARRIVAEWPDLDLEARKFTARILGDDLEPIQSPDQSKDSTNEDSLKEDLESKAEL

SEQ ID NO: 4687 - protein, 1622 aa, Hymenolepis microstoma
MQLLEDMILDVQGVHVSKDGNRDLQKRLFRLTVASRALSPAVQTANHMASVAHFQFGANNLEACEGRKTWGRIGSMLICDLDLLEASVQKALIACSASCPDNLADSALLSDNVFPTNVESNSSPHLIVHGDLRSIEFYKWHMIAKQLAKDNKIVYIFRHFIRTRTSSKTWLNGYGVALDLKSTEYKAMDDKSSESGRDFSSDALSENEMEPVIQGFNFTLLRAKYPELKLELNSFQRHLITGTTEVKPLKAWQMRDLGLQAAQTVMDVASENDTDISGLLMIKDLSQNFPSRAYQLSQRKVTEKLKEELKINQNILEQHYGIQAGGSVFLLNGLALSPDIDIYALLDLLRSESHLLSQLHGLGLSTEQSARLLQVSPSGEDSYRVSTFIDSYKHTVTGERLLDISSAPILYLNDIERNPAYSSWIPNIHVLFMMGAPGQLRQIRKNLFNVVFVVDPTEPMAIEMLKLAEILILKKVPLHLGVLWSVNPEIDTLGRTLARAFVYIAENMKSYPGRRGLPSGLGNPGAMIALNFLTDLYSTYDEKDLTAQIVESEFKKAFPDAYYEDIFVEPGFECSYDKDIKNHFDFLEDSGIRQSAGSPSLIFNGMTFSLEGINKLGGLQEAIMTTALEQTVYFQQAAFEGRLYDHLSAAELFAADGLLVSRINHRLLSVLPPLVNKFALGDGSDGKSVTPFLQFDMLKASTEGSVASNLSPGEITNFLADQMRYLQKGDLESETRANTVWVVLGDIEPSITSSNHSLKLLAQAAKFMRRHATMDTRLGFVLNPSSTASFSEKGVWGAGGWLTRALLLIGHPAEKMFPMSNSDKTAEKYMNIMAAKNFIIKITEEALKMVRGEIKDPSPLSELTVSGMEVDKFEKTFAELDLKGKLALHTSFCQKTLHMQPGDSAVIINGRVYGPLLDNETFASEDFRLAEQLSIKSAGMETMAKQLAKMLPNRQPNYISELVWRSASVMESAKWRLTSFAKSLSSEGIFASGGSNRISLKGLRSQYSGFTLPANTEGLAYDLVAVIDPVSKEAQRLSEFLLVLRRSLPCSITVILNPVAGLSDLPLKNYYRFVWQPSLYTAEGESLAEAPSAYFDHLPGNSLLTLGVDAPHNWMVAPIRAEEDLDNLRLGEIASQTGNQRVDAEFELEYLLLEGHCLDNSTRQPPRGLQFTLGTAEMLDRYDTIVMANLGYFQLKANPGAWHLNLREGPSREIYKIIGHEYADSPSGAPSLIAVIDSFRPKIIRVDVQKKPDHLNDSVLEEKEEKDEMDADGSGGGGGGSDKPLGKLWSVVDSTINFIRMSSTTVDPLRNPNNETINIFSLASGHLYERFLRIMMLTVIRNTKSPVKFWFLKNYLSPSFKEFIPYMAEKYGFDYELVQYQWPRWLNAQTEKQRIIWGYKILFLDVLFPLNVKKIIFVDADQIVRTDLQELVNLDLEGAPYGYTPFCNDRKEMDGFRFWKTGYWQSHLGNRPYHISALYVVDLVRFRKMAAGDRLRGQYHALSRDPNSLSNLDQDLPNNMIHQVPIKSLPQEWLWCETWCSDKSKEKAKTIDLCNNPLTKEPKLKAAKRIIPDWTSFDEEIKELQEEFSKSKGKEAPVSTTTPVPRLVTTEQSDMTTEKEEL

SEQ ID NO: 4688 - protein, 1547 aa, Capitella teleta
MMRFLASALWLCLCAFLPIVLSKYVSVNLDAKWKHTPLVLEASEFLAKESNDKFWHFANAISEMKDFQTGEAMKKSNDEHQYLASLKIASHLISPLQLNLLKFSLALRANSPTVEMFNELSKDKSPPAECEVFVEVNSIISCEIDALGAFIKAAAGQPKPMLIKSDHHYPGTQGRPVMVILYAQLATPAFHQWHEILRKRAEDGEINYIFRHYIKESASHQVRLSGYGVELAIKSTEYKAKDDSKVEGQAPDSEEDTEDVEGFMFGKLKKLHPELNEHLTEFQEHLRKTSGDIDELKVWQLQDLSFQAAQRVLMAPEEEALATLREISQNFPIAARSLAGKPITDELRKEVKKNQDKLQNSVGLMPGDNAMFINGLQADLEVYDVFTLLDHLKAEAKLMEGIHHLAKQYSVVDKDEMSGLLKLDINSADSTYAIDIRDDSVVYLNNIETDRKYASWPASVQELLRPTFPGMLRHIRKNLFHLTFFVNPADPSARDLLKMAEAFYVHNAPARIGLVLVVNSDPEVDPMTDAGVAMYRAFNYIKTQDSPAKALSFITDIYDKYKSSGLAAEHVVTELREQKPKADVKKVFGVQGAWDKGRKESVEFFKRTGLTSAPQVLINGVPMKASELTADEFEEAAVTAILKATPDLQKATHSGHLNDRTDTLDFLMTRGNVMPRLNARILNPTDHFLDFSEEIRSYILIFTNCRLILFTFDSAAATMLTDLEAFQELSPGKMASAVANGLKYLAKKDEDAVRPVTMWIIADLESPEGRSTVYDAIKQMKTTNNIRFSVVHNPSEMPSPNTLSISRAVQAAISHLPVSTAKSFITKLVKEDLVKELESGSKTLEDLAVGGMDFDDYAVSLEKLDDKIFHAHRLFCEKAVEMKPGQIAVIANGRVLGPLTADENFIQADFALLEKFTHQQSAGKIHDKIKKLQLDQQDASDLTMKADALLSSVPQKESRKEVKFKAEKHSVLKISALSDGPAYEVVVVMDPTTRAAQKYTPLIEVLQQVTNVDIKIFFNCREKLSEMPLKSFYRYVLEPEVLFSADKSLASGPGAFFKDMPSKPILTLGMDPPESWLVESVKTHYDLDNIHLEEVERGVDSNFELEYLLLEGHCYDSQTGQPPRGLQYTLGTKTHPDQVDTIVMANLGYFQLKAKPGAWFLKLRHGRSEEIYDIISHEYTDSHADSDEVIVVMDTFKSKIIRVKVSKKPGMEMEDLLSESGAQADQGLWDSISSSLTGGTKDESEDKDETLNIFSLASGHLYERFLRIMMTSVLKHTKSRVKFWFLKNYLSPSFKDFIPHMAKEYDFDYELVQYKWPRWLHQQKEKQRIIWGYKILFLDVLFPLNINKIIFVDADQIVRADLQELADFDLEGAPYGYTPFCDSRKEMDGFRFWKSGYWASHLAGRKYHISALYVVDLKKFRRIAAGDRLRGQYQGLSQDPNSLSNLDQDLPNNMIHQVAIKSLPQEWLFCETWCSDAELEKAKTIDLCNNPLTKEPKLSAAQRIVPEWTDYDQQIKSLWDTVYSSKKPAVSSGSSHTSGDTKDRDEL

SEQ ID NO: 4689 - protein, 1550 aa, Gigaspora rosea
MILRKFISILVICFLSLIFISNAETPPVQAWIKTSWEAPYLVLEIIESVAVENSSAYFSLIDEFLGRGLISSNTMSDRDLYKQALDIIESGQYLSVPTSLSFLEFALYLHTTAPAVQAYYHYYNATVVPSTKDYIENHENLKFDPECDVWVDWYGNQACSIEEFKRITGITDNNKFDLSFNIKSDAPFPKLLPFDHILQYDEVTPIAILYANLYSPDFVTFHKLLSDLAKNGVLNYVLRYRPPREKRDMLYLSGYGVELALKNTDYIVLDDRDDVNVNENDNQEPIFQERSSTDHLFDQQISEIKPLKFGEITDLGLKAAQFVLEAQNPLLALSQLSQDFPKYSGPISQITLNSTWEAEIQLNQQYITDLEKNSIWINGLNLDSHTVDPFSLLKTLRRERQIMLSLKSLGLNLQRAVELLASPIISESKSSQDLFRGVFDVRDKSDEKHVIVWLNDLEKENRYAHWPHRIYELLRPVYPGQMRYIRRNLFSVLFVLDLSYVDNLKTITDYVNTLIARDIPIRFGVVPLFSDDQPNALVMAQIFYYLVDRYSTTLTMDFLTQIYSELNKKSTKEFIEIIREKYNHVINDKKLNEEKSSSTFEDIINSENSPVRKQIEDAAEFIKRFHIKPDDDGVLFVNGKYFDMDENYQRNMIQMINEYTMFLQQKVYIGEINDVTDIYDYFMSMPGIPDRRNSYIFVSDDKPLNVVNLVIDNNWSNVPINNLKYIYSENQTSEEIPMTILIVSDFNQEYGAMQALKALEFLDSSPNVRISFIHNPSNDTGDSIMSSMIYYLLYEVADLPKDLSFKSAFKEFLDKLSLEKNHMKDGDDEHQIPIGKIVNSAVSAGWQMIDNLKADKYWKDMKPFIKNRLKLDKGDTAFVVNGRIVGPIDPKDSFTPDDFELLANTELNERINPVIEAVKNLNLNLTLQGTNYSDFFFKLTSVISVSGVSDGPVSLFNVQNNKRDLLYQSLKRNYGLIQIGQKETAMYYISAVVDPLSQTAQKWSTILMALSQIEGVYIELYLYPQLNLKELPIKRFYRYVLEPRLTFNATTGALIPPTAYFAHLPEDPLLTLGMDVIQSWLVTPKASIHDLDNIRLANLTKGVDALFELKNILIEGHAFDVTTNSPPSGLQLILGTNNYPAMVDTIVMANLGYFQLKANPGVWTLQLREGKSKEIYDILSVGSEGWFSRNVNETGYEIVLNSFEGPIIYPRFVRKPGKENVNIKDDENDDSFWDYITNKFSHKQDIHKQDKAEINIFSVASGHLYERFLYIMILSVLRHTNSKVKFWFIENFLSPSFKDFIPHMAKEHGFEYELVTYKWPHWLRNQAEKQRTIWGYKILFLDVLFPLDLDKVIFVDADQIVRADLKELVDMDLNGAPYGYTPFCDNRPDMDGFRFWKSGYWSEHLNGKPYHISALYVIDLQRFRHVAAGDKIRGQYQYLSADPNSLSNLDQDLPNNMQHIVPIFSLPQEWLWCETWCSNESLSTAKTIDLCNNPLTKEPKLDRAKRQIPEWESYDNEVAALAEKITQQKASAPDNKQNVPERILHDHDEL

SEQ ID NO: 4690 - protein, 494 aa, Sugiyamaella lignohabitans
MNTPNAWIVTPSICEYDLDNIILSTASEDGVLKGTYQLSNILLEGHATDTTLDVPPRGLAVDLGTREEPKIVDTIVMANFGYLQLKANPGLWILSPKSGRSSKIFELVSIGLSSVSLSHESNKIWLTSMTGATIFPKFRRYPGMEDEDVLDTSEVSTIASKIGSGLAKVWSKFDRKTTNIVSVDDKSQAEINIFAVASGHLYERLLSIMTVSVMRHTNHTVKFWLIENFLSPSFKEFLPTLSSKYGFEYELITYKWPHWLRGQKEKQRTIWGYKILFLDTLFPQTLDKVIFVDSDQIIRTDLKELVDMDLQGAPYGYTPMGDSREEMEGFRFWKQGYWKKYLNGLPYHISALYVVDLKRFREIAAGDRLRKQYQMLSADPESLANLDQDLPNHMQRQIPIFSLPQDWLWCETWCSDESLATAKTIDLCNNPLTKEPKLDRARRQIPEWTVYDNEIADLESEFKQIKHQSNLEDKILDPVSSVQAEVDSIGHDDL

SEQ ID NO: 4691 - protein, 1523 aa, Unknown
  Description of Unknown: fungal sp. No.11243 sequence
MRPHIMGRAGQLLFATAVLTATANAAAPTVDVSLQAAFPAPPYLVELLEAAAEENNTAYFPLLDRIAEGHFDAATTDKQVYDAFLKVLQDDGHISDPQALSTFKLSLSVHSAAPRIAAHYQYYNTTASRIGTTGEECEAWLLFDGKGYCSPDLSAQPDAVVKDKHDLRMLPFDRVSGNPESQSSILYADITSPSFRKFHKTIAATIKDGRTSYRLRYKPSKSAKQEALAVSGYGVELALKRTDYIVIDDRAAPKQSEEEEKTAKQAVLNDDDDVADLKPLSASELQHLGLKAATFVMSSEDKLATLHRIVQDFPKYSGALAAGGVSDELWTELKMNAMSFLPPGYNALWINGIQSYDRDLDVFALLEQLRRERKLISSAKALGLSEKEAIELITHPAITSPSDQQDVQRYDWRDDIEGNDVIVWMNDIEKDKRYFDWPETVQALLQRTFPGQLPSVRKDIHNVILPIDFSNMTDLVMLVDSIQNFVKRGVAIRFGLVPITQSDAAAQQARIVYHLTQTYGLGVTLSYLESSFRAAVRGSRLSVQAHFEEAIHEKKLRRDRVAVPFQDVLVDEAIFAKIENARSYLTRLGASDADAPYITNGVPIPRGDDWMQHMSNRVGTDARLVQQGVYMGTIDENTWIPGVFLQGASSRRNALIIPEEDKDIRVLDLSSIPELGNAKFGSVPAIRANKESIDTYTAQMLVIADFDSEQGGKLFHDALQFRKEKDNVELFFLASSPGQVGGFTQKLDAILSKEGDLQLADLEGLEWSPATQDSSNNEGPAFSWKAGQILLQALHLPVASSVILLNGRVIGPISSMTSVTSDDLEMLLAYERKKRLQPIVTALEALGSFELASSPYSFSRITNFVALSQKSDVPEGIFEGGSTLRTSIFQQLKGEHSAFEIGNIETANIQLVLAIDPAAETAQRWLPVVKVLTEIAGVHAKIYLNPKDSLEELPVKRFYRHVLRPEPVFDASGKVDDRGAHFSGLPADALLTIGMDLPPAWLVSPKESIHDLDNLRLSSVKGDSVTAIYQLDHILVEGHSKDTTSGAAPRGAQLALTTGPGDRFADTIIMSNLGYFQFKANPGFYDLSLMKGRSQEIFHIDSAGLAGNIPSSEDTSNGIGLTSFRGTTLYPRLSRKPGMEKEEVLEPNKSTLERTVDTLADTAGGVLNAIGLDGKTAGDWISRASQKVASLSNAGSSSKDISTLPHADINIFSVASGHLYERMLNIMMLSVMKHTSHTVKFWFIEQFLSPSFKSFLPLMAEEYGFRYEMVTFKWPHWLRAQKEKQREIWGYKILFLDVLFPLDLDKVIFVDADQIVRTDMYELVQYDLKGAPYGFTPMCDSRTEMEGFRFWKQGYWKNFLRGLPYHISALYVVDLVRFRQMAAGDRLRQQYHQLSADPGSLSNLDQDLPNHMQHVLPIHSLPQEWLWCETWCSDESLGVAKTIDLCNNPQTKEPKLERARRQVPEWTVYDDEIAAVAKRKAGENASLPGIGEKGEQERLQVEEYRRKQEEEKAKNGDRVKDEL

SEQ ID NO: 4692 - protein, 1524 aa, Lomentospora prolificans
MKPRRLPASLGALLLTFASAPALAVPSISVSMRAAFPAGPYLLELIETAAAENSTSYFPLLDRVAGGYFTDAASEKDLYDRFLALLLQDGHISDPDALSTFKLALSMRSAAPRIEAHYHYYSTGVEPNFPSGSTPACDTWAFFDASRYCDYDSLSSLVVNGEPARLPDLPFDRVLGTGPSVVLYTDMQLPSFASFHNSLVEMARRGDISYTVRYRRGERPEEDDSPLPVSGYGVELALKKTDYIMIDDRDATTGRNGDSTVNRDSPDQIVLSEEEEVTDLKPLSKAEVSSLGVNAASLIMKSESPFDTLVKFTEDFPKHSAWIASHNASDEFIKEQRENLGGIVPPGVNVLWMNGVQLIERQIEPFTLVDMLRRERKLIAEAKNIGLTGSQAIALLGHPNVTSAKVDGSSQRFDWRDEREGGGVIMWLNDLESDTQYEEFPSVLTALLQRTYPGQVPRIRRNIFNAVIPIDVAKVDDLKVALQILAFVHRLLPVRFGLVPFSSNAGATDLMKVFYYLHDNYGLEGLFTYIELAAHGEQAAADDAMFEEAINAGSPPAGFKTQKLEEVLASTPLNERIRLTENWVGRLNVNSGTTPVLVNGVIVPRIDNWLQGMGARINLDLQTLRQGLQLGEVNEGTSIQELFLQESVVSRNLRIYADDEEGLNMIDLGKLYREHATLLRNVPVLDAYVDSTLENWATLSVVADLTSEDGLSLLQSALQFKANNPGIRMDIIHNPIAETSMASEINAALVANSGKLLEAGSIQEIRSLLSSHAFAPDTSYGTLLSSYLASTKLRPGSKGLILNGRVVGPLSDNEAFDEDGLQQLVEFERKNRILPVYSAVTDLGLGKVIKDPLAAAKLTSLVALSTISDLPEGIFESAPTLRTSIFNTWRSRHTTIEVGDPESASVHIVGLLNPASEQAQRWTPILKVLSQVDGVYVKLFLNPDERLEELPIKRFYRYVLEAEPTFDEVGKVKPVGATFRGLPLDALLTVGMDVPPAWLVAAKSSVQDPDNIKLSLVKGDVDAVYELRNILIEGHSRMVTQNTAPPSGAQLVLGTEKTPHSADTIIMANLGYFQFKANPGFYNIQLQTGRSSEIFEIESVGALGYGVSPGDEGTSVALMDFKGTTLYPRLKRKPGMETADVLSDGANEAKPSSENLLSRGFKAAAEFLGGSDAKASGGDKGKPLKEHADINIFSVASGHLYERMLNIMMLSVMKHTDHTVKFWFIEQFLSPSFKDSIPHLAREYGFQYEMVAYKWPHWLRQQKEKQREIWGYKILFLDVLFPLSLDKVIFVDADQIVRADMMELVNYNLEGAPYGFTPMCDSRTEMEGFRFWKQGYWANYLRGLPYHISALYVVDLRRFRELAAGDRLRQQYHTLSADPNSLANLDQDLPNHMQFMIPIHSLPQEWLWCETWCSDESLRDAKTIDLCNNPMTKEPKLDRARRQVPEWTVYDEEIAAFERKRKGETTAEDRKEVPSVQEQEQLKEKEEAQSQAAEDDGENEPAVERNTKSRKWEEEPSSRVKDEL

SEQ ID NO: 4693 - protein, 1483 aa, Aspergillus bombycis
MISGIGPVASWRLSVIVAALLTCLVHASPSVNVALEASFDSAPYLIELLETAAEENATAYFPLLDRIADGAFDDVVTDKEVYDRFLQVVHEDGYLRTPESLSSFKLSLAIRSTSPRIAAHYQYYNASVQHSLMAAQDAACPVWVHSDGKQYCSSTMERAQQDVSGDLDLRELQFDRVLGDTSLPPAVLYADVASPMFKEFHQTLSALVKEGQISYRVRYRPPQHWSPRPLYVSGYGVELALKRTDYIVIDDRDAGQKERRNEANKVGDLEEDAPDDLRPLSSSEVSRLGVNTVSYVMDSNNPLGTLVKLSQDFPKYSAKIAAHNATTKLLQDIRSSRLGMLPSGVNVMWINGVQMDPRKIDAYSLLDHLRRERRLIEKFRDLGISAQEAVDLLSHKLLGESLEQDAPQRYNYRDEIEGGGVLIWLNDLEKDAKYDSWPGELGAFLRPTFPGQLPQVRRDAHNIVVPVDLTDAEDMNFVVKTIQVFVKRKIPVRFGLVPIASSPGSTAQLKVAHYLQETFGLASLIQYLEESLSANKIASPDKTSFQAATKERKARADRSALSLEEIQKHGELAKTVSRTVSYQNRLQITGGSSLMFINGVPVVRDDNWVQEMSNRVGKDLQSLQQGIMDNAFEEDTWLPGVFLSQAFDRRNPWVIPEDPKDIRVIDLAKVSESQKGGLDVLPRITSDKDNALDSVHMIVIGDFDSESGAKLLTAALESRQKHSDVEILFLHNPAHVPSASGSIALYHLLKESQNVDVTQVLADIGSSGASVPAHKEAEIAHFWALQQPLAGELGFAPGVSGVVINGRVVGPIPGDYTVVPDDFDQLLIYEHTKRIDPVAKAVKDLAIGSKLSGPLAFAKLTSLATLSTISDVPEGIFESTSDARMNLFDKWNDSHSVVTVSNSEDPAITIVASIDPTSEVAQKWLPILKVLSELASVRLRLFLNAREEIQELPIKRFYRYVLDPEPSFSNDGAVLRPGASFSGVPVEALLTLGMDVPSSWLVAPKDSVHDLDNIKLSSLKAGSDVDAIYALEHILIEGHSRDLTTKTPPRGVQLALGTQENPYFADTIIMANLGYFQFKAQPGLWQINLKPGRSERIFKLDSVGGMGYAPQPGDENNEVALLSFQGKTLFPRLSRKKGHESEDVLDTNSKPGSAMDYVSKGLSFASGILSSVGAGSKLSTTEKQADINIFSVASGHLYERMLNIMMVSVMRNTKHSVKFWFIEQFLSPSFKSFLPHLAKEYGFSYEMVTFKWPHWLRAQREKQREIWGYKILFLDVLFPLSLEKVIFVDADQVVRTDMYDLVNLDLEGAPYGFTPMCDSRHEMEGFRFWKQGYWKNFLRGQPYHISALYVVDLSRFRALAAGDRLRGQYQMLSADPNSLSNLDQDLPNHMQHQIPIKSLPQEWLWCETWCSDESLGQARTIDLCNNPQTKEPKLDRARRQVPEWTEYDGEIAALVEKVSLEQQQSEEVQPDDEEDEEWTKDEL

SEQ ID NO: 4694 - protein, 1634 aa, Handroanthus impetiginosus
MGTQVRSGFCFVILILLCICISGHSVSAESRRPKNVQVALRAKWSGTPLLLEAGELLSKEWKDFFWDFVESWIHSVNVDSDSSTAKDCLKKIAKYGKSLLSEPLASIFEFSLALRSASPRLVVYRQLAEESLSSFPLADDFIASSSGGPNETTKGKNSEAFLLGMNPNSPGNKCCWVDTGGSLFFEVTELQTWLQEPNDVTDGAFQQPEVFEFDHVHPDSTAGSPTAILYGALGTECFKEFHMALSEAAKKGKVKYVVRSVLPSGCESKSSPCGAVGTGEALNLGGYGVELALKNMEYKAMDDSAIKKGVTLEDPHTEDLSQEVRGFIFSRILKRKPELTSEVMAFRDYLLSSTISDTLDVWELKDLGHQTAQRIVHASDPLQSMLEINQNFPSVVSSLSRMKINDSIKDEIIANQRMIPPGKSLMALNGALINIEDIDLYLLVDMVHQELSLADQFRKLKVPPSAVRKFLSVLPPSESYAFRVDFRSSHVHYINNLEVDAMYKRWRSNINEILMPVFPGQLRYIRKNLFHAVYLLDPASLCGLETIDTIISLFENNLPMRFGVILYSTKLVEKIEANDGELPAAYLKDDQEDISGLIIRLFIYIKENHGALMAFQFLSNVNKLRIEAAAEDSPEMHHVEGAFVETVLPRAKSPPQDTLLRLEKDQTLNELSHESTMFAFKLGLAKLECSLLFNGLVYEPNEEALINAMNEELPRIQEQVYYGQINSHTDVLDKFLSESGVQRYNPKIIADGKAKPKFVPLCASILAKDSVLNDLYYLHSPETMDDLKPVTHLLVVDITLKKGMKMLREGIHYLIGGSKNSRIGVLFNAKEDATLPSLFFMKVFEVTASSYSHKKGVLQFLDQLCSFYEKEYILTSGDAASHQALIDKVFQLADANGLPSKGYESALSGFSAENLRSYLDKVTQFLYRTIGLEYGANAVVTNGRVISLLDASTFLSHDLHLLESLEFKQRIKHIAEITEDIKWEDVDPDMLTSKFISDIVMAISSSISMRDRSSEGARFEILSAEYSAVILQNENSSIHIDAVIDPLSPSGQKLSALLRILSKYAQPSMRLVLNPVSSLVDLPLKNYYRYVVPTMDDFSGTDHTVHGPKAFFANMPLSKTLTMNLDVPEPWLVQPIVAIHDLDNILLENLADTRTLQAVFELEALVLTGHCSEKDHEPPRGLQLILGTKNTPHLVDTIVMANLGYWQMKVFPGLWYLQLAPGRSSELYVMKADGEGTQDTSLLKRITIDDLRGKLVHMDVVKKKGMEREKLLVPDDDDSHSSNKKGTKNGWNSNILKWASGFIGGKDQSKKGQSGSLEPESGGRHGKKINIFSVASGHLYERFLKIMILSVLKNTKRPVKFWFIKNYLSPQFKDVIPHMAREYGFEYELITYKWPTWLHKQKEKQRIIWAYKILFLDVIFPLALEKVIFVDADQIVRADMGELYDMDLGGRPLAYTPFCDNNKDMDGYRFWKQGFWKDHLRGRPYHISALYVVDLVKFRETAAGDQLRVFYETLSKDPNSLSNLDQDLPNYAQHMVPIFSLPQEWLWCESWCGNATKSKAKTIDLCNNPMTKEPKLQGAKRIVAEWPDLDLEARRFTAKIVGEHFEEPQELVAAPEIQTADDDSSEDLESKAEL

SEQ ID NO: 4695 - protein, 1434 aa, Fusarium avenaceum
MPCVSQCLAIALVAAVATSASPSVNVGMNAAFPRGPYLLELLETAAEENSTAYFPLLDKIASGHFGSATSDAELYDQFLEVLQQSGHITTPDALSTFKLSLSLRAAAPRIEAHYQYYITAVDPKSKIDGADDCQTWAFIDNKKYCSPALDTVVDSDLSAKQLNVLPFDRVLGLGKDAVLYADPTSASFGPFHDSLSRAAKQGSLSYRLRYRRSSSIPATPLSVSGYGVKLDLKRTDYIVIDDREADHKGQKPIANDVDLDADEEVADLKPLSTSELASLGLKTASFILKSENPLDSLVKSTQDFPKFSGSIAAHEVTKEFADEQEKNVAAGIPSGINFIWMNGVQLIERQIEPFNLVEMIRRERKLIDGVRKLGFNGQQAVSLLGHPQIASSKADDEAPRFDWTDRLENHKALIWLNNLEKDSRYQKLPSDLTAAYGRAFGQLAQFMQRGVTLRFGIVPLATTPTAAAQAKVVYHLMETYGLEALITYLQESEEGPDGAANKRAFSRTIDDREPVPGASKMSLSEVLEAESYVQRVKASQAWASRLNADTAVRPVFVNGLAIPRENNWVQTMGQRLSEDQQVIQKAVYFGQIEEGMSVSDLFLNTALSKRSTYIFPDDDKALRILDVNKLYTDYTGLFGKIAVLPADAKAAKVDWAVFTVVADLNTDDGQDLLVAALEFKHKSPGVRLDLIHNPSSPTDAHTINGAFKVNEGRLSKMRNKDELKTILEASWTSEDEGFSTALASFLSVANIRPGTKGLLLNGRVVGPLPSNVSFKNDDLQQLLEFEQRNRILPVYAAIEELGFTDRLLDPIAAAKLTSITALSTISDLPQGIFESAPSIRSTLYTTWNSTHTAIEVGNPETASIHIAGLLNPISEQGQRWAPILKVLSELDGVYLKVFMNPKEVVGELPIKRFFRYVLNSKPSFDKTGHVQSPKATFKGLPSEALLTAGMDVPPAWLVAAKNSVQDLDNIKLSSAKADIDVTYELENILIEGHSRDGKRGAPRGAQLALATETDPLVTDTIVMANLGYFQFKANPGFYNIQLKEGRSSKIFSIESVGAQGYSPVPGDEGTEVALLDFKGTTLYPRLNRKPGMEELDVLESPDKEDKGIVAKGLKFAEGLLGGTKSPKEISAQEHAEINIFSVASGHLYERMLNIMMVSVMRNTKHTVKFWFIEQFLSPSFKEFIPHMAAEYGFKYEMVTYKWPHWLRQQKEKQREIWGYKILFLDVLFPLSLDKVIFVDADQIVRTDMINLVNHDLEGAPYGFTPMCDSRTEMEGFRFWKQGYWANYLRGLPYHISALYVVDLNRFRQLAAGDRLRQQYHALSADPNSLSNLDQDLPNNMQFTIPIHSLPQEWLWCETWCSDDSLAKARTIDLCNNPQTKEPKLDRARRQIPEWTVYDDEIAALDRRRKGVEDNKDKSIKNQAVEGGAHTKDEL

SEQ ID NO: 4696 - protein, 1893 aa, Artemisia annua
MEPRSDLGFGNVLMYVFGLFSAEIKDQNVQVALRAKWPVLHYFLKLVWELLSKEWKDHFWDFIEIWINNESGNTDHYTAKDCLQKISNYGKSLVTGPLASVFELSLTLRSSSPRLVLYQQLAEESLSSHPLSDDINANFIDGGASEDNQDKKADSLLVGVNPKSPGGKCCWVDTGGALFFDLPDLLSWLRNPHKDGDIFQQPELFDFDHVYFDSAIGSPIAILYGALGTDCFKEFHRSLVEAAKEGKVKYVVRPVLPSGCESKSGHCGAIGTKDPLNLGGYGVELALKNMEYKAMDDSEIKKGVTLEDPHTEDLSQEVRGFIFSKILVLSRYFLLIFKNLVIINAESGLHVENYFLRGDGDIFQQPELFDFDHVYFDSAIGSPIAILYGALGTDCFKEFHRSLVEAAKEGKVKYVVRPVLPSGCESKSGHCGAIGTKDPLNLGGYGVELALKNMEYKAMDDSEIKKGVTLEDPHTEDLSQEVRGFIFSKILERKPELSSEIMAFRDSLLSSTVSDTLNVWELKDLGHQTVQKIVHASDPLHSMQEINQNFPSVVSYLSRMKLNESIKEEILSNQRMLPPSKSLMALNGALIDIDDIDLFLLLDMVHQELSLADQYTKLKIPSSTVRKLLSTLPPAESSGFRVDFRSDHVQYINNLEADARYKQWRSNLNELLMPVFPGQLRYIRKNIFHAVYVLDPASICGLETIDTIVTMFENSLPVRFGVILYSTKMIETLEANGGEFPSSLENESQIKEDLSSLTIRLFHYVKENHGMLKAFEFLSNVRVNKLRMESGEEDAPVLHHVEGAFVDTILPKAKTPPQDTLLKLEKDQSFRESSQESSLFVFKLGMSKLECSLLMNGLVHSSNEEALMSAMNDELPRIQEQVYYGQINSRTDVLDKFLSESGIQRYNPQIVGDKAKPKFVSLTASIVGDESLLSNMEYLHSVGTIDDLKPVTHLLAVDLTSRKGVQLLHEGIRYLEALMSAMNDELPRIQEQVYYGQINSRTDILDKFLSESGIQRYNPQIVGDKAKPKFVSLTASIVGDESLLSNMEYLHSVGTIDDLKSVTHLLAVDLTSRKGVQLLHEGIRYLMAGSASARVGFLFNSDLDSGSNSFILMKALEITASSYSHKKKVLNFLDQLCSFYATSQDSQSSQALLDKISELADASGIQSKGFMSALSEFSVSKFTSHLKKVGQFLHGQVGLEKGVNAVITNGRVVRVPEAVTFLSQDLHLLESVELKQRVKHVADIIEEVTWENVDPDTLMSKFMSDIIMSVTSSLSTRDRSSEGARFEMLSADYSGVVLGSENSTIHIDAVIDPLSSSGQKISALLRIIQKCSQPSMRLVFNPLSSLVDLPLKNYYRFVIPSEDDFSNTDSTVHGPKAFFANMPLSKTLTMNLDVPESWLVEPVIAVHDLDNILLENLGDTRTLQAVFELEALVLTGHCSEKDHEPPRGLQMILGTKKNPHLVDTLVMANLGYWQMKVSPGVWYLQLAPGRSSDLYILQDGQEMHLTKRITIDYLRGKPVHLGVVKKKGKEHERLLIPSDDDDSSRKQGDEESWNSNILKWASSLIGGNGQSKKSVSTKVENVNNGRKGKTINIFSIASGHLYERFTKIMILSVLKNTQRPVKFWFIKNYLSPQFKDVIPHMAQEYGFEYELVTYKWPSWLHKQKEKQRIIWAYKILFLDVIFPLSLEKVIFVDADQIVRADMGELYDMNLKGRPLAYTPFCDNNRDMDGFRFWKQGFWKEHLRGRPYHISALYVVDLIKFRETAAGDNLRVFYETLSKDPNSLSNLDQDLPNYAQHTVPIFSLPQEWLWCESWCGNSTKSRAKTIDLCNNPMTKEPKLQGARRIVTEWPDLDLEARRFTSKILGEDVSPVEKVVSPPAQQEVPEEDLERKDEL

SEQ ID NO: 4697 - protein, 1859 aa, Smittium mucronatum
MFSGRKFVRFLLTLLVVQHSAPFVSVLGDDSQGPSEPALGQKSNQHVFAKDQGLPSADSPPIKAMLRAPFASPHILLELGEIIYSRNPNYYFLFLDYLTKNPSLFDSSPEKAYKSGMDWLKTELLASNSVSSSDSIDWIIGLSDLDLSVHTKAPKIIAQFQYYLNVVSESPLFSQSPNTHPPSNSNSNNNNEKNQIGDCHSWVWWNGNKACNQDDLEKLVESQTFYGDTYKSPVTSFPVSLSFDHIYPSPNPNKHPDNVAILYGHPSSTGFSKLNNYLIHLSNLGDTKYILRLIPPHNSNSPIVSNGNLNGMELSGYSVELVLKSTEYKVIDESNLFSNTDGQVEGSGNEWNFGENHYKERSYISKKPSSLIQADNNSTIVTNIDKDLLINLSKNIAEEVLNASEPLEMLEWITGDFPKYTHLFTHPPKNKTRAKIAQKLSKKLVGVKNVITLNGLAITPQSLNPFEISNMLENERKVSSSLQSLGLSSEQAIHFISSPMGTNPDSSPDSTNASEDLIYDISDKNEGRLVIGWLNDLSNDLRYKKWPSGISSIFYSQGSSSLPQISENIVSSVSALDLSTIDGIQFFTETIIGAIKKDYPFRFGIVPMSSTFSSSAILKSKTCVDLTNIDFSQPDQSLATSSLSPEPADTMARVFYYLYHFAGIRKTTEYFTQVLKLASSKNPSEISANTIIQVAESAYNSIIFGTKNNQSLKKIKNLITNFSNDKDTIDLISQKYRDDFLSWDLIKSDPVLGALLCKHSSYVSRLNLIAPDTNQVASKDELPNSQSVTVFANGNQITDLGSFVPELVKNYQQSSYLLLTKLLSGSIPNTGMDILQEIISSTPHTAFRNQLITSKCFLDSKPGTKLVAKSEQVGILSLFNSDFSNSQTKKIKQWLSGIEYLYIPSLQTPQISNSIPTTIWLWANLDSVVGRNRIVESLQSALDLCISGKNEISGFRISIFHVPKSFSKDKTVEEDNDEEGDNQDGDTKNVPKSKEGKLIYFIMKKITASGDSSKFSSNEAKLLATTYIQHLLKNKEDSAITGQNLIDELKNLDKKSKLKLDLNLANDLVETLNKEISNIERDDEISSYYNKYSADMVDLIKVSYGGGNWDEISIFKNGFQPDDFLISISGRLFPVVKSHQQYNSDVVKILLAREYAARIGGSEKAFSKGLTAKESKKQKRISADTFLQTLCILEQSKMSSISDSIFQSGNTLNRLDIFEGLDGYEDFTFEVSTSNSRNKNSNIYAHFKAFLDPISDDVQDVVPFLRILSKIPGIKVSVMINTFTVPESLPLRQFKRFVFNHKPLFDSKNGGQRVGVGAEFNNMPKDALLTLEMNVPSSWVVSATKSDYDLDNINLKSVNSKFGIAALFSLNSVLIEGHAQDTVNKSPPSGLQVVLSKGPYSVSSNKSQFDNDVYSREKSNYGEIEAETIVMSNLGYFQLQGQFGVYSLSTREGRSSRMIEIICLGANSYSKCSRALESKYVEKSKESNNYGVIVSDSFNGVTVYPVFSKRAGMEKESILASGGDEDKPIDEGVGIWESAMRAFNKMFGAKDEPNEKEINSVVEVKEADLNIFAVASGHLYERLMSIMIASVVKHTKSTVKFWIIENFMSPSFKKFVPILAAQYKFQYEFVTYKWPHWLHSEKEKQRTIWGYKILFLDVLFPLKLKRVIFVDADQIVRADLQELSDTDLEGAPYGYVPFCEDRKEIEGYRFWKVGYWKTHLKGRPYHISALYVVDLTRFRELGAGDKLRYQYQSLSSDKNSLSNLDQDLPNNIQHIVPIYSLDQDWLWCETWCSDQGLERAKTIDLCNNPMTKEPKLERAKRLIPEWNVYDAEIQKLRTSFNSDSSQKKEKPDEYIKQEL

SEQ ID NO: 4698 - protein, 1460 aa, Folsomia candida
MTWISSCLQFLGVVAVTAIIVTVTEAHQPPKQSITTRLQAPWAPTSLLHEASEYLGELNPNLFWSFLETTLQKLEHLPTPATGRTEHDLALVVAYNFLSSSKLRMLDWALTARTQSPKVLSLQQLAPENTPPECPDAFVNLGSKTSCSVEVLEKLLEQSSGAEGLLQPPLLTDDDHKFPSLVWTQHQRTEGEERSSPPSVAILYGDFKSKKTPELHQLLKRWSDRVGYVFRPFETKGNKGDNDGKKLLLAGYGIELQFKSTEYKAQDDSEQAGSRELGGFNFDKLEELYPDKGEELAKFQNYLAAQKGAKTEFEALKAWQVQELGLQASYFAAEKPDMLTALRDVSGNFPSRAATLSSLRVPPEFKKSVAHNQRLLASHFNLDEGEGAFFLQGSYVDPDALDLFTFMQNIQVELEFMELLRSLRQDWPAVTRGEVEKIIALGTKSQAEPELALDMRDSSIFWINDLEKDEEYEDWPDDLTQLFFRMGGIMLRPVRRNVFNLVVTVDPADPSAGALLKMVHSFMVHKSPVRIGVVFCSAPSTPETDTTNASLIRRLMNFAASEGKMRTVFHDVVNAYVTSDFVTLKKKWGSLTNGDELEFGAELACDFVRRSGRPTPSAFLNGVPLKWDSLDDFEDVVLNQLLKEAQSVQVEAYNGKVNEDTDIFEHLMNKCHVLTRLNDKILDTSNSKVVSFGTESWSALGKQFRDPLANIANSVAYLTPTGKKSVPVTVSLWVFSDLETEQGRTFLLRTVEFLEESATHARIAFISSSDHLSKFTQEVLEAFGNADLKAIKKLLQSDTYDAGARGESNVLGQELMKQLGLSGGDRGVLVNGRLIGPLPPTESFELGDWALIQKFTFDSCPKHLEGDDWTPDAVMRLCSALASSTFKKSAKRFILPEFQSPVMAGKGREGGSGTGDTAGDVFYVDLTAVIDPASRHAHKMAALLTAVEQKVGEWVRSRVVFNPPSKHSELPLKSYYRYVAGLTPDETVTFEDIPREPLFTQNIAAPDNWMVEVVTCEKDLDNIRLKDLGTDSVDSVYELEHLLVEGHCLETKTGSPPRGLQFTLTPHNPNVRTAETIVMANLGYYQLKASPGLWALDLREGPSRDIFALESNKQRIVSVNSFQSVVLKVKVRRNPGKETASLLDTEEENSSWFGFGGSKQKEAEEDTINVFSVASGHLYERLLRIMMLSVVKNTKSKVKFWFLKNYLSPTLKDILPEMAKEYGLEYELVQYHWPRWLNPQREKQRIIWGYKILFLDVLFPLSLKKIVFVDADQVVRADLKELFDLDLDGNPYGYTPFCDSRTEMEGFRFWKHGYWKSHLGRRKYHISALYVIDLLRFRRIAAGDRLRGQYQALSQDPNSLSNLDQDLPNNMIHQVGIKSLPQEWLWCETWCDEGSKKAAKTIDLCNNPQTKEPKLDAAQRIVPEWKDYDTEIRNFQQRLHKERSGDRSSSNQDKDKHTEL

SEQ ID NO: 4699 - protein, 1286 aa, Peromyscus leucopus
MFLSGYGVELAIKDTEYKALDDTQIKTMTDTAVEKETEADEVQGFLFGKLKEIHSDLKDNLTAFQKYLIESSKQMMPLKVWELQDLSFQAASQIVSTPVYDAIKLMKDISQNFPIKARSLTRIAVNELMRKEIKENQKDLRDRFEIKPGDARLFINGLLVDMDVYDPFSILDMLKSEGKLMSGLKNLGLSEEDMSKFLKLNSPVWNYDYVLDIRHSSIVWINDLENDGLYISWPTSCWEFLKPVLHGTVPSIRRNFHNLVLFIDPAQEYTLDFIRLAEFFYYNEMPLRIGFVFILNVDNEVDGTTDAGVALWRAFNYIEEKYDVSEAFISMTHMYEEVKGHRVLTVDNVKNILQNKSPYADILDILGPHSKYDRRRTAGTSFYKMTGLGPLPQALYNGEPFDLKEVSTEELKGAVLGKMMDAFVYLQRDVFMGTLNDEINAIDFLMDKNNVVPRLNSLILHTEPQYLNLLSSSVTADIEDFSTFSFLDSQDKSAVIAESMQYLTQEDPVISAVTLWIIADFDVPSGRKLLLNALEHMETSVHSRLGIIYNPTSKINEENTVISRGILAAFLTHKNSLLRRFLKKLAKEETAEAIYSGDKIKTFLTTGMDKNAFEKKYNTVGVNTFRTHQLFCQDVLQLQPGKTGIVSNGRFLGPLLEEFYLEDFHLIEKITFSNSVEKIKDIVENMEINSKHMSDLVMKIDALVSPLPVRASRYNVTLLKENHSVIKINPPENDTFFDVVAIVDPLTRAAQQMAQLLAVLGKIVNARIKLFMNCRSKLSEAPLRSFYRFVLEPELMSGTNNSPSRGPVAKFLDIPESHLLTLNMITPEGWLVEIVHSNCDLDNINLKDTGRVVTAEYELEHLLLEGQCFDRTTEQPPQGLQFTLGTKNNSALVDTIVMANLGYFQLKANPGAWILKLREGKSEDIYEIVGHEGTDSETDAGDVIVVLNTFKSKILKVEVKKKLSKIKEDILADKHENRGMWDSFKSFTQSLHEGDKKENDILNIFSVASGHLYERFLRIMMLSVLRNTKTPVKFWFLKNYLSPTFKEVIPHMAKEYGFQYELVQYKWPRWLHQQTEKQRIIWGYKILFLDVLFPLAVDKIIFVDADQIVRHDLKELRDFDLGGAPYGYTPFCDSRTEMDGYRFWKTGYWASHLMKRKYHISALYVVDLKKFRRISAGDRLRGQYQALSQDPNSLSNLDQDLPNNMIYQVAIKSLPQDWLWCETWCDDESKQRAKTIDLCNNPKTKEPKLEAAARIVPEWVEYDTEIRKLLDHLENKKNAISVHDEL

SEQ ID NO: 4700 - protein, 353 aa, Paenibacillus sp.
MIVKNESEKIGRCLRSVQSVVDEIVIVDTGSTDHTKQIASTFGARIFDYIWNDDFSSARNYALEQCNGDWILVLDADDRITHASRKEIDDFIRKHAALGRIQITNSFDYNGELRESKAHVTRLFPKGSFYTGKIHEQIVSELPRKNVPIEVYHDGYFKSEKYKRNIKMLEVELEQNPDDSYTLFQLGKEYRIIKEYAKANVYLTRCYKAITSNDGYKPQVVIEYLYTILGLDDFERGLTLIEQETHNLSDYPDFLFASGLFFMELVFSETDKYFKYFPLIEESYLKCLSIGDTTKYESVKGTGSFLAAYNLAVFYETTGDLGKAKTYYRISAEYNYKMAQQRLGILNTIKEEN

SEQ ID NO: 4701 - protein, 631 aa, Lysinibacillus sphaericus
MKPRILIASPVRQKPLILDYFLFSLQSLNKDEHKVDFLFIDDNDDQQSTELLTLFQSQNEGVKIIKNNQQNELYRKDEHTHYWTDSLIEKVGKMKDRIIEHAIQLQYDGLLLIDSDLMLYPNTLQNLWNAQKDIISNIFWTEWNKNEVALPQVWMMDEYTLYEINNGEKLEPIDIANRTSAFINKLKVPGIYEVGGLGACTLISRKALLKGVRFKQLKNLSFWGEDRHFCIRASALELPLFVDTRLPAFHIYRESDLLGAEKFKNEIIIGKKQQATVSLCMIVKNEEQVLARCLSSVQGLVDEIIIVDTGSSDKTKEIAKQYTSLIYDFEWIDDFSQARNFSFSKATKDYILWLDADDIIEERERIHFLNLLEELTNKEVDSVMMDYHLAFDENGNPTYSLKRNRVVKRSCDFKWVGAVHEYLAVQGNVIQRNIAITHRKEKAYTDRNLKIYKRREAQQEQFTARDLFYYGNELKDHALYKEAIDKYQQFLATKQGWIEDEIAACIKIADCYEMLNDADRQLHFLLKTFAYSTPRPECCCRLGAKFLADSQYEQAIYWYEQAISMKNKPKQGNLIEHIAWTWLPYIQLAVCYDRLGQYDISNNYNEQALQYDPTNKLILDNQQYFKNRLKD

SEQ ID NO: 4702 - protein, 373 aa, Paenibacillus sp.
MYRKRVKTLITISLCLIVKNEEKTLRPCLSSVAKAVDEIIIVDTGSTDQTKSIANSFTDHIYDFKWIDDFSAARNFAFRRATKDYILWLDADDILKEEDCNKLIKLKADLEPSVDSVTMFYNYAFDEFGTPTFRFKRNRLVKRENQFKWIGAIHEYLEVSGNIMDSDITVTHCRIHTKSDRNLKIFQNRLLRGETFTPRDLYYFANELKDHNKYAKAIIYYNKFLANGKGWVEDEISSCSNLADCYNQLGNSEMELQSVFRSFQYDSPRAEFCCRLGYYFLTRKQYEPAVFWYKLASELQVPTHNLGFSNPKFSTWLPHLQLCVCYDHLGQHANAYKHNEIARTYRPKDRNIQHNKKYLESVLHISDSSQDAE

SEQ ID NO: 4703 - protein, 357 aa, Amphibacillus jilinensis
MITISLCMIVKNEADVLERCLASAKDIVDEINIVDTGSTDQTVEIAKGFTDRVFFYKWTGDFSAARNESMKYATKDYILYLDADDVILPEDQKKFLKLKETLNPNVDAVSMYYHAGTDGFGNVTLKYRLNRLLKRTKGFKWQGDCHNYLNVSGHIINSDIAITHKKQQHSVGRNLNIYQKRKERGDTFTARDYFYYGNELRENGHYQEAIDSYNKNLELKTGWIEDKVYACINKADCYRFLNQAEQELAALFQSLNYAKVPRPEICSRLGFHFQSQHAYQQAVFWYELATQLETDPNKWSFTYPAYSTWYPHLQLCVCYYKLGNFEKAFEHNERARVYRPEDERILYNKQLLENKRS

SEQ ID NO: 4704 - protein, 574 aa, Bacillus sp.
MKPLISFCMICKNEEKMIARCLNSIKHVVDEMIVVDTGSTDKTIQIATSLGAKVYQHEWVHDFAVARNSGLERATGDWILFLDADEELHPEDGKKLRKFAKYSRAPGCYLKLINFVGKSDNFKSSTKDTVPVLRFFRNHHDIRFVGRVHEQIGGSIRARYETKYIPYENIRIFHYGYLEDIVKEQDKIKRNFKLIKKQVEEEPKNPFHHYNIAGEYIRVNQFQFALEHLRKAKSLCEINRVGFGHLIVKKEITCLDFLGRHEEALEVCRNEIKRFQDYPDLLYILGRCAIVCQKNEEAKEAFRKVMTMTTPPSHYVIDVTIPKIKAPFYLAKLFEEVGEVGKALNFYEGILMNNGLAYYPAFERFLDLMVSQEGEKVLLRQLRKLSFSKIEKELIVQHLYEANFYELALQLVKEGWNDNGQIKNMLLFLTNHESEVSGETNLKLIVQWIKEQTLHNPTRIENSTFIHFLHNGEWPDDVYPTKLDWELLEFAYKLSRVHEKRKNATQLMKLWKYFIFLKGNTSEVSRGGLSLALNLVFQARSLLNEQKSPVSHLWEDVSHHIPYPLIEQGGRIDV

SEQ ID NO: 4705 - protein, 356 aa, Lachnoclostridium phytofermentans
MITISLCMIVRNEEDNISKCLISVRDIVDEIIIVDTGSTDKTKEIVGLFTNEIYDFEWINDFSAARNFSFSKATKDYILWLDADDVLLEADRIKLKRVKEILDPSIDVVMMNYNYAFDEKGNVLLSHFRERLLKRAKNFLWNDPIHEFISFEGKVVNSDITITHKKSHMNNRRNLNILEAMLAEGKEFSPRNMFYYAREKLNVNEYEGAIEYFNKMLDSEKGLPADCISSCIYLAKAYKAKNDRKNMLKALIRSFEYDTPRAEICCQLGYYYKDIEDYKRAIFWFDLAMKLEKPESKWGPILHEYWGFIPCIELCLCYYKLGNIDEAIKFNDKAAEYKPEHPSVLQNKKAFGNIKN

SEQ ID NO: 4706 - protein, 351 aa, Unknown
  Description of Unknown: Lachnospiraceae bacterium MD335 sequence
MAKLPISVCIIAKNEEKYIGDCLSRIKRYGFEIVVTDTGSTDSTKEIALQYADKVIDFEWINDFAAARNYCAKAASYNWILALDCDEMMESFDEKAVRMMTQKYPKDRGMLNFKLMLRNAVGEECFEWDKMVRLYNKKYYEFQGAIHEQIVPRNDFDTRKHNPANIILPVNIVHLGYSISGEEMEKKQQRNIELLRGCVENEPGNSYLWFQLGQSHYIIKDYENAVLYYRKSLELLNGNLSAGHAQELLISLSKAYAGLEQYEATLEVLLEYADRCKSAKYAYATALAYIENEAPVKAMLEFIKIIALPDAETLGSDLETCYGCIIDLYEQMGDPGMAEFFRNKRNERFYN

SEQ ID NO: 4707 - protein, 650 aa, Brevibacillus sp.
MKISVSACVITKNEEKNLPVCLKSIQSIVSEIIVVDTGSTDRTVQIAKEFGARVFSFEWIHDFAAARNYAIEQASSDWIIFLDADEYFSPDCVQYLPGAILEATQKELDMILCMMSHIEPKTGKLTFSNIHIRIFRNHPQIRYVGAIHERIVRMDKPAQALDVQQDITIIHTGYCDEDLHTKEKGKRNLEILFSELQKKPDSFDLLFYIAESYLVDKKYEEALEYAKRAQKYRNSGLKGVYEKNYVNIIKCLNQLGEQEKVILQTILEAIEEYPNYPDLYLLLGDAHKRSYRYRDAIHVYQIGVNLLNQSSIAQSNGYATAAKVLDSVGFLYSKLREWNQSVTYHVQALQIDKFLYTSLVNLISVLGRFEKPDTVVAFLDKIYERSNIRECLYLFRASLESNNIGVATILLKNLPEKDPALKEFKAIFDFLTGNYEHAYSVFCDLYRETSTIEYAYGALAAAWKKNNPNYYTDLQNLFSNDSELHQLTLNILGDTSQFNIDKKSMLMFLIYVCGTLKISDFQLLFDVVKKSNLYLEMAEYLYIQEKYVDAYQFYNVFLEQGEQLPSNRLAEITFKVGDCLLQCGLHEHAWAFLQKAHSLVPEDFRVYESLFELAKHSKRVHEVKSVLETAIRKYPDSNFLRNIKEQLILA

SEQ ID NO: 4708 - protein, 283 aa, Cytophaga aurantiaca
MNSITVIILTFNEEKHIARCISNLNKIASKIFIIDSYSTDKTVEIARSLGAEVYENPWVNYASQFNWALENCPIETTWTMRMDCDEYLLDELIDEVNHKLPGLPADVGGIILKRRVIFMNKWIRRGGFYPHNLLRIWRSGTAKLEDRWMDEHVVLEEGKTIFFDKDMVDHNLNDLTWWINKHNSYASREVIDLLHIANHTTSSQNVESTLVGEQYSRKRWIKEKIYSKIPLFVRPFIYFVYRYIFLLGFLDGTPGLIWHFLQGFWYRFLVDAKMYEQRIKNKS

SEQ ID NO: 4709 - protein, 355 aa, Romboutsia weinsteinii
MEISLCMIAKNEEDVIARCISSIKDIVDEIIIVDTGSTDNTIEIAKNLGASVYEFEWIDDFSKARNYSFSKATKDYILWLDADDILNPDDIDKFRELKSNVNNLVDSVTMNYVLTVGPKGEFISSLRRNRLVKRERNFKWIGQVHEYLEVYGNIINSDINVIHKKEKAYTNRNLRIYEESIAQGKELSTRDKYYYANELCDNGRYDEAIEQYIKFINTNEGWVEDIKGACSKIADCYSYKKDSENELRYLFKSFEYDVPRADFCCRLGHKFFGENKLDIAIYWYNQAINAAPKEGNLSLINHDTYTFTPWVQLCVCHDRKGDMKLAIECNEMAAKYKPDSPAVKHNREYFKTKIQ

SEQ ID NO: 4710 - protein, 302 aa, Bacteroides sp.
MSNNSIAAIILTKNEEKHLERCIRSLKGVCDEIIVIDSFSTDRTCEMAEQMGAKVYRNPWKNYATQFNYGVYQCPIQSEWIWRIDADEFLEGNIGLAVKDAVSRCNADVNGVYVRKRIDFMGRPLLHGGWYPSYHLKVFRKGHGDCENRWMDEHIRIFDGTTITVKEGNQVDANLNDLTWWTEKHNGYATREMVDMLMMEYGMDAKAEEVIPKFFGTEEQRKRWLKIKYVKAPLFVRPFINFFLRYVLKAGFLDGKEGFIWHILQGFWYRMLVDAKIYEIKKRFGHDAEKIKAYLKENYLNL

SEQ ID NO: 4711 - protein, 300 aa, Persicobacter sp.
MLDISVIILTYNEEKHIERCINNVKGWVKEVFIVDSFSSDKTVALAQKMGAQVFQNKWEKNYAKQFNWGLANLPITGEWVLRLDADEYLLPELVAELQDRLPNIESRVSGITFKRRHIFMGDWVKQGVYPVKLCRLFRKGKGVCEQRWMDEHIVLKSGTDLEFEHDFVDHNLNNLSWWIGKHNGYAIREAIDLLDMEYGLISKETVPQDLELNRQADSKRSKKYKYMRQPLFGRALAYFIYRYFFKMGFRDGKAGFMWHFFQGWWYRTLVDAQIFEIKQKCGGDTTAIKQYIAKEYQIQL

SEQ ID NO: 4712 - protein, 309 aa, Dyadobacter jejuensis
MVDLSVIILTHNESKHIERCIRSLQLITDKIFIVDSYSTDNTVEIARSLGVEVVQNKWISYAFQFNFGIQNTPFKSTTWSMRMDADEYITPALAAELQETLPHTTPDISGYYLKRRVYFMDKWIRRGGYYPIWLLRIWRQGDGVCEELWMDEHIKLSRGNTARLEHDIVDHNLNNLTWWTQKHNNYAIREVIDLLNIKYNFGNKESVTPNLWGSQEQRTRYLKIKYAEFPLFTRPFIYFVYRYFFKLGFLDGKKGLIWHFLQGFWYRFLVDAKIYEVYRSAGKNKKDIIEHFRTEYGKDLEKPNQSVAL

SEQ ID NO: 4713 - protein, 252 aa, Unknown
  Description of Unknown: Candidatus Amesbacteria bacterium GW2011_GWA1_46_35 sequence
MLSSIIITKNEEDMIGECLLSLEFSDEIIVVDTGNTDSTDDIAKSFGARIVTSNSNSYAEFRNAGLKAARGDWILYVDADERVTPLLKKEIEQIMFSPDSASAYQILRKNIYLGKEMRFGGWGGDRVIRLFKRSALQRYEGQLHEQPVFTGNLLTTHYELTHYSHRDLSSMLDKTLDFTAYETRLRLAAGHPPLAWWRFLRVMLTEFWLRFVKLSAWRDGVEGVIDGIFQVFNMFVIYARLWKLQNEKRRHI

SEQ ID NO: 4714 - protein, 280 aa, Unknown
  Description of Unknown: Candidatus Cerribacteria bacterium 'Amazon FNV 2010 28 9' sequence
MGETTVTKEKPTISAIIITKNEEEMIANCIATLLFCDEIIVVDSGSTDNTVGIAKREGASVVCTTEGKFKDWRMAGLREATCDFVLYIDADERVTPKLADEIKRTIAFTSYSAFLLKRNNIHFGKWMQHGGWERDSIVRLFSRGKLLRWEGNVHENAIVEGPIGLLQEPLVHLTHRNVRDGLIKSYVWTDTEAQALVNAGAKQVTPFTLVRKTLMEFFRRLILKKGYKDGMEGWIESMQQAMNRFLVYERVWELQQKPSLPQRYERVEKEILHLWKQIGK

SEQ ID NO: 4715 - protein, 345 aa, Butyrivibrio sp.
MRGMAMVTVSLCMIVKNEEDKLKTCLDCLKDLVDEMIIVDTGSTDKTVEIAKSFGAKVFEYEWTGNFSDARNFSFQQATCDFIYAADADETIDEENQKRFKQLKIDIDELDIDVVQMYYCNQLSHNTVYNYDRELRPKLFRRVRSFVWEDPIHETVRLDPTVCNSDVEIIHNPTEEHGERDLTAFRCSITRGEYISKRLHNLYARELYLVGSDEDFMLAKKFFEESIVDTGRTLDEIKEASCVLAHIAVIERNTEALLKYSLKDLTTIPSSEMCYELGNYYRNIGDLDEAIVWYYNAVYESSPILNIHIGGDVTLMKLSECYRELGNLEQAEDYEKEARNWHVPY

SEQ ID NO: 4716 - protein, 323 aa, Spirosoma luteum
MADVAVIILTHNEEKHITRCLESLKSFTDKLFIVDSFSTDNTVEIARSMGAVVVQNAWVNYATQFNFGIAQIPFQTPWLMRMDADEYVMPELASEINKRLAGLPDQVGGVYVKRRVFFLNRWIRHGSFYPIWLLRLWRRGDGFCEQVWHDEHIKLTKGESIQFEHDIVDHNLNNLTWWTQKHNHYTILEMINLLNYRYQFDKAETVQPRLFGTQEQRMRYLKEKYASLPLFTRPVLYFLYRYFIRLGFLDGRPGFVWCFLQGLWYRFLVDAKLLEVSIRVGTDKEALIDYFRKEYGKDLRPDKTPPVGQSSISSPSASASNPA

SEQ ID NO: 4717 - protein, 273 aa, Leptospira biflexa
MEGKRKRKLSVAIITFNEEKNIGDCIRSVVSFADEIIVLDSLSTDKTKEIATSFPKVRFLEAPFPGHVEQKNKAISFCQNEWIFSLDADERADEVLQNSIQTFLETDEVHCDGYKIARLTFHLGRWIRYSGWYPQRRYRLFKKENASWIGENPHDFIELKPGSFGKVMKGNILHYSFTDFSHQITTINQFSSIVAYTRYAKGERFSLVKTIIKPLGKFFEIYLFKFGFLDGIPGLWIALASSFSTYLKYAKLYELDQLKIQRPSNIRKDYGKK

SEQ ID NO: 4718 - protein, 356 aa, Paenibacillus agaridevorans
MKTLSLVMITKNEEAVLGRCLDSVKSLVKEIVIADTGSKDLTNEVAATYGAKVFECEWNQHFAEARNFAISKASGDWILVLDADEYISNDCAAAISAFINKGDAIGRIRRIDKFRSKDGVSYASSYISRLFPKHVRYQGRIHEQLDSSLPRVTLPVEVQHDGYFETTRSERNIPLLLMEIEADPANPYYHYQIAKEYRGLEKHEAARQHLQTSSSLLTKRELYYPNVIVDYLYAMMATKQMEIGIQVINENQQQLNDFPDFHFVRGQFYLDLLLQDTQRYIHLFPEIEKAYLECLRIGESNKYESVMGTGSYSALHNLAVFHEVTGNMNKALDYYEQASHFSYAPSIERLAQLKRN

SEQ ID NO: 4719 - protein, 356 aa, Unknown
  Description of Unknown: Thermoanaerobacterium saccharolyticum sequence
MCQSITISLCMIVKNEELTLDRCLTSIKDAVDEIVIVDTGSTDLTKNIAKKYTDKIFDFKWIDNFSAARNFSFSKATMDYILWIDADDYMEPDDLEKLINLKDNFDTSIDSVTMKYVLTKTSNGSPSFISIRNRLVKRTKDFKWIGAVHEYLEVYGKIYNSDIQIVHGKIKNTPNRNIEIYEKMIESKKDFSPRDMFYYANELAEHKRYAEAVQYYNMFIDSKKGWMEDILYSLGKLADCYEALGDLNKRDEAIFKSFEYDVPRPEFCCRLGYKFLQENKIKQSIFWYELATKVEKPNQGFVNIACSTWLPHIQLCICYYRLGDIEKSYMHNEEARKYDPNNPMVLQNKAFLESIL

SEQ ID NO: 4720 - protein, 363 aa, Bacillus toyonensis
MITISMCIIVKNEEKTLERCLKSVEGIPDEIIIIDTGSTDLTKKVAKQWTQHVLDFKWINDFSAARNYSFNQAKMDYIFWLDADDILLPKEHQKLLDLKQTLNPNIDAVSMIYHTEFDINNNVLTSIPRIRLIKRDKKFQWYGVVHEDLHINNQNNIYESDIIVTHKKIHNNKKSTRNLKIYEQYYKKNKDKMTLHDIFHYARELQKHKKYKEAIKFYLIFLDSQDIQIEHRLFVMHKLASCYYLIGDFQKEKEITLHSLEYDIPQPEFSCRLGELFLKKDQFYQAIFWFKQAIEFSSTNSSLFIEQQPFKTWLPHKQLALCYYQIDDYKQSYYHNKMVLKYSPNDKETIINIKTIEQLINTK

SEQ ID NO: 4721 - protein, 459 aa, Yersinia frederiksenii
MSDINYFNSNYLIRLKDFILNSIAESDKINLLNNWLDKVSFILEIDPRLNCFVVMDNTFHDIYLDKILNDILVLFERIYQVSLPTISAVIIVKDEERCIYRCIESILDYVDEIVIVDTGSTDSTMDIINSIVSDKIKTYSTPWENDFSHARNFAKRKAKKDWLMFIDADEYLDGKGDYNEVKEILLILQFLSIKNEMVICPFISNHNGYNVTTVRRFFLNNTDINYFGLVHEEPRINNTKPYYISVNITFIHDGYMHEIVKNKRKTDRNLSLLSKMMLLEPNNLRWKYFYYRDGIEVIDLLNAEVGIKSSLILNEQYDFSKSNIREDEFTFALLDLLAKNNLRQSKFDDVDIITDIMNCFLPENSNSYYYKCLINIVELKSKYKELLDKTILYRERNIDPQYGMIHSEGYHIDALISILLFDNNYISQAAKYFDFLNSINFNSDILNEYKSKIKQIKSL

SEQ ID NO: 4722 - protein, 272 aa, Unknown
  Description of Unknown: Chitinophagaceae bacterium sequence
MLPNTNISVVIITLNEAGNIADCLRSARMLTEDIIVVDSGSTDGTARLAALCGAHVLQHEWKGYGHARNLGAAAARNPWILALDADERLSTDLVRELNQVRLQQGIVYRFPRRNHWEERPIRFGTLGFERIARLYHRGDAHWNDFAVHERLTGIFTMLHLQGCIVHYGIQDPARYAEKKAHYAWLCALTYARQGKAAGLLQRIGAPIFNAFKSFVLLGGFLDGARGWQTAAAIFSYTLRKYRLLHQHRATLLAPVPAEQSVSSAYTLARFDP

SEQ ID NO: 4723 - protein, 310 aa, Runella zeae
MNDISVIILTYNEEKHIERCIRSLMPFTDKVFIVDSGSTDRTVSIAESLGAKVVYNAWITYAVQFNFGIENIPFDTKWLMRMDADEYVTPELANEIKTNIASLDSSISGVYVKRRVMFMNQWIRRGGYYPTWLLRVWRKGQGICEELWMDEHIKLSEGQTVQFQNDIVDHNLNNLTWWTQKHNNYAIREVIDLLDIKYNFGDAERVIPKLFGTQDQRKRFLKHKYASLPLFTRPFAYFLYRYFVKLGFLDGTKGLMWHFLQGLWYRFLVDAKIYEVYYRVGHDKQAIIDFFKNEYGKDLTAAQNRPVEVR

SEQ ID NO: 4724 - protein, 249 aa, Unknown
  Description of Unknown: Candidatus Microgenomates bacterium sequence
MFSAVILTKNEENNIKDCIASLSWCNEIIVIDDDSFDKTAEVARKLGAKVYLRSLNKDFSAQRNFGLLKAANEWVIFVDADERVTETLSSEILAFQFSNFNKFSGFFINRKDNIWEKELKHGESGNIKLLRLAKKDAGKWEGAVHERWKISGQTDILSNELIHFPHQTISEFLKEINFYTDIRANELFRKGKKVNIFSIICYPVVKFLQNYFIKFGFLDGLEGFIFAVTMSFHSFLVRGKLWQMLQNEK

SEQ ID NO: 4725 - protein, 294 aa, Ruegeria kandeliae
MTHTITAIILTYNEEQHVERCIRSLDGVVERICVIDSFSTDRTVEVAESLGAEVFQNSWPGHAAQFQWGLDTIGVTSDWTLRIDADEYLDQGLRARLLGDWADEAFNGYYLRRKIVFLGRPITHGFFYPLKILRLWRTGQARMEQRRMDEHVVLKDPHTEVLEGGDLVDENLNSLSWWVEKHNGYAALEAISRIEAEEGKRKSEAKLSGQAARKRWLKEKVYTRIPSTLRASLYFVYRYIFGRGFLDGKEGFFFHFLQAYWYRTLVEAKLFELEKRAADRGITPYALLAEEGVL

SEQ ID NO: 4726 - protein, 305 aa, Unknown
  Description of Unknown: Candidatus Sulfuricurvum sp. RIFRC-1 sequence
MKSCISVIILTFNEEKHIGRCIESLLPITQNIFIVDSFSTDRTVEIATALGAKVFQNRWPGNHAIQFQWGLEHCPITTEWVMKMDSDEYLLPELANEINEKMNMLSDDVSGIYIKRRVYFMERWIKHGGYYPIWLLRIWKYDKGMMEQRWMDEHIKLSSGTTVQFEHDLVDDNKNNLTWWTEKHNNYATREAVDILNIIHGFSKYDEVEANIFGTQEQRKRWLKIRYASLPLFVRPLLYFHWRYFVKLGLLDGRQGIIWHFLQGFWYRFLVDAKIYQMNHIARKENKSLKQVIKDTFGIDLDAAR

SEQ ID NO: 4727 - protein, 254 aa, Neisseria lactamica
MIMKKVSVLIVAKNEANHIRECIESCRFDKEIIVIDDHSTDNTAEIAEGLGAKVFRRHLNGDFGAQKTFAIEQAGGEWVFLIDADERCTPELSDEISKIVQTGDYAAYFVERRNLFPNHPATHGAMRPDSVCRLMPKKDSSVQGKVHETVQTPYPKRRLKHFIYHYTYDNWEQYFNKFNKYTSISAEKYREQGKPVRFVRDIILRPIWGFFKIYILNKGFLDGKMGWIMSVNHSYYTMIKYVKLYYLYKSGGKF

SEQ ID NO: 4728 - protein, 399 aa, Dictyoglomus thermophilum
MTSKVGITACILAKNEEKVISNCLKSIVNYVDEIILVDNGSNDKTVEIAKDFGSKIINAESFTFDSARNLYIEAASYPWIFVIDADEVITPEGGLELRKLVREVSDNIMAFYLPHLNYFGEGKWANFLMCRLFRKHPQIKYNDRPIHASVVPSIKALNGAFARGSVLLHHFDLLYCEEKSLSKRFRNINLLESEIAKNPQDHNLHYYLGLEYWALDRLDEAEREFKLAISLDHNRSPLAQFFLAQLYLSMNEIEKSETIVENLLSFDIGIKDKIYTLLAEISLKRQELDKALSFTKEALLYDPMSPNLNLNFASLLERFDPISAIRHLQIALKYNPFLLNSIIYKEIKVANIYKIQKSGTFLSSTKTIFDHMINCWERIGDYEKAQEWRKKKINITYAT

SEQ ID NO: 4729 - protein, 247 aa, Unknown
  Description of Unknown: Elusimicrobia bacterium HGW- Elusimicrobia-4 sequence
MISVIIITKNEEDNLTRCLESVKWADEIIVVDSGSTDATVEIAKKFGAKVFVNDWKGYGAQKNFAIDKATGEWILSIDADEEVSHELREEIKKVIQNTGDYVAFKIPRRLIFQGKFLRCGGCYPNYQIRLFRKNKAKFNLDLVHEQLIVGGKIGYINGSLIHYSYKNLSDYFERFNRYSTLDARKRFSNNKKFYFWHYIQPFFKFFSMYFLRLGFLDGSQGLIWAILSSFYTFVKFQKLKELWNEKK

SEQ ID NO: 4730 - protein, 295 aa, Bacteroides vulgatus
MLDISVIILTYNEEIHIERCLKNARKFAKEIFIVDSFSTDKTIEIAEKMGAKVYQHTWENYSKQFNWGLQNLPIHTEWVWRMDADEYLSDSLINELHQRLPNLTGEINGFTVPCLRIFMGKYIKHGIIPLILLRLFKIKYATCENRYMDEHIQLSEGIIDSLKNPFYDDNLNDLSWWTNKHNGYATREAIDLLMTEYELLPQDTVVNSGSHSASIRQKKLKYIQMPLFWRAFAFFCFRYIFRLGFLDGKEGFLWHFLQGFWYRTLADAKVYEIKKRFGWNDKRIKAFIKETYLDK

SEQ ID NO: 4731 - protein, 349 aa, Bacillus toyonensis
MIVKNEEQTISRCLDSVEDIVDEIVIVDTGSTDATKKIVTRYKAKIYDFKWIDDFSAARNFAFSKATKKYILWLDADDVIAEEDKKKFLQLKRTLDDSIDAVSMKYYLNFDAEGNPTYQLRRYRLVKKKRDFQWTGFVHEYLAVYGNLINSDIGVTHKKEKGHTDRNLKIYEKHLADGKILNPRDVYYYANECKDHKLYDVAIKWYSKFLDGGEGWFEDNIQACLKRAECYLGLGKWKESIYSCLYSFMYDTPRAEICCHLGYLFLQQDEYPKAIYWYLSAIEGSKPKDSPFICEACYTWLPHIQLCICYDRIKEYEKAIYHNEQAAQFLPNHPSIKYNREYLDNLLKK

SEQ ID NO: 4732 - protein, 730 aa, Epulopiscium sp.
MDEIIVVDTGSTDKTVEIAKDLGAKVYDFKWVDDFSKARNFAISKATGDWIIFPDADEYFEEGKQQNLLKRIKLVDGLGYEALQLYVRQINKATPKKWTFSYYIKAFKNKSCLRYERAIHELLVNTEQELYDVQLEEADIILYHDGYSNPEIQNDKLDRNINLLLKVIEDNPADKLSLLYLAREFLSKKDYESTYKYLMLIEGDLGIYETYNRKVAYYTYLLSTLNSLNKPLDMLQQVYNEAIDFDDNYSNFNFIMALYYIKNREHTKSIKYLEKTIDNLQIIPNHKYLLVNIFDIDKVYELLAQSYRLQGNLKKSREICVEKLGHKTVSLCIIAKNEEHNLFNCITSVKNIVDEIIVVDTGSTDKTVEIAKSLGATVHYFEWVNDFSKARNFTISKATGDWILFIDADEYLNQKHQTDLFNSIQQVADTGINAISICRINYNLKGGLTKQDYKIKAFKNCSEISYTRPIHEFIVHNNDNLNVMTLPSDKVRLYHNGYSEEELVKKDTINRNLQILLANIASNPDDEIAFLYLGRELVGKQDFENAYKYLKCIKDICKVELKNKEKMYYVNFLNCMMELKVAEDEIVFLYNQAINFEPDFPDFHWNMALYYLAKNNILDAIDCFEKTAIGLKRFPQDNFGYVNIKMLSEIYMMIIDLYMLINEYDKVIFLYKELLSYNKADKNILNRFLDLVKDNYPEDIVEFLKEIYDFKNYNELDFIDRVMKERKMSK

SEQ ID NO: 4733 - protein, 700 aa, Thermanaeromonas toyohensis
MCMIVKNEEAYLEKCLSSARNVVDEIIVVDTGSTDRTIDIARQYGAKVITFEWGQDFSAARNLSLEQATGDWILYLDADEELVEVDKEAFLQLLKDPKVEGYYFRIISPTAGETGDQGLRHLSLRLFRNRPGYRFQGALHEQIVPSILATNPSAQLWDSGLYIYHHGYKQEVVGSRNKVSRNLDILQKQMEKAPQDSYLRYNLGVALYEAGDLAGALREWENVEQKIDIRAGYAPTFFRNYAIALLKDNQPLRALEVAERGLSYFPDYTDLHYLRGQALEQLERYTQSQDAFLRCLELGEAPARYVTSIGVGSYLALYKLGELMEKCGYYELAINYYQKAFHLQPELPGLLSSLGRVLKRVLHEPLQVRAYIQDHIKITSFPQLLQVVDLLYSSGDYYGCLLYLNEYLLRTGTKTDEIRLLKAKALMQLNRWEEAKYQCVEIGPESPYYLDALLYICICNWSTRPRKNSLPWITKLRGRDDKLYSILEVLNRKIMWGEEPADELDVVTLEGLIVKLVQVNNWDLARMAATLILPQTRAETSFKEASTEASSAPKETSTEGGTEQEAELCYLLGRALFNHKFYLEAADELLRALEAGLSRDDLFYMLGFICAQRQALWEAEQLLHQAIRLNPEKKEYYEELVEVLLKQTCQTLKETLAHFPDSPEVKDILTRVKDCQLQLRARRGVPVEESHHQPMYDRQG

SEQ ID NO: 4734 - protein, 373 aa, Unknown
  Description of Unknown: Sporomusa sequence
MSDSAKQAHAPITISLCMIVKNEEATIERCLRSVEQIVDEIIIVDTGSTDKTKELVSQFTNNIYDFEWIDDFSAARNYAFSKATQEYILWLDADDVFFDQDRQKLLDVKATLSREVEVITMLYYLTFDPSGNVACQIRRERLVKREKNYQWIGAVHEFLDAKGTQLDTGIAVAHKPLKHDSDRNLKIYERRQLKGEEFSPRDLYYYANELREHNLYNRAIECYQKFLETKQGAFEEKIAACASLADCYYLLHDEENELKYIYQSFQYSTPRSEFCCRLGFNHLNNNRIKQAIFWYTLATHLKTANSSWGLVNNQCETWLPHLQLCVCYSRLGDYKLAYEHNEKAAKFIPDNALIHHNRKLLQSKLNMEPSESE

SEQ ID NO: 4735 - protein, 370 aa, Brevibacillus nitrificans
MTAPLISLCMIAKNEAEQIPLALQSVLPSVDEIIVVDTGSTDGTPDLCRSFGATVVDHPWEGSFAQARNRGLEHATGKWILWMDADEELDADDQKKLRSLVEASDAAALSLKLIHYFGPSKDTLRPHLAHRCPQVRLFRNQKGFHFVRSIHEGLQTTESGLLDPPIPLLPVQIHHYGYMDDAFSSKAKSARNKHYLLQEKAQGDYDPWCDYHLAAEVYREGKWEEAFSLVNLSMEGFLTRQQIPPSLLYKLKYEILFHHGSMRGAWPGIERAIQLYPTYVDLHFYKGVFLLEHGFYPEAVKALEQCLYLGEDQWEHLSLRGVGSFRAYSALARCMEKMGKPNDARVYSQHAAASTAFFSPNRLLEQEVTR

SEQ ID NO: 4736 - protein, 302 aa, Clostridium sp.
MKISLCMIVKNEEKYIKMCLENAMKLADEAIIVDTGSTDKTKKIIGEFNNSNIKLIDYKWEDDFSKARNISIEAAKGDWILMLDADEKLLCNVDKVRNILEKAKSESYRIPLYNILNTSNVVYSSVYLKLFKNNRGYKYFGRIHEQLNVKDDQINGNGIDSSIAQIIHYGYLGNVIKDREKAKRNLKILRKQLKDNPNDPFVRYNIGASYEVAGNYKKALEYFFKANDILKRGDPTGLTLYEIDMAKRICECLINLKKYDDCIMLASNLLTDNKYKGYVDLQYIKSWCYFFTKEIQKSCRKF

SEQ ID NO: 4737 - protein, 256 aa, Roseivirga seohaensis
MQQIKLSGVIITFNEEENIGRCIESLKEVCDEILVVDSFSTDRTKDIALSHQVKFIENAWKGFLDQKNFAQDSASFDYVLQLDADEELSEELKKSIQLVKNNWAYDGYIFNRFTNYCGKWIRHSGWYPDAKLRLYDRRKGKWLGLDPHPSVFMDSESRTRHIEGDLLHYSYTSYEDHINRSAKYAKQAAIAMHTLGKKPSNFKLIFSPAFRFFNSYILRGGFKDGFEGLIICKTASYYTFLKYMYLKLIHKGKSIE

SEQ ID NO: 4738 - protein, 360 aa, Virgibacillus sp.
MHSISLCMIVKNEEEVLEQCLRSVESICDEIIILDTGSTDRTKEIALQFTNKVFDFEWVDDFSKARNKSFSYATKDYILYLDADDVVLPEDLDKLKNLKETELNDTIDAVSMYYHTSFDQQGNPTFKFRRNRLLKRSNHFKWFGAVHEYILVYGNIYHSDIAITHRKEDKEIDLSTRDRNLKIYEKQLEKGVEFTPRELFYYANELKDHQRFLEAINYYKKFLNSERGWIEDAIRACIYMADCYKALGEIDEETTALLHTFKFDLPRPEVLCRLGDHFMNKNSFQKAIRWYMLALTIEVENDAGFTNTAYTTWYPHLQMCVCYWQLGNKQKSYEHHLKVKEHDPYSEFAIKNEEFFKDIH

SEQ ID NO: 4739 - protein, 365 aa, Ruminococcus sp.
MVTISLCMIVKNEELVLERCLASAKNIADEIIIVDTGSTDRTREIGKRYGKVFDFTWIDDFSAARNESFFRANMDYCMWLDADDVVTEENQKKLLELKMSLNPDTDVVMMKYAISEDEEGKPLFSYYRERMVKNGKGFLWEGRVHEAIVPRGKVIYSDIVIAHRKMAAGDKERNLRIYETMLQEGEVLKGRNLFYYGRELMAHGRYQDAVCVMEEFLDGEGWVENQIEACLNLAFCFGALGQETERAKALLRSFLYDSPRGEACFEIGQYFQRQKKWQQAVFWYETALKGNPRTESGGFVRSDYYGYLPEINLCVCYDQMGEREKAYEYHLRAKKRKPESKEVKWNEEYFRNFRDEPNGQEGHRI

SEQ ID NO: 4740 - protein, 241 aa, Unknown
  Description of Unknown: Candidatus Jorgensenbacteria bacterium GW2011_GWA2_45_9 sequence
MDKKSLAVIVLTLDEERHIRRCLESVKDITSQIIIVDCGSADGTLEIARTFGAEIELAKEIKSALHGVDDGVCGFYMKRRVYFMGRWIRHGGCYPIWLLRLFRNGAGRSEEREMDEHIVLGRGKTARLRNDFIDENLSDLRWWTDKHNGYSSREAEERTRNEKASRNTVVKGQAGRKRFIKNRFYAKLPLFLRSFAYFIFRYVFFGGFLDGKEGLIFHFLQGCWHQFLIDAKIFENRTKKD

SEQ ID NO: 4741 - protein, 273 aa, Unknown
  Description of Unknown: Candidatus Pacebacteria bacterium CG_4_9_14_0_2_um_filter_34_ 50 sequence
MNKQTISALIIAKNEETMIENCIKSLLWCTEIIVVDSGSTDRTREIAESYGASVISFKHDSFSRLREEALKRATSQWVIYVDADERVTPTLAKEIMVNIETTDAEVFRLSRENIYFGKKFKWGGWQDDKVEKVFKKESLMGWIGDIHESPNFKGELIDLKTKLLHFTHRNIVSGLIKTANWTPIEASELYKSNIAPVTFFILMRKGFMEFFRRAIFKKGYKDGLEGLIEALIQGINRILVYIQVWELQQNPSIKEKYNKKEEEILGLWKKDRH

SEQ ID NO: 4742 - protein, 299 aa, Unknown
  Description of Unknown: Microgenomates group bacterium GW2011_GWC1_49_7 sequence
MKQTLSVVVSAYNEEKSLGRCLASVGFADEIIVVDNQSQDKTVEVAKKFTKKIYSQKNILMLNTNKNYGFGKATGDWILNLDADEEVPKELAKEIQEVIRSNLKENGFWIKRKNIIYGKWITHGLWWPDKQIRLFRRGKGKFPCVHIHEYITIDGQIGELVTPYTHYNYESVSQYLRTIDRASTSEALLLADMHHEFVWYDAIRFPMSDFLKIYFAQAGYKDGLHGLVLAIFQAFYSFTVFAKYWEMQGFPQRDLAPSAVPSELYRQKKDILYWIFTTKIRETNNIFEKLLWKLKRKFL

SEQ ID NO: 4743 - protein, 304 aa, Parabacteroides sp.
MLDISVIILTYNEEKHIRRCIENVISFAKEVFIIDSFSTDRTLEIAREYHNVHILQNKWENNYAKQFNWGLEHSDITTQWVLRLDADEYLLPELIQELYEKLPSLTPDITGVLFNRRYIFMEKWIKGGIYPTKLLRLFRSGKGICEQRLMDEHIQLLEGYAVEFKYDMVDKNLNDLSWTLHKQVNYAIREAIDLLDIEINLTGTRRMDKDKYIGKQAYFKRMKKHKYVCLPLFWRAFAFFCYRYILHGGFKDGKIGFLFHFMYSWWYRMLVDAKILEIRKACGRDKEKIREHILTNYNIDIDFI

SEQ ID NO: 4744 - protein, 256 aa, Unknown
  Description of Unknown: Bacteroidetes bacterium HGW-Bacteroidetes-6 sequence
MNVKISVVIITFNEERNIGRCIDSVQSIADDIVVVDSFSKDRTKDICLEKGVRFVEHAFEGHIQQKNWAITQALYPHVLSIDADEAPDVVLCESITKAKENFTADGYTMNRLTNYCGHWVRHCGWYPDRKLRLFDSRKGKWDGLNPHDKFEMDERSSIVHLRGDLLHYSYYSRDDHRKQIVKFTDILARSMFDAGRRTNWPMIVFSTIFKFIRDYFLKLGILDGKSGFIISWLSAGATFKKYKKLRALQKSNSKRS

SEQ ID NO: 4745 - protein, 653 aa, Paenibacillus herberti
MLLSICLIVKDEEEVLSRCLESVREAADEIIVVDTGSTDKTKEVAAEFTDKIYDFEWVKDFSAARNESLRYAAGTWILVMDADEYFASGDAIKLRNFLTTITPREDQVFAVNISSFLGKDRTTAILSAGEVPRLFPNHFSIKYYRPIHEQLLSETGIKLHSFLAPVSLFHTGYLKETIQSKSKSSRNAELLTSIKKKDGFAPYDFFTAGNEFAVKADMPKAIYYFEKAIKSGTKHKTASWYPKAVISLTQCYCRQFRYFDALNLLERELIKWKDYPEYSYLKANILHYLGFIKEAQKHYLDALNVSLVKAELTHVFWLDSAEFATTMPMRRLAAIYENEGDLQNAVYYWSKLLHQDLYDFTSLHSLLNTLIHYESMDKIIFLLGQIYQVDDLKHIYILFRSSLTVRSAELAKHYYNLLLNKEFTVSIADQIFYSIVQKDQAHYSNCTNHPDYKPSNEHYTHEAIACRVWGLEIPLYRPNSSEDVSEKIQKKLNHVKAILELQEEAHTVAVNEYPELLLTILQSAYLLQEFEIYDQLIQTYSDDNIINEMANFLYSRKNESIALDYYSILLNKNALDARSCENLAMYHFKGDDIEGGLAFLEEAIRLQPQTIYLYVQYLERSNNQNKRSKIKDKLLRQFAGAVRIPEFALLLKN

SEQ ID NO: 4746 - protein, 361 aa, Bacillus cereus
MITVTLCMIVKDEEDTLERCLQSVAGIPDEIIIIDTGSTDTTKDIASKWTSQVLDFEWQDDFSAARNYSFQHATMEYILWLDADDILLPEDRERLLTLKQTLDPSVDAVSMAYNVLFDSNENVISRTRRFRLLKRSRNFQWHGIVHEDLQLHSGYHHYDSDVIVTHKKIHARSDRNLKIYEQAYQKGKQLTPQDLFHYARELQVHKRYQKALHMYQEFLNTDSVSIEHRIFVYHNMACCYHELGQPEKEHELTLHSFSYDIPQPMFCCRMGEYFIKNQQFSQAAFWYRLAIEVPTDNFAYVIEQPIYKTWLPHKQLGLCYYQLGDYERSYQHNQHVLKYLPNDPDTLTNIKALETLRNNQI

SEQ ID NO: 4747 - protein, 344 aa, Desulfosporosinus acididurans
MIVKNEEKFIKRCLECLKDIADEIIIVDTGSTDRTKEIAGNYTPGIYDFEWVDDFAAARNFCFSKATMDYIYTADADEVIDDDNIKKFLLLKSDISPDVDIVEMQYTNQLEKGSTYNFDEENRPKLFKRLRTFRWIDPIHEVIDCYNNVLTSDIKIIHKPEEGHFQRDLSIFVKSTGNGQVLNSRLHMMYARELFICGTDEDFLKAFDYFNRSLMEETLKPDDKRLSYCVLARYYNLISDAHNLFKVITKTLNGVVSSEICCELGSYYMKMEDYEEALYWYYLASGAASADLNIDYMNFIPNFQMCRCFIKLGDMTEALKHNSLAEFYKPNHPDVLANKQILIY

SEQ ID NO: 4748 - protein, 356 aa, Roseburia sp.
MSKVPISVCLIAKDEEKNIEECLKRLKPYGFEIIVTDTGSTDRTKELASRYADKVLDFAWIDDFSAARNFCAQHASNNWILSLDCDEYVNSIDVKTMRILMQKFPRYTGVIRLKNLVLDENGQTGYGTDDVTRFYNKNFYTFDYPIHEQVCSKDMAKREEMMQCFLLPMEVVHHGYALTPEEMQDKQRRNLSLLYKNLERDPDDSYTLFQIGQSEFILGNHEKAVTFYERGLASDPSPEFIYVQVMIISLAKAYVKVGREKEALALMDRYAGRCKTAKFQFTYAGVCLDNGQPLKALLYYVKTTTMADADTLGENLLHCYEHIIELYRDMGDEKMAEVFKGKYEACMREKERVVNS

SEQ ID NO: 4749 - protein, 361 aa, Bacillus shackletonii
MITISLCMIVKNEQQTLEHCLQSVKDATDEIIIMDTGSTDQTKEIAKKWTTLVYDFEWNDHFADARNAAFAKSTKDYILWLDADDILLPKDYEKLLKLKQSLSPEVDAVSMPYHCDFDDFGNTTLKVRRIRLIKRLRNYQWEGAVHEDLLIDDGNIYDSDIVITHRKNHKTSDPDRNLKIYEKLLKREKDLTARDSLHYAMELHQHREYRKATEYYLKFLDFGNLSDENRILAYTRLADCYYYLGDRKKERECTFKTFEYDVPRPESCCRLGYYFLEKQQYHQAIFWYKTAAESKDTSNWSVQNETSKTWLPHMQLGLCYFQIGEYELSYHHNKIAHSFQPNNEGITHNIKLLEDLLKNKM

SEQ ID NO: 4750 - protein, 614 aa, Unknown
  Description of Unknown: Candidatus Brocadia sp. sequence
MYLCQTKSCGFKQIRFLMGKQSMTITDLHTSQKNGRSLVKISRGRPTLSACMIVKNEEKFLPQCLQSIKDAVDEIVIVDTGSTDKTVEIAQSFGARVYYHPWKNSFSEARNHSLNYATRDWILQIDADEALEQADISLLHKLITVDSYNAIFVAIYSDLPGGRSKHYYTRVFRRGKAHFEGIVHNQLIFEGKAFQSEIRFYHYGYNLSESEMRRKYKRTGDLLRQQLAENPNNIFVIANLIRNYRNEYNFEKVIELGEKGLNISLSQTDFNSQSQRQRIYLDLAYALLNTDQIDRAEEICKEAIKENPDSLDILFVLGEILLKKEAFADALQYFKKYLIAKDKENKKPIFNLSIVDAYYYECKAYDNIGVCYEGLGLINDAEVAYKKAIELNNREPLYYSNLASLYVSQNRLEDAENMASAALKLGTNNHQIYLLLGKIQAMRKKPYEAIHTVKQLLQKDSKNIHAHIFLINLQIEANLLSEAEETLKKINSSHPDHLGLKCIAERIKYKKGDKKSVVQFINNILSSSPSHSSVYHDLGNLCIETEEYEKAIELLEKHLKTSPTDATVITNIATCYARLGKLESAMIGLQAALKIDPGCNYALQNLVALKKNFF

SEQ ID NO: 4751 - protein, 377 aa, Desulfotomaculum hydrothermale
MAKTVSLCLIAKNEEKHIARCINSAKPFVDQIVVVDTGSTDHTAEIAESLGAEVYHHIWQDDFALARNQSLSYATGDWIIFLDCDEELAPATAPLLRQVIQDDYYQGYWVKIVNFYDNRPSTSFIGFRLFRNSPRHRFEIPIHEQILPAVIRNSSPEKIGQSDITIYHYGYENDQEAHRNKIQRNLRILHKAMRDYGQTGFLPFYLGVEYQKLGDYQKALAYYQISLPRTPLTESYAPALVRGMAFCLLSLKQYQAGIDLIDHFLQVYPDYTDLVFLKGAMYAAQENIPAALACMNRCLAMGPPPGHLFSSHGIGREKPLAVIKDLTEKLLHQAAASLARGECSQVFLTLNTVLEQLTKTPYEEGFHKMIEIMLATL

SEQ ID NO: 4752 - protein, 285 aa, Crenotalea thermophila
MKLPITCIILTFNEENNIENCLKSVFHLCDEIMIVDSGSTDKTIEIAKNYTDCIFYHEFENYASQRNWALDNLPIHNNWIFNLDADHRITEELETELLRLFQEGIPDEVSGFLISRRTIFLGRWIRYGGHYPTYHSCLFKKGFGRCEDKLYDQHFVVTGKLIKVKGDIEDIITDSISRFIARHNQWSTLEARFITEKQKSRKNHELIRGNPAGNPIEKRRAFRDLYYCFPLFLRPFVYFFYRYVIRLGFLDGKEGLIFHVLQGFWFRFLVDVKIWELRRSSSGLE

SEQ ID NO: 4753 - protein, 245 aa, Unknown
  Description of Unknown: alpha proteobacterium MED- G10 sequence
MNISALLIARNEQDIIKNCLESLGFADEIIVILDRSVDDTKLICKKYTKKVFVGSWNCEGERRNFGIKKCSYDWIFEIDADEIVSKSLQNEILKKKKLTNFDFFYIKLINYVGDKPLKYGWMGCMAPDGKFCMFKKESKKWLKGLVHPNYQLTGNKGPIFENFIIHKMSNNISDLVKRFNRNTTLHSKELKLEDKRNHVSFRKVISRFIKSFFKRKGYKHGKLGLLIGILNAIYPLVSLIKSKEN

SEQ ID NO: 4754 - protein, 321 aa, Methylomonas koyamae
MYGRFADLSLIFQKINTVSNISVIILTYNEQLHLARCINSLKPVVDDIFVIDSFSTDDTVQIAEALGATVYQRRWKNYADQFQWGLDNCPIRTTWVMRMDADEYLEDGLAHEIKLKLPSVSDDIAGIYLKRKYYFLGRWIRYGDRYPLVLLRLWRKGKAHIENRWMDEHVVLDQGAALVFDGNFVDDNLNNIEWFIDKHNKYASREMIDILNHKYRFLERDERIEDSENDQAKLKRLVKEKVYNHLPIFFRPVLYFFYRYIIRLGFMDGKEGFAYHFMQGLWYRCLIDLKCLEAEFTLKGAESNVEKIARLQKLTGLNLSN

SEQ ID NO: 4755 - protein, 651 aa, Unknown
  Description of Unknown: Desulfitobacterium dehalogenans ATCC 51507 sequence
MKISACMIVKNEEKVIARCIESYRGAVDEIIVVDTGSTDQTVAIAQALGAKVFHFAWIDDFAAAKNFAIAKAKGDWIVFLDADEYFAGGTGGNLRTYLENLDKAYGAVACRMINIDETSGKIINEIVHVRIFKNDKELRYLNPIHEALHYSRKGGKLQAHLADRRKLLIYHTGYSKDINQDKAHRNLKLLLRQVDGDTVAKPEYYYYIADTYFTLSQWDKVITYVRLFRDCGAKLTNLNVRLHNILIDAMMNLHYPVGEVMEEVEIAIGKFPRHPLFYFYKAKFLYDDQRYDAAFLELRRALQLHENYEDIEVNPLAVNLGNLHSMMGVISEFRSDSGEAVEYYIKTLQIDKYDATAFDRLLRLIRPQPLEEIIGFLNALFDVEKEADLDFLATNLVNHPLPKVLAYYTSLREKKYPKEDYVVLQMLVANGYYDKAFAALLDCYGRDKDERLALVSATAAALSGNGGYVAQATKQLPSAYARILKAYHGDIMLFSEEDKPAFLSMVRTFFLWADDTAKEKLLRLADQFPDDMTAPLGSLFIMEGYYQDGLNYYNYAVQRSVEAGILVHPALYYNQGYCLNRLNSPIAASEAFIKAYEAGYRVNDIYEFLRWNVDKLNASSSVRAKANEVLRDRAESKHAERYERKPSKTYK

SEQ ID NO: 4756 - protein, 359 aa, Bacillus cereus
MVTISLCMIVKDEEQVLERCLQSVKGIPDEIIIVDTGSTDKTKQIANKWTKHVYDFKWVYDFSAARNEAFRHATMDYIFWLDADDVLMPEEANRLRMLKNVLDHNVDAVSMKYHADFDAQGNVTGSVIRHRLFKREKQYRWTGVVHEHIEVSPSDITWASDIVVKHQPPNNERSVRNLDLYERYLKRGGTLTPHDLFHYGRELSMHERYEDAINIFETYLKTPGIAPDIRLFILNELASCYFFIKDMQKEESVAFQSLKYAMPQPVFCCRLGESFLRKGDLHTAIFWYDLALQVPITYSWSQDKIAFRTWFPHKQLGVCYEHLKQEKKAISHYEQVLTYLPDEETDHNLRKLMMKQSKE

SEQ ID NO: 4757 - protein, 369 aa, Clostridium sporogenes
MEITLCMIVKNEEENIEKCITSAFHIVDNAVIVDTGSTDNTKDIIKKFGEKVKLIEHEWKDDFSESRNVSIENAKGDWILVLDADEEILGYKEPILKQITNTKKESFNIKGINKIDKEGGLNSFFYNRLFKNKGYKYYRAIHEQLNIDENKVGVLDEKISKIIHYGYSKENFIKRDKMNRNLKILTNEYNKNPEDPFICYHLGATYASSGDYKNALHYFVKSYQIGLTKGFGGYYYELLKRMSQCIYLLKDYRLCIDFLTGILKDENLRGFTDLYYILGSCLYKIKDYENAKKMFNECIKFGEKTKFPTFTGRGTFLAELMLARIYLALSNRQEAQKCYLKLLNYKEKLSEDIIEEINCYTKNVKTGGL

SEQ ID NO: 4758 - protein, 737 aa, Pontibacillus marinus
MTTISLCMIVKNEEEVLENCLKSVKKACDEIIIVDTGSTDETKEIAAKYTDKVIDFEWVDDFSAARNFSFSHAKMDYILWLDADDILKTKDLKKLLTLKKNLDPSVDAVSMFYHLAFDEHGNPTFNLRRNRLVKRERNFKWHGVVHEYLEVSGNIIGSDIAITHNKQKKKNTSIEGGRNLRIYEKKLKRGEPFTPRDLYYYANELKDNHHHKKATLYYKEFLATKKGWVEDEIMACINMADCYRRLGEKDEELNALCKSFQYDLPRPEISCRLGEYFMGKKDYQSAIFWFNTAINTKQKDNGGFQKPAYSTWFPHLHLVLCYWETGNMEMSYEHNKMAEKFIPNDPSVEFNNNFFKDYFKQEPNPTPNGKKKVLYIGWIGHKNLGDELMWNLFKEKFDESLGNENWELHGTIRKPARDFDLDQFDLIVLGGGSIICKNNTPVLHEAMKKGKKVMIWGSGIDLIEKSDIPLLAAGEKINVHNYLAEDIQKKLVEIIEHAEFAGVRGPLTYEIIRQVGANEEKLMISGDPGLLLTQKEKVDEEVKVAILPFKGNKIIGVNWGTSFNHVYGANERNVEDQLAEALKEYINNGYKIYLYSVWDHDTTALKQLYKKVNDHKNVILDTKLHDQNFLIDLASHFHFTINLKLHANLISLAANTPPIALAYGFKVYDFAKSTQLDQFVIPTDSMQMKSELMEMEALINQERDKIINRVNEIKAEYINHISSPFNQHLYLRRDDHA

SEQ ID NO: 4759 - protein, 255 aa, Unknown
  Description of Unknown: Candidatus Woesebacteria bacterium GW2011_GWA1_41_13b sequence
MASLSAIIIARNEESMIGECLLSLKDLASEIILVDTGNTDSTNDIARSFGVRIVTTSNLDYSHFRNAGLKTATGEWILYVDADERVTPLLKKEIEQIMSSDEAGNVYQIPRRNIYLGREMHFGGWGQDKVIRLFRKGVLLRYEGALHEQPIFTGQLRTTNHELIHHSHRDLASMLNKTLEFTQYEAKLRLEANHPLVVWWRFLRVMFTEFWLRFVKLSAWKDGTEGIIDGIFQVFNSFVIYARLWEMQNEKNRHL

SEQ ID NO: 4760 - protein, 498 aa, Romboutsia weinsteinii
MKDNTISVCMITKNEEKNLPRCLESIKDFANEIIIVDTGSTDKTVEIAKKYGAKVYHYKWKKDFSDARNKSLEKATMDWIVFLDADEELPLEECTKLRARINATPYEGLYLRLVNIISDTNLGDAIVLRAFKNKPLYRFRGKMHEQIVFSIQEAAGLDCIESTDVKIIHYGYDPDVADLDAKQKRNLELLESYPESDRDGYFYYSLANEYARIGENDKALEIYYKAMDTPMVNGAFPSFMPYLVVNVARVLTTSKRYIDVINYLKPFEEIYKDFGDPHFFECLAHIECSNFTKAKDALLRYLNSETGSYIYPNSNFEDQFNMGKLLKQLKASCIPHEENLISALIIASEDEEHLVDTVKTVNEIAHEVVIITPQGSNLNKKAVSNVGAKVVESKSDIYEDLFMEGYKQCSGQYILFLKPKEICSLDTQKSLTSYLAINKVESLNLLVVDTLKNVQSNEFRVFKNTELIKKMNNFKDFAKYFDSINTNTVNIYLHKMYE

SEQ ID NO: 4761 - protein, 261 aa, Granulicella sp.
MPPTLSVAIITLNEEANLARTLASVKFADEIVILDSGSTDRTLEIARSYNATVFSEPWQGFAAQKNAAIEKCTGTWILSLDADEELTIELQTEIRALLGLNPTADAYLVRRRNLFLGRWIRHGGYYPDPKLRLFRRHAANFAPPARFTDRPVHETIAVDGRVETLDYDLIHHAYPTIESYIEHMDRYSTLGSQIIVSKGQTSRSWFAFYYHVAVIPTFTFLYNFIFRLGFLDGREGFLMHLYHSTYTSWKYAKAWQTTRKR

SEQ ID NO: 4762 - protein, 257 aa, Mesorhizobium sp.
MPALSVIIITRNEEASIAQCLRSVHFADEIVVLDNNSSDRTREIAGDLGAKVLMTVDWPGFGAQKNRALAAATGDWILSLDADEWVEAPLGAEIRAAIADPKAYDGFEIPRRSRFCGHIVRHSGWSPDLVLRLFRRRSGRFSDDTVHEKVLVNGKVSRLSQPIEHDSITDLADAHDKIGRYAEASAAQLLAEGKKSSIGKAVLRSVWAYVRSYIFRLGFLDGSIGAMVAAYSASYTYQKWARVALGMRGQVHPKKQG

SEQ ID NO: 4763 - protein, 360 aa, Clostridium tyrobutyricum
MVHHITISLCMIVKDEENVIGRCLSSIKDVVDEIIIVDTGSSDNTIDMCKNFTDKIYNFKWIDDFSAARNFSFSKATGDYILWLDADDVILPDDIKKFKILKKSLDTSIDSITMKYNVGFDEYGNITLSYRRNRLVKHSKNFKWIGFVHEYLEVYGNVINSDVSVTHKKIDFKPKRNIEIYENKLKERVNFSLRDILYYANELYDHNRFKEALKYYTRFLNSKQGWSEDNIRVCNKICDYFESINQEYKARSYIFKSFEYDSPRAEGCCRLGFSFLKENKLYQSIFWYETASKLEKPQNSLGFFNDSYWTWLPHLQLCVCYDKLGKHEIAYKHNEIAAKFIPKDKRILFNKKYFSGIGIS

SEQ ID NO: 4764 - protein, 326 aa, Fibrisoma limi
MTDVSVIILTYNEEKHIARCVQSLHPFTDKIFIVDSFSTDRTVEIARSLGAVVVQNPWVNYATQFNFGITHTPFKTSWLMRMDADEYVLPELAQEINRRLPTLPDHVSGVYVKRRVLFFNRWIKHGTYYPIWLMRLWRRDQGICEETWMDEHIKLVKGQPINFQHDLVDHNLNNLTWWTQKHNNYAIREVIDLLNIKYNFDDTERVEPKLFGSQEQRTRFFKIQYASLPLFTRPFLYFLYRYIVRLGFLDGQKGLVWHFLQGLWYRFLVDAKLMEVYFHAGRDKQAIIDFFQTEYGKDLRPSRERAAASGAVDGGNSGRPDRPVAL

SEQ ID NO: 4765 - protein, 361 aa, Bacillus toyonensis
MIKISLCMIVKNEEETLNRCLESVKGIPDEIIIIDTGSTDQTKTIASRWTQHVLEFKWIDDFSAARNYSFHRASKEYILWLDADDIILPNEREKFLLLKQSLNRDIDVVSMVYHAALDEHNNVLTSIRRNRLVRTNKNFQWHGIVHEELNVDNQCNFFHSDVIVTHKKINTGNESNRNLRLYENFIKEKKGEMTIHDIFHYARELHKHKRYKMAIEYYMEFLNCTDIKLEHRLFVMHKLASCYHLIGNFQKEKEITLQSLDYDVPQPEFCCRFGEVFIKRNQFQQAIYWYNQALETLSTNNSLFIEQYPFKTWLPHKQLAFCYYKLGNYEESHHHNKMVLNYLPNEQEALINIKVIEELMK

SEQ ID NO: 4766 - protein, 569 aa, Bacillus vietnamensis
MKNSISLCMIVKNEEDFLDNCLSSVKEIVSEMIVVDTGSEDRTIEIAERHEAKVIQAEWKNNFAEARNIGIEHATGEWILFLDADEELHKDSIEELKKWTDYPDAEGYFLRVYNHFGQNGQEASVNPTIRMFRNRIGYRFSGAIHEQIADSMQLQNPQARFVMTTVRIDHYGYQSAVRDKKNKSSRNITLLEQELKNTPDHAFHLYNIGVEYLQIGAVQKALESFQKSRQLVSPQINYAHLLYKCEARCFGALNLIDEAIRCCNEGLELFPDYTDLHHYKGSYYIVKGDCPSAIEHLQKAAEIGETPKYHTEAGMGTFSTHYLLGLAFESTQEDDKAVDHYYKSYQASQASQRPLFRMFQLLRVTGRQGDLLPFIQKKFRMNTKKQRETLLTILMRTHCYSIASELIKSWLKRSSTLTGQEVRQLLSTEEDCLLLKRPCKEGEGDYAKISEEKRQTLMNEQNPFDAMLPSSFHPVLNEESVDSILQAERGARLLFSQGFFKAFQEHTNLWKKEHSSTSKNFRVNSIIQLVNTLCFNAEIHIDSALENITSSELLNSAKLTLPFDEGFIE

SEQ ID NO: 4767 - protein, 310 aa, Spirosoma endophyticum
MTDVSVIILTHNEEKHITRCLQSLLPFTDKIFIVDSFSTDRTVEIARSMGAVVVQNAWVNYATQFNFGIEHVPFKTGWLMRMDADEYVMPELANEINQRLTGLPADVGGVYVKRRVFFLNRWMKHGGFYPIWLLRLWRRGDGFCEQVWHDEHIKLTKGQPIQFDHDIVDHNLNNLTWWTQKHNHYTILEMINLLNYRYKFDEAEKVQPRLFGTQDQRMRYLKEKYASLPLFTRPIIYFVYRYFIRMGFLDGRAGFVWCFLQALWYRFLVDAKLMEVDLRVGQDKEAIMDYFQTEYGKDLRAIRPQQVSRA

SEQ ID NO: 4768 - protein, 249 aa, Myroides odoratus
MAISGLVITFNEEKNIGKCIDALFQYCDEVIIIDSNSTDNTVAIAESKGAQVHLQAFLGDGPQRTHGLQFCKHDWIMNLDADEFLDVDALAFIQKKEYEHSPYDGYKFRVKNFLGDKLINFSGWYPDSKVRFFNKKTAGPSADITHQYIVTTQEKSVNVHILHYGWQNYKQVIDKKNQYSTWAAQQLFEKGKKVSSFKPVLNGAVAFVRCYFFKKGVLNGIDGLAFAIIQSFFSFMKYVKLIRLHKSKS

SEQ ID NO: 4769 - protein, 268 aa, Unknown
  Description of Unknown: Candidatus Daviesbacteria bacterium GW2011_GWA1_38_7 sequence
MISAIVLTKNEEKMIQTCLESIKWVDEIIVVDNGSTDKTLEEVQKYTEKIYQSDKPSFAERRNLGLSKAKGNFILCVDADERVTHDLKTEILEKVNSSFEEVAWDTPRRNIILGEEKRYKPFWPDYVTRLFKREFLKGWVGDVHEYPEFDGKHGKLKNALLHLTHRDIDSMVLKSLSWANIDAKLRVDANHPQMTGWRFLRILFTELWNQGIKRRGFFNGTVGVIDALLQVFSMYISYVKLWQLQRKETLEETYQKIDQQLLKSNFRY

SEQ ID NO: 4770 - protein, 630 aa, Bacillus cereus
MKPFITACLIVKNEEDMLRKCLESLRDGIDEIIVVDTGSTDKTKVIAKEFTDKVYDFEWNNDFSAARNFAASKGSGEWILAIDADECVEKDNIKDAIKEIKLDSGKYNTYIVEIISFVGEVGQSTTVNKMARIYKNDGTVHFKGAIHEQLVAIDGIERMAMSALTFYHYGYLPHVIEKQNKKDRNMKIVKQDLKSGENKGFAYFNYGQELRRLRKTKEALNYFVKAYAYKRSVDEEWVRTCLFFIIESLTELKRYEEALKIIKDTETLWPSAPDFTFSKGDIYFLQNRVDDAKEVYQSIVANSEKYNNVVYHYDRKSFLPYERLGRIYQIEKNDEQALQSYIKALNENFLSVHIITNIVRILSEYHTAKEVYEFLMSQNVIKTNAIRLDIVKYLLSAGYVDLAIHLAVDLEDRNKDFIKVIDLKAKMITNTSRKNATITFEKIDLLLGIQEGLFDLADLCILYSITKEECIEDIVKNSKFKHIFEWLFTESGRFKKIKQEEYVVILRRAIRYNQIEFVERLIMLKKFVHKDIDAKIADLFYENGYEDIAMDFYGLSERNHITKQGYINMIEWLISQKNIEEAYKLAIEALDKFKKDFRFYKYAIEFGKKGDKTLVAKALNIFPDSSWLKK

SEQ ID NO: 4771 - protein, 371 aa, Paenibacillus lautus
MIFVNSNLPVSACVLVKNEEQHILNCIRSLIPVVNEILIIDTGSTDKTISIASHEDVIILNYTWNDDFSEVRNYAIGVASQPFILMIDADETLNINSYTYLEQYTRSCVKVPATVNIRNVIDENTIVNSVVTRLFPNLSGYCYKGMIHEQLFYDDKPLEQVLPTEIVIDHYGYRKSEIQTKHKIERNLTLLNKQLAIDSNSIYLKYQIGQTYYVNGDYQKAIPYFDDSIRMISVSKFDALPRFMSTVFLSYGYCLLYTLQFDILDNLINDATELYPDFTDLYYLYGVSLIERKDIHNFSSIQDVFEFCIRLGDVKNPLYESVEGVGSYRALFNLGVYFEVTNNVEQAFKYYLQSSEYNFKPAIEKIKRLSM

SEQ ID NO: 4772 - protein, 356 aa, Unknown
  Description of Unknown: Peptostreptococcaceae bacterium VA2 sequence
MISISLCMIVKDEEKVIKRCLDSVFGIVDEIIIVDTGSIDNTKEIVKEYTQKVYDFKWIYDFSKARDFSFSKATKDYILWLDADEILDYVNKNKLLELKENLNTGIDVVTMETYMCLDENNNPTIKSRRNRMVKSNKNFKWTGYIHEYIKIDGNIYDSDIGIIHHKVKCADDRNLKIYKRNIDLGNELSNRDLCYYGKELYCNCMIDEAIKIFDQVILKDICKEEKVDALCKIGECYLYKKETSKARKYFYKTFEYIEPRGEVLYNIAYSFEEEKKYHQAVFWYEMILNIKISKDCSQCMNISCWRFKPHLNLSFCYFELNNLPKAYYHHEKAKQINPLNKYVMANDEYFKSIIKK

SEQ ID NO: 4773 - protein, 262 aa, Edaphobacter dinghuensis
MQSTLSVAIITLNEEANLARTLASVAFADEIIIVDSGSTDRTLEIARSHPNTKIFSESWKGFSAQKNSAIEKCTGTWILSLDADEELSPELQTEMRVLLIGEPPADAYMLRRRNLFLDRWIRHGGYYPDPKLRLFRRHSANFAPATRFTERPVHETIAFEGNLDTLHHDLIHHAYPTIESYIEHMDRYSTLGAQIVVSKGQTSKSWFAFYCNILAIPAFTFLWNYFFRLGFLDGREGLLLHIYHSTYTSWKYSKAWQTTRRH

SEQ ID NO: 4774 - protein, 298 aa, Bacteroides acidifaciens
MDSIAFIILTYNEERHIARCLQSLMPFGHELLVIDSFSTDDTCRIAEKLGAKVYQHPFKNQAQQFNWALENCPIESGWIWRVDADEYISADLGERVMNTIQTCGANINGIYVNKRIVFMGRPLMHGGWYPAPQIKVIRKGFGASEKKWMDEHLIVFSGDTVYIDGDQTDENLNDMAWWSHKHVNYAYREAINMLMMAYGIDTDTDTVKPDLWGNGVERKRWFKIKYARAPLFLRPFAIFFIRYVLKGGFLDGRQGFIWYILQSFWYRMLVDVYIWEIKRACRWKKEAVKEYIRRYVSE

SEQ ID NO: 4775 - protein, 254 aa, Thalassospira xiamenensis
MADKAPRLSVVMCAHNEEERLPSCLAHLGFADEIIVLCDKCTDRTEEIAREFGAKTIVGSWDIEGERRNRVLQEATGDWIFEVDADEHVNEELGKSIRNAIVDTEFDCFVISVHNYIGKRLVRYGWGASYGTSAVRRLFRAGRKTWGLQRVHPSFELIGRTGPRLDGALLHYVDRNISDMIKRLDSYTTARAADLRASGNIGSFANNFRRIFSRFFRCFVSRKGYKEKGMGFLIALFAALFPLLSYLKARYDDE

SEQ ID NO: 4776 - protein, 255 aa, Unknown
  Description of Unknown: Candidatus Roizmanbacteria bacterium CG01_land_8_20_14_3_00_33 _9 sequence
MRQTITAIIPAFNEEKNIERCVKSVLWCDKVMILWMGNDKTGAIAKALGAEVIEMNKNAKPDFISVQKNINWAIDNATTDWIFRIDADEEVTPKLNSEIGFILNSKFIIHNSPVAYGLPRNQFFLGAFLKGGDWYYDRLVRLFRPKFARYDPIVPIHEQFKVTGKIGYLENRLNHYSHPTFNDVIKKFQLYTDAEIPQINNPVWLAFIKMIFLPLYVFCRWFFWHHGYRDGWRGVVAGALRGWYEFLRFWKFLSC

SEQ ID NO: 4777 - protein, 301 aa, Bacteroides clarus
MNNTISAIILTYNEEKHIARCINSLRGICEEIFVIDSFSQDRTLEIAKQLGAKVYQNPWKNYATQFNWGVMNCPITSEWIWRIDADEFLEGNLGQAMKYTLAECSSEVNGVYVRKRIDFMGKPLLHGGWYPSYHLKVFRRGHGECENRWMDEHIRIFDGITITVEEGNQVDANLNDLTWWTEKHNGYATREMVDMLMMEYGMDDKGKEVQAKFWGTEEQRKRWLKMKYIKAPLFLRPFINFFIRYILKAGFLDGKQGFIWHFLQGFWYRFLVDAKIYEIKKQFDFDSEKVRRYLKENYFKD

SEQ ID NO: 4778 - protein, 264 aa, Unknown
  Description of Unknown: Candidatus Shapirobacteria bacterium CG03_land_8_20_14_0_80_40 _19 sequence
MHNTNLTAIVLTRNEEPVVKDCLESVKWADEIVVVDHGSTDKTLEVVKKFGVKIIVEAPVYSNFSDRRNLGAKEALGEWLLYVDADERVTPELKEEILHTISNFKFQISNFVGYAIPRKNIRLTKVLYHGGWWPDYVLRLMRKDKLIKWEGELHEQPKIDGEVGKLKEAFLHYSHRGSLEHKLQNTINWSEIEGRKMFNAGHPPMNIIRFLSAMWREFYYRMIKQKAFLDGTEGVMEAFYQVFSVFISYARLWEMQQKSEKEKK

SEQ ID NO: 4779 - protein, 357 aa, Clostridium saccharoperbutylacetonicum
MITISLCMIVKNEEDSIARCLESVKDIADEMIIVDTGSSDKTKDIVGRYTSKIYDFQWIDDFSAARNFSFSNATKDYILWLDADDVILPEDVEKLKTLKETLDPSVDSVTAKYNIGFDEYGNVTASYRRNRLVKRVNNFKWYGFVHEYLAVGGNIFNSEIGITHKKIKHTPKRNLEIYRGKLEQGAEFTPRDILYYGNELYDHNIYDEALEYYNKFLDSKQGWFEDNIRVCGKICDYYQSINKIEEARKYAFRSFEYDTPRAEACCKIGFSFLHEKKYKQAAFWYEEATKLEKPKDSWGFFNDSCWTWLPHLQLCVCYDKLGNYKLAYEHNEIASQFRPNDERILYNKKYFEKLGFS

SEQ ID NO: 4780 - protein, 352 aa, Paenibacillus physcomitrellae
MIVKDEEKVIGRCLASVRDLVDEIIIVDTGSSDRTKDIAAGYTDRVLDWEWTDDFAAARNYSFDQATMDYIMWLDADDVLYEKDRVKFAELKQSLSWEPDAIIFNYDLAFDPNGNTIASSRRYRLVKRSQGYRWFNPVHEYLNVTEGKVLDTDIAVSHHRAGDHTARNMAIFQKWIENGGKLEGRTLFFYANELLDQKRYQEAAACYETYFGEPIGYREDRIAACAKLAECYHHLGRKDKQLDTLFKSFHYDVPHADICCAVAGCFEGREEWGLAVYWYNRALESLLPEGYMGVVSAAYQTWVPHVQLCFCYARLGHLQLALEHNNLALSYLPGEVNLLENKKRLEQALGLL

SEQ ID NO: 4781 - protein, 364 aa, Clostridium sp.
MSTVSLCMIVRNEEEYIEACLESVKHLVDEIIILDTGSTDRTKELCSHYTDQVYEAEWQEDFSLARNQCIEKATCDWILWLDADERLILKDRKLLQQKLSKKRCKSYTVRMLHFMNSMEEGKGRYYISYHIRLFQRKAGYQFQGIIHEKLVDRKGNELQSKEITDVIELYHYGYTELHLKEKSIRNLSLCLKAKENDRENPWLDYHIAAELYRLGDMKKSLEFINFSILGFLSKGKVPPSYLYNLKYDLLITCGNTENVNEGIERAISLFPDYVELHFYRGIVLFRLNLYKEAVKAFSYCILLGEDNPNYLIKYGSGTFLAYYYMGEAYRMCGEKEYALEAYRQALLYQTEFPEAEERLKEYTA

SEQ ID NO: 4782 - protein, 282 aa, Pedobacter sp.
MKVPVSVVILTFNEEKNIRDCIESILDFTDDIFVVDSGSTDKTLEILSNYPVQILHNPFENYSQQRNWSLKNIKFKTEWVLNLDADHRATKEFKEEVEKLFLNGIPNHINGLLTSRRTMFMGKWIKYGGHYPTYHAALFRLGRGKCENKLYDQHFLIEGDTLKVKGDIIDLITESLSTFTQRHDKWSSLEAIQQFENNLNKKDIIKANVTGNPIQKRRFYKNIYEQFPLFVRPFIYFFIRYFLKFGFLDGKRGLIFHFLQCFWFRFLIDAKIYELKKNSNKF

SEQ ID NO: 4783 - protein, 595 aa, Clostridium sp.
MKNQVSLCMIVKDEEEYLPRCLSSIKDVVDEIIIVDTGSTDKTVKISKSFGAKVYYFKWNNNFSEARNESLKYATKDWILILDADDELNSEARETFKALLNTELDENAIYHFETLSYYGSGIEKDNIAVNLNPRLFKNNRGVHYEGEVHNQLIRAEGDYNAVCKDIKIYHYGYIDKRIVSKEKRKRNIAILNEQIKKKPDDGFVYFNLGSEYGALDDMNKALECYYKAYEKFDQHTGYSSLLILRIIISNLNLKNYNEALKFVDIGISYYPKCTDFYFYQSLIWKELDRPTLQIRALEKCIELGEPPSELKFIFGTWSYRAYYELGNVYMKYKDNYTAYNCYIEALKLKPDYIEPLYNIIQVLEEKKVSLDEMKRILEEFFPEDKKAYYEIAADLFYHVGHYSTALEYIKKYEDTVNVTESTTVLKSRCFIRNGNFEEYTNINNIDKKSSYYIISLMYKVLCFILLNKNENALYIVNNINKDNLSDYDKRYLKVYSELIKLFDKKPTMILTNDENDKEYMNIILEVIEILLINDKFDELAIAIELLNLVDTKYALLNLGKLYYRYGYIELAQKEILRSIKEVDIYDAEGLDILKY

SEQ ID NO: 4784 - protein, 667 aa, Unknown
  Description of Unknown: Geobacteraceae bacterium sequence
MTQFTAPLISRADLLYAKGRCDEAVDLLTDSLARNPSQGSVVTRLAEFLIDSGWHARALEFLKNINTDENDGRALLLRGLCHEALQNFVCAEDIADQLLAQERQRPNALALKARIAVGTQANDKAERLFQEAIECDPGCGMAWYGRACLRRQQGELHAYHTFIKKAFLALPQSKEISIAFHENGLAIGDLQQVESVFREALAGELMDRRLRFFLIDLLLRQSKNAEAVTEIESAIVDFGADERMLAAALNIRTRLGPMSIPTQPKPGGSVSLCMIVKNEQSHLARCLRSVKPLVDEMIVVDTGSSDRTQDIAKIFGAKVFEFPWNSDFSKARNFSLSKAAGNWILVLDADETISVKDYEEFRRILKLSQSRPDAYRIQTRNYSNQANTVGFNTNRGAFPDEMGLGWSPSDKVRLFTNDPRIRFAHPVHELVEPSLQMLKIHVRPCSVVVHHYGTLQNDKTLEKTKTYSDLGRKKLKKDRNSPTAIREHAIQSARLGKHSEALDLWRRFIRLQPRSAEAYVNMGTACWDLERYAEAASFAEKALRLDPLLKEAKFNLAISLLLMGRGGEGKSLLERLIDEQPDYTAAQFMLCVAHICMQERVQAENLFRKLRSLPIGDYIGESFLDISKRFISASRIDDAGRILNTALSFGCETPAMRVLLEDCKAVA

SEQ ID NO: 4785 - protein, 644 aa, Unknown
  Description of Unknown: Desulfitobacterium hafniense DCB-2 sequence
MKLSACMIAKDEEKNIARCIGSYKDSVDEIIVVDTGSVDKTVEIAETLGAKVYRYEWNNHFAEAKNYAIDRAKGDWIIFLDADEYFVNDTARNIVPLIRRLPAHFKAIACKMKNIDYTNGKLLDEITHVRIFRRDKNILYMNNVHECLTHKTKNKAIEAFLADDKDLLIYHEGYSLSDRGKKSRRNLELLLKRLDKAPEDPTIYQYISDCYFGMEEWEKSIEYARMFIASGARFVGYNVKPYQNVIDSMLRLKCNANDILEEIYAGVNKFPCHPSFHFYLANMLFDLKKYDKAHSEYKKTLTLQEKYDDIEINSIVPNLYHVYYYMAIIASHRNEHEDALSHFVESLKMEKMQYDCLRKLLLAIKSFPAEDIILLLNSIYNKEGKEDLDFIVTVLTGVSLPKVLAYYSALRIKKYGSEDLTVVYMLLANGQYNKTFAVAQKCLDADPDNRTFGTLAVVSALLSEHGEYMAWVGAQASEPMRRFVRGLTKHEIFVFSKEDKEDYLDLITYLHLFGTKEILNKAIELAQDFDEKVIYAELGNLFFKQECYAEALKLYQHYIKQEEAKKEKQITQIYAKGICWYKLREYEKAATALIEAYELGYRQNDIYEFLRWSVDKLPSGNRSGERGLEIIAESKWQESAFLKV

SEQ ID NO: 4786 - protein, 765 aa, Unknown
  Description of Unknown: Bacteriodetes bacterium sequence
MELSVSACIITKNEEKHLRDCLKSIESCADEIIVVDTGSTDKTVEIADRLGCKVIITEWQDDFSYSRNIALNSATKNFILVIDADERLLNPEELKSAIENKGPSTGGWIINVVSEARREDGSIDTYSSGLLRLFVNHPSVRFHGIIHEQVLEPLLQQGFRLQQSNLLFKHIGYGHSSEQMRQKQERNLYLLNKSLEKNPEDAYSLYQRAKTFLALKSLEEAEKDIQKTLEIVNPNSAVKPQALNFGAVVAFQMKNYEKAIARAKESLSILPNQSFANYILGDTHTQTGNYPDALESYQRMEEAETKEDLTTKIVGDYHLPKEQLYFRKGKCLIGLKQFDAAFSEFEKGFKINNNDVGILVGMANVAFFWKKFDEARGFLLKAKKLAPNKGEITNYLEQVDNALSKIKSIQTSSEVKTGGNGYKPFLTLSMIVKNEEGTLPGCLESVRDVVDEIVIVDTGSTDRTKEIAKKYKAKIYDFEWIDDFAAARNEALKNSTGEWILYLDADERLDINSKNNIRNILMNASDEIGGFICTIESDHYQLNGSTERHRGGYPRIFRNYGIPKISFQGRVHEQITPSIFALGKSILFSDLVIEHLGYNQSREVMEAKVNRNYKMLIQHVQEEPLNAYAWYQLGQTLAQMKLIDEAEKTIRFSLQLGNLSDSVYASATSTLAQLVGNKKNFDECLYWTEKSLEKAPGQVYALHLKAYALLYLGRFEEAEQLFLEVLNRLNVKKGVPHSGFDIVIPEEIVMKGLNQAREKRITDNI

SEQ ID NO: 4787 - protein, 361 aa, Clostridium hydrogeniformans
MNGDITISLCMIVKDEEDVLERCIKSVLSAIDEIIIVDTGSKDKTKEIALGLGANVYDMQWQNNFGLARNLAFSKATKEYIMWLDADDVVTEESLQKLLELKKNLDRNVDSVTMIYVLEEDSSGNPTSTLRRNRLVKRGRDFQWIGKIHEYLAVHGNIINSDVSVHHRKIKSSSGRNLMIYEGMVKEGEELSVRDMFYYGNELFHNGHYDKAIEQYNKFLDTKAGWIEDVKTALSNMSECYSANGDNENQLKCLLKAFEHDVPRSDFCCKIAYCFFNRNMIYQAIFWYKLAIDTAPSKDNLSLVNHATYTWIPNIQLCVCYSRLEMYDLANKFNEEAGKFIPDNPMIIHNREFLKDKISNS

SEQ ID NO: 4788 - protein, 314 aa, Alteromonas oceani
MLGNFCVSSNLSVLILTHNEELHIRRCIESLKPIVSQIFVVDSGSTDKTIQICEELGVRVFRRKWKNYSDQFQWGLDNCPIETDWVMRMDADEYIEPDLIAELPKVLAVAKAETSGFYIRRKYFFLGQWIKHGAVYPLNLLRVWRTGKGRIESRWMDEHIVLDDGGQTEMLSGHIVDDNLNNTKWWTDKHNKYADREMVDILGRKYSLFAADQTLEVDDSSSQAKIKRLVKEKLYNRIPLFVRPLLYFLYRYFIRLGFLDGKKGFAFHFFQGYWYRSMVDLRVLEAEKLFADKHCDTKEKKLDALAELTGLELK

SEQ ID NO: 4789 - protein, 749 aa, Unknown
  Description of Unknown: uncultured Desulfobacterium sp. sequence
MSEIETDWVLFIKPEERVIISSAKKLTKMLTSKQAPGYGVHTKTTKDRHLLENYQWIKKLEQFKDIGCSDFIVRIEPRLVIKSHTKICMKGLAQENTDEVSWICGIIAHGLKIELIHQENETGNSDGNIREHDTRCLKGELVYDVTPEEDMVELSEMYTGFRILTNSQLDGFMEGARCGFGHYKMYIPMLEFLVKEGFFTEAKELFEQWTDHRPDDKEEYNTQLMGAMIYSNLLEYDKAIEWFKKITEKSESALAFANLGKLYLIKGDKNKAIEHLEMSKDTEGDIFLKKRILSIIKNEEWRPLKLSLCMIAKDEEDQIGKALQSVCDLVDEIIVVDTGSTDKTMEIVKEYGAKLIESKWEDDFSQARNLGLSKATGDYILFMDADEYIHPGDRFGLALFKMLLPIGKNIAFGLKIEPAKEARKMSMAQSDLLTDQKEDNYQIRVFPKKTGVRFQGKVFEDLDEALNEKQVRALRYDVVKITHSMEGREKRDKRKIPAIAKAFGSIYDSQKILKAGILFLRLGDIESAYPWLIKAAGVDPNLSAKIGMLYSRQNKHEMAKEILTNAIAQFPESSELVLSLAGVYHREENFCKVVSILGERILNIEKELISEKTALARYYLGIASIETDDVAYGIEQLAIAHEIDPANISYKIAGIYAFAKVEQWEEALQTAGQISDKEEIDIRCEVNDFVDVVQIFVDLNRHFNRKGRMEEANLCRMIIEVIIKSKLSGSEDMDKMSAMIEGVATGGCI

SEQ ID NO: 4790 - protein, 360 aa, Paenibacillus sp.
MITISLCMIVKNEEESIGRCLGSVQALVDEIIIVDTGSTDRTKEIAEQYNAKIYDFEWINDFAAARNYSFSLATMEYIWWLDADDVLLENDREKLLQLKSTFDRSIDSLAMDYHLSTGPDGKPTFSMKRNRIVRRACGFQWHGFVHEYLAVHGKIVPSPIAVTHQKEKVHTTRNLDIYEEQRAKQTPFSPRETYYYANELKDHRQFENAITHYQAFLDTKQGWIEDVMAASCKIADCYEAIEKIDEALAAILKSFEYAVPRAESVFRLGRYFMHRDALDQAIFWLSMATTLEPPKESWGMQQSGYWTWLPHVQLCICYYRKGDMITSHYHNEIALTYHPDDEMMLSNRKLLLPYQPEDPN

SEQ ID NO: 4791 - protein, 254 aa, Unknown
  Description of Unknown: Bacteroidetes bacterium SW_11_45_7 sequence
MNHVSAVIITYNEERNILRCLDSLLPVADDIVVVDSYSTDKTPQIVESKGVRIVQHPFEGHIEQKNRAITQAKHPFVLSLDADEALDKDLQQAILEVKKSGNADGYYLNRLTNYCGTWIWHGNWYPDPKLRLWDSRKGKWGGVNPHDTFIMEKDSKISQLSGHLLHYSFSTFAEHRQQIHHFADIASRAAFERGKRSSPFHILLSPTVRFLKGYLLKRGFLDGKAGWQIALWSAYAKYLKYRNLQRLWHANRAA

SEQ ID NO: 4792 - protein, 247 aa, Unknown
  Description of Unknown: Candidatus Shapirobacteria bacterium CG11_big_fil_rev_8_21_14_0 _20_40_12 sequence
MISVIVLAKNEEENIKRCLKSVSWADEVLVIDDNSIDKTVKIAKSFGAKVVNHSLEADFSRQRNFAVSRAKNDWVFFLDADEEVSLELKDEILKSLSQHPQKTSAFYFKREDFFMGKWQNFGETGNIKILRLARKGSGKWEGKVDEIWKITGGCQIFKNPLKHYSHPNLSQFLESINYRSTLNSQVFFERGEKLNFFEWLKPFLKFMQNYFIRLGFLDGVSGFVFAVLMSMHSFMVRAKLYLLWRKK

SEQ ID NO: 4793 - protein, 359 aa, Desulfosporosinus orientis
MKISLCMIVKNEEDTLERCLSSVSDIMDEIIIVDTGSTDKTKEIAAKLTEHVLDFTWIDDFAAARNFAFSHASMGYIMWLDADDLLLPEDRQKMLQLKQSLDPSVDAVSMEYHCDFDEHDNTTLNVRRIRIVKRVKNAKWHGAVHEDLSVDGKIFDSEIAVTHKQNHKNTDRNLKIYENRLLQGKEFTVQDIFHYASELHHHKKYKKAIEFYLKFLEDENNTEENKIFVCIRLADCYCQLNDKEKELALTFKTFQYDIPRPESCCRLGYYFLQKNELNKAVYWYKQAIEVPMPENSWAIVSGVSRTWLPHMQLGLCYYQLGRYDLSYQHNKIALSYRPKDKGILNNINLLEELLKQGQD

SEQ ID NO: 4794 - protein, 269 aa, Mucilaginibacter psychrotolerans
MIPVSVVIITRNEEAMIGRCLEMASLISNDIVIVDNGSTDDTIAIARAFNCRIYHKDWDGYGANKNKGITLARYDWILSLDADEVADGQLVGQLHRLMLKDPNVVYDIAFRSYFGQKRIRYGTWGRDHHRRLFNRRLVRWSETEVHETLLLPAGVKILKLDGHLHHYSVNNIYECRQKAVHYARLSAAKYANQGKKAGFFKCRLSPVFGFVMSYILRLGFLDGPEGLDIALTMYQNTRLKYQHLKLLESRKYLPSDKPPVPKKLAVEYR

SEQ ID NO: 4795 - protein, 421 aa, Bacillus pseudomycoides
MLPTISFCTIMKNEEEYIEKCLESIKNIVTEIIIVDTGSTDKSIEIAKRYGAKIIYYDNKNINFSQARNLALNIATGDWILTLDADEMFYKKDVYKILELVKTHEKIAYYFPRYEYLKNGGWFLKKALKLFKNSPNVQYRRTIGENIIDSLEECSYKFCEVDEIYIHHYGKRKKTTQLYNKKNLYSELTKGFLKENPVTYPKMYGFLAESYLLTEDYVSALNNFKIAYEKAPSLYAYKRICDLYYKMGIYDKWIGGYRKLVTTELFDESSLNNTKGHYYFLIEQYEEAKLFYEQTMESCHKYINIGLCSERLGQYESAIHNFEMAVNLNPMIKQLYPLKFSYPIELFNDTNWAFKCVYNHLLFCYLMLGKTEEALNVLMKINNEECEQLRTYVLESTKRINSMSEGVIIKYELDKLMLKNY

SEQ ID NO: 4796 - protein, 369 aa, Bacillus filamentosus
MITVSLCLIVKNEESTLQRCLNSVKEIVDEMVIVDTGSTDKTIEIAAQFTNKVLEFPWEDDFSKARNFSFQQATKDYILWLDADDVLNEKDVEKFLELKKTLSSQVDAVAMDYYLDFDEYGNVAGKIKKYRLVRRMAGFKWIGAVHEYLDVEGKVESSNISIIHKSERQSKDRNLRIYKNKLARGEAFEARDLYYFANELKENGTYDKAIFYYNKFLNTEEGWIEDKISACSKLADCYFEKGEHEKEYIAILTSFIYDIPRPEFCCRLGYYFLERNELRNAIYWYYVAIQLEISTECSGFVNPAFSTWLPHLQLCVCYDRLQQYDLAYQHNESARKFRPEDPQILHNKQYLEVMKNRNLTSLGETYVGI

SEQ ID NO: 4797 - protein, 357 aa, Unknown
  Description of Unknown: Lachnospiraceae bacterium A4 sequence
MSKIPVTVCIIAKNEEKHIENCLKHLKKYDLEVIVTDTGSTDRTKEIAEKYADKVVDFEWVNDFAAARNYCTSFAKNNWILAIDCDEYVTNIDVRILRILMQKYPRYTGVLRLKNLIPEGNNGAKGYVSDDVPRMYNKNYFEFDFPIHEQLRFKDRTKSDDVMEAFLLPIEVIHHGYALTGDDMRKKQERNIKLLEGSIEENPTNGYYYFQMGQSNFVLGDVDKAIEAYEKGMELVDNLDNVYVPEMIMSLAKAYTAKRRVDDALNFLEKYVKYYNTAKFQFEYAELLRKNNQVLKALAMYIKVTTMQDVETIGENLITCYGCIISIYESMGNKEMAELFHNQFLQCVAEKERIVNS

SEQ ID NO: 4798 - protein, 285 aa, Pedobacter glucosidilyticus
MLDYPVPISIIILTFNEEKNIKACMESALNFAEEIFVVDSGSTDATLSILENYPVQVVQHPFENYSQQRNWAIQHLPIKTQWVLNMDADHRLTEEFRTEVSALFSKPIADDIHGFLASRKTIFMNKWIKYGGHYPTYHAVLFRKDKGLCEEKLYDQHFKVEGKTQKLKGDIIDLITESLSTFTLRHDKWSNLEAFEQFHPPQHGAVIKGSLQHDNPIARRRYMKNLYERFPLFVRPFVYFFIRYFLRLGFLDGKEGLIFHFLQCFWFRFLIDAKIYELKKQQDGH

SEQ ID NO: 4799 - protein, 349 aa, Bacillus luciferensis
MIVKNEEAVLSRCLSSISNIVDEIIIVDTGSTDKTKEIAKNFNSLIYDFKWINDFSAARNFAFSKATKDYIIWLDADDILTEENANKLLALKKSLNKKVDAVGMKYHLSFDENGNPSFSSVRHRIVKRERNFKWIGFVHEYLEVYGEIIQSDAAIIHQKDKEYSDRNLKIYENAISSGKELSPRDKYYYANECVDNQLYEKAVEWYELFLKEGKGWYEDSIQACGKMADCFINLQNWEKAINSCLKSFYYDGPRGENCCRLGYIYLQQGDYSRAISWYKLATLVSVPETSPFINQACYTWLPHLQLCLCYSRLGDQVTAKKHNDLAANYVPNNPSVLYNQEYFRTYFKD

SEQ ID NO: 4800 - protein, 364 aa, Paenibacillus castaneae
MISISLCLIVKNEEKTLGRCLSSMKDIADEIIIVDTGSTDLTKQVAGKFTDRVEHFTWINDFAAARNYAFSLATKSYIMWLDADDVLKESDQLKLRELKRNLDPAVDSVTMDYHLAFDEFGNVTSKLKRNRIVKRERGFKWIGPVHEYLEVYGNIFHSDIAVTHSSIHHDSDRNLKIYEQRLAKGEVFSPRDLFYYANELKDHSKFKAAIRYYNQFLDTGKGWIEDNVASCSRLADCYSELKETRKMVDSIFRSFHYDKPRPEFCCRLGFYFLEREEFKLAIYWYKLALAVEKPEQNWGFENLACSTWLPHLQLCVCYDRIGEFETAYAHNELARTFRPTDERIVANRAYLVKRLGKKVGEEAL

SEQ ID NO: 4801 - protein, 350 aa, Alicyclobacillus macrosporangiidus
MIVKNEEETLGRCLESVADLVDEIIIVDTGSTDSTKEIARKWTPHVLDFEWIDDFAAARNFSFSHASMEYILWLDADDVLLEPDRQKFLHLKQNLDSAVDVVSMYYHLAFDSEGNVTASLRRNRLAKRSKGFRWYGAVHEYLAVNGSVLNSDIAITHLPVKHDSDRNLRIYERRLAAGETFTPRDLFYYANECFDHQNYERAIEYYTKFLNSKQGWIEDIIATCGKLADCYFHLGDMERAKEYALKSFEYDTPRAEFCCRLGYGFMQQGEWNKAVFWYKLATEVEKSKDSWGYFNDACWTWLPHLQLCVCYYHLGEYELAYKHNEKARQYKPNDEQVLYNKNYLESILKT

SEQ ID NO: 4802 - protein, 615 aa, Unknown
  Description of Unknown: Firmicutes bacterium sequence
MTASLCEGDVLEIGCGNGDLSSYISMYGNRVFGIDIDPVAVEIARYKVWDYALSDCFFDVADANQLDLPDSSFDTVILAEILEHVKEPMKVLKEARRLCKNGGKLIISVPNGYKIPSHDHLRIFNLDVLKELLAGIGVKESDINLDERVPNEWILCWFYNKKEENLNLRGKNNQDLTKYFLPPHPIEDLKNAGKVSVILPTYNGEKYIQESIDSVLNQTYKNFEIIVVNDGSTDKTYEKLRPYIERGQIKYISQGNKGKPHAINRAMQLATGDYVWIFDDDDTALPRKMEVQMRHFLRKPYLDLIHTSSIYTDSSNKTPLLVWEPSEIEQKDLLKSLLHGCIFHQGSVIVRKRCYLNAGKYDERLVRAEDYDMWIRLVKNRCNVGKILLPTVTYRQHNKVRGSKENPIPVEKVAEATREYEKIIFKKVYNDIPLAEIFPELKEENSNSGLRVSALIERAYAMAKRRLFDYALNDLKEAFELAQKNYPVSITFRGMYFIKKFSEMLTQIENEEIKNIVMYFSLLIGNRDVRNFGKKGKTTLSLCLITKDEEKNIARCINSVKEIVDEIVVVDTGSKDRTVEIAESLGAKVIHAKWEDDYSKARNIAIENATSDWIL

SEQ ID NO: 4803 - protein, 295 aa, Unknown
  Description of Unknown: Marinobacterium sp. AK27 sequence
MENNITAIVLTYNEELHIGRCLESLLKFCSAIVVVDSYSDDSTLEICKSFHKVQVVQNPFVNQALQMQWALDHTQINTRWTIKVDADEYFDEKAIRNIKAISQGEDCAVAFRRRVVFNDRWIRFGGTYPQTLVRMWPSGLCQVENRWMDEHMIVKGMRRVVVKGGFYDHNLRNIEWWTNKHNSYSTREMIQYYLEKLNPINEEDKLGFSLSTYVKRNLKKAYNRFPKLFRALFYFSVRYFFLLGFLDGKSGFYFHFFQGFWYRALIDFKIDEARIHAYDMVSFRVYIKKKYGLNI

SEQ ID NO: 4804 - protein, 350 aa, Bacillus sp.
MIVKNEEAVLSRCLSSVSNIVDEIVIIDTGSTDKTKEIAKKFTNSIYDFTWINDFSAARNFAFSKATKDYIMWLDADDIITDENAKKLLKLKKSLTKNVDAVKMKYHLAFDENGIPSFSSVRSRIVKRERNFKWIGFVHEYLEVYGEIIQSDAAIIHQKDKEYSDRNLKIYENAISSGNELSPRDKYYYANECVDHKLFEKAIEWYELFLDEGKGWYEDNIQACGKLADCYLNRNELEKAISSCLRSFSYDGPRGENCCRLGYVYLQKGDYTRAISWYKLATLVDVPTSSPFINQVCYTWLPNLQLCLCYSRLGDQLTARKYNDLAASYVPNNPSVLHNQAYFRSYFKDQ

SEQ ID NO: 4805 - protein, 300 aa, Unknown
  Description of Unknown: Candidatus Woesebacteria bacterium GW2011_GWA1_39_12 sequence
MHYTPSTTHQTLSVVLATLNEEQNIGSCLESIKTIADEIIIVDESSTDKTREIAEKYGAKVIKVKHKENFHINKQKAIETATGDWILQLDADERVSPELAKEIVEVVNSPNDELLKRVLDSPSTKNLKLFSRHQRLIEQREGRLGIHNGQIVAFFIPRRNFFLGKPLIHAGVYPDGVIRLIKRGKARLPGKSVHEVMEVDGEVGWLFNDLEHHDSPTLQRYLERMNRYTDLQAEELRRNEVPVNAFYMLLYTCYRPAITFLKLYIRHRGYLDGMRGFIWSFFSSLHYPLSYFKYWQAQKS

SEQ ID NO: 4806 - protein, 349 aa, Bacillus sp.
MIVKNEEQTISRCLDSVKGIVDEIIIVDTGSTDATKEIVKRYQSKIYDFKWIDDFSAARNFAFSKATKKYILWLDADDEIADEDKKKFLQLKRTLDANIDAVSMNYYLSFDVEGNPTFQLRRYRLVKRNRNFKWHGFVHEYLEVYGNLMDSDIGVTHKKEKAYSDRNLKLYEKHIADGKELSPRDVYYYANECKDHQLYDVAIKWYSKFLDEGQGWFEDNIQACLKRAECYLELGNWNESVHSCLHSFIYDTPRGEICCHLGYLFLQKNDYQKAIYWYRSAIEGPRPDNSYFIREACYTWLPHIQLCICYDRIKEYEKAIYHNEQAAKFIPNDPSIHHNREYFSNLSKK

SEQ ID NO: 4807 - protein, 379 aa, Unknown
  Description of Unknown: Anaerolineae bacterium sequence
MENPLISLCMIVKNEQEYLPRCLESVQNVVDEIIIVDTGSTDGTKEIARKYGSKLFDFEWIDDFSVARNYSLEQAKGRWILVMDADEELERDSGARLRKLAQADEADAYWVLQRNFYKNRPQNTLDVPVLRFFRNCPTYRYRKRYHEENTTSIRESGGKIAKDPQGLIIFHYGYLHSTAQGKPRVERAIQTMQLALQEEPNNAWLLAKLGIDLYSIGRQDEAYAYLYRFATAEQGQLDYRQATPLDTHEALTYLGDLAMRRKEYTLAKYCGLASRKLTDVFELRLYSEFAVIGGTLGETQILLEQVQQENVPLRLTSENFSLLRQKLQELSDLEGEITTLLDGFYTLLSSSQRNLLRSWKSSCRQLILAIQQILTSKRA

SEQ ID NO: 4808 - protein, 289 aa, Sporomusa sphaeroides
MISVIIHTLNEEKNIRNCLECVKWVDEIIIIDMHSKDKTVQIAKEYTDKIFFFEQMEYADPARSYGLSLATNEWILSVDADEIVPVDLKNILIKIMKENYYDAVSIPHFNYFFGHAIIGGDCAPLENPHIRFFKRNIVSYSDNIHSFFQIDYKAKIYFIENKELSFIHFGYIDVEHFLEKLNRYTTIEAKALYLNNEKNIFYKLVIKNIKEVLKFFLKKGYKDKTYGLIYTLLKCGYNICVGAKYFLMKQSKTIVPRNSIICEYDKIAQKCIQEHKKRNKKYNEDKSTN

SEQ ID NO: 4809 - protein, 477 aa, Unknown
  Description of Unknown: Desulfurobacterium thermolithotrophum sequence
MKISACIIAKNEEKNLPRLLKSLKGKFDEIILVDTGSTDKTKEIAKEYGCKVVEHEWKGFADARNRAVEEAAGDWIWHFDADFELEEDEYKKALLFLRKLPIEIKAVMIGIKNLDNSGHIKGISSHIFIHRNENGIRWVGKVHETPNVEEAIGIPVFVKHYGYADPKVQLEKAERNLKLLLQEISTLEKGSHEYILKLFYLVQTYTILSYRNKEYLQKAKEAAEEFLYLTKEKEEKFGFFFIYVYNYLLNILKMMKDKKTFEKYLFEVLEKDFQVPDFYILAYHFYKEQNKLKKALKNLRKAAELFDKSQKNPFFIKMSFASDKLKEFEKIILSEDLISEDYESELKKEWKKKKGRNLGLLFYAVSNKDRLKTIKKLVMRYPDELTVFLLFKELENKKLWKEIEKYVKTFSDFSISYLYKGKLFENKGMIEEALSYYLKYLELNKDFNVALHVNSLLRESGIIEINSKINRLTSDNK

SEQ ID NO: 4810 - protein, 344 aa, Butyrivibrio sp.
MVTISLCMIVKNEEKVLGRCLESLKGLFEEIIIVDTGSVDRTKEIALKYGAKIYDFDWINDFSAARNFAFSKATCDYIYSADADEVIDKENYLKFQALKSVLELNPTDDLPVDIVQMYYCGQLSSKSVYNFDKELRPKLYKRIRSFIWEEPIHEQVRLNPVIFDSDIEIIHKPEGDHSSRDFAAFENYTEKGKKLSSRLLDFYTRELYMAGRKEDLEKSVSYLTSVTEDENTDSNDIQKASIILCKFYRITDNIALFMKYALKDSAIGMSSEICCELGDYYLEHEDAKEASLWYYNAAFSQSAVLDIFSSGKRAFLGLGNCFENLGDEENAFFYKQKAKEWKTE

SEQ ID NO: 4811 - protein, 294 aa, Hymenobacter sp.
MNSLSVIILTFNEEKHIERCIRSLQGIASAIYVVDSFSTDNTCALATALGAQIYQNAWTNHSKQFNWALANCPITTDWTMRMDCDEYLLPELIAEINQKLPQTAAATGGFIIKRRVYFMDRWIRHGGFYPHRLLRIWRTGQAVVEDRQMDEHVVLEQGEVESLAHDMVDHNLNDLTWWTTKHNHYATREMRDLLDIDAHTTASQNVESSLTGEQYSRKRWMKENMYSKMPLFLRALVYFSYRYFIQLGFLDGKPGLVWHFLQGFWYRFLVDAKLYEHTHRQQQAAPVAPVPQPL

SEQ ID NO: 4812 - protein, 255 aa, Unknown
  Description of Unknown: Acidobacteria bacterium sequence
MRLSVVIITRNEESNIGRTLASVTWADERIVVDSGSTDRTLEIAREQGAKVFQEPWKGYAQQKNSAIAKASGDWLLSIDADEEVSSELGESIRQVIGNGTPSIAGYFIARRNLFLGRWIRHGGFYPDRKLRLFRRGKGEFVERAVHETMRVDGATAELTGDLIHHAYPTLTGYLETMNRYSSLGAEVAVQKGQVSQSLPSFFWNIRVRPTVNFIWNYFFRAGFLDGREGFLLHLYHHGYVSWKYAKAWEAKREKR

SEQ ID NO: 4813 - protein, 364 aa, Paenibacillus odorifer
MVTISLCMIVRNEEKSLHRCLSTIASLVDEIVIVDTGSTDKTKEIALSFGAVIYDFEWIDNFSAARNFAFSKATQEYILWLDADDYIKEEDQILFKKLKEILPGHIHSVNMQYNLAFDEAGNVTASLRRNRLVRRSCNFQWIGPVHEYLEVSGPSFSSDVCITHEKDKEYTDRNLRIYQKRVALGEVFSPRDQYYYANELRDHAINEEACKYYEIFLAGGQGWIEDNFQACLKLAECRERLGDKDGAFEALCKTLQYDKPRSEFCCRLGALLLEKGQLHPAAYWYELAIQLPRDNDSMGMKNGIFYTWLPHLQLALCYDRLGQYEKANHHNETALSFYPSHPSMLYNRTYFKNLLGDKYVALQA

SEQ ID NO: 4814 - protein, 647 aa, Paenibacillus sp.
MDKLLSVCMIVKNEEAVIDRCLSSINDYADEIIIVDTGSTDLTKQIAAAYTDLIYDFEWINDFSAARNAGIRRATGQWILVVDADEYYHPAEAAKLRTFLETETPNPGLVYAVSIVSYLGTSIEKSSTMSTGEVARLFPNHQNIFYTRPIHEQLYATDGTPLHFQLAPGSLYHTGYLKDAIESKDKLNRNAGIFSDLKKNKGFSAYDYYTVGNEKAMQRDFQSAIYYYERSLKKSERNSSVSWYPRCIISLVQAYLELKRVYDAWHLIETKLIQWNQYPEYYALKGSIYYYIGLFDASREEYQLAYRSAEKLAETTEVFWLDSPDYASTFPLRVLSDIAVYENDVEKTVYYLTKLLMQNPYDYRAITQLIDTLAQTQPAESISQLLNEIGNADDRKFQLYLFKVTLALGHIDLSKYYWAMLEDVESELDIIDRLNLALLQRDEAMFGNLVASLAKDQTITHDILVSCTLGSLMWGSNYYERITISEDHALSASYNSFRCLLEGAPVDSQPDIFTLLTKCYLYHNYDLYDRFVNAYSSSEITNMLANFFYNKKNYDLALNYYSLLLRNNDLSVTSLENLSLYHLTRHYIEDGLEFILAALEKRPDLPHLITLYLRFCTNPQAKQTFIKKYGDHLSYYRKIPLLASLLK

SEQ ID NO: 4815 - protein, 372 aa, Desulfosporosinus fructosivorans
MEDNPITISLCMIVRNEETTIARCLDSVKGIPDEIIIVDTGSTDNTKEIVRLYTEQIYDFEWIDDFAAARNHAFDQATMDYILWLDADDVLLEVDSRKFLDLKGNLATLIDAVNMPYVLKRDEFGVVTYSFGRNRLVKRSKNFRWIGTVHEYMNVYGQILKSDICVTHTGTFKVSDRNLKIFEKNQDKGMPFSSRDLYYYGNELFQHQLYHRAIEVYQEFLNTGQGWDEDKISACARLTDCFQQLGDKAKELEWNLKSFEYANPRAEFCCRLGFYFLRAEQYEQAAFWYGLATKLEKPDFRGPMLEACWTWLPHLQLCVCYDRLGKQELAYKHNEIARTFRPEDPQIIHNKKYLERTFGIKSIEKEIRGNEL

SEQ ID NO: 4816 - protein, 259 aa, Unknown
  Description of Unknown: bacterium sequence
MVNLTAVIIAKNEEGRIGKCLDSLKGFAGSIVVIDNLSTDRTVELCKKYGAEVIVHEEKEYFGNQRNIGIKNAPGEWIIQMDADEIVPKETADKIIKALQSPGEFVAFNVLRKNFFLGRPLKTAGNYSYMTKIFKKGRAVYADNCFHEELNIDGPVGNIDAEIDHYPFTSISQVIDKCNYYSEIESDLFLRSKDKVSIKEIKYRLTWKSLKLFWKLYFRKKGYKDGMHGLAWCILNVIGPQVRWMKIWEKASKEGKLTD

SEQ ID NO: 4817 - protein, 1254 aa, Syntrophus sp.
MRFSICVIEPAGYKYSHFLYDLCKYLCFSIESAGHECCILRNKMTNDRTNIIVGAHNQTDPAIVDQIKKVGRYILLQTEIITGDSINNWSVQKWFAEVYLPLMRKAAAVWTGVQKNIDALKKLDVQADRILWGYHPLMEEIKHKQNKDIDFLFCGSITQHRRKLLDQLIDRGCKVVTMFDDAAMYRNDLIARSRVNLAPNQGPGMNHLGGGRVLYLVNNRSIVVVERCHDQAMYEQCFPWAETEHWVELCMETLHRPDLEHVTEEYYERFKKMPMADMIAPLLDKFLAANKSSLSSITYPGWNDPMQMDTVFDAKNVLNSQVEQKNLLKKMTSIIILTNNRLDQTKKCLKSIHKHTPEPHEVIFVDNGSTDGTVKWLQGQLKENKNYRLIENKENVGVAKGLNQGIALSKGEFILIMHNDVLVSDGWLSGMLDCMSHAPLAGIVGPMTNNISGPQQIAYGEYQSVNYLDKYAARFKEKYRYRRIPCRNLDGFCLLFKRALAEKIGLFDERFGTGQFEDEDFCLRAALKDYRNYIAGDVFIHHGGKGLAGNRNVLDKKWTLSMASPEGKKLAVLKSIESANDFYSKGEIDQAVKTLIDCIKLAPDTKEIYYELARIFIESKKFSEAWEVVGTMPDSVKNDLKGLECSGYAKEGLGLDDEAAVYADRILSQKENDPAALNLKGILAYKKDDKETAADYFRKAMNADPGYGEAYTNLGVLCWSLDKKDEALAHLRKGFVLSPSVPDINSLYYSVLASLGIFSDAEAEFREAYRLYPSNKNLAFLYIDILIQQGKFDSAMRNIEDVLDVFGLDEGTLNAALAVREKIGPLQLEKTSKKDSLSLCMIVKNEEKHLIKCLKSVRDVVDEMIVVDTGSTDKTIDIARIFGAKIFEFPWTGDFSAARNHSLDQATGDWILILDADEVISECDLNELKALTHKRNSQPTAYSIVTRNYTRNVSVIGWTPNRGQYPEEAGAGWAASAKVRLFKRRKDIRFSNPVHELLEDSLKKANIPISHCNVVVHHYGKLNMDLDSEKGKDYYLLGKMKYENDPTNVRYINELAKQAHVLGKYEEAIDLWIKLLSLIEADPQSPSYKEIRRVSYGEPISEIYIQLASAYLLLNRYEEAIKAARKTIENKVKLKEYVNIYAHCEIIAGSLSNAYAALEELLETNPDYLPALFLKAVIFRLEGKKEKAQELFQLLQQKNVRITSPLNKIARQLLAHEKKEEALLILNAAIENQINDEETGTLLEALEERQSRAS

SEQ ID NO: 4818 - protein, 310 aa, Spirosoma montaniterrae
MADVSVIILTFNEEKHIARCLNSLLPFTDKLFIVDSFSTDKTVDIARSMGAVVVQNAWVNYATQFNYGITHTPFQTTWLMRMDADEYVLPELADEINRRVADLPADVGGVYIKRRVIFLDRWMRHGSYYPIWLLRIWRRGDGFCEQVWHDEHIKLSKGSSIEFQHDLVDHNLNNLTWWTQKHNHYTILEAINLLNYQYRFDNAETVQARLFGTQEQRMRFLKERYASLPLFTRPVLYFIYRYFIRLGFLDGKAGLVWSALQALWYRFLVDAKLMEVYLRAGRDKEAIIDYFMKEYGKDLRAIRPAPVKQS

SEQ ID NO: 4819 - protein, 258 aa, Roseivirga echinicomitans
MNESNTKVSGLVITYNEEHNIARCLESLIEVCDEVIVVDSYSTDKTKSICQSFDIKFIEHPFEGHIQQKNYAVSQANNDVVLSLDADEELSSELKKSIKQALSNWNNEALSFNRFTNYCGKWIKHSGWYPDTKIRLWNKKKGAWGGVNPHDSVELENGVKVEHINGDLLHYSYYTIEEHIVRSAKYAKIAAKAFHEMGKNPSSYKMIFSPLFRFTRDYFLKLGILDGFYGLIICSTNSYTTFLKYAYLRQLNLGKKID

SEQ ID NO: 4820 - protein, 354 aa, Paenibacillus harenae
MTTLSLAMIVKNEGKVIERCLNSVKHMVDEMIVVDTGSTDSTKLIAERLGAKVFDFKWIDDFAAARNFSIACTTGNWILVLDADEYFEEDYTVQLRQFINQPLDRIGKVTIISSYLDNGQLRTAKSAASRLFPRSVSYTGIIHEQLASSFERTDTPLIFLHDGYYETDKSERNLSLLLKELASKPEDSYLLFKIGKEYHRKKDAVQAEAFYTKALSNLQNHSTYSEEPIVDYLYLLLETKQLDKALAALEVHFVRLQHVSDYYFVCGLIYLELALQQPDEALQFVEMIENSFQYCLHLGQQSATEYVIGTASYLAAYNLGLLYEMFGQTEKATAMYRLSSSSGYEPARDRLNFI

SEQ ID NO: 4821 - protein, 285 aa, Pedobacter agri
MKSPLTVIILTFNEAKKIKDCLGSVIDFASEIFVVDSGSTDQTLEIISEYSEVKVFHHAFENYSQQRNWALENLPIKTGWILNLDADQRLSNEFKVEVGNYFQKGIPENINGFLASRKTIFMGKWIKYGGHYPTFHAMMFRKGKGNCEQKLYDQHYVVSGDTLQLKGDVIDLITESLSTFTLRHDKWSTLESIQQFNLKNPTAETVSGNLNGNPMQRRRYFKNLYERMPLFVRPFLYFIIRYFFLLGFLDGKRGLIFHFLQCFWFRFLIDAKIYELRKQQKNNPY

SEQ ID NO: 4822 - protein, 280 aa, Unknown
  Description of Unknown: Acidobacteria bacterium sequence
MILSVVIITHNEEANLPRTLESVKPLVSDGKGEIIVVDSGSTDRTVEIAKSFGAKVFIEAWKGYAAQKNSAIDKAEGEYILSVDADEEVSSQLAVEVENTARWRPAIHKFAHVTPDGQLEPLYVNGFWIPRRNYFLGRWISHGGFWPDRKLRLFRRGIGRFKETLVHETLDLQQLPGPGVVATPRRLRGALIHHSYPTLSDFIEHMNRYSSLAAEMVAVRGKVRFSAINIVLRPLATFIYNYFFRLGFLDGREGMLLHLYHAVYVSWKYAKAWELANKRE

SEQ ID NO: 4823 - protein, 317 aa, Clostridium sp.
MTSFSLCMIVKNEEKVLERCLKSLAPYMDEIIIADTGSSDATKKIAQKYTDKVYDFEWTGNFSDARNFVASKATKEYIYTADADEYLDADNQKKLAQLKQILLPEIEMVQMLYCTKAEFNTVYNFEKEYRPKLYRRLRAFQWIDPIHETLRIDPIVYDSRIEVIHEPQSDHSKRDLAALLQAGLKERLSKKLHHMYAMELYHSGQDEDFVKAIPVFEQTLQQDSREMDTIKEAICVLVRAYRIKGDIPKFFGYALKDTATVSSAEVCCELGRYYESTGELQEALIWYQNASTETESILDIATSQTIPQEALKRLGAY

SEQ ID NO: 4824 - protein, 266 aa, Unknown
  Description of Unknown: Candidatus Amesbacteria bacterium GW2011_GWA1_44_24 sequence
MKKIKLSVVLAVYNEEANLARCLESVKDIAGEIVIVDGGSTDKTVEIAKRFKAKIIRTDNPPNFHINKNKAIDAAAGEWILQLDADEVVSPELSREIKSITYNLKPNHYAGYWLNRKNWFLDRFLTKGGQYPDPTLRLYRRGMGRLPAIDVHEQARVNGPTSHLKSDLLHYRDTDFARYLSGFNLYTTFIAEQLRQQEIHFNLSNVFLYLCFKPLSTFLKIYFRHRGYVDGFPGLVFALYSGLVHPVSFIKFWQKTFYPDQYSKKL

SEQ ID NO: 4825 - protein, 304 aa, Unknown
  Description of Unknown: Ignavibacteriales bacterium UTCHB2 sequence
MQSNPSITLIVLTLNEEKQIERCINSTKKICSEIFIVDSFSTDNTKSISEKLGAKVFQHQWLGNHAKQFNWGLENFPIKTEWILRLDADEYLTLELSTEITQKLSTLGKDVNGVIFKRRVHFMNRWIKHGGYYPTYLLRLWRFGSGKFEERWMDEHVKLESGKTITFENDFVDDNLNNLTWWTNKHNNYATREAIDLLNIRYKFLKSDSINAELTQQQDKRKRWLKENLYTYLPLFLRPFLYFIYRYIFRLGFLDGRPGLIWHFLQGFWYRFLVDAKIYDIQRRAKKEKKTIPEVIRENYGIEV

SEQ ID NO: 4826 - protein, 354 aa, Lysinibacillus sp.
MIVKNEEAVIGRCLESVKDLVDEINIVDTGSSDSTKQIVAQYTDRIFDFEWIHHFAAARNFSFQQATKEYILWLDADDVFLEEDQEKFRALKNSLLPSFDAVSMNYNLSFDSEGNVDALIRRNRLVRKDKNFQWIGAVHEYLEVGGKLMDSDIAVSHLPLSHDHSRNITIYKQLIESGETLSPRDTFYFANELLDHGQFEEAIYYYELFLTSKQGWVEDNIRACFKLADCYSNLSEKENNFIAVLKSFEYDVPRPEACCRLGYHFMEQYKNYEAIFWYEQALIIKQNPNAPFQNKSFSTWLPHLQLCVLFDRLQQHQLANAHNELASSFIPNDAKILHNKKYFERILNNEQVDS

SEQ ID NO: 4827 - protein, 335 aa, Clostridium sp.
MITISTCMIVKNEERVLARCLDCVKSFSDEIIIIDTGSTDRTKEIAAAYTDKLYDFEWCNDFSAARNFSFSKATMDYIYVADADEIIDADNQQRILDLKKVLLPEIEIVQMYYTNQLEFGTTYNYDKEYRPKLVRRLREFHWQDPLHETLRIDPVIYDSEIAIIHKPHENHSARDFANLQALITSGQKLSTALITMYAKELFISGSDKDFLDAEDYFLTISMDVLPEDLLAPVQCVLTKCAVIRQDARALLAPALKNLSTGDGVSEVCTCLGQYYENCTNYPEAVLWYYNAAYETTSILSLDYGHRLPLEGLIRCYESLGDTESAGHYESELNRL

SEQ ID NO: 4828 - protein, 252 aa, Veillonella rogosae
MATITAIILARNEEQHIVDCINSIQCANEILVIDDGSTDRTVELAESLGAIVIPHPLNNDWSQQRRFGISQASFDWILFIDADERVSPELNEEILKAVNSGDQKAYWLSRHSLFRHNTASHGTMRPDKVLRLMPKEGATVEGFVHEAFISPFPKDKLKGKLYHYTYDNWTQYLNKVNKYTSAAATNYYEQGKSCSFLLDIILRPQWAFFKIYILQRGFLDGKFGFILSLYHYMYTVTKYVKLYYLIKSNGKL

SEQ ID NO: 4829 - protein, 359 aa, Unknown
  Description of Unknown: Clostridiales bacterium oral taxon 876 str. F0540 sequence
MIVKNEEKNIKRCIDSALNIVDETIIVDTGSADRTLDIIRSYGSKLKLIEYKWENDFAKARNIYLDHCTGDWILVLDGDEELICDSNRFYEKLSSTKAESFNLHWLNQLDNNSEMDSFAYNRIFKNSGYKYYRAVHEQLNIDEAKIETLSDDICKIFHYGYTNENVKGKNKIDRNLNILIKEYNKNPGDPFVSYHLGATYAASGDYKNALVYFAQSYELGLAKGFGAYHFELVKRMSQCIYLLKDYWLCIDFIMDLLKQSKLEKYTDLYYIAGCSFYQLKDYKCAENFFVKCIELGERSDYPTFFGRGSFLAELMLARVYNDAGNTDMCKKFYLKVLEKKKLLNEQDFREVTEYTKNMN

SEQ ID NO: 4830 - protein, 256 aa, Unknown
  Description of Unknown: Candidatus Amesbacteria bacterium GW2011_GWA1_44_24 sequence
MLSAIVIAENEEKLIGDCLMSLSFADEIIVVDSGSTDNTITVAKSRGARVVKVRGDDFSAFRNKGLYAAEGDWILYVDADERVSPLLRREVQTAISDGSPVGAYALLRKNIYLGRHMQHGGWGNDYVIRLFNKSKLEKWQYPLHEQPVYSGKLEKLSEALIHFSHRDLSSMVDKTLLFTVYEARLRFDSGHPPMVVWRFLRVMYTEFWLRFVKLGAWRDGTEGVIDGIFQVFNMFIIYARLWEMQNIVKSDHSPQS

SEQ ID NO: 4831 - protein, 356 aa, Clostridium aceticum
MITISLCMIVKNEESVIARCLDSVKDLVDEIIIVDTGSTDKTKAIVKKYTDKVLDFKWIDDFAAARNYSYSKATKDYILWLDADDVILKEDQINFLQLKQNLNPDVDVVMMQYNADFDVYGHPTLSYFRERLSKRIKNYRWHEPVHEYLEINGKIINSDIAITHKRESTSSFDRNLSIYEKVISKGIPLSTRGLYYYARELYYHEKYDEAIIYFTKFLDTEMGWVEDNICACYHLSLCYQYKNERANRLESLLKSFKYDNPRAEICCQLGYYYMEIDDYERAILWYTLATQLKKPTDHWGFVLHDFWDFVPNLQLCVCYDKLGNQQEAIKYNNKAAEYKPEDSAVVYNRNYFESLQ

SEQ ID NO: 4832 - protein, 245 aa, Unknown
  Description of Unknown: Flavobacterium beibuense sequence
MNKLSVIIPAYNEEAYIADAIKSVREAYEIIVIDSYSTDSTKEKALALGCKVIERKFDNFSAQKNFALPYATGDWILFMDADERVTQKLWFEILDTIANPKHEGYKIKFLHFYMNRFLYHKVDRVTRLVRNKDIKFTGDVHEKLNVNGSIDELKNFMVHYTYKGFFNWLQKKDSYAWFQAGMGFKKGKKVTYFHLVFKPMYRFFHTYIIKRGFLDGIPGLALASINAYGVLSRYAKLLLLQRGLK

SEQ ID NO: 4833 - protein, 643 aa, Unknown
  Description of Unknown: Desulfitobacterium dichloroeliminans LMG P-21439 sequence
MRLSACMIAKNEEKNIARCIESYKDAVDEIIVVDTGSNDKTVEVAISMGATVYHYEWTNNFADAKNYAINHATGDWIIFLDADEYFVNNSAQNIVSLIQQLNSKYDVIACKMINIDSATGKKIEEFTQFRVFRRDKHIRYTNSVHEMLKKTAENNTLEVFLAKDRELLIYHTGYSRTNKLEKAERNLELLLAELDKDESNKSFYHYISDSYCALGDWENAIKYARLFIKSGISLMGYNTKPHENIIKAMIILKYNTEDILSEINNALEIFPDNPMFHFYLANVLMELKKYNHALLEYNLVLKLHNEYDDIEVNSIPLNLYYVHYYKGVIASHCNQHEEAFASFVESLKLENKQADCFRRLLMIIKDFPVEDIILLLNSVYKKDDKEDLHFIITTMMGVPLPQVLAYYSVLLIKEYGSDDLTAVYMLLANSQFDKTFAIAQKCLHEDPSNNTFAAIAVVSALMSEREEYLDWVEEHTSEPMKSFVKGMVRHELVVFDQKYTEEYLNLINYMYLFGTKEILDRGVRLAQYFEEKIVYAELGNFFFQHENYLVALKLYQQYRKQLVIENKQLVNQIYAEGICWYKLREYNNAAASLIKAYDLGYRKNDIYEFLRWSMDNLPRGNDLEQKYLEINEHGLKTQTGSKT

SEQ ID NO: 4834 - protein, 249 aa, Unknown
  Description of Unknown: Candidatus Woesebacteria bacterium GW2011_GWC2_47_16 sequence
MDISAVILTKNEEKNIGECVKALTFCEEIIVIDDYSADKTVEIARGLGAKVFQRNLDGNFAAQRNFGLEKATNKWVLFADADERVSQELKEEMEKEVAAPNNPLLGYFVKRDDYIFGKKLKFGETASVKLLRLARKSAGQWVRRVHEVWDVPGRTKTLKNSLEHYPHPSLREFINDINFQSGLHAEANHQEGKHSSLVKILFWPKLHFLKNYFLRLGFLDGTEGFVLALMMSFHSFLAWSKLWLDERKN

SEQ ID NO: 4835 - protein, 309 aa, Ketobacter sp.
MPIDLSVLILTYNEAKHIERCIRSLKAVSNNIFIVDSFSTDDTVKICEALGANVYQRAWKNYADQFQWGLDNCPIETEWIMRMDADEYIDKDLMDEFPKLFVTDLDEIDGFYIRRKYYFLGKWIKYGTIYPLNLLRVWRHSKGRIENRWMDEHIVLVPEAKTARLLGHIIDDNLNTSRWWTDKHNKYADREMLDILDRKYELFPQDNSLRTDDDSSQAKIKRLVKENIYNRIPIFVRPLLYFLYRYFIWLGFLDGVRGFAFHFFQGYWYRSLVDLRVFEAERLLKNTKNNREKIEILEGFTGLQLKASN

SEQ ID NO: 4836 - protein, 300 aa, Bacteroides sp.
MNTNTIAAIILTKNEEKHIERCIRSLKGICDEIFVIDSFSTDRTCEMAEALGAKVYRNPWKNYATQFNYGVYQCPIQSEWIWRIDADEYLDGNIGVAVKKALAECSQEVNGIYVRKRIDFMGRPLLHGGWYPSYHLKVFRRGHGDCENRWMDEHIRIFDGIAITVAEGNQVDDNLNDLTWWTEKHNGYATREVADMLLMEYGMDAKAEEVVPKFFGTEEQRKRWLKLKYIKAPLFVRPFINFFIRYILKGGFRDGKEGFIWHILQGFWYRMLVDAKIYELKKRFDFDKERIKAYLMENYK

SEQ ID NO: 4837 - protein, 266 aa, Unknown
  Description of Unknown: Microgenomates group bacterium GW2011_GWB1_44_8 sequence
MSKRETITAIIPAHNEEQNIERCIKSLDWCDEVTVVWMGSDKTGRIAKNLGARVVIRNQTKGSNWQKVQENINWAIDESKTDWIIRVDADEEITRKLKDEILAVLERDSDAKNPDNFVAYGIPRNQYFFGSFLKGGDWAHDRLVRLFRRPAARYENFVRIHEQFVVEGKVGYLKGKINHYSHPTLTAAMEKFNSYTSTEIYDHHELFGKALYNMFTQPLYIFLRWMIWHQGFRDGIRGIVAGAYRAWYEFMLWSKYLEKLNTKKAK

SEQ ID NO: 4838 - protein, 357 aa, Paenibacillus daejeonensis
MIVKNEEEVLEQCLSSVKEACDEIIIVDTGSEDRTKEIAQSFTDKVFDFEWIDDFSAARQYAFDQATSEYILWLDADDMLNDEDKVKLISLKQSLSSEVDAVSMLYHIAYDAAGQPSFSYRRNRLVKRSKGFKWIGPVHEYLEVSGTIIASDIAVRHKKFMKKKRQVSGSRNLDIYEKRLAKGESFSPRDLFYYANELKDNAKYHKAIMYYREFLATKKGWVEDEIRACLNMYECYRGLDNAEKSMEALVMSMNYDVPRPEVSCKIGDIYKNKGQHKKAALWYRLALEVEVNDSQGFVQRQYSTWYPHLQLVVCCWELGEQEQAMAHNQAAGEYLPESPQVKHNEAFFTEYFKSKAT

SEQ ID NO: 4839 - protein, 371 aa, Bacillus cereus
MISISLCMIVKNEEANLGRCLQSIEGIADEIIIVDTGSTDNTKEIARKFTKRVYDFQWIDDFSAARNESFRYAQKEYILWLDADDVIESSEVKLLKQLKKTLDVTIDAVSMKYHVAFSKQGQVISSTRRIRLVKRTKPFYWSGIVHEDLKCQENYSYLSSDITVVHTKQTSTDANRNVQIYERAVGRGYQLSVQDMFHYARELTIHKRYKKAIEMYEKCLDSPELSLENKTFIYHQLASCYALIGNEEKEQELTIQSFLIDIPQPVFCCRMGEQFLNKKQYEQAVFWYELAIQIKLPQRYEWSISQQIYQTWLPHKQLGLCYYQMGDYRLSYIYNKKVLTYLPDDKATLSNLNNLEQVLCERGVPIPQEDA

SEQ ID NO: 4840 - protein, 253 aa, Unknown
  Description of Unknown: Desulfobacteraceae bacterium sequence
MLSVVIAAKNESAHIEKCIRSVLFADEIIVVDDFSTDETVAIARGLNARVMARDSRGVFHENKNWGIAKAAGDWIFSLDADETVSPELARSIQAAIARPEADGYRISRRNYFLGQWIKGSGWYPEYILRLFRKGQAQWPLEIHDTPKLAQGNQAAPVLEGPLLHDSYQTFEQYFDKFNRYTTRLSAEYQEQNISMQGIHGIVNLFLRPAFWFIKKYIFKMGFRDGLFGFFVSFSSALVIFVSYLKLRQRRKIN

SEQ ID NO: 4841 - protein, 358 aa, Cellulosilyticum ruminicola
MNTTISLVMIVKNEEANLPRCLESVQGIVDEIVIVDTGSEDNTKEIAKQFGAKVYDFEWCNDFSAARNYALSKATGDWNLVLDADEYIISGTKSDLVNGLKKGTVGQILLIDVFKDKMNKEEELSYSKIYLSRIMSKGTKYIGKIHEQIDSKLPRVKVNLEVGHDGYLHKDKSERNLAILYDVIKKDEKNSYMLYQLAHTLFVAGKNEQAMMWYEKYYKVSKLNEGYRCSAIVDYLYSMIQIGKLEKGITIIEKEKANYYDSPDFNFVCATFYRELVLSNVEKYINYLPLIESYYINCLEIGETTKYTSVVGTGSYAAAYNLGVWYEVSKQFDKAKVCYEMAIEWGYEKAAERIKLLK

SEQ ID NO: 4842 - protein, 368 aa, Acetonema longum
MTESSVASQSAITISLCMIVKNEEETIERCLRSAEQIADEIVIVDTGSTDKTKELVSQFTKDIFDFEWIDDFAAARNYAFSKATQEYILWLDADDVFLAEDRQLFLQLKSSLNRDIEVVSMLYNLSVDNYGKVISQLRRNRLVKREKNFRWIGAVHEYLEVGGKKLDTDIAVTHQPQDHDSDRNLKIYERRQQKGEVFSPRDLYYFANELKDHQLYNRAIEYYQKFLATKQGWVEDNIGACSKLADCFYYLNDVENQLKYIYLSFQYDTPRADFCCRLGFYHLNHNQLKQAIFWYKLATELDITNAAWGVVNHQCATWLPHLQLCVCYSRAGEYKLANDHNELAAKFIPDDPRIHHNREYLRQMLGSQ

SEQ ID NO: 4843 - protein, 250 aa, Magnetospirillum gryphiswaldense
MKLSALVVAHNEENRLPSCLQKLAFADEVVVVCDKCTDGTRTIAETFGAVIVEGSWEIEGDRRNTGISACSGDWILEVDADEHVPPALAAEIRQVIEITKYDWHEILVDNYIGDRLVRHGWGASYGKAAYPGLFRKGAKVWGHDRVHPGLIWRGRKGAMLANRIDHHVDRNISDMIRRLDSYSTAKARDLRDQGQTWGSGMANVRRLFSRFFKCYVRRGGWREGGYGFIIALCAGLYPLLSHMKAKYEKD

SEQ ID NO: 4844 - protein, 275 aa, Unknown
  Description of Unknown: Photobacterium lutimaris sequence
MISVLIITYNESLHIERCLESVKCISDDIVIVDSYSTDNTEGLAIKNGVRFYKNSWVNHSNQINWAIDNIDFKNDFIFRIDADEYLTPELVAEIKEVFSNQVDKKINGFNIKRRTYFLGRWMKHGGYYPTVLLRIWRKGKARCEDREMDEHMVLTDGDSTFLKFDFIDHNLMGINSWIDKHNRYSEKEVIEYYKSLSGRVESYELGEAKKNRLLKNKYYKLPLFLRSFLMFIYRYLLRLGFLDGKEGLMFYVLQTFWYRFLVDSKIYEKENDVNV

SEQ ID NO: 4845 - protein, 365 aa, Desulfotomaculum sp.
MASISLCMIVRNEEKVLGRCLSCVRGFADEIIIVDTGSTDRTKEIAFSFTDKVYDFKWKDDFAAARNFAFSRGTGDYLFWLDADDVIRQEEWRKLMDLKRRLDMERPDVVMMKYAVGYDGDGAPSFFFYRERLLRRCGKAVWKGRIHEAVEPFGKVVREDIMIEHRKVGTGDPDRNLRIFEQMLREKGKLSPRDQYYYGKELYYHRRYRDAASAFSEYLELPDGWREDRVDACRHGAYCMYRIGDRDRALKFLLSGLSEGIPKPELCCDLGWWFFSARRYRDAIFWYGQAVRTGRWTGEDGFVMPECRGYVPYLQMCVCYDRLGEWKTAERYNELAERCRPGTEICQLNRKYFEKRKEQQIEWVQ

SEQ ID NO: 4846 - protein, 300 aa, Maribacter stanieri
MPPISTFILTYNEEKHIERCIKNAQRFSKIVYIVDSYSSDKTVEISESLGAKVYQNKWENNHAKQVNWALVNLPITTEWVFRLDADEYLTDELIFEINEKTHKLKANISGIVFERKMYFLDKLMTKGMIQMYMLRMFRYQKGVCEDRWMDEHIVLTEGESIMFDGYFIDHNLNPLGWWIEKHNNYSIREAVELLNLEFQLIEPSNQTVTLAMSDDAQSKRDKKEKYASMPLFWRSFIYFIYRYIFKFGFTQGKEGFLWHFLQGWWYRTLVDAKVFEIKKACGSDKVKIKKFLNQNYNIRL

SEQ ID NO: 4847 - protein, 364 aa, Bacillus pseudomycoides
MEKGNITISLCMIVKNEEKTIARCLQSVKEVVDEIIIVDTGSTDQTKEIAKEYTPYIYDFEWIDDFAAARNFSFSKATKDYILWLDADDILIETEKNKLFHLKGNLDFNVDAVSMSYYLAVDENGDPTYSSVRNRLVKRRQNFQWIGFVHEYLAVYGNIMKSDIAILHKKEKEHTDRNLQIFEKALREGKKFTPRDIVYYANECVDHQKYEKAIELYTQFLDGKEGWVEDCIHACGKLSDCFTQFQKWEEALQACFCSFQYDIPRGEICCRIGHIFMEKSDYKHAAFWYEMAINVPFQNSTRFIDYASYTWIPNLQLCVCYSRLGDNEKANYHNEQAAKYVPKHVSVLYNREYFRNVLSEDIKK

SEQ ID NO: 4848 - protein, 635 aa, Unknown
  Description of Unknown: Desulfitobacterium hafniense DP7 sequence
MIARNEEKNIGRCIASYKDVVDEIIVVDTGSTDKTVEIAEAMGAKVYSLEWHNHFAEAKNYALDRAKGDWILFLDADEYFVNNTARNIIPLLRRLPSRFNAIACRMKNIDYANGQLLDEIMHIRIFRRDKNIRYKNRVHEYLICTTKNNAIEAFYANEKELLVHHEGYSLSEQRSKARRNLEILLLQLDRATEEPTIYYYLGDCYFGLGDWQKTIEYTQLFLASGTQLVGYNVKPHQNIIDSMLRLKCNPDDILKEIYVAINKFPRHPVFHFYLANRLFDLKKYDEAYHEYEKTLQLQKNYDDVEVNSLIPFLYHIYHYMGIVASYRNDYEDALNRFTESLKLEKKQSDCLIRLIMIIKDFPVEDIILFLNSLYNKDDKEELKFLVAALTKVPLPKVLAYYSALEIKKYGSDDLTVVYMLLANRQYDKTFIIAQKCLHEEPKDTTSAAIATVSALMSDNREYLDWIEEHTSESMKRLVRALVKHEVFAFSQEDKAEYLNLITTLHLFGTKKTMNRVVHLAKYFNDNTIYAELGNVFFKYGNYELALEQYQCCINQVEVEKEDQATRLYTIGLCWYRLREYENAMTSFIEAYDLGCRENDIFEFLRWSVDKLSSGNGLKERCLEIITESKRPGNKF

SEQ ID NO: 4849 - protein, 650 aa, Paenibacillus paeoniae
MTHVEKLLSLCMIVKDEEETIDRCLSSISGLADEIIIVDTGSTDLTKEIAYKYTEHVFDFKWSNDFSAARNKSLSYATGKWILVLDADEYLNTDDCERFKKFIENEQIEQNKVYSISIISYVGESIRNANVTESTMVRLFPNNQGIHYFRPIHEQVVDANGILLSTTVSPITVYHTGYLKDTVQKKDKHNRNQAIFSELKQSSGFIPYDYFTIGNEYATKGDYKKALYSYERAFKKAAPNNPWILDCASQMFTIYMKFNRVHDAWEILHQVFSHYPDYPEYHAFKGSLYEYAGHYSLAKESLLTAFHNAEALSRKTDRFFLINPSYGSIVPLSRLLKIAKVEQNKEEIVYYCIKILQANSHDFQTLNTLITVLLLKESESAVITTINKIIINQTQRDFILLHKIFLSHGNKEIAKYYENKIENRSLISIEDLLFSSIINSSEQQFKEALLKLQPDNADNPKINLAIMIATLKWQNPFIDMLVYNENQIKAEQQLSMYQKIINNTIAQQDIVQNVTTVHTLLSTLFELKQFDLFDIYIDQLNHPLVISLLANYFYHNFETNLAVSFYNLLLEQNKMDDSGYINLAHLHINSGYSADAVPFLEEAIKLNPNGHHLFSLMLIHADNEDIRKRYRKQYTSLFAQHVKLPFIKQL

SEQ ID NO: 4850 - protein, 252 aa, Colibacter massiliensis
MSSLSVIILAKNEEKNIGDCIKSAKFADEILIIDDYSTDSTASIAKTLGARVVEHSLNNSWESQKNFAISITTGEWIFFLDADERISSNLADEISKIVQNNTYICGIIRRYNQFRHYTATHGSVRPDKVLRLCPKKGAHVVGRIHEQLEAPYEEKVLSGKLYHRTYENWEQYFRKFNQYTSLLAQQYVEQKKTIRFVSHILLRPLWAFIKIYLIQGGFRDGKIGFVLSMNHAFYTFTKYVKAYYLYRSDGEL

SEQ ID NO: 4851 - protein, 352 aa, Bacillus sp.
MIVKNEEETIARCLEAVKNLVDEIIIVDTGSTDKTKEIVSQFTDRIIDFTWINDFAAARNFAFSHATMDYIFWLDADDVVMEQDREKFLTLKKTLDPSIDSVTMHYNLAMDEKENVISSLRRNRLVKRQNDFQWHGAVHEYLEVWGNIFHSDVAVTHCSIHHDSDRNLRIYENRLSLGENFLPRDLYYFANELLDHQRIEPAIDYYKQFLATKNGWVEDYISACGKLADCYNTLGDHESELHFTLKSFEYDSPRAEFCCRLGYRFLQNNQLHQAVFWYKLATQLEKPTENFGMIKHACWTWLPHLQLCVCYSQLGNYVLANAHNEIARKHVPDHPSILHNKRFLEPILQKQQ

SEQ ID NO: 4852 - protein, 251 aa, Unknown
  Description of Unknown: Candidatus Woesebacteria bacterium GW2011_GWA1_43_12 sequence
MNPKKTNISVIILTKNEETRIETCIKSVSWADEIIVVDNGSTDKTREVVRGLGIKVIERHVSDFSSLRNAGRDVASGEWVLYVDADEVVSEQLQKEIMSVTGKQPFAGYEIRRVNYFLGHQWPGDEYILRLMRNDALVEWYGILHESARVKGTIGRLKNSLVHRTHRTLEEMVTKTNVWSGTEAKLRYDSNHPPIVWWRLVRVMVSAFFDSFIHKGGWRAGTVGWIESVYQAFSMFITYAKLWELQIKNVK

SEQ ID NO: 4853 - protein, 226 aa, Bacillus cereus
MITISLCMIVKNEEETLHRCLQSIEGIPDEIIIVDTGSTDRTKEIAKKWTPHVLDFTWRDDFSAARNASFQPATQDYILWLDADDILLPEDRQKLLLLKQSLHPQVDAVSMIYHVLFDENNNPITSTRRYRLIKRCKNVKWHGIVHEDLQLSAGFRYEESDIVVTHKKMQTASDRNLKIYEQAKKQGKTWTAHDIFHYARELQVHKRYQDALRMYERFLETDSISA

SEQ ID NO: 4854 - protein, 354 aa, Unknown
  Description of Unknown: Lachnospiraceae bacterium sequence
MSKVPISVCIIAKNEEKYIEECLRKLKPYGFEIVVADTGSTDATKEIASRYADKVVDFTWINDFSAARNFCAKQASNNWILALDCDEYIESVDIRILRVQLQQKPKQVGVIRMKNIQLRENDELGYSVDDLPRLYNRNYYRYDKPIHEQIIPIKGDLDSLDGFLMPMEVIHHGYAIKGDDMVKKQERNLEILYAGLKDEPDNPYYYFQIGCSLQVLKRYEEAAQAYEKGLSFEPSTDRTYVIEMITSLANVYSDMGRKADALALMDRYAESCNYANFVFCHANILLENDQPIKAVMNYLKATMMKDSNTLGERLLTCYERVIAIYQKTGNEDLAKPFEQKYLECRAERERIVNK

SEQ ID NO: 4855 - protein, 252 aa, Veillonella tobetsuensis
MSTITAIILARNEEQHIADCIKSIQCADEILVIDDGSTDRTVELAEGLGAKVIPHPLNNDWSQQRRFGISQASCDWILFIDSDERISPELNDEIRQAVQCREKKAYWLSRHNIFHHNSATHGSMRPDKVLRLMPTEGATVEGFVHETFISPFPQDSLKGKLFHYTYDNWTQYFNKFNKYTSAAAEKYHEQGKSCSFWKDIILRPHWAFFKIYILQKGFLDGKIGFILSLYHYMYTVTKYVKLYYLNKSNGIL

SEQ ID NO: 4856 - protein, 390 aa, Unknown
  Description of Unknown: Lachnospiraceae bacterium A4 sequence
MQTIGRHDRPILLATGHRKDYRIMAKIPVSVCMIAKNEEQYIEQCLRKLLRYNMEIIIVDTGSTDRTKEIAARYTDQLFDFAWCDDFSSARNYAVSKASNNWILILDCDEYVQEIDVAKLRTCMQKYPKNVGVMEIGNVHTVVEGGVPKERLQMDEIPRFFNRNYYEYHFRIHEQITPKKWDNYDEIVLETFHLPITVKHYGYDVPRAEMLKKQERNLKLLLNSLGETQGMDDYVYFQIGQSYYILGDYEKAIEAYDMCLEINRNPEKKFLNICLEAYAECLIKVGNGEDAYRLLDLNSAYLQTTRQRYLFGKAAHLCRDYETAVGFLTQITDAADFEQLGDDVYDAYTRIFAIFSETGQSDEFERYKEKLAEFGRQHGKQITFSGKGAQ

SEQ ID NO: 4857 - protein, 481 aa, Paenibacillus sp.
MNPRHKEISDLIKNEAYDSAESVAKLHVQKFPIDGQGWLLLGEALMKQDKGQAAQLMFNRALFLDPKAKWMPFMQRELQNVGHSEVVSEEIKQLLSVPKVTVSAAIIVKDEERSIGRCIQSILNAVDEIIVVDSGSTDRTLSTLQDYPQVKVFSLKWNDSFAELRNEALRHVSSDWVFWLDADEWLHEEDNDSIRLAAGIYNNLDIMIPVLQPCLINYVKKGHIEEYSVPRLFQTNRGIHFSGRIHEQIATEKEGIFTSNLLHKPTGIRLHHDGYRPEIKAQKDKLTRNLRLLELMTKEDPTNPGWWYFLGRETMSSEDSLRSIEYFEKAIELGRSYRQFGRIAEIYMLIGKLHTSQNRLELAEEFYQKALTVHPDYPDAHFLLANISMLKAQNLLAESLKHVREATNGFHTYRGAVAPDQDIHLWKADALRSDILVLNGHFAEGAAILQELKAKAPHADNIDRKLEFMKQQTQRIQQLFQ

SEQ ID NO: 4858 - protein, 290 aa, Runella slithyformis
MRPKTDLLKVTKQSFSDKTDKILIIDSGSTDKTVAIAEGLGAIVRHNSWVTYAAQFNFGIQNNPFQTRWLMRMDADEYVMPALAAEINDELNRLSEDTTGIYVKRRVMFMNQWIKHGGYYPIWLLRIWQRGKGMCEELWMDEHIKLFEGKTIQFKNDIVDHNLNNLTWWTQKHNLYAIREVIDLLDIKYNFANTDRVAPNLFGTQDQRKRYLKLKYASLPLFTRPFLYFFYRYFIKLGILDGKKGVIWHFLQALWYRFLVDAKLFEVYFRAGKEKQAIVTFFRNEYGKDI

SEQ ID NO: 4859 - protein, 468 aa, Unknown
  Description of Unknown: Candidatus Arthromitus sp. SFB-mouse-Yit sequence
MIIIDSIINSIDTDYFKFNLNFHKYVLHKLKTDNFPIDEKFENKLTKRIKLLSTINGTCPSILKFFINDDYINYKDDLTNENLIELINIFSDDTPIKLSVNLIVFNEERCIERSLNAVSTFADEILVLDTGSTDNTVKIIEEKFPNVKLYRDKWRKDFAYSRNLLIDKSTNDWILSIDADETPTDEFYLIKDVISIFNNFNSNEKHPLVFSPTIDSLGQKINTTKRIFNKKHEMKFDGKIHEEIVSKNESEINYIMLNLTLLHDGYHPEIFKNKNKAERNTEILEKMIKLEPNKIRWYYFLGREKNILGHDIDECIKILKSGLKLKHTQNSIENFYYNILTLLAKIAVSHKKYDLLKEVIDLMEYEIPNSLDSFYFQLILENDSVMSDKFDQINSMVKSIGDITNKVNTIDGSYSHVLHTLGIIYLSFRDYTRAFYYFNQITSPKNIEAIKSILLPLRAQIDDFLKNK

SEQ ID NO: 4860 - protein, 236 aa, Unknown
  Description of Unknown: Candidatus Fermentibacteria bacterium sequence
MKLSLVIIALNEEETIGRCIGSVPFAGEIIVVDSRSTDSTAAVAQSCGAKVLVHEFQSFSTQKQWAIEQASGDWVLTLDADEFLNDELAGEISSIVNSETVQSGFRLPFRILYMGRLMRFGPWSGERHLRLFRNGQASFPDSGVHEGLKLLEGTEGVLKNGYVIHESYSSLSDQMRKMLQYSTLWAGEEFGKGRRSGSFRIVFRPAWRFISAYLLRGGFLEGLPGLAASIISAYYV

SEQ ID NO: 4861 - protein, 305 aa, Pseudomonas oryzae
MSSVTVIILTYNEAMHLERAIRSVQLLASQIIIVDSFSKDDTVAIAERCGALVLQNPFVNQSAQFNWALENAPITGDWILRLDADEIIEPDLAVTISTQLPALPTDVVGVNLNRKHIFMDRWVRHGGRYPLLMLRLWRRGHGRVEDRWMDEHVVVKGGRTVILKGGFADHNLNDITYFTDKHNKYATREAIEVLNQRYGLFAKEKGLTTASASGQAALKRFIKEKIYNRIPFTLSALLYFLWRYIFQLGFLDGRSGLVYHFLQGYWYRFLVGAKIMEFEHALKGATSNTERVQILERLTGLKLTN

SEQ ID NO: 4862 - protein, 256 aa, Unknown
  Description of Unknown: Candidatus Nomurabacteria bacterium GW2011_GWA1_37_20 sequence
MQNLSVVLATFNEEKNLPACLDSVKNLADEIIIADGSSTDKTVAIAKKYGAKVIVVENLPNFHINKQKAIDLATKDWILQLDADERVTPELAQEIKEIKEIDNSINGYWVARKNWFLGKFLMKGGQYPDYTLRIYRKGKGHLPQVHVHEQAEVAGRVGYLRHALLHYPYKDFGSYLLKWDRYNNLLATQIKDNLRGKNFFIKIAYGVGYLIIKPTHWFLTTYVRHKGFVDLWSGFVFSFFSALRFPAAYLKYLKIL

SEQ ID NO: 4863 - protein, 361 aa, Lysinibacillus sphaericus
MVTISLCMIVKNEEDVIARCLESVKDLVDEINIVDTGSSDNTKKIVKQFTDRIFEFEWVHHFAQARNFSFQQATQDYILWLDADDVLLAEDQEKFKALKESLAPEIDAVSMNYYLSFDAEGKVNSLLRRYRLVKRDKQFQWIGAVHEYLEVSGHLYESDVAISHLPLHHDHQRNITIYRKLLQSGEALTPRDTFYYANELLDHNEIEDAIFYYELFLTSKRGWVEDNIQSCFKLADCYSTLNDKENNVSSILRSFEYDIPRPEACCRLGHHFMEQGKNQEAIFWYEQALTIKTKPNAPFLNTTFTTWLPHIQLCVLYDRLQQYELANTHNELARGYLPNDEKILHNKTYFEQLLKKMNDNA

SEQ ID NO: 4864 - protein, 784 aa, Unknown
  Description of Unknown: Candidatus Desulforudis sp. sequence
MPTRTLSLCMIAKNEADSIARCINSAKGFVDEIIVVDTGSTDNTKEIARTLGAKVIEETWNNDFSAARNISLEHATGDWILFLDCDEELDLASGPVLREAIQSITYEGYFVLVTNTTENNLQLTSPSIRLFRNRKSFRFEGRIHEQIAPAIIKQYGIRSIANINVTIIHHGYDPNTNNIKAKINRNLEILNSYPEEKRDGFFLYNLGTEYLRLGEQKLALENYLKALDLTKPGQAFGPILVKRTIATLIALNRYRVAIEQLQYYQTIYTDFNDLFYLEAFCHFKCGCFSKAKVCLERYSNMPPPPRWYPTENVYYLSSTKNLMPILETSVINKEYPGLSVCIIGRDESAQTYQCLQSVNEIAREIIFVDTGSTDRSPAIAYQMGAKLYSFPWNNNFADTRNFAVSLAGEEWVLILDADEVLPDQSRERIVDLIKDARHDGYLLRVCTFLDRNLSTTNCCFKGSCRLFRKDRYRFQGAVLEEIIPFIPGSGAGLTAADISIHHLHYLAPDTHIARKREWKLETIREGMAHDPRQRDYALGVECFSRQDFQSAASYFASSLGDTEWAGVPDFFYYFGMSLINTGNPARTLTVLERATIRYPDYTDLFYLQAIAHFMRGNIEVSEQLFKRCLEMGDAPWEKYLATPGTGQYKAKCSLGTIYAQKGDVNRALEIFLEAVGTPSAFEQAIESIVFIRDKLSVPIERFLEQNGLLNTPSVSTVSRCLAKMGRYEESLKYLALAGDLIKSETPPRNYAVITESIDLLLTRYLWHAVQPLPEDSPLRKLSLN

SEQ ID NO: 4865 - protein, 275 aa, Rhodopseudomonas sp.
MSPTKPTLAVVAIARNEIRDIAAFMANVDPVADEVIIVDDGSTDGTLEYLQGCGSKVRVLQRRLESAGGFAAQRNAGSALATADWLLHMDIDERIPPRLAAEIATTLSSTKFDGFRYRRLNFFLHRPFRAGGWQNWNNVQLGRRGRHRFVGAIHEQVEVDGGAAAIGQLAAEMWHLNDESFVERIGKNVNYAQPTAREIARRGPVRWWHLLFIPMWRAVKAWTWGGAWRYGEHGLIFALYVFAGTFNGYAVAWDDQNRIARDELEKRILDEGNGT

SEQ ID NO: 4866 - protein, 247 aa, Unknown
  Description of Unknown: Candidatus Roizmanbacteria bacterium CG_4_10_14_0_2_um_filter _39_13 sequence
MISTVILTKNEEKSLAKCIESVSFSQEIIIIDNGSQDKTISIAQKYATRIIEMSEKFNFSELRNRGLMEAKNNWVLFIDADERVSDELKSEILTISKNRKYAGYYIKRRDHWWGRTLRFGEVRHAYSLGFIRIIQKEAGIWSGVVHEVFQTNKEVGLLRGYIEHYPHPTLKEFISDINDYSSRRASELYNQDISISIVEVLCVPPLKFLYTFFIQWGFVDGPPGFVYSFLMSFHSFLVRSKLYMMKS

SEQ ID NO: 4867 - protein, 373 aa, Bacillus anthracis
MISISLCMIVKNEEVYLEKCLESVKGIPDEIIIVDTGSTDRTKEIALKWTSHVLDFEWDDDFAAARNFAFQQATQEYIFWLDADDILLLEDRKKILKLKQSLDQSIDAVSMVYHTLLDKHNNVITSTNRLRLLKRKKHFKWVGMVHEDVKTAEVYRCYHSDIVVTHTKKTGLSNRNLRIYEKAVKDVKKFTPQDLFHYARELQANKRYEEAIKYHKLFLEDENIGTELRIFTYHNLACCYFQIGNPEKEFELTVESFKYDIPQPVFCCRMGEHFIKQNLFQQAIFWYSLAIENGKLNQNNHIEQLIYQTWLPHKQLGMCYYKVGEYMRSYEHNKEVLKYIPDDNETLNNVRVLKEMLYGQGGILLENDELNIN

SEQ ID NO: 4868 - protein, 361 aa, Alkaliphilus metalliredigens
MITISLCMIVKNEEKVITRCLESIKDIVDEIIIVDTGSTDHTKAVVQRYTNKVFNFKWIDNFSIARNYAYSKATMDYILWLDADDVVLETDRMMLRQLKQDLDPSIDVVMMKYNVGFDEQGHTTLSYFRERLTKRANNYQWHEPVHEYLAIDGKIINSDICITHQKEYNSSPDRNLSIYEKVLSREGPLSTRGHYYYARELYYHERYDDAIIYFNRFLDSETGWIEDKICACYHLSLCYQYKNQKENMLQTLLRSFSYDEPRAEICCLLGSTAMEDANYHKAILWHQLATQVQKPQHTWGFMLHDYWGYIPNLQLCLCFYKLGKIKEAIYYNNKAAEYKPEDSAVVQNKRYFSSLTKRDIN

SEQ ID NO: 4869 - protein, 359 aa, Unknown
  Description of Unknown: Candidatus Dorea massiliensis sequence
MKTLSLVMITKNEELKIRRCLESVKDFVNEIIVVDTGSTDKTKDIALEFGAKIFDYEWNNNFSDARNLAIKQSTGDWNLILDSDEFITNLNIDKINNFINSKENTIGKIKVINLFKEDNEIKKSNAFISRLAPKGIYFEGSIHEQLDVSLPREVVDIEIEHDGYLNTNKFDRNIYLILNELKSNSSDSYLLYQAAKTYYSNNMYMNALPYFDKFYNTVNFDKDNFFNDGIILYIYNLIKVNQFEKGLEIIDNVFDLMNNSCDFYFACGVFFTELVSYNPENYMNYFNNIELCYLNALHLGEHAKFEIVDGTGTYLAAFNLGLFYELLGDSTKALKYYEISYSFNYSKALVTINRIKEKK

SEQ ID NO: 4870 - protein, 462 aa, Bacillus cereus
MGTNDYTFLKYNIAFFMFSLERIKHNNLISNKLLIDIEKRIALLTKICKYTHGLDNLVNNLDWNTKQYLNTLDEAVFITLLTENLKIPEVTISVNIITFNEERCIERCIKSIRGFADEIIVIDTGSTDKTINIIKTLFPEVRLYHEPWCEDFSLHRNSLIKYSTGDWIFQIDADELLQGDQADLKDFLRVFHNFPLPSLIVSPKIINHDNSELNFTKRIFRKKDNLQYFGLIHEELRCDIQQKGSDLIHVITNFVIEHDGYMMDIIQEKNKVTRNIFLQEKMIQIEPNNIRWFYFLAREKRTAKYSIQEVIEILNEGIKNSEIPEKEDPFLFMVLLLLAECYYEKSDLEELNNVTSKLVLLYPDHIDSMYYKLLNKIVQNSSNVSFFMEKYLEGLKTIQCMESNIDVQRCEIYRLMGSTYMQIGCYEQAFKLFNSIKNESLVNDLKSDFIFLKKYLDDFLEK

SEQ ID NO: 4871 - protein, 296 aa, Unknown
  Description of Unknown: Acidobacteria bacterium sequence
MFPFRCSARYPLPVTLSVVIITYNEEANIGRALESVMPLLSGGKGEIIVVDSGSTDRTVEIAKSFGAKVYVEEWKGYAGQKNSAIDKATGEYILSLDADEEVNSELADEIESTVRRRPAMHKVAQKTPDGHLAPLYVNGFWISRSNYFLRRWIKHGGFWPDRKLRLFRRGAARFKDALVHETLELQQSLGAGITATPRHLRGALIHHSYPTLSDYIDHMNRYSSLGAEMVAAKGKVGFSVHNIVLRPMATFIYNYFFRLGFLDGREGLLLHLHHAVYVYWKYAKAWELSRLSGEKS

SEQ ID NO: 4872 - protein, 362 aa, Dehalobacter sp.
MVTISLCMIVKNEEKTLGRCLESVGDIPDEMIIVDTGSTDQTKMIAARYQAKVYDFAWIDDFAAARNFSFAQATQDYILWLDADDVLLEDDGNKLRQLKETLNPQVDIVMMRYNLGVDDKGNAVCTFFRERLLKRSMNYTWQDPIHEYIKIEGNIINSDICVTHKKIERKTARNLEIFEKIISEGRILSDRNCFYYARELYINSRIDEAIQYYDKFLDTEGGLLSNYIDASIDMSNCYLSKNDRGNALKALLRSMEHDLPRAEVCCQIGHLYKTAEDYPKAIFWYELATTIKKPEESWGSVVHDCYGYIPCMELCACYFKSGNLAEAIRYNKKAGEYKPDDKLVLHNQKYFETLLGSVVSKN

SEQ ID NO: 4873 - protein, 305 aa, Providencia alcalifaciens
MNNDLSVIILTFNEELHISRCIESLKEITKNIYIIDSYSTDKTVEIAKNLNVTVYQNKWPGNHAAQFQWALDNCNIETEWVMKMDADEYVTNELKNEIKTYMHSVPSDISGIYIKRRVFFMGKWIKHGGYYPTWLLRIWRYSDGHMEQRWMDEHIKLSKGNVIHFNHDIVDDNLNNLTWWTEKHNNYATREAIDTLNAIYKFSESDGIEPKLLGTQEQRKRYLKLKYHKLPIFIRPFLYFIYRYIIKLGFIDGKKGLIWHLLQGFWYRLLVDCKIYDIKRRAKKLDAETLKLIIKKDYGVDWKND

SEQ ID NO: 4874 - protein, 492 aa, Paenibacillus sonchi
MDPRHKLLSDLILSEQYEEAEQSGKKHVREFPIDPQGWLLLGEALMKQGHGQAAQKLFNRSVLLDPKATWMSFMQKELQKVPLGEVSDELKQLLSVPEVTVSAAIIVKDEERSIERCIQSILNAVDEIIVVDSGSTDQTLSILRKFPQVKVYQMKWNDSFAELRNEALSHVHSQWVFWLDADEWLDEEDRGLIRLTAGIFSRLKGLIPALQPCIVNYVKDGTLREFSVPRLFPTDKGIYFSGRIHEQIATAEEGIFTTRVLHKPVGIRLHHDGYEPQIKAGKDKANRNLKLLEQMTEEEPTNPGWWYFLGRETMDSEGSKRSLECFEKVIEYGKDNRHFGRMAEVYMLMGKIHNSQSRLDQAEEYYRKALALHPDYPDAHFYLASIATLKAQKLLSTAMKHVQLAATGFHTYRGPVVPDQDIRHWKADALKSDIFVQNGQIAEGAALLRSLKLKAPNKKVISEKIKYIEKQKQQLLLQNLRLSNFERRDIGE

SEQ ID NO: 4875 - protein, 569 aa, Desulfosporosinus sp.
MEERPITISLCMIVRNEESNIANCLESVKGIPDEIVIVDTGSTDNTKEIVRQYTDQIYDFEWIDDFSAARNFAFAQARMDYILWLDADDILSEVDCQKFLNLKSNLTPFIDAVNMPYNLSFDEFGVVTYSFRRNRLVKRSSNFRWVGAVHEYIDVSGNILKSDICVTHTGTAEISERNLRIFEKCQAKDMVFTPRDLYYYGNELFEHQLYNRAVEVYQKFLNTGQGWVEDRLSACARLTDCFQQLGDRDKELEYNLKSFEFAAPRAEFCCRLGFYFLSAEKYEQAAFWYSLATKLEKSDIWGPVIQSCWTWLPHLQLCVCYDRLGKYELAYEHNEMARTFRPEDSQILHNKNYLEQTYGLGSAERKVSNHESAFESSKRGWSMNHLQIALKDQLPGLNWHEDFIVHLASLYRPKVYVELGLFQCALFNRVIPFAEQLIGVDITPEAGNYMQHSPKTHFMNAATQEFVKELQANPIKIDMLFIDANHSKEAVLQDFRDFFPYVAPHGLILLHDTHPSDEAMMQPNWSGTACQAVEILAQDTKDYELMTIPIGPGLTICRKRQVQLSWQEE

SEQ ID NO: 4876 - protein, 273 aa, Leptospira kemamanensis
MDGKRKRKLSVAIITFNEEKNIGDCIRSVESFADEIIVLDSLSTDKTKSIATSFPKVRFFEAPFPGHVEQKNKAISFCQNDWILSLDADERANDELQKSIQSFLEAETVSADGYKIARLTFHLGRWIRFSGWYPQRRYRLFQKENAEWVGENPHDYIALKEGSRGKVMKGDILHYSFTDFSHQINTINQFSSIVAYTRYAKGERFSLLKTILKPLGKFFEIYIFKFGFLDGIPGLWIALASSFSTFLKYAKMYELDKLNIERPSNVRKDYGKK

SEQ ID NO: 4877 - protein, 349 aa, Paenibacillus paeoniae
MIVRNEEDSLGRCLSSVKDAVDEIVIVDTGSTDKTKEIAASFGAVIYDFEWIDNFAAARNYSFEQATQTFILWLDADDVLEPEDLTRLKALKEKQELPYDSVTMNYNLTFDHNGNPVFSLKRNRLVRRSRDFRWIGPVHEYLAVSGYTYHSDIAVTHRKERHHTDRNLRIYLKRLEGGEEFSPRDQYYFANELRDHARLQEAADWYEKFLVSGLGWVEDDIGACMKQADCYGRLGQADRQIASLLRTLNYDLPRAEFCCQLGSVFLEQKRYQQAIHWFTQATKLEKPKDLMGSTDNATWTWLPHLQLTVCYDRLGERDKAIEHHRIAQGYNPKHPSVVYNEKFFSGSKG

SEQ ID NO: 4878 - protein, 234 aa, Unknown
  Description of Unknown: Candidatus Collierbacteria bacterium GW2011_GWC2_45_40 sequence
MKKSKRQTISVTLASYNNEDCIADCLNSVKGWVDEIIVVDGHSTDKTAEIARKLGAKVLLRENNPVFHIQKDIANREAKSDWILQLDADERITPVMQKEIIGILDGDYFGYDSWLSPLKSTINKFLPFFPEPYRLTKPAAAYWLPRKNFFLNRYLKNAGQYPDPVIRLFQRGKAELPAKDVHEQMIVKGSVGWLRSDLDHFATPNFSRYLLRENRYSSLQAENQFFQHPKLFIL

SEQ ID NO: 4879 - protein, 275 aa, Unknown
  Description of Unknown: Candidatus Pacebacteria bacterium CG_4_9_14_3_um_filter_40 _12 sequence
MSTLKKPSVTAVIIARNEEKMIAACIETLRWCDEILVINNGSTDSTNKIAETAGAKVILFTSSSFARVREEAIKHVETDWILYIDADERVTPTLAKELLVTIETGTASALTLQRKNYFFGHAFAHGGWQHDQVTRAFKRSALTGWSGDIHESAEWNGEELRIVSPLIHLTHRSVVDNLKKSAEWTPKEATAFIEAKTAPVFFKTILRKGVMEFWRRAIRDQGYKDGTAGLIESLVQAINRMWIYIQIWEFQQKPSIPERYAHLEEEISKKWKNDS

SEQ ID NO: 4880 - protein, 253 aa, Fluviicola sp.
MNHKLSATIITFNEERNINRCIESLLPIADEIIVLDSFSTDKTEEICTKNGVRFEKREWKGYSNAKNYLNSLANHDYIFSIDADEAPDKKLQESILKVKKQGFEGAYAVNRLTNYCGKWVKHSGWYPDVKTRIFPKKTSKWEGKFVHEKLIIDGSPPSHLLEGHLLHYSYYNYTEHRERADKYSKLTAQKLYAKGKRATAVKPFISGLGRFISMYFIKKGFLDGRAGWKIATISAKSNIYKYKELRRLQHEAN

SEQ ID NO: 4881 - protein, 303 aa, Bacteroides sp.
MSNSIAAIILTKNEEKHIGRCIHSLEGVCDEIFVIDSFSTDKTCEIAEELGAKVYRHPFENQAKQFNWAINVCSISSDWIWRVDADEYVEETLAKKVIEKIDALPDDINGIYVNKKIVFMGRPLLHGGWYPAQQIKIIRKGFGASEDKWMDEHLIVFSGDTISINGDQTDDNLNDLSWWTQKHNGYSDREAINMLLMEYGLDNQEKEVQPKFLGTGAERKRWLKLKYIKAPLFVRPFINFFIRYILKGGFRDGKEGFIWHILQGFWYRMLVDAKIYELKKRFDFDKERIKTYLIENYKQCANK

SEQ ID NO: 4882 - protein, 633 aa, Unknown
  Description of Unknown: Paenibacillus sequence
MSKPSISLCMIVKNEERFLARCLKSVQGLVEEIIIVDTGSTDNTKEIAECFGAKIYTFEWVNDFSKARNEAIKYAQSDYVLVLDADEYLESADQILLLLESLEKDIYFLSIKSFLRGGISTIHPVIRLFRNVPELKFFGRIHEQIIIPADSLFTQDHLEVMINHDGYMKDVITEKNKEQRNLKILLEDLEEQETGFGLFNLGIQYKMMGQYEQAIKTFEKAFPLSMEYSYICKLITSLIQCYMELEQFDKALVICHESIEAYPNYTDLYYLQGQIYESLHYINDASESFNHCLKIGDVRNHELMTFHGVGSYMALTSLAGISLRKGDMTQAIQKVTDSLGINKHYMPSIKLLLDITKNTSFKDAFEFISKTWEISSLDDLKEMIGVLYKLRHPLLYGFCELYNHNVDKSILAAGYLYSKRYNEAASIWYEIEQIVDVDELEDVMLCSILTKDKVLIQKYKHKFSLREKDYKLIIRCLEREELNNNHWAKDLEQLLVRFFEKLIQLHEFDTIDYFVSQMTSYNLQFSFAKILANYGFNDIAINIMDLQLPNVDRDALVWIADQLAAVGNYNESMRFYEFANEQESTFNVLESMYQICIKNNDSYKLFNLIQAMKNSTPKSKWANKLEHYNFLSR

SEQ ID NO: 4883 - protein, 294 aa, Ochrovirga pacifica
MNTPTITAIILTYNEEIHIKRCIDSLKKDVDTIIVVDSFSKDKTVAIAEENGALIYQNPFVNQAIQFNWALDHCEIKSEWILRIDADEYLESQKSIKSFLSKLASETDGILIKRKIVFLEKELLHGGWFPKFNLRIFRNGNGRCEERWMDEHIIVMGNVVESDIVLVDKNLNSLKWWIDKHNKYAEREVADFFWEQTKKESVSPKFWGTEAERKRFLKLAYINFPLFLRPIMNFLYRYIIRMGFLDGTSGFVWHVLQGFWYRFLVDAKIYELKLKYQGNQDKIKEHIKKEFQIK

SEQ ID NO: 4884 - protein, 656 aa, Paenibacillus riograndensis
MTQLSVCMIVKDEEALLSRCLESVKGIADEIIIVDTGSTDRTKQIAENFGAKIYDYVWSNDFAAARNESLRHAAGKWILVLDADEYLGSNDHSKWIEFLQKEKPQAQLAYTLPVINFTGEKDYQEEMTTAPVTRLFPNFKGIHFERPIHEQLTRGGKEKLLHKKISLEIYHTGYQIQRVTEKSKHERNMSIFNEMKKANKLSAYDWFTLGNQYRFGKEDEEALQCYERAAKGATAKEAWYSHCLMGLISLYFKNGRLDSSWRWTEKELYKYKDFSEYHTIKGVHFETLGFFDDAIASYLQAINTAEQRAKRNQEIWLVDPMYSFETPVQQLVDIYFRLNDNQQAIYWLSKLLNKNNRNPKVLLKLVEWLCQNEEPAAIIGFLDKIYDVRNEAECNLLFKISLVLGQAELVNYYEKYLTTLDNINILDQFRYVILTDKKEEWMSLPIPEVNNDVDWKLQIWVQMVVGALKWNSLQRLHEITRILDHDDITQLTSIVEKLFFENSSVEEGLLKHYSSSLFLVSKQLFLIKEFEKFDQFIQLCKSPGIINQLANYFYTLNLTDMAMNYYSILLSQKELDFNSLVNLGLYHANQGYYSDAVEFLNEAIDKQPKAKHLYYLLIQHAAREQKQYFIDKFNLQFPEYGGISFVHNFFNNAKKA

SEQ ID NO: 4885 - protein, 482 aa, Paenibacillus sp.
MDSEGGSVVKQPAISLCMIVKNEAVALPRCLRSVAGVADEIVVVDTGSTDETVQIAKNFGAKVVTAAWNGDFSAARNAGLDRARGTWILFLDADEELDAGDKEQLRICTNHTEYEAFFLQVHNHSGETAESFAATVNPIVRMFRNRPSYRFRGRIHEQIAASIMEQRPQAHFHMTTVKIHHYGYSGSVMTGKNKIRRNVELLEKELSEHPGDPFTHYNVAVEHMRMANWSSALAHLRESMSLAGPDTSYRHLLHKYESRCLLEMARYEDALEALDRGIARFPDYTDLYHMKGAVLNAAERKPEAKEQFLLALSKGRPPVHYNTDAGTGTYLSAFALAQICEELGEDNAAIHWYGEAFRHNPNWAAPLLKLIRICKVARQEDRLAVLLKERFLPDSEAAAVKVVRALTEENCHTAAAALLEVYPGAGRAAAADETSEEEQAYRQIRTLLGLADTHLSYLDRELPYSDVYRRVRRRLPFPMLDR

SEQ ID NO: 4886 - protein, 268 aa, Unknown
  Description of Unknown: Candidatus Kaiserbacteria bacterium CG10_big_fil_rev_8_21_14_0 _10_59_10 sequence
MNPDSIPATALILTRNSAATLRRALDSVEDFDDILICDGGSTDDTCAIAREFGARTIEQERTCLNEDGSIRNFACVRNAALKEALYPWVLSIDSDESASEGLVAEIRVFLAGNPPPGVCRTPARIILDGTPIFRSSNYPGYQVRFFHRDAGRYKKPLHERFTPHSNVPIRTLTSPWQYYIESRTYNADYGKDLPHHLAIYVEGYKNAPARKRMRGTYRALRAMLGIAIRAIYNNIVHPGPNTYPLSYEWVRIRYQWEIIKAIWRTLSK

SEQ ID NO: 4887 - protein, 308 aa, Unknown
  Description of Unknown: Proteobacteria bacterium TMED72 sequence
MATHQASIAVIILTFNEEDHVGPAIESVQGWAREIFVVDSFSTDETVNAALEYADHGVRVVQHAFENYSSQWNWALTNLPISADWTLKLDADERVPDDFKAEVLDVLQDADPELAGFYFQRRMIFMNKALRFGGNVSYDLRMWKTGSAQFDGRQINEHAMVDGATHSLKCLVDHHDTKSITEWWEKHNRYSSLEALSMIDEAQFDVIKPRFLGSPDERMKWLRRMYWGHPFRFLSALGLFLYHYVLKLGFLDGTRGFQVAFLRATYFYLTDLKLIEYRRTGKRPTIHWPTRGRPHPTLAKSLDGETDS

SEQ ID NO: 4888 - protein, 645 aa, Unknown
  Description of Unknown: Bacillus sequence
MRPFISACIIVKNEEEMLRNCLESIRSGVDEIIIVDTGSTDSTKKIAREFTKKVYDYEWENDFSAARNFAAAKASGDWIVAIDADECVDVENLKGAVKEIEEQKDQYNMYLVEITSFSGSLGESTTVNQMLRIYKNDGSICFKRAIHEQLQTVEGKPRINLSSLKLYHYGYLTNVVEKQDKKNRNVKIIQKDLKNENNKAFSFFNYGQELRRLKETEEALNNFVKAYSSKENVNEGWVRICLFYIVESLVILKRYEEALKIICDVEELWPMVPDFVFWRGEIYFAQKRFEDAKEVYLQILSQTHVYKEVVYHLDRKSFLPNERLGQIYELEKKYNEAIKHYIEAFNENPFSVRIIVKIIWILSKHYSSQEVYDFIVKQNMIRTDNIRIEVLKYVLNNGLTDLVDLFVSDMAGEDESLKASIKLKVRMITSNSMNDILKIGDIQSGIQKGLFDWVDLCILYEMTHDAYIKELFKGSDVVDIFDFVFGESEQTGGIKQKEYLDLLDRGILYNKVDFVEKLIALKHLTNHDVDAKIADILYKNQYEDIALEFYQLANENDITEQGYVNIIEWLINNENNEEAYRITLEAVEKFGEDFRFYHYLVELNMGNISMVKVKLPSIFSNSNWLNKKITQSNNINSQNGEIIVY

SEQ ID NO: 4889 - protein, 311 aa, Fibrella aestuarina
MNGLSVIILTHNEEKHIGRCLDSLRPLTTDIFIVDSFSTDRTVEIARSMGATVVQNPWTTYAVQFNYGITHTPFKGTWLMRMDADEYVLPELADEINQRLSTLPTDVSGVYVKRRVMFMDRWIRHGGYYPIWLLRLWRQGQGICEQTWMDEHIRLTDGPNKEPAKTIQFAHDLVDHNLNDLTWWTNKHNHYATREVIDLLNIRYNFDQTVRVTPKLFGTQEQRKRYLKEKYASLPLFTRPIAYFLFRYIGQLGFLDGRKGFVWHFLQGLWYRFLVDAKLMDVYNRAGRDKADLIDYFKREHGKDLTAGIRG

SEQ ID NO: 4890 - protein, 303 aa, Unknown
  Description of Unknown: Candidatus Gottesmanbacteria bacterium GW2011_GWA2_47_9 sequence
MKISVVISARNEESKLGRCLASVAWADEVVVIDNSSTDGTARIAREFGAKVFRRPNNLMLNVNKNFGFEKASGDWIFSLDADEEVTKDLAKEIQERVMSKEQSDSSGYWIPRKNIIFGKWITHGLWWPDKQLRIFRRSKGRFPCVHVHEYLEVDGSTKELTEPYVHYNYETISQFIRKMDTIYSESEVQKLIRTNYQWTWHDAIRFPVSDFVKVFFAQEGYKDGLHGLMLAMLQAFYSFVVFAKLWEQSKFEQKELTVGGIDGELQRNHREIRYWVLSEQIKETRSIIEKIRLKLLRRYGKSH

SEQ ID NO: 4891 - protein, 254 aa, Unknown
  Description of Unknown: Acidobacteria bacterium sequence
MLSVLIRAKNEEESIGRAIRSVKGLANEIVVVDSGSTDRTVEIAKSLGAKVFFKEWEGYPNQLNYGIGLCSGDWVLVLDADEEVSHELAESIRHTIKAPKHKVYMVSRRTYYLGRFLKYAWYPEWRVRLFERGRVRFEGEIHERAIFEGPVGKIKGDLYHYSYRNLMDQYEKTLMYAHKMASLKHKGGEKFRLYKLVFNPLWSFFKVYFVQLGFLDGVRGFLVAVSAFIYTFLKYKFLLELELAKDDKRCNTCI

SEQ ID NO: 4892 - protein, 305 aa, Flectobacillus major
MQQDISVIILTFNEEKHIARCIKSLLAFTDKIFIVDSGSTDKTVEIATGLGAVVQYNPWVNYAQQFNFGIENNPFKTKWLMRMDSDEYVLPELANEINTKLFVLATEITGVYVKRRVMFFDKWIKRGAYYPIWLLRLWQNGKGICEETWMDEHIKLTEGKHHNFDHDIVDHNLNNLTWWTQKHNLYAIREVIDLLNMKYDFREFESVEPNLFGSQEQRTRYLKMKYASLPLFTRPILYFIYRYFVRLGFLDGVQGLMWHFLQGFWYRFLVDAKIYEVYHRVGKDKKAIIDFFRTEYGKELNNLRK

SEQ ID NO: 4893 - protein, 273 aa, Leptospira levettii
MDGKRKRKLSVAIITFNEEKNIGDCIRSVLTFADEIIVLDSFSTDKTKEIATSFPSVRFYEAPFPGHVEQKNKAISYCNNNWILSLDADERANETLQKSILRFLEAEEIHCEGFKIARLTFHLGKWIRYSGWYPQRRYRLFRKESAGWVGENPHDFIELNTGSRGKVMKGDILHYSFTDFSHQINTINQFSSIVAYTRYAKGESFSLLKTILKPLGKFIEIYLFKFGFLDGIPGLWIALASSFSTFLKYAKLYELDKLKLERPSNVRKDYGKK

SEQ ID NO: 4894 - protein, 372 aa, Desulfosporosinus orientis
MVSKKITVSLCIIVKNEEKTISRCLDSVKDICDEIIIVDTGSSDQTKEIVKKYPVKILDFAWIDDFAAARNFAFSQATMDYILWLDADDVLRIEDQEKILKLMKNLDPYVDAVSMLYHYAFDQHGNVSFSFRRNRLVKRDKNFRWVGAVHEYLEVSGNILNSDICVTHKRMQGHSSDRNLKIFERRREKGESFSPRDLYYYGNELFDHRLYSRAVEVYQEFLQTGQGWVEDEISACGKLADCFKELGETEKQLEYCYKSFNYASPRAEFCCRLGFYFLNAKQYEQGAFWYKLAARLEKPIGNSGFMIEACWTWLPHLQLCVCYDRLGKHELAYEHNEIAREYSPENAQVLYNKKYFEEVLGIGTKKQEIGQV

SEQ ID NO: 4895 - protein, 252 aa, Unknown
  Description of Unknown: Candidatus Cloacimonetes bacterium sequence
MKNSLSVVIITKNEENNIKRCLQSVKWADEIVVVDTGSTDRTLEICEKYGCHIIETEWLGFGKTKQLGVNCAANDWILSIDADEEVTSELTEEIRQLLSKDNLKNGYRIKRTSFYLKKWIRYSGWNRDYPLRLFNRKYGNFNENFVHESVRIRGKIGKIDKVLRHYTYPNLTTYIQKIEHYANLRAEEAVKKGKRASVFNAIFHGLFKFLKMYLLNTGFLDGTVGLVLSINSAFSVYLKYLKIWERIENVKK

SEQ ID NO: 4896 - protein, 349 aa, Bacillus psychrosaccharolyticus
MIVKNEEQSLPKCLESVKDVVDEIIIIDTGSTDRTKELAKTFTDKIYDFEWINDFGAARNYSFSKATKDFILWLDADDVFTDENREKLRTLKKTLSLDIDAVSMLYHLTFNEDGSPSFSSRRNRLVKRENNFKWIGFVHEYLEVAGNIIPSDIAVVHQKERHASNRNLLIYEKALESGQPFSPRDKYYYANECNDNRKYEKAIYWYQYFLEEGLGWSEDNIQACGKLADCYLNLKRYPEAMDICQKSFLYDAPRGEICCRLGFLYLEQNDLVKAISWYKLATVVEIPEKSPFINRSCYTWLPNLQLCLCYSRLGHQEIARSYNEKAAEFLPNNSQIQYNQEFFKRYFGE

SEQ ID NO: 4897 - protein, 365 aa, Lachnoclostridium edouardi
MITISLCMIVKNEEGVLERCLESAKEFADEIIIVDTGSDDKTIEIAGKYTEKVYRFQWRDDFSAARNYSFSRAEMDYCMWLDADDVVTEENKRKLLELKKSMNPSVDVVMAKYAVSEDKKGNPLFSYYRERLVKNKKGFLWKGKVHEAIAPSGNVIYSDITIHHRKIGQGDTDRNLRIYEGMIAAGEFMDERSWFYYGRELFYHGKYEKAVQIFEKFLEGNGWVENKIEACLNMAECFKNMGEGEKELKALFQSFLFAPPRGEVCFAAGRYFQEQERWEEAIFWFESALRVKAPSEAGGFIRWDCYGYLPEINLCVCYDKLGDREKAYEYHLKSKARKPEAKEVEWNEKYFNREKRTNQTCSAHI

SEQ ID NO: 4898 - protein, 288 aa, Unknown
  Description of Unknown: Clostridiales sequence
MTDITVIILTKNEEKNIGDCIESINSFAKRIVLIDSGSEDKTIEIAQKYSVDIFSHPFENYAKQFNWGIDNTNITTKWILRLDADERFTPLLCKEIEKLTKDHMNDNVNGITLEAEFYFLGKKIKYGGSKKRKLMVFKTGIGRIENRKMDEHTILSKGCTISAKNRFIHYDFRNINYFINKLNWYATREMQDYFEISCQNSAEVNYDEKIAKTRKRKFEFYYKLPMFFRSWLLFIYFYIFKLGFLDGKEGFIYHYMYQRWYRCLVDAKIYEHLKTNASFEKTGDLKSY

SEQ ID NO: 4899 - protein, 350 aa, Bacillus sp.
MIVKNEEAVLSRCLSSVSTIVDEIIIIDTGSTDKTKEIAKKFTNLIYDFTWINDFSAARNFAFSKATKDYIMWLDADDIVNEENAKKLLKLKKTLTKNVDAVGMKYHLAFDENGNPSFSSVRNRIVKRERKFKWVGFVHEYLEVYGEIIQSDAAIIHHKDKEYSDRNLKIYENAIASGKDLSPRDKYYYANECVDHQLYEKAIEWYELFLSEGKGWYEDNIQACGKMADSYLFIEELEKAINSCLRSFSYDGPRGENCCRLGFMYLQQNDFTRAITWYKLATLVDVPTTSPFINQACYTWLPNLQLCLCYSRLGDQETAKKHNDIAATYVPNNPSVLHNQEYFRTYFKNK

SEQ ID NO: 4900 - protein, 784 aa, Ammonifex sp.
MSAPTLSLCLIAWNEADNIGRCLKSAEAFVDEIVVVDTGSTDCTREIAKAMGAKVIQVKWQNDFSAARNVSLENATGDWILFLDCDEELDAESRHELRKAIEHGSYEAYFAMVRNTTDTNIELTFPSIRLFRNRKSFRFTGKIHEQIVNSIVANYGLQAIGHSSITIIHHGYNASTTNVAAKVQRNLEILKSYPEEKKDGFYFYNLGTEYLRLGDKKEALTSYLKALKLTKPTQAYGPILVKRTMTTLMDLHRYRDAVEQLRYYQTIFKEFSDLLLLEAVCHLNCGRYSEARARLEDYLKMPVPPAWYATENIFQGSSAEDLVERVKALALDRGCQGISVCIIGRDEEELVAYCIKSVNEIAAEVIFVDTGSTDRTPAIAYQLGASVYRFPWNDSFSEARNFAIDKAKGDWILVLDADEVLPDESRQAIVDLIRDPDHEGYFLKVRTFLDRGLSPASCYVTGACRLFRNDAYRYRGSVFGDIISPIIDAGGSTAYTEITVNHIHCFANDEYIARKRQLKIDAIKKQLRSDLTKLNFALGIEYFQAQDFISAIDHFESVRASLDEAHMAKFYYFYTLSLMKTEHYRRLAEVLDEAISMFPDYTDLIYLQAVVRFVLGETEEAKLLLHRCLEMGDAPWEKYIASPGTGGFKAMCSLGTIYSQKGDTEKALNIFLEAAGIPGAFEQAVESIVFLKEKLPVPLERFLEVRGLLNSRSLSLAAKSLAKMGRYKDSLNYLALAGERAASEPPPRDFANITQAINMLLSRFSREVLDSLPKDSKLKNRLTV

SEQ ID NO: 4901 - protein, 353 aa, Desulfosporosinus acidiphilus
MITISLCMIVKNEERLIKRCLECVKDFVDEIIIVDTGSTDRTKEIAGDYTSRIYDFEWIDDFAAARNFCFSKATMDYIYNADADEVIDKENIEKFFFLKNTLNPDVDIVEMQYTNQLEKGSTYNFDTENRPKLFKRLRTFRWIDPIHEVINCSNNVITSDIKIIHKPEDSHSQRDLSIFIKCTGNGQVLNSRLHMMYARELFICGNDEDFYKAFAYFNMSLMSDSLKPEDKRLSCCVLARYYHLKSDVHNFFKVITKTLNGIVSSELCCELGSYYMTLEDYEEALYWYYLASSSASADLNIDYMNFIPNVQMCQCFIKLGNLTEALQHNTLAGFYKPNHPAVLANMQNLNKLS

SEQ ID NO: 4902 - protein, 274 aa, Leptospira perdikensis
MEGKRKRKLSVAIITFNEEKNIGDCIRSVLAVADEIIVLDSLSTDRTKEIATSFSKVKFYESPFPGHVEQKNKAIGFCSNDWILSLDADERANQTLIQSIELFLESESVYADGFKIARLTYHLGRWIRYSGWYPLRRFRLFQKNAATWVGENPHDYIELKPGSHGKVMKGDILHYSFTDFSHQITTINQFSSIVAYTRYAKGERFSLTKTIFKPFGKFIEIYIFKFGFLDGIPGLWIAIASSFSTFLKFAKLYELDRKQIERPSNIRKDYGKNE

SEQ ID NO: 4903 - protein, 254 aa, Sulfurihydrogenibium sp.
MKLTVLILTKNEEKNIERAIKSVLDIAEEIVVLDSGSTDRTVEIAKNLGAKVFFREFDTYSDQRNYGLSICNGDWILVLDADEEVSEKLRENIKRELENPKFDCYEVPRRTYYLGRFLKYAWYPEYRKRLFRKGKVRYEGKLHEKVICDGKVGRLEGDLYHYSFKNLYHQFIKNIEYARIMAEIMHSEGKKFKLYKLIINPFVIFFKLYFLKLGFLEGTRGLIIAFSGFLYVFLKYAFLYELKLKEKYKDKLWL

SEQ ID NO: 4904 - protein, 584 aa, Desulfotomaculum profundi
MNNTVTLAMIVKNEAGNLGDCLESVKDQVDEIVIVDTGSTDNTLEIAGRYTDKIYTYPWQGDFSAARNYAIARSGGQWILYLDADERLFCEPGQLKKTVIKDDQIEAYLLPLDYPINESTGEYNRFLVLRLFKNTKDYYFAGRIHEQVIIHKNEAVGFTQDIIIKHQAVSPKERNRKRGRNLTALKEACAAEPQNFFLQYYLGIEWLGLGKPAQALPFLESAYRNITDNHLHFRMPALRYLLTCLNALEKFDDTICLGQEAALRYPQYTDIYYLTGIALEEKAEYKLAVKWFEEAVKCGVPPVLYTHMQGAGSFLAYYHMGYCCQNMGRPDVAQTCYEQALHVNKSYYYPATSLFLLMLTHHGPRFTFDYFNEKGYLNHTPIALSIAELFFSYGYPGLAKKCLEGSEVSRHMTEEILFHLGRYRIYSENFQEGLICLDRIPGDSQFSNMAVTHRSVALLLTGCLKECRNLALTMWKNKQLRPTSRVLLGLCRFMQQGGMAIQGMQGNEEELVQCSLHLLDLCYHYLPDRPGDACKNLERLISHLETLLITSPKGIQKLEQFYQDKMNAVRELFDYKFQTGGVGV

SEQ ID NO: 4905 - protein, 270 aa, Unknown
  Description of Unknown: Acidobacteria bacterium sequence
MPEQNPSRSARETLSVAMVACNEEANVARTLSSVINLADEIIFVDSGSTDRTLEIASSFGPKVKIFHEPWKGFPRQKNSAIDKATGDWILLLDADESLTPELQAEIAAILSGQAETPRPAPVAYRIARRNYQFGRWIRHGGHYPDPKRRLMRKGAGRVEDCPVNEELQIPGLVGDLHSDLIHHAHSSIADYIEHANRYSSLGAEMKAPRGFSLLNIVLNPFFTFIYNYFFRLGFLDGAEGLLLHLYHSTYVSLKYAKAWELTRNSKKLEN

SEQ ID NO: 4906 - protein, 428 aa, Unknown
  Description of Unknown: Chloroflexi bacterium sequence
MAKRKHRRQKPGGGVDAPPVPEGTLQFSADSAPESWPSVSLCMIVRNEEANLADCIRSAGDFAAEVIVVDTGSTDRTVEIAKSLGARVKHFEWVDDFAAARNESMKDAQGDWIFYLDADDRLSPEEVTRLKNVVASGLADAYRCRVVSHVADAGQSLNIVYHTRLFRNHRNVWFSGAVHENITAAILRQGMTVAQTNVTIQHVGYAGGPEVLRQKARRNGQILQRAIGRHPDDLKLRYYLGVSLYQLADYRAAIGQFEAVIAHPPPTLNRDSQLYKAYLLLISAYTHVPAPEKARRTLQRALELFPERRHLWITAGMFYLSQDEPEAAISALEHATQLSPQSDAEGESWPPGVLQDRLRAAYQRQGMKAIQQENYPQAVWSFSRFVGLAAPPQQAEGFKLLALALQKCGRQDEAIASWQAAQELESAG

SEQ ID NO: 4907 - protein, 958 aa, Unknown
  Description of Unknown: candidate division KSB1 bacterium sequence
MKSNLPSISLCMIVKNEEKFLAQCLESVKDVVDEMIIVDTGSTDKTVEIAESFGAKVFHHPWQNSFSEARNYGLQFATCDWILQLDADEELRGDDIPAVKSAVQNREIDAVYVALMNKTPVGWTKHYSPRLFKRGRAKFVGDVHNQLVYPGKDIKTEIVIYHYGYNLSKEEMDKKFKRTEKLLRKQMSRDNTNPFNYMNLMRVLKSQHKYQEVVSLGKKSFVAAGRRMTDPIRQMIEYDMICSLIELGKFSEAEKRAKNILKKFPDNLDITYSLGHSLILQKRYKEALDVYKKFLEIHEKEKKTPGFSYLIIDTYTLDHKVWAIIADCEYELENYESGIRAAKKAIELSPDTAEYKIALARNLIKAGRKEECRILLDRMERENNVDEETYLKYFALCVKYPELGSSADVLQRAVRKYPDSDKLKSYLHSKTPAGKKKNEPTISLCMIVKNEEEFLEQCLKSVQDVVDEMIIVDTGSTDRTVEIAESFGAKVFHHEWQGSFSEARNYGLQFATCDWIFQLDADEELEREDIHLVKKAVNQDKFDAVYVALLNDSVNGWSKHYFQRLFRRGKARYEGIVHNQLICEGESAWSEIRIYHYGYNLSEEKMKKKYQRTESLLLKQIEQEKDNAFSHQNYVRILAAQKRYEDVLKAAENAFGLCKETMNQNNRQMISFDYSVALLNLDLLDRAENVCNEILEEFPENLDITYALANVKLKKGEYKEAVSLFNKFLKILEKKRKQPKYEGLIIETYSYDHRAWACLSDAYTFLSQFDDALKSAENALKINPDNYEYHVIYAKALVNMGQQEKALNYLKEIDKNKKPSVAFYSKWSSLSETLPLGEKQEILEAGLKKHPDSVELNSLYAHLFESSDPEKAETIWNRVLSFDTENCNAMLHLAFLFLQEKQNNKFHDIKEKFINKCTRPVYFKKLGALCIKAQDYGTAIEVLGKYLEFFPEDAETLA

SEQ ID NO: 4908 - protein, 303 aa, Unknown
  Description of Unknown: Candidatus Gottesmanbacteria bacterium GW2011_GWA1_44_24b sequence
MKHTLSVVISAYNEEKKLGTCLSSVAHLADEIIVIDNSSTDQTAKIAKSLKAAVYKRENNLMLNINKNYGFEKATGDWILNLDADEEVTEELKDEIQRILELEVSQAKKGYWIPRKNIIFGKWIQHGFWWPDKKLRLFQNRSGKFMCKHIHENIEVDGEMGELTHPYIHHNYDSVSQYLTKLERCTTSESIALREAQYQLSWFDAIRFPLSDFMKTYFAESGYKNGLHGLVLSLFQAFYSFVVFTKLWEMEQFPQESMGLPIVLHEFKRAGKEFSYWMITSRIKESPGILDKLILKIRRRLSL

SEQ ID NO: 4909 - protein, 304 aa, Alteromonas sp.
MISVIILTYNEELHIRRCIESLLPITKNIFVIDSFSNDKTVSICNELGAVVYQNPWKNYATQFQWALDNCPIQTEWVMRMDADEYIENDLQNELKSGLFISEIREEIQGIYIRRKYFFLGKWIKRGAVYPLNLLRIWRFGKGRIENRWMDEHIVLEDGGMTCQLNGHIVDDNLNNNRWWTEKHNKYADREMIDILDKKYNFFPLDESLLNDQKTNQAKIKRYFKEKIYNKLPIFVRPLLYFLYRYFLRLGFLDGKRGFAFHYMQGYWYRSMVDLRVFEAEQLLLSCQTNDERLAVLKELTGLEL

SEQ ID NO: 4910 - protein, 625 aa, Paenibacillus bovis
MRFTVSLCMIVKNEEEVIGKCLESIHKQINEIIIVDTGSSDRTIPIAESYGATIHSYKWNDDFASARNYSLQQAKSDYILILDADEYFEGEYDLQKELATAKDFYIFPIHNLLDNERYFIHSAIRLFKNSPELRYKNRLHEHLDLEGKEKQMQWSKVSVSIQHTGYQSNTIIEKDKNNRNLNLMMQETKEHPNSYNFYNLGKAYMAIEQYEESAEYFAKAITDSDNQTHQADLLKKWGESLLQLNRSNEALKILYDAVQKYPAHTDLLYVLAEAYYDEKYLKDAASTWIKCTELGNKGDFISEGVSDYLAYAQLAELYKQEDNLAEAYKYILKAITSKRSHMPALKKYFEIAYIYAFAEDDIKKDLDISYKITRVEELQNLLDVLYTMRHYLFSGYLKSYNISPEKNVLAISYQYSKQYDLAKNSWYEVEHIPEENTIDILTLAFLLKDEKLVKSLQNVGEIGPSDIRILLQLLHNESIQMEELSSSLETLIFQLVNNLIYMKEFEAFQTVLQLLMGKDFEVKYQIGSMLNGHGYYEAAIDILVQAYHLDSENIQMIGLLGDICLRAGYFDDAEYFYTNLIERSPVYASYERYYRLYERKKDESRMQEIKQFIAAHYPMATWSQE

SEQ ID NO: 4911 - protein, 253 aa, Geovibrio sp.
MSSNLPLSVSIISFNEEDNIGRTLESVMGFAHEIIVVDSHSTDKTVEIAEAFGAKVYDEDWKGHVKQKNSAIEKCTQEWILSLDCDEVVTPELENSIRETVASGEKDGYIMNRRTFYAGKMLAHSWQPDNKLRLVKRSANPRWGGYDPHDVLEIEGTKGKLNGDLIHYSYRDINDHFQRLLKYAKTAAMSYHKNGRRFSMFRLIFNPPAAFIKKYIIRGGFLDGFHGLLVAVSSFIYVFLKYVFLWEIERNEG

SEQ ID NO: 4912 - protein, 296 aa, Unknown
  Description of Unknown: Candidatus Jorgensenbacteria bacterium GW2011_GWA2_45_13 sequence
MNKNLTVIVLTYNEELHLARCLTSVKTLASEIVVVDSFSTDKTQEIARTFGAKVTTHEFKNQADQFNWALDNVSLAGEWILRLDADEYLLPELAEEIKARIGNVGSSKDHGSFDDQNIVGFYLRRRVIFMGRWIRHGGYYPTLILRLFRNGKGRSEVREMDEHIVVSEGQTQTFENDFVDENLRSLHWWTAKHNDFSTREARERIKEEEEHMEIQEDPLGSQTERKRWWKMAVYMNLPLFWRAFGYFFYRYFLRLGFLDGKEGLIFHFLQGGWHQFLIDAKIYEQEKGQSYKAEEE

SEQ ID NO: 4913 - protein, 331 aa, Clostridium chromiireducens
MDITLCMIVKNEEKYIKDCLDSAFKLVNSAVIIDTGSTDKTKEIIKEFGEKVKLMEYAWNNDFAKARNESLKYADGEWILVLDADEILNIDKDNVINTINTTIAEAFNIPLTNVLSERNKQNSYVYMRLFKNKGYKYYRPVHEQINISIDKSENLNRKDIEIIHYGYMQKCIDEKNKIERNLDILFNELSKEPEDSFINYHIASTYSANMDYSKALQFYVKSYECGLKYGFGKYYYILVKKMCQCIYVLGDYNLCIQFTNNLLLDSRLKEFVDLYFLIAECYFKLKKYGKAIEYAKKCLEIGERDDYPTLNGRGSFLVEVLLSDIHKEMNK

SEQ ID NO: 4914 - protein, 315 aa, Spirosoma rigui
MSDVSVIILTHNEEKHIARCLQSLHLFTREIFIVDSFSTDRTVDIARSMGAVVVQNPWVNYATQFNYGIAHTPFQSTWLMRMDADEYVLPELATEINSRISTLSTDVAGVYVKRRVMFFDHWIRHGGYYPIWLLRLWRRGQGICEETWMDEHIKISMPGNAPLKTIQFQHDLVDHNLNNLTWWTQKHNNYAIREVIDLLNIKYDFDDTQRVEPRLFGSQEQRKRYLKIQYASLPLFTRPFLYFLYRYFIRMGFLDGRRGLMWHFLQGGWYRFLVDAKVFEVYYHAGRDKQAIVNYFRSEYGKDLSPKQPRPLGQS

SEQ ID NO: 4915 - protein, 383 aa, Paenibacillus sp.
MGGISVKRQCTVSLCMIVKDEEATIERCLESARDAVDEIIIVDTGSTDRTKELCLPFADRVLDYEWQDSFAEARNYGLRYATGDWIIWLDADEVLESGSPLRLGDRLEGLREAIILVEVVNYYGTAPADGNFAYTLAHHRIFRNHSGFLFRHAIHEQLNVGEVMAEGTTLTMLPVRVHHYGYMDDAPGAQFKSERNIALLLQEKAKQDACLNPWLEYHLASEHYRKGRYATALQLLNEGIVGFIQSGMPPPSLVYKLKYATLLAMGEVRSMWPAIDKAIEIYPDYVDLHFYKGLVLFNLGQTKEALQAFEHSVQLGDACSMHLTMKGAGSFFAWFYAGQCYEKLGDRTNAAHAYEHALALNKDLKEARDRLDALDEERSGGAA

SEQ ID NO: 4916 - protein, 362 aa, Falsibacillus pallidus
MMTLSLCMIVRDEEKVLGRCLDSIGNLVDEINIIDTGSTDGTKELASRYTDRIYDFKWIDDFSAARNFSFSKATKDFILWLDADDVLPEGEQEKFSALKIFLREDIDAVSMPYILARNEEGMVTQSVRRNRIVKKSNGFRWFGSVHEYMEVGGNVISSDIHIVHNSQKTGVSTRNLDIYEKMLGEGRSFTPRDLYYYANECLDHKLYERAIEYYQKFLDTREGWVEDCISSCAKMADCYLALEDPENAIDQILNSFKYDIPRADQCCRMGFIYLSKDQLDKAVFWYELAASLDYEAAKAKGGFLNHNCYTWLPHLQLCVCYFRLGQIEKSKHHNQMAKAYEPTNRMVLYNEEYFQSLTEQEE

SEQ ID NO: 4917 - protein, 365 aa, Lachnoclostridium sp.
MASISLCMIVRDEEDVLGRCLESAGELVDEIIIVDTGSKDKTKEKALQYTDKIYDYSWQDDFSAARNFSLAKGTKDFLMWLDADDVISADDAGKFKRLKEKMESDTDMVMMPYITAFDESGKAVFSYYRERIFRNRRGFAFRGRVHEAVTPAGKIVYWDAAVEHRKVHPGNSTRNLRIYENMERSGEYFDSRSLYYYGRELIGHKKYEKAIRILEEFLGREDAWVENRIDATRRLADAWYAKDNDKNALKALLKALEYDVPRGETCCCLGRHFQERGQYEQAVYWYTQALAAKKNMMSGAFIEEDCYGFLPAISLCVCHDRMGDLEQAEYYNEMAGKFRPDSPYYLQNREYFRGVKDKQNQNTHI

SEQ ID NO: 4918 - protein, 363 aa, Bacillus sp.
MIEISLCMIVKDEEIVLERCLKSVANVVDEIIILDTGSTDKTKEIAGRFTDKIYEFEWVNHFAKARNKAFSYATKPFILWLDADDVFKADDVQKLQELKRNITPRTDAVSMDYHLGFDGSGGVTSSIRRFRLVKAENQFKWHGAVHEYLEVFGNLEHSDIAVTHLSLDNGHDLTRNLEIYEEMKRNNETFSPRDLLYYANELTDHSKFEEAINHYIQFIKQKKVGIEDVIRACNKLADCYSNLGIVEKARDWSFRALEYGKPKPETCCRIGHIFFEKQLFPEAAYWYEQAVTNKETNGYFRNIACETWIPHLQLAVCYDKMGLTEKGNEQNELASTYLPNDERVAYNRTYFTERLALLERIID

SEQ ID NO: 4919 - protein, 269 aa, Unknown
  Description of Unknown: Candidatus Omnitrophica bacterium CG11_big_fil_rev_8_21_14_0_20 _63_9 sequence
MDTPAILSAPAAPGRIKRPKLSVVILTRNEEPRIARCLESVRWADDIVVVDGLSTDRTVEICRQFGARVIPHAFSGSFAEERNLGMRHATAEWVLQIDADDVVTPAFRTAVEVLLQGASQHAAYKFRRKSYLMGRFMRYGGWYHYLPNLVRREDVRYVGDVHERPVVEGTIGVLDADIEHYPCEDLAAFISRHNRYTSLQARELSQQPFGRLALIQRLVHRPWKTFWKCYVKKQGYREGAHGVLFAYLYAWFELLKWAKCLELRVTKIS

SEQ ID NO: 4920 - protein, 359 aa, Paenibacillus baekrokdamisoli
MVTVSLCMIVKNEEKTIGGCLSSIAKAVDEIVIVDTGSTDQTKAIVSTFTDKVYPYKWIDDFAAARNFAFRQATKDYILWLDADDILKEEDCNKFMELKKELDPSVDSVTMVYNYAFDEYGNPTSRFRRNRLVKRENDFKWIGAIHEYLDVKGNIVNSDISVTHCRIHRKSDRNLKIFQNRLMRGETFTPRDLYYYANELLDHQKYNKAITYFDKFLATGKGWVEDEISSCGKLADCYNKIGNTEKELESVFRSFRYDSPRAEFCCRLGFHFLNLNRYESAIFWYKLGAGLKPPEDDWGFSNPTCSTWLPHLQLCVCYDRLGNHEAAYEHNELARSYRPNDSSILQNKKYLDALLQKDQ

SEQ ID NO: 4921 - protein, 375 aa, Paenibacillus sp.
MLLSLCMIVKNEQDVLERCLESVKSAVDEIIVIDTGSTDRTKAIALSYQAQVYEYAWSNDFSAARNEGVKRAAGKWILVMDADEYFAAGDADKLRRFLETAEPSPHLIYSINVINFVGKSKEQAAITSGEIPRLFPNGYGIEYYRPIHEQLRSQSGELLSSLAPVSLFHTGYLEEMVNSKAKLDRNAGIFKELKNKQGFSAYDYYTLGNECAVGKDFQKAVYYYERAIKKQSKLINSSWFPHCVISLIHSYLVQNRMFDAWKLTEEKLSAWKDYPEYAFYKATILHHLGFMEEAEMTYVQTIETAASKSKESQVFWLESAEFASTIPMRKLSSIYEWQKKMVRGRSLFNQASHAGLIRLQRSESPAQNHDKIRYH

SEQ ID NO: 4922 - protein, 370 aa, Desulfosporosinus hippei
MSDSSITISLCMIVRNEEATIGRCLDSVKGIPDEIVIIDTGSIDLTKKIVQKYTDKIDDFTWVDDFAAARNFAFSKATMDYILWLDADDIFVDSDRDKFLKLKESFNTSFDVVNMPYLLAFDQSGLATFSLRRNRLVKRNKNFRWIGAVHEYLEVYGSILNSDICVTHKGIGGHDSDRNLKIYEKRKAKREAFSPRDLYYYANELFDHQLHERAIESYKDFLNTNQGWVEDNISACGKLADCYQKLEKPDKQLEYILKSFQYAPPRAEFCCRLGFYFLTGEQYEQGAFWYKLATQLEKPISSWGPINEACWTWLPHLQLCVCYDRLGKYELAYEHNEIARKYRPDNTQILYNRKYLEGVFIKNGIKNSNG

SEQ ID NO: 4923 - protein, 360 aa, Clostridioides mangenotii
MIDISLCMIVKDEEDVIGRCLDSVKDIVDEIIIVDTGSTDKTKEIVEKYTDKVYDFKWIEDFAAARNFSSSKASKSYIMWLDADDVILQKDKVGLLKLKKSLSSTIDMVMMKYNVAFDADGKPIHSYFRERIFKRKNNYRWVGEIHEVIVPSGNIIHSEVAITHKKEGHKDPKRNIRIFEKMIKDGKKLGPREQFYYSRELYYNDRYEEAIKGFEDFLDSGEGWIEDCISACKDMSTCYYLIKEDKKALYSLFRSFEFDEPRAEICCDVAKHLFDRAQYKQSIYWYKVALSKDINEIKQGFKFNDCYDFIPSIQLSVCYDRLGDVEKAIFYHEKSKKLKPNNEAVLYNENYYNSLKNKKK

SEQ ID NO: 4924 - protein, 254 aa, Unknown
  Description of Unknown: Cytophagales bacterium CG12_big_fil_rev_8_21_14_0_65_40_12 sequence
MREPVKISGVVITHNEEKNIGRCLNSLIGICDEILVVDSYSTDRTKEICLKLGVRFIQNAWNGFLAQKNFAQDKAEFDYVLQLDADEVLSPALEKSILGVKANWQFDGYYFNRFTNYCGKWINHSGWYPDAKLRLYDRRKGKWEGLDPHPSVHLIGAAQHIKGDLLHYSYTSYEDHINRSANYALQAAKAMHQLGKKPSNFKLVFSPAFKFVQTYLLKQGFRDGFEGLIICKTSAYYTFLKYMYLKLITKGKTV

SEQ ID NO: 4925 - protein, 382 aa, Paenibacillus alvei
MQSPTLSICLIARNEEDVIARCLQSIRSIADEIIVVDTGSTDRTIDICREYGARVLTHEWQDHFAMARNFGLEQATGDWIMWLDADEELAKEDRDEVKALLPTLDKDIYSIHLINFIGDSINENDTYHISHTRLFRNNKGFKFQFSIHEILNIKDVLPNQDESQIETLPIKLYHYGYLNDVTHAKNKNERNIALLHKARAANEPNSWLEYHLASEYSRMKQYDQAFHYINLAIIRFLSEGLAPPSLVYKLKYSILIETGSIEGAWPAIDKALILYPDYVDLHLYKGVILYQLGKFEQALESFHNCIQLGDEQLNHLTLRGSGSFHAYYYKGQCYEQLNNLHEAVNAYRAALQFNPAYEPANHALHTLLAAHPEWSEHHSAIT

SEQ ID NO: 4926 - protein, 359 aa, Geobacillus jurassicus
MIVKNEEDVLARCLDSVQHLVDEIIIVDTGSTDRTKEIAGRYATRVIDFPWNDDFSAARNFSFSHATMDYIFWLDADDVLLKEDQEKFLTLKHTLPSDIDSVTMIYSLASDEHGAPISSVRRNRLVKRSNHFKWHGMVHEYLEVWGTILNSDITVIHKPVYHHSDRNLNIYEKQLAQGKEFSPRDLFYFANELFDHQQYERAIQYYEQFLQTKKGWVEDCIAACGKLADCFYALGDEEQALRYVYQSFEYDSPRAEFCCRLGYYFLQRKQYRLAAFWYHLATQLTMPSDSWGFFHHACWTWLPHLQLCVCYFYLGEYELAYKHNEKAREYAPDHPDVLHNQCLLESILSAKSTFHSTDE

SEQ ID NO: 4927 - protein, 1994 aa, Syntrophus sp.
MDWNEFDPGIQALQSGVLRDLNEELHEMTDHNDIHHPAAVAAGLSGGNPVTYDAARLNGRPVEPCADASAADEGVRISGVSTEASSKSADARKARGTSFLIGRKPAIRVLAAGSKYASGSARRGYDYVWWNLFDALNRFENIEAHFYDCAAEARRSGIEAMCGQLGNIVLKEKPDILFYGGSSDGFAEFVRSCLKRITGSTDTQTVLWMNDQEERQGGGLALSEACADLIVTLSPDSAQRYAAAGFGRKIMMSQWGFNPFTYALPFSPRSRGISFCGTAKGDRSEIIRKMRQHGLAVGTFGPDWQEDLTLPLADMVRIFRQSRINLNLNDIGDFAARQIKKRTFEVPGCRGFLLTIPAGHLDAYYEPGREVAVASSLEELIDKCRYYLVHDKEREEIARRGYERTLAEHTWSHRLKDMFECLGFAAIPGESAPAGTRNPYPGVSDFPGGEEAASPGCSDPRGCTEESVTPEEREIETSIIVLAFNKLEYTRQCVESILHYTNGSYELLLVDNGSADGTFEYFERVKDFHPDTRVIRHFQNRVVEEIGIHVFSLARGKYIACVANDAIVHEGWLENFIRQMESAPDIAMVGPRSNNVSGPQMMPTEYDTVEAFHAFADEWCRRHKGSNFVIHRVVGVANILKKSVLERIGGFDPDLPTNGREGGYGFSDDDFSLRLTLAGYRMLVANDVFIHHFGSVTTRQDRPDLFGAPQNVNKEKYRRKLQQNDRVSVGADGVIKVRPYRLDEEIPVDERTAIRTPRVCFVEKGRGGKKSRAEYGYAALARKYNGDIIPGRGETISALILKALEKNEFDFLVLIDSRLAPSPEILSALTEYALCYPDVAVMVPTGNYGALTHAHKPDSAPEVERIPYADLSLCVINLNVVRPLRMALARCENEEEWPWFFQRRIRGESYFIAKANSLEVNGDWTRYAHPYDALRLPEQLLDEKKYAEAGAIYRDDLSRDPDFAEACYQLASIAVKQRRLEEAIDHARRALQADPHHIPSLVLLSGIFLEQGDFQNAADTVSQANFKQPGNPEVKKIVSRYEEQFKRHPEAFQENPDGAATFPTRRETVKGSVSIVIVTRNRLDFTKKCVNSIRRHTRRPYEIVFVDNDSKDSTMKWLKRQVKENKDCRLIENRENVGLIKGRNQGINAAQGEYIVLLDQDALVSRGWLDSMLQCLNRCSAAGIVGPMTNRGGGIQQVLDDSYRSVDFLDKYAAKFMERYRHRRIPCRCVAGFCLLFKRSVVEKIGLFDETFESGHFEDEDYCLRAALADYRNYIAGDVFVHRLEGGKSHGDRQILNKKWELGPASPEGKKLAVLKATELAGDLYQKGKMGQAVDTLINCIKLIPDSKEVYFELVRLFMESGQFSEAWDVVGTMPEAVKNDLKGLQYAGYTQEGLGLDGEAAGYAERILLQNGSCPEALNLKGVLAYKSGAKEEAVDYFREAVEVDPGYGEASTNLGVLLWGIDEKEEGLACLRRGFMLSPTVPDSSSLYYSAISSLGLFRNAEAEFREAVSLYPQNKNLAFLYIDILLQLGKLKEALLKIEDALALFGIDEGVLNAAMAVRDKIGPSKIENPSKKSTLSLCMIVKNEEKHLAACLRSVRDIVDEMIVVDTGSTDRTMEIARVFGAKVFEVPWTGDFSAARNASLAQATGDWIFVLDADEVLSPRDFKELRTLIETPSSSPAAYLITTRNYVEKFGIIGWTANDGQYPEEMGAGWIPSAKVRLFKRRSNIRFSNPVHELVEYSLHQAKIPILRSSIVVHHYGKLDTEREGMKSREYYLLGRMKYERDPKNMKYVYELAKQAQLLKKYDEAARLWLELLDLLRENPESAGYKTIAAISCGDPLPEIYIQLASAYIMLDRCDEALELARKAMKESRIKLPAYVNVYAYCEMIAGSLNAASSALEELLRDMPDYPPALSLMAVIHCLEDKEEQARELSRQLRLKGIPLSATLKHISEKLSSYGKKDEAELILKWMAGASGSYCKNSHGLEAAQINGS

SEQ ID NO: 4928 - protein, 643 aa, Paenibacillus pinisoli
MSKLISLCMIVKNEDDVLDRCLNSVKDIMDEIIIVDTGSTDSTKDIAYRYTDKVFDYEWVDDFAAARNQSIQHATGKWIFVMDADEYMEAHDAKLLRDFLSKETPSEDRVYSVSILSFLGQERSYSVNEGLVIRAFPNHCHLQYARPIHEQIVSTKKLELKSINMPCRVFHSGYTQETISNKNKHERNLSIFNKMKNQSRLSAYDNLMLGNQQVMMGNYEEGLEYLQLALSKKRELGTAYKQVLFTMMNVYMNTNNLIEAWNFMDEHLVDYEKNYPDILALRGIIYYHLGFTQDAKKTLLTCVENAELLAAQNKPISISSPDLGVRLPLKYLALICEQEKELSSSVYFLTKYLRVFNDGDALTRMVRILALKDNAKQISGFLDHLLSHMKDELRAPLLCKISISLGLRDLADHYYQQLSATEVLSLADRLRYALLMNQEEDFKQIWFTGLPSEQEDPASLNHLALAALVWNKPEWIQWSNNTKEETSYMQAIEGLLLGNSSGMIKNEGYLFTLLGGLYTTNYLDMFDKILDQVESPAVINSLANMLYTIHHDDAALQCYSYLDANNALEYSSCCNLASHHTNLKNTGQALRYLELAIKQDPSQKQLFIQFCLLSNDPAEKRIKKEQLIRLDSNYKNLPPFIAL

SEQ ID NO: 4929 - protein, 304 aa, Vibrio sp.
MLDCSMSSSISAIILTYNEELHIERCINSLINSVDNIYILDSFSTDRTLEIASKFSNVKIKQNRFINHAIQFNYALDAFDIDTDWVMRIDADEYVDRDLSSFLLNSLDGLPADVTGVTVNRFMTFMGKLLEHGGMSDYWMLRIWRNGLGRCEQRWMDEHIILSNGSTIQATGRLVDDNLNTLSWWAHKHVDYSTREAIDVLTNATSGNSDVVDSKLFGTSAERGRFLKGVYNKVPKFTRPFVYFTYRYIIRMGFRDGKQGFLWHILQGFWYRMMVDAKVFEIQSAVNTNSDLKQVIKNKYDYEI

SEQ ID NO: 4930 - protein, 378 aa, Clostridium frigidicarnis
MSITISLCMIVKNEEETLERCLESAQSFVDEIIIVDTGSTDSTKEIAKKFNAVVYDFKWIDDFSAARNFAFSKATKEYIFWLDADDYITNENIKKIEELKVTFDNNVDAVSMNYSLSRDAKGNTTYSLKRNRLVKKSKDFKWIGCIHEYLEVFGNIIHPDISINHGKMKPHGNRNLEIFRAMEKKNIEFSVRDNFYYANELYYNGLFKEAIIQYENFLDTGKGWVEDKKTATANLIQCYNLTNKKEKCMEIILKSFEFDIPRADICCRLAEQFMEKQQYNQAIFWYKVAMGCIHEKDNLGIDHKDYYTWIPSIQLCVCYSIIGDYDAAYYYNEMTAIYVPNSPKVEYNRNFLNGKFKELGKVQPDLDCKLIDRRHRFF

SEQ ID NO: 4931 - protein, 293 aa, Unknown
  Description of Unknown: uncultured bacterium sequence
MKIKRQTISVTLATYNEESNIAACLDSVKDFADEIIIVDGRSQDKTVEIAKKYGAKILLRENNPIFHIQKAIANREAQSDWILQMDADERVTPGMKKEIVGILEGTYFGYDSWISPLKSSVNKYLTVFPRPKKLTEPAPAYWLPRKNFFLNRYLKNAGQYPDPVIRLFQKGKAVLPAKDVHEQMVVHGVTGWLVSDLDHYATPHFSRYLLRENTYSSLKAHQLKEAGVKINIFNTLNYLFFKPLGTFCSLYFRYRGFMDGFPGFVFSLYSGLHHAFSYMKLWELYKDEEYGTN

SEQ ID NO: 4932 - protein, 352 aa, Bacillus thuringiensis
MISISLCLIVKNEEQTLNNCLSSVRGIPDEIIIVDTGSTDRTKEIAKKWTSHVYEFEWIDDFSAARNASFQYATKDYILWLDADDVLEQEQSRKLKQLKESLSEGVDAVSMKYLMLNSEERGITSYTTRLRLVKREKGFKWKGIVHEDLAINQAYTSLQSDICITHTKKGNTNMPSSRRNLEIYERHIAKGYQLNVSDMFHYARECKIHKEYEKAIQYFEQCKNHPEISLENTIFVYHQLATCYAMVQKPQNELELTLQSLSLDIPYPAFSCRMGEHFLRKGHLEAAIFWYTTAYTQPLLERYAWSVADQAYHTWLPHQQLALCYQTLGEQEQAIFHEQQAKEYQNISSDSF

SEQ ID NO: 4933 - protein, 369 aa, Desulfocucumis palustris
MIMKEISISLCMIVKNEENTIARCLDSVKDIVDEIVIVDTGSTDRTKEIVGGYTDKIYDFTWIDDFSAARNYAFSLASTDYILWLDADDVILEPDRLKFLDLKKTLDPLMDAVNMPYLLAFDQHGNVTFSLRRNRLVKRSRNFQWIGAVHEYLAVGGHILNSDISVVHKEEARDSDRNLNIYERRLAGGEEFTPRDFYYFANELFEHQQFERAIEFYEKFLNTDMGWVEDRIAACAKLADCFHRLGDPKSEHAFLYRSFEYDTPRAEFCCRLGHSCLQAGRLKQAVFWYKLATELEKPVDSWGHMYHACWTWLPHLQLCVCYDRLGEHELAYKHNEIARTFQPENVSVIHNKIYLEGVLGKEVKEEKNS

SEQ ID NO: 4934 - protein, 361 aa, Lysinibacillus sp.
MVSISLCMIVKNEEDVIGRCLASVKGLVDEINIIDTGSTDNTKQIVKQFTDRIYDFEWIQHFAAARNFSFQQATKEYILWLDADDVLLEEDQVKFKALKESLSLDIDAVSMNYNLSFDHEGNVSSLLRRYRLVRRDKQFQWIGAVHEYLEVGGKLLDSDIAVSHLPLSHDHNRNINIYKQLVESGEPLSPRDTFYYANELLDHEQFEDALFYYETFLVSKLGWVEDNIRACFKLADCYSHLNDKENNLSSILRSFEYDIPRPEACCRLGFHFLEQAKNYEAIFWYEQALVIKQKPNTPFQNKTFTTWLPHLQLCVLFDRLQQYELANAHNELARAYLPNDEKILHNKKYFDRILNKENETS

SEQ ID NO: 4935 - protein, 284 aa, Unknown
  Description of Unknown: Blastocatellia bacterium AA13 sequence
MPTKKSDARIAAQLGDSVSPNEKPRRRISATIITLNEERNIADAIESLSFADEIIVVDSGSTDRTLEIARGLTERVYVKEWRGYSAQKNFAAAEALHDWIFSLDADERVSPDLATEIDAFKASPDQPASAYEMSRLPNYLGGWVRHSGWYPDRKVRLYDRRKARWVGDFVHEELQVDGVVKRISGDLLHYTVRTVSEHVQRSDRYTTLAAEEMLARGRTPSILAIALAPPVTFFRSYVLKLGLLDGIRGVAIAFFAAYYVFLKNLKSWRKANETRTDSDNHDNH

SEQ ID NO: 4936 - protein, 625 aa, Paenibacillus sp.
MSKTISLCMIVKNEEQVLGRCLESVKDVVNEIIIVDTGSTDMTLDIARKYTDKIYSFEWVNDFSAARNESLKYATSDYILVLDADEYLEVGADFQKDLEKNCDYYLFRIRNEISWDRNFTFAAIRLFKNHISLKFENRLHEHLNIINGTAEYTMGESNLLINHVGYTDGKMLEKDKHKRNLPLMELEVAENPTAYNLYNMGKTYFAIQEYKKAVDFFKKAYPLSKDRVFLPELLTKLAYALAEINQMEDALSILADAVMMFPKETEMRYILGMIYQKAEYYRDAEVCFRKCIELGDQGSLITEGSGGYMAHMRLSELYEEIGQLEDSHREAVFVLNLKRNFAPALQQYLNLMLKLKVSTENIQSGINQHYTLKSVEDLQQLLDIMYGVRSPLLEKYLTTYNITVQPNVLATSKIYSKNYMEASLLWNEIADKQNENGQDLLLLAFLLKDVSNLVHIQNLLNLSNKERNALEKMITDQDGKYSLTPVIESRLLDICCKMIILQEFEQFQLLVEKMIEIKSESRLSIGKLLSDYRFDELAIDMLITMFKDQPNNVQLVRLLGDLCLRNGYMEDTQLFFSKLLTMDSQYSSYERSFKLYEKQEDTISCRTIKEEIKNRFRNVLWVREA

SEQ ID NO: 4937 - protein, 311 aa, Runella sp.
MNDVSVIILTHNEEKHIERCIQSLLHFTDKIFIVDSGSTDRTVAIAESLGANVMHNPWVTYAVQFNFGIHHTPFKTDWLMRMDADEYVTPELGQEIKESLAALNNDTTGIYVKRRVMFMNQWIRRGGYYPIWLLRLWRRDKGICEELWMDEHIKLSEGTTVQFKNDIVDHNLNNLTWWTQKHNNYAIREVIDLLDIKYNFTEANRVIPKLLGTQDQRKRFLKLKYASLPLFTRPFAYFLYRYFVKLGFLDGKKGLIWHFLQGLWYRFLVDAKIYEVYHRVGKDKQDIIEFFRNEYGKDLSAVQNRPVEVRQ

SEQ ID NO: 4938 - protein, 252 aa, Unknown
  Description of Unknown: Moraxellaceae bacterium sequence
MSKISVVIITLNEELCIGRAIESASQIAEEIIIVDSGSTDKTLEIIKSYDIVKVFHNNFIDFSSQKNFAISKASCEWIFVLDADEYFDKNLENQLKSKLFKNEKIYASIRKNWFMDGWLSESFGKDMQHRLFERKKENIYQNKVHERLKSIGNLEIIELEGCILHEQKRLSINNIISKQIKYTDYDIMGKYKNASLFLLLSKSFFKLINTLILKRIVFKGKRNILWAFVIFSYDLLLVMKKIEIDINNKGKS

SEQ ID NO: 4939 - protein, 249 aa, Unknown
  Description of Unknown: Candidatus Woesebacteria bacterium GW2011_GWC2_45_9 sequence
MNISAIILTKNEGKNLGECIRALTFCEEIIVIDDYSSDKTVEIARGLGAKVFQRSLDGNFAAQRNFGLEKATNKWVLFIDADERVSHELKEEMEKEVPAPNNSHLGYFLKRDDYFFGKKLKFGETASVSLLRLARKSAGKWMRSVHEVWEVQGRTKTLKNPLEHYPHQSLREFINDINFHSGLHAEANHQEGKHSSLVKILFWPKLHFFKNYFLRLGFLDGTEGFVLALMMSLHSFLAWSKLWIYERKN

SEQ ID NO: 4940 - protein, 310 aa, Spirosoma radiotolerans
MTDVSVIILTHNEEKHITRCLQSLLPFTNKIFIVDSFSTDRTVEIARSLGATVVQNAWVNYATQFNYGIEHTPFETTWLMRMDADEYVMPELAGEINQRLTGLPANVGGVYVKRRVFFLNRWMRHGGFYPIWLLRLWRRGDGFCEQVWHDEHIKLTKGESIQFAHDIVDHNLNNLTWWTQKHNHYTILEMINLLNYRYQFDQAETVEANLFGTQDQRMRFLKEKYASLPLFTRPILYFIYRYFIRMGFLDGRPGFVWCSLQALWYRFLVDAKLLEVSIRVGTDKDAIINYFLTEYGKDLRPNRPERVGQS

SEQ ID NO: 4941 - protein, 364 aa, Bacillus sp.
MLSISLCMIVKNEEEVLEQCLNSVFHLCDEIIIVDTGSTDKTKEIAEKFTDKIYDFKWIDDFSAARNFAFSKANMDYILWLDADDVLRKEDQKKLEALKLSLDPSVDAVSMNYILEFDEYGNPSFYFRRNRLVKRINNFKWIGPVHEYLEVSGNIFSSDIAVVHRKSDKAGSDQSVGRNLRIYEKRIKAGEDFSPRDLYYYANELKDNNQYKKAIIYYREFLATKKGWIEDNIRACLYMAESYAILGDKDEEVEILLKSFTYDVPRSESCCRLGDHFKAKKDFQTAVFWYNTAVLNKPQTPQGFHNESYSTWYPHLSLCVCHWELGNVEKSIEHNEIVKEFRPNDPQVLFNKRFFEDYLSKNKT

SEQ ID NO: 4942 - protein, 266 aa, Bacillus sp.
MIKEDKMSISLCIIVKNEERSLERCLRSVLNVVDEFIIVDTGSTDQTLDIVDRLSGQPEFGSKIKLFHYEWCGDFASARNYAVEHARGDFILQLDADEYLHPDDVELIKPSLKKMCKDIRKVYFFYMKIINETIDGRLQTTPESILRLWSNRSKIRYSRKCHESIDDSLKLVSNKQGFNINFRIMHDGYDTTLPSFVDKRKRNIALLNEMIAEDPYDQLSLYYFARDYSYFDKSKSINLLKRIEPLLDSPHKENARALIKEYSKQL

SEQ ID NO: 4943 - protein, 299 aa, Pseudarcicella hirudinis
MQDLSVIILTLNEEKHIERCLKSLFAITDKIFIVDSGSTDRTVEIAEALGAKVAKNTWVNYAQQFNFGIENNPFKTKWLMRMDCDEYILPELASEINEELSGISEDVSGLYISRRVIFMGKWMKRGGFYPMWLLRIWRSNQGICEESWMDEHIKLFQGKTIKLKNDLVDHNLNNLTWWTQKHNLYAIREVIDLLNIRYNFRNFETVEPKLFGTQEQRTRFLKVKYASLPLFTRPVIYFLYRYFIKLGFLDGVQGLMWIFLQGLWYRFLVDAKIYEVFHRVGKDKEAIREFFKTEYGKNI

SEQ ID NO: 4944 - protein, 299 aa, Unknown
  Description of Unknown: Flavobacteriaceae bacterium CG_4_10_14_0_8_um_filter_31_99 sequence
MEKTTITAIILTFNEEQHIARCISSLKNSVDEILVIDSYSNDKTVELAESLGAKVYQNPFVNQAIQFNWALDNCILKSDWILRIDADEYLDIKLNYNLREELKRYSIDVNGIFIKRKIIFMNQPLLHGDWYPKWNLRIFRNGFGRSEVRWMDEHIVISRGISKQLEINFIDENLNSLTWWIEKHNKYSNREAIDYFLQVDKNKSQTVKLNLFGNDTERKRWFKEKYNTMPLFIRPFFIFSYRYFYKLGFLDGKSGFVWHILQGFWYRFLVDAKIFELKLKFNNDHDKIVAYIKQKFDIN

SEQ ID NO: 4945 - protein, 630 aa, Paenibacillus sp.
MRNLMMKSPSISLCMIVKNEERCLERCLNSVQNIVSEIIIVDTGSTDRTIEIAKQFTDKIYSFEWINDFSAARNFALDHATGEYILHLDADEYLYEGTECLQEELDKSYYFLRIRNELGQGRAQTHLFVRLFRNQPSMRYEGKLHEQINLDTNGHLPFGFMDCVIYHDGYMDEVVKDKNKSKRNMDIIKAAIKTSPTSFNYYNLGLQYVHEKNYKEAVEAFKKSFSLANNQTFTPRMLILLFNSLLELKQYKQAMDVAADSTLLYPDSPNMEYGLGNVYQKMGFAEDAKLCFERCLEIGEEAGVQEYNHEEGSGSFLANSKLCEVFLEEGDREKAQQYFLAAVKEAPDLLYLVKLFADLNPNVNGKDFLASMLKIFPFSNPIKIRQYMSVLYDRRHIATYELIKCYHVNIEPEIQTWVDMVEHNYDLAAKRWEQITELKPFAKRDLLMLSFIRNEFLIARFKGDFGLREKEWKWWKKFIEQGIDDGTELSGDSEELWTWLCGDIVQLQEFEWLEKLVNNTNNAKLRYLIAKELSNRGFVELALEIIVESKHQKDNKLIYTLVSHILMQLGQFDDAIYYAEQVYKIENSYNNAYVLLSLLQKAGSLDRGESLLNNLKTNGIKSRWLDGLVS

SEQ ID NO: 4946 - protein, 594 aa, Clostridium sp.
MKNSISLCMIVKDEEEYLPRCLKSIKDIVDEIIIVDTGSKDKTVEIAKSFGANVYYFKWTNNFSEARNESLKYATKDWILILDADDEVYSEDQKNLKSLLDSSLDENIIYYFQTINYCGDVIDDNFTTMNLNPRLFKNNKGIHYEGEVHNQLSYPENIQHAICDFIKIHHYGYMNKVIKNKDKKNRTITLLKNQLEKNPDEPFANFNLGTEYAGLNDYKNALKHFYKSYEKFDPQNGYSFLLILRIVIANYQLKDFDNALKFINIGIEYYPDFTDLYFFKSLIFKDLDMPILQIKALKKCVELGEAPPQLRCYYGTGSFKAYYELGNAYFNLKDYDTAYNYYIETMKSKNDFITPLYNIAHILKIRNTPLEDFKKIMEDFLPDSLNSKLILINLFFNEDYYDTALEYIEKYEQYSTITENLNFIKAKCLLMTGKFNECICLNNVEENNSYYVPLSMYKVISNILINNYNGALSILNNFKEDNLSNHDKKHFKVYSQLLKLFTKEALLDISNEENESEYLNIILEILEILLVNNKFNEFKIAVNLLNLINNKFILLAFGKLYYKYGYIEHSKNELIRSIKEFEVYDKESLKILMN

SEQ ID NO: 4947 - protein, 395 aa, Risungbinella massiliensis
MIVKDEEETLASCLESVKYIVDEIILVDTGSTDRTKEIAQNYGANIYDFPWTDDFSAARNYGIQKAQGDWILWLDADEKVEVKDAAMLRDILYCSNYDLLAVNLINFIGEKEDKSHFYQIAHHRLFRNHMGFCFENRIHETLNITNVLSETDQKKRVGIVPIRVYHTGYLQTSVEKKGKFERNLTLLKRELGEKEHSPWIHYHIASEYYRVQEYAKAFQHVNQSIRDFLTAKSTPPALLYKLKYSIMLSLGSIEGAWPSIRLAVSLYPDYVDLHFYMGYILLARGEYKEALASFQKCLEIGEGNLEYLCLYGLGSYQAMYYCGLCHQKLGEPSEAIKCFLQTVVVSPNFQDARKALRICLKNQGFTLDSFLDQYYSNEDAQKYQKLISDTDKNKS

SEQ ID NO: 4948 - protein, 352 aa, Anaerotruncus sp.
MIVKNEERVLARCLNSALRAVDEIITVDTGSTDKTKEIAARYSDKVFDFEWCDDFSAARNFAFSKAERDYILWLDADDVLLPPDLEKLIDLKQSAEKSVNAFYMRYNTAFDELGNPTFWYYRERLIKNNAGLKWRGRVHEAIACPQPVEYCDIAVTHKSVKTEYSNRNLLIYEKQLALGEPLSPRDEFYYGRELYYNKQYEKAASVLEKFLQSGRGWLENNIEACRVCAHSKKALGDFGGALSALLGAFFYAPARAEICCDIGNLFLEQRQYDKALFWFRSALSLNENAEKGGFVNTDSHGFLPAIGLCVCYDALGDYESAEKYNEIAGGYRPASSAYLHNKKYFEQKAGNR

SEQ ID NO: 4949 - protein, 364 aa, Solibacillus kalamii
MHTVTLCMIVKNEEEVLYQCLNSVKEICDEMIIVDTGSTDKTKEIARQFTEKVIDFKWIDDFSAARNFTFGHATMDYILWLDADDILLIEDLKKFKILKTNLDSAFDAYSMIYNIAFDEYGNPTFSYRRNRLVKRVKNFKWVGPVHEYLDVHGTIFPTDIAITHRKTDKKNQSIQSDRNLKIYEKRLEKGEEFTPRDLFYYANELKDHAQFLKSISFYEKFLATKKGWIEDEIRACINMAMCYRNLGNAEKEKESLVMSFIYDLPRPEVTCRLGDLYTNKRNFKKAITWYRLALEIEEDDHQGFRQIAYSTWYPHLQLCYCFWEIGDVELSLKHHEKAKIYRPNDSNVKKNEEFFRTYFKNRSE

SEQ ID NO: 4950 - protein, 362 aa, Hungatella hathewayi
MATVSLCMIVRNEEDVLGRCLESVKDIVDEIIIVDTGSTDRTKEIAGRFTNTVYDFPWIDDFSAARNFSFSKATMDYQMWLDADDVIEEEDRKKFQQMKEELDGSTDVVMMPYQVAFDQKGNPTMTYYRERLLKRSRRFLWQGAVHEVITPAGTILYGKAAVCHRKLHPSDPDRNLKIYETMKEHGGITDPRHQFYYARELFYHGRYEEAAAMFLTFLEEGRGWIENNISACLDLSHCYARMGKREEALQALFRSFRYDLPRPELCCEAGKWFMEQGGSDKGNLKQAVYWYLRAKDQKTNEESGAFVNPDCSDFIPDIQLCVCYDRLGEREKALEYHEKSKKKKPDHPAVLFNEAYFAGKGM

SEQ ID NO: 4951 - protein, 361 aa, Unknown
  Description of Unknown: Lachnospiraceae bacterium 28-4 sequence
MIPISICIIAKNEEQYIGECLRRLSLYDWEIVVVDTGSTDHTVEIARTYTPNVYHFNWIDDFSAARNYSIAQASNDYILVVDCDEYLENDDMAAHTISSLPQMISPYQIGILDRFSPSAELSTSGESTSVIHERIARFFNRKFTHYKGTIHEQLVSKTGKASEFIPIPLAFYHIGYQSMDIKKAKASRNISMLEAELEKKRDDPYILFQLGQSYFGLSNYEQALPYFEQALSMEVNEQEEYVQTMVESYGYCLIYLKLFKKALELEGVYSVFSRRADFVFLMGLVYLNNAMFEDAVREFLKAATIADYAAVGVNSYLAYYNAGVIHECTGNIPEAAMLYKKCGDFAPALQRLTQLTDPRCD

SEQ ID NO: 4952 - protein, 361 aa, Sporosarcina psychrophila
MITISLCMIVKNEEEVIGRCLDSVCELVDEINIVDTGSDDRTKEIVNKYTNRIFDFQWIDDFSAARNFSFQQATMDYVLWLDADDVFTAEDQEKFKLLKQSLQPTIDAVSMNYHLSFDHEGNVTSLLRRYRLVKKVNEFKWIGAVHEFLSVSGNLFDSDVAVTHSPLSHDSERNITIYKKLLASGKTLSPRDTFYYANELMDHSDFETAVLYYEEFLDSKLGWIEDNIRACFRLADCYHKLNDKNKELSSTLRTLAYDVPRPEACCRLGYYFMEQFKNHEAIHWYSQAFLYENHQQIGFQNTSFSTWLPNLQLCVLYDRLKQYDKAYHHNELARKYKPNNDSIMKNKTYLDEVIKNNQEKI

SEQ ID NO: 4953 - protein, 444 aa, Clostridium celerecrescens
MKPVIRLSQCMIVKDEEKNIRQALNWGKGIVCEQIVVDTGSTDKTVEIAEAMGAKVFHFPWEHDFSAAKNFAIEQAKGNWIAFLDADEYFSDEDVRKILPMLKRVEKNSTHPARPHVIRTLLVNLDDSGNRINTGVQYRIFRNIPKLRYRSRIHEYLDLTDGSQLFSWDAMETLAVFHTGYARAICIEKKKEKRNIFMIRKELEKDPENSMMWSYLGDSLLADEKLEEAEEAFFRATENPDAVMEIDRRNLSFAFWLKTKYIRNSGSEEDFMEVYQKAKKRGCDTPDVDYWAGQWFCRQGSDEKTRLYFEQALQLLDEYKGNDPLDMSGRLTFVYQWLFFFYAKYNRSSEMIRYGVFTLRAEPYEFSVLKEILLLLKREPGEETTASATFGFLSKLYDLSIFKNKIFLIKVSEQAAFPALENKLSLLLSEQEREFVAKSGDIFR

SEQ ID NO: 4954 - protein, 292 aa, Unknown
  Description of Unknown: Nitrospirae bacterium sequence
MWRRLRVEALAAIGGSTRVSTVRCCGVAFEANTRPTVAAIVIAKNEERNIQACLQSLAWADEVLVIDAESTDKTAELARAAGARVIVRPWSGFGAQKNFAMEQAQADWVLIVDADERVSQDLRDEILRVLQYDGSNVTAYRVPRRNYYYGTWIRGAGQYPDRQTRLVRRECGRYNYLPVHEHLEVNGFVEDLRGHLDHYTHPTVVSHEAKIERYSSLAAEERLRRGKTDAAWYHLLFNPIWTFFKVYLLRGGYRDGLPGFLVSGFSAAHVLLKYAKLWERAHVKAPSAVSER

SEQ ID NO: 4955 - protein, 283 aa, Unknown
  Description of Unknown: Candidatus Beckwithbacteria bacterium CG10_big_fil_rev_8_21_14 _0_10_34_10 sequence
MFLTLILLEKDGKRYNKNMKTAVVLAKNEEKSIKTCLLSLKGFEEIIVIDDNSSDKTREIAKKLGVRVYKRKLNNDFSNQRNFGLKKAKGDWIFFLDADEKIDNKLKREIFKAIRDPQTNSGFSFKRKDTFLGKELKFGETASLRLTRLGKKNSGFWTGKVHEVWKVKGKIGKLYNPIIHQRHIGVSGFIKRINFYSSLRARELYEKGVKTNAFLIIIYPLAKFFLNFFVKLGILDGKQGFIMATLMSAHSFLVRSKLYLLWKNKGVEDPPIPPLKKLYKQYG

SEQ ID NO: 4956 - protein, 305 aa, Spirosoma fluviale
MTDVSVIILTHNEEKHITRCIQSLLPFTHKIFIVDSFSTDRTVEIARSLGAQVVQNVWVNYATQFNFGITNTPFQTGWLMRMDADEYVMPELADEINRRLHSLPASVGGIYVKRRVFFLNRWMRHGGFYPIWLLRLWRRGDGFCEQVWHDEHIKLTKGEPIQFDHDIVDHNLNNLTWWTQKHNHYTILEMINLLNYRYQFDKAETVQPRLFGTQEQRIRFLKEKYASLPLFTRPILYFIYRYFIRLGFLDGKAGFVWCSLQALWYRFLVDAKLMEVNIRVGTDKEAIINYFRTEYGKDLRPARPE

SEQ ID NO: 4957 - protein, 359 aa, Unknown
  Description of Unknown: Anaerobacterium chartisolvens sequence
MITVSLCMIVKNEQDTIARCLESVKDIVDEIIIVDTGSTDKTKDIANAFTSKIYDFEWIDDFSAARNYSFSKAEMDYIMWLDADDVILEEDRIKFIKMKEILPQDVDIVVMQYNTGFDHMGNVIMSFYRERIFKRIRNFKWNDCIHEYICLTGNITCVNICITHKKIHSEAGRNLRIFEKLISQGSELSVRNLFYYARELLYNGKTDDAIVYFNKFLDTEQGWVENKINACDDLAKCYLMKNDRKNALKAMLRSFGYGIPRAEICCQLGYYYMHDNDYKTASFWFELATRLEKPEYSLGFVLHDFWGYIPNIELCVCHFKLGNIKESLKYNNKAAEYKPDDPSVLYNKSFFKSISCNEL

SEQ ID NO: 4958 - protein, 306 aa, Siphonobacter aquaeclarae
MRPNPDLSVILLTHNEERHIERCLKSLLPVTDKIFIVDSGSTDRTVELATALGAVVVSNPWVNYATQFNFGIRNTPFQTEWLMRMDADEYLLPELAGEIREKLGNVSENVSGVYVKRRVMFMDKWIRRGGYYPTWLMRLWRRSKGHCEELWMDEHIKLSDGDTTRFDNDLVDHNLNNLTWWTQKHNLYAIREAIDLLNVRYNFDDGAIVTPTLFGTQEQRKRYLKIRYATLPLFTRPFLYFVMRYFFQGGFLDGTKGLVWHFLQGFWYRFLVDAKIYEVYHRAGRKKEDIAAFFWTEYGKDLTGKR

SEQ ID NO: 4959 - protein, 316 aa, Clostridium sp.
MVSFSLCMIVKDEEAVLSRCLDSLHDIMDEIIIVDTGSTDKTKEIARKYTDKIFDYKWCNDFADARNFAASKATGDYIYTADADEYLDAENRDKLCQLKKIMLPEIEIVQMLYHTPAGLSTVYNFEEEYRPKLYKRLRTFTWIDQIHETLRIDPVVYDSDIVIEHRPLTNHAPRDFAAFERIAVDGKRLSKKLHHMYAMELFRSGSDDDFLKSENLFKRTLEEDGRTIDEVKEAFCVLARCYRVKGDIVSFMECALKDAATSSCAEICCELGMYYESVGNISEAVMWYHNALTETESILDIRSSQEIPKEALERLE

SEQ ID NO: 4960 - protein, 357 aa, Clostridium bornimense
MNTISLCLIAKNEEEVIGRCIESVIDIIDEIIVVDTGSTDNTIEIAEKYGAKVYNFTWIDDFAAARNYSFSKASKEYIFWLDADDILIPEDKEKLKELKDSLDSTVDAVSMNYVLAVDENNNPVSSLRRNRVVKRKNNFSWIGKVHEYLEVYGNVISSDISILHQKNKPYTDRNLRIYEGMLKNNDEFSPREQFYYANELFDHGRYDEALDMYRKFVDGKKGWVEDVKSALSKIADCYNYKEDKDMEMKALLEAFEYDMPRPDFCCRIAYRFIEQNKYREAIFWYKAAIDTKPDEDNMALINHAYYTWIPYIQLCVCYANLGDFNTSNYYNEKAAEYIPDHPSVLQNREYLKDKINK

SEQ ID NO: 4961 - protein, 370 aa, Paenibacillus lautus
MISISLCMIVKNEEDSIDRCLKSVQDIVDEIMIVDTGSTDKTKEIALQYTDQIFDFEWMDDFAAARNYAFRLATKDYIFWMDADDVLKDEDRKKFIHLKGILDPSVDFVTMDYHLAFDEFGNVTLSVSRNRLVKRENKFQWIGAVHEYLEVWGNILNSDVAVTHNRLHHDSDRNLRIYESRLLSDEEFSPRDLYYFANELVDHRMYEQAICYYEKFLDTGKGWVEDNISSCGKLADCYHELGNRERELESSLHSLQYSSPRAEFCCRIGYHFLNHGDIRTAIFWYKLATQRKQTGDNWGFINPVCSTWLPHLQLCVCYDRIGEYRLAYNHNEIARSYRPTDPRVTQNKRYLESVLGMYEGIKVDGGDLHE

SEQ ID NO: 4962 - protein, 303 aa, Unknown
  Description of Unknown: Microgenomates group bacterium GW2011_GWB1_40_9 sequence
MKPTLSIVVSAYNEEKSIGRCLASVKELADEIIVVDNESQDKTVAIAKKFTKKIFSATNQLMLNANKNKGFEKATGDWILNLDADEEVTLDLVKEIVSLIRSNPTSNGFWIKRKNYSFGKWIQHGLWWPDKQIRLFRRGRGQFPCVHIHEYIKVDGSVGELVEPYIHYNYETVHQYLTKIDRTSTSEAITLSELNYELMWYDAIRFPASDFIKIYFAQGGYKDGLHGLVLSLFQAFYSFCTFAKYWEMKKFQARDISLKEVSSELKNRKKEIQYWILTSRLNQSSPIMKIFLRVKRKLISIHA

SEQ ID NO: 4963 - protein, 310 aa, Spirosoma pollinicola
MTDVSVIILTHNEEKHITRCLQSLHPFTNKIFIVDSFSTDKTVEIARSLGATVVQNAWVNYATQYNFGIEHTPFETTWLMRMDADEYVMSDLADEINLRLSGIPATVGGIYVKRRVFFLNRWMRHGGFYPIWLLRLWRRGDGFCEQVWHDEHIKLTKGESIQFSHDIVDHNLNNLTWWTQKHNHYTILEMINLLNYRYKFDQAETVEARFFGTQDQRMRYLKEMYASLPLFTRPVLYFIYRYFVRMGFLDGRAGFAWCFLQALWYRFLVDAKLMEVNIRVGNDRDAIINYFRTEYGKDIRPKQPEQVGQS

SEQ ID NO: 4964 - protein, 356 aa, Bacillus toyonensis
MQKSITISLCMIVKNEEQAISRCLESVKDITDEIIIVDTGSTDKTIELVKKYNAKIYNFKWINDFSAARNFAFSKATKEYILWLDADDIIEHTNREMFLNLKSTLNTEIDAVSMKYNLSFDTEGNSTFSVKRYRLVKKNKNFQWYGFVHEYLEVYGNLIDSNISITHKKEKAFNNRNLNLYQKQLAKGKKFSPRDTYYYANECKDHQLYTVAIEWYTKFLDEKKGWVEDNIQACLKRGECYLKLNNIEKAFYSSLQSFIYDTPRAEICCQLGYIFLEKQEYNKAIYWYETAINISKPTNAPFIQESCYTWLPHLQLCICYFHIKDNQKSIYHNEQAAKFIPNHPSIKHNREYFSKL

SEQ ID NO: 4965 - protein, 273 aa, Unknown
  Description of Unknown: Candidatus Levybacteria bacterium GW2011_GWA2_37_36 sequence
MQTITAVIPAKNEEKNIERCITSVLWCDKVLVISTGTDGTAEIARGLGVNVIEKNKSDKDDFEEVQKNLNLAIKTCSTDWIFRVDADEVVTPELQEEIKDIIGQSQIKSDKIGKETDSIRLNPVSSDYIVAYGIPRQQNFLGTFLKGGDWAYDRLVRLFRPKFCRYDPIVKVHEQFKVNGKIGYLKSSLLHYSHPDKKTLFKKFDSYTTLEARELKETKLSAFFKLIFIPPYIFLRWMIYHHGYRDGLVGIQAGSMRAYYDFLLYSKYLKSNK

SEQ ID NO: 4966 - protein, 361 aa, Desulfosporosinus acididurans
MNNSNITISLCMIVRDEEQTISRCLDSVTGIPDEIIIVDTGSIDQTKEIAQKYTNFVFDFEWIDDFAEARNFAFSKANMDYILWLDADDIISGSDRDKFLILKKSLDPLIDVVNMPYILDLDEYETVAMSLRRNRLVKRSKNFQWFGAVHEFLKIDGYVMNSDVCVTHLGIRDDPNRNLRIFEKQMIKGNPLSGRDLFYIGNELLSHRLYHRAVEIYQKALQQEDLWVENKLSACQRLAGIYHHLEEKDNELQFLFKSFEYDVPRAEFCCHLGNYFLENGQYEKSIFWYNLATKLERPGENWGPAEHACWTWLPHIQLCLCYDRLGNYSLAYKHNEIARGYRPQDPRILYNKKYFEDILSP

SEQ ID NO: 4967 - protein, 307 aa, Larkinella sp.
MSSISVIILTHNEEKHIGRCIASLLPFTDQIFIVDSFSTDQTVQIARSMGAVVAQNPWVNYATQFNYGIRHTPFQTTWLMRMDADEYVMPELAAEIDTKLTTLPADVSGIYVKRRVMFMNRWMKHGAYYPIWLLRLWRNGQGICEETWMDEHIKLSTGRSIQFEHDLVDHNLNNLTWWTQKHNLYAIREVIDILNIRYNFDQSIRVEPKLFGTQEQRKRYLKLRYASLPLFTRPVVYFLYRYILRLGIIDGRPGLMWHFLQGLWYRFLVDAKLYEVYHRVGTDKGAIIEFFKTEYGKDLLAERPGQH

SEQ ID NO: 4968 - protein, 302 aa, Unknown
  Description of Unknown: Candidatus Microgenomates bacterium sequence
MKKISVVISAFNEEEKITECLESVKWADEIILVDNESTDKTVEIAKNHTSNIISRKNNLMLNVNKNFGFTKASGDWILCLDADERVSSELKNEIKLTIEKDTEVMGYFIPRKNIIFTKWIKHTGWYPDYQSRLFKNGKGKFAEKHVHEMIEIEGKTEYLKENLIHYNFESISQFLHKHINIYAPNEVDNIIAGGYKFDYLDAIRFPIKEFLSRFFAREGYKDGLHGLVLSLFMAFYHFIIFAYLWEKQGFPSVEKNNFLQEMRGEFKKINKDIMFWFSNEQTKMIKNPLIKILHKVRKKLLK

SEQ ID NO: 4969 - protein, 340 aa, Butyrivibrio sp.
MVTVSVCMIVKNEEECLGRCLKSLQGIVDEMIVVDTGSTDKTKEIAKECGAKVYDFKWTGDFSEARNYSFSLATCDYIYAADADEELDEENRQRFLKLKEDIEELDIDIVQMYYCNQLSFRTVYNYDRELRPKLFKRVRHFVWEDPIHEQVSLEPVVCNSDIEIIHRPRENHAGRDLASFRKAVDDGRYLSKRLHNMYARELFMGGTDDDFIKAKEFFEKSACDTNRGVDEIKEASCVLAHVAVLEDDAPALLKYSLKDATTEMSSEMCYELGEYYYGKKDYDEAIIWFFNGAYECESILDIKKSKELPRLALAKCYRALGNEEQAADYEREAAECEKGE

SEQ ID NO: 4970 - protein, 293 aa, Unknown
  Description of Unknown: Acidobacteria bacterium sequence
MTISVVIITFNEEANIGRTLESVMPLVRDGRGEIIVVDSGSTDRTVKIANSFGAKVFVEAWKGYAAQKNSAIDKASGDWVLSLDADEEVETELINEIGEHALIRSANPDIRSREWCLTMENAQRGFDTRLQNLKGKPAGYWIPRKNFFLGRWMKHGGFWPDPKLRLFRRGYGRFKERAVHETVKVEGPTAKFKHALIHHSYPSLADYIGHMNRYSSLGAEMAGAQGHRGFSVVNIVLRPVATFANNYFFRFGFLDGHEGLLLHLYHAAYVSWKYAKAWELAKADSSRTEVRSE

SEQ ID NO: 4971 - protein, 254 aa, Unknown
  Description of Unknown: Bacteroidetes bacterium sequence
MIRLSVIIISLNEERNIRRCLLSVKALADEILILDSFSTDKTKKIAESYGATVIQKQFEGYVAARRDVESRAANDYILAIDADESLSEELHKSIVELKKNWIKDGYYVARKTNYCGRWINHSGWYPDRKLRLYKRGSGEWTGKYVHEKYMLFPDKTTGILKGDMLHYSYYKEKEHWARADKYANLAAQELFENGKTTSVFQTYFKAVVKFMRDYVKNLGFLDGKKGYTICKITAWGTYKKYAKLLELNKTRKNS

SEQ ID NO: 4972 - protein, 591 aa, Unknown
  Description of Unknown: Candidatus Brocadia sp. sequence
MNNTRQQTMTDKGRQAVLNNNRPTLSACMIVKNEEKFLSQCLASIKGAVDEIIIVDTGSTDKTVDIAHSFSANVYHHPWNNSFSEARNHSLEYARGDWILQIDADETLEQTDIPLLHTLINNDSYNVIYVAIYNELPGGCAKHYFQRIFRRGKAHFEGIVHNQLIFEGKALQSEIRFYHYGYNLSEQEMQKKYTRTGDLLRQQLAGNPGNLFIMANLVRNYRNEYAFDKVIDFAENGLKISASQTDLVSKNQRQRMSIDLAHAFINKNLIDKAELVCKKALIENPDSFDILLVMGEVFMKKGVFHDALPCFKKYLILKEKENKEPTFFLLSSDFYQYEHTVYNHIGECYKHLGLIHEAIVAYKKAIELNSRDPLNYANLINLYISQDRLIDAKDLTFAAIKSGIANHLIYHLLGKIYAAEGKMNDAIDACKQSLRMDNTNIPTHAYLINLLIQINHLDEASKILKDMLSLYPEEFTFLCLLERITYKQGNKESLVSFVRNILQSNPSDHNIYLHLGSLCMEVEEYADAIEAFERYLRTSSKVDASVIADIAVCYAKQGMREPALFGFQTALKLDPNCKCALQNLAALKANA

SEQ ID NO: 4973 - protein, 362 aa, Lysinibacillus endophyticus
MLTISLCMIVKNEEEVLEQCLSSVKDICDEIIIVDTGSTDKTKEIAYQFTDKVFDFEWIDDFSAARNFAFSKASMDYIFWMDADDIVSEGDQEKFKKLKAELPDNADAVSMLYHIAFDEYQNPTFSFRRNRLVRREKNFKWHGAVHEYLEVAGNIVASDVAITHRKKDKRKGQVPSDRNLKIYEKRLERGDTFTPRDLFYYSNELKDHGQYEKAIEYYNKFLDTKKGWVEDQIRACINMATCYRMLGNTENEIEALIKSIMYDVPRPEVSCRMGDLYKERRLYEKAIIWYQLACQVNPEDIPGFRQESYSTWYPYLQLCVCHWHIGNHELAVEYNKKAKEYRPNDPSVLKNEEFFKEYFAEK

SEQ ID NO: 4974 - protein, 289 aa, Bacteroides neonati
MIIKTDLTVLVLTMNEEKNIINCIDSVKELARRIVVIDSGSTDNTISLAESLGAEVFHHEFENYASQFNWGLDNTNISTKWILRLDADEVITHDLAKEMAEEMEKHKDDEVNGMQLKLKQCFLGKWMKYGGTYPFIKLMLFKNGIGRIENRKMDEHTILSSGRSILLKNDVLHYDFRDLTYYIHKHNWYAIREAQDYLENKMGNSVDALEEGSLKGHRKQKVLYYKLPKFFRAFAIFIYRYIFQLGFLDGKEGFIYHVLEDFWYRFLVDAKIYEYQQTGNKIENTGALK

SEQ ID NO: 4975 - protein, 307 aa, Siphonobacter sp.
MTPSYPDLAVILLTFNEEKHIERCLKSLLPVTDKIFIVDSGSTDRTVELAQALGARVAQNPWVNYATQFNFGIQNCPFQTKWLMRMDSDEYILPELAREIAQTLPNVASEVSGFYIKRRVMFMDQWIRYGGYYPTWLLRIWRSGKGHCEELWMDEHIKISEGEMLRMNHDLVDHNLNNLTWWTQKHNLYAIREAIDLLNVKYDFGDVEIVTPRFFGTQEQRKRYLKIKYASLPLFTRPFLYFLFRYFIKMGFLDGKRGLIWHFLQGFWYRFLVDAKIFEVYHRAGISKEAIARFFLTEYGKDVLEKR

SEQ ID NO: 4976 - protein, 355 aa, Unknown
  Description of Unknown: bacterium 1xD42-87 sequence
MKGEILFPLSVCIIAKNEEKHIGECLKRLSAYGFEIVLTDTGSTDRTLAIAKKYTDRIYHYDWCDDFSAARNFCMQKASHYWILSLDCDEYIENLDPSALRRCMEEYPNHTGRILIRSRFLRGDEISYEQTRVSRLFDRRYFLFAGAVHEQLERRDGGVKSVYDAPVTILHVGYDETEADMQEKSRRNISLLQAQLDMEGPDPYLYFQLGQSYRRLGDAEKAFESFDAGLSMEVDPVLDYVKTMVESYGYTLLDLKRNQEALGLTELYDVFSVRADFVFLMGLIYMNNGLFDAAIAEFKKAATMEDFSVDGVNSYMAYYNIGVIYECTGRLEKAREYYKKCGGYAPAEKRLKLLS

SEQ ID NO: 4977 - protein, 253 aa, Unknown
  Description of Unknown: Bacteroidetes bacterium CG_4_8_14_3_um_filter_31_14 sequence
MISLSVVIITFNEEKNILRCINSVKNFADEIVVVDSYSTDSTKDICLQHSVKFIQHKFEGYIEQKNFAILQAISNYILAIDADEALSPELEKSIIEVKNNWNFDGYYFNRITNYCGKWIKHCGWYPDKKLRLFVRSKGMWAGNNPHDRFEMHEGTTTSFLKGDLLHYSYYSIFQHIEQSIKFSEIAAKADYNNGRKVSFIGLIFKPSWKFIRNYFLKVGFLDGYYGFVICKISANASFLKYLKIRELKKKSFK

SEQ ID NO: 4978 - protein, 312 aa, Runella sp.
MKSDISVIILTHNEEKHIERCLRSLLVFTDKIFIVDSGSTDRTVAIAESLGAKVVHNPWITYATQFNFGIENTPFQTKWLMRMDADEYVMPELANEINQTLAGLAPTITGVYVKRRVMFMNQWIRRGGYYPIWLLRLWHRDKGICEELWMDEHIKLSEGETVQFKNDIVDHNLNNLTWWTQKHNNYAIREVIDLLDIKYNFAEAERVIPKLFGTQEQRKRYLKQKYASLPLFTRPFAYFLYRYFIKFGFLDGKKGLVWHFLQGLWYRFLVDAKLFEVEFRVGKDKQAIIEFFRNEYGKDLSSVQNRPVSVRQ

SEQ ID NO: 4979 - protein, 1065 aa, Bacillus massiliogabonensis
MKTSIIILTHNQLDMTIRCLESIRSNTSEEIELIVIDNASTDGTIHYLKEQKDIKAIFNSENAGFPRGCNQGVNHASGENILFLNNDTVVTPNWLENMLRVLYSNEKIGMVGPVSNFCAYPQQVPVTYNGIHEIEEFAQKREQAYKGQSLPYPRLVGFCLLIKKIVLDEIGLFDERFGLGNFEDDDLCLRAKMKGFELMIALDSFVHHEGHATFSQTGIDLEGLLNENWNKAREKWGNDIYSLLLDQEPPMTISLCMIVKNEEGSISQCLNCIKDIVDEIIIVDTGSTDRTKELVRDYTDLIYDFEWIDHFSEARNFSFSKATKDYILWLDADDILLEEDQKKLLNIKNTLNPSIDSVTMLYHLGVDSSGNPSLSYRRNRLVKRSNNFQWHGAVHEFLEVRGHITNSDVVVIHTGTHQDSTRNLRIYEKRIENGEAFTPRDLYYYANELLDHKQYNKAIDYYLTFLNSNKGWVEDNISACGKLADIYYHLGDETKEREYVFKSFEYDTPRAEFCCRMGFQFLKKNEYQKAIVWYKIAAELERPKDNWGFFNESCWTWLPHLQLCICYYHLGDYEKAYFHNEKARTFNPYDEKILHNKQFFDDLLKKHPIPSIELENEDSGKRISFISCVKDPLKYQKSQAFIHSLTIPEGFEIQFKSLENMNSIASGYQQMMQNSDAKYKVYLHEDVFIINNNFLVDILSIFKRHPLLGMIGVVGAKTMPKSCIWWESLDTYGKVYDSHTGQMELLSFSEVTSEYESVQAIDGLIMITQYDLPWREDIINGWHFYDTCHSFEFLKAGYDIGIPKQLSPWCIHDCGIRNASTGYEDSRKEFIHHYSNCLNTELGNKWIFHKPVFEYEKDHMYITQESAWSGHRHFAYDLVRFLKPATIVELGTQWGASYFSFLQAIKDEGMNTMCYAVDTWEGDPHAGYYDNTVYEAVSKITDQLYAKNSSLIRCRFDEALNEFEDESIDLLHIDGYHTYEAVSHDFKTWLPKLAKQGVILFHDIAVQRDDFGVHLFWEELKSQYSFIEFKHSYGLGMLFPKGYRLDFQHVFSIVNRLKDSYEHSS

SEQ ID NO: 4980 - protein, 289 aa, Unknown
  Description of Unknown: Chitinophagaceae bacterium K23C18032701 sequence
MSLVTVIILTYNEELHIERCIRNLQKISSHIVLIDSCSTDKTCAIATSLGAKVYENPWPGSHSIQFNWALENCTFDTEWLMRMDADEYLTDELIDEINRTLPATPSETGGFIIKRRVIFLGKWIKRGGFYPHRLLRVWRNGYGKLEERWMDEHVVLSKGNIAHLQYDMVDHNLNNLTWWTQKQNNYANREVLDLVDIQNRSTAAANVAASLTGEQFSRKRWLKEKAYSRIPLFVRPLCYFFFRYILLLGFLDGKAGLVFHFLQGFWYRFLVDAKMLELRMAGLKRSEKK

SEQ ID NO: 4981 - protein, 876 aa, Thermincola potens
MSSPRLSLCMIVKNEEEFLPRCLASVAEIVDEMIIVDTGSTDRTKEIASSFGAKVFDYEWQGDFAAARNFSLSKATGDWILIMDGDDELAPEAKGKIRDLLHVGQEIQGYRMPVISFLGESPGGPCSTVHHVRIFRNLPKYRYTGALHEQLPMEIYARCPETPYKIYHYGYLSRIVEKKDKTNRNLVLAEQELAAEPQSLFKQYNLGAELVRAGNFTRGAKLLKAVTDEVTGWEAYAPSAFQKLALCYVEQKKLNAALSTAKRGWQKCPWDLSLLYLQGVILMAKGKTLAAVKIFEECLALNDRVRSIVYQGAGDSLALGSLSSAFVQLGRPWAAFECAAEAYRINSNYSFALQAVIAYLWQVADRNEARYYLTERRIMPEHIADRLLASWPDNQVGKNIIVPFSKKPLISLCLITKNEADNLRNHLGRLTAIADEIIVVDTGSTDDTVRVAEKFGATVTTMTWNDNFSLARNKALSLARGKWILSIDADIDISLSDCGKIRRIAETGKADAYRFTVLNHLGGNAPAMRDKKILLFRNRKNFKYTGAVYEQLLLKKNGKKPVRVEDSDVQVHHHGFNRDLAGFQAKRERNIKILQKEINKGAGPYLAYCLASEYMQTNRYREALAELTKTEKLCSTKEPYYPDIIRKIALCLFKLKDYSGAKRVIKAGLKKLGSALQDQYSLLSSIYLIQKQYNKAEKILQKLFQTPSNAATFNYAWELNREQSYVDLAQLYLEKDKWAEAIVLCLQVLYRTPDFVPAANLLSKILKQRSRPKNVEIFLERYFNLKSNEGLVSLAAQFIALGWPGLSLKLLNRIDPAWADREPTVLKLKLKAYTSMLKNVLTRARESYPGDQNLRRAWSMWERWQKTNTEWFNNSV

SEQ ID NO: 4982 - protein, 359 aa, Unknown
  Description of Unknown: Clostridiales bacterium sequence
MATVSLCMIVKNEERVLARCLESVRECMDEIIIVDTGSSDATKEIAARYTDKIYDFEWIDDFAAARNFSFSKASMDFAMWLDADDVFLEADKNAFIELKNSIPDNVDVVMLRYHTAFDEEGKPVFSYYRERLIRKGTVSFWKGRVHEVIVHTGRVMYSEVAVTHRSVKTGYNDRNLRIYEKQEKAGEPFSPRDWFYYGRELYYHKHYEKAIQILQDFLSSEKGWAENKIEACKILSYCYQETGDSLSALGALTVSFRYDVPRAEICCEIGNYFMRLQNFRVAAFWFELALRAPREDRSGAFVAEDSHGYLPCIQLCVCYDRLGDYKKAEEYNQLAGTYRPSSPAYLQNLKYFESRGLHT

SEQ ID NO: 4983 - protein, 277 aa, Unknown
  Description of Unknown: Carnobacterium sp. 1290_CSPC sequence
MVSDITVIILTKNEEKNIEDCLKSLKNFAKRIVIVDSGSTDKTIEIANKYNVDVYFHDFENYAKQFNWGIDNTNISTHWTMRLDADERLTPELCLELENLMNINKNTTINGITMEAWLYFMGKKIKYGGPKKRKLMVFKTGIGRIEDRNMDEHTILKKGDSIAAKEKFLHYDFKNLTFFIDKLNWYASREVLDYFDYINQDLDENLKDKAILSTRKKKFGFYYKFPMFIRSWLLFIYFYIFRLGFLDGKEGFIYHYLYQRWYRMLVDAKIYEKIQKK

SEQ ID NO: 4984 - protein, 310 aa, Pseudomonas sp.
MTTEFFAVDVCVIILTFNESRHIARAIDSIRPFAKEIIVVDSYSDDGTVELAKALGATVLQNKFINQAKQFQWAMDNAPINSKWIMRLDADEVVESDLVAEIKAKLPALSERVVGVNLKRKHIFMNKWVRYGGRYPLLMLRLWRVGYGRVEDRWMDEHVVVLGGEITTFEGGFADHNLNNLTYFIDKHNKYAVREAIEVISQRLNLLIQDKALNKNSASFQAAFKRFIKVNIYNRIPFTVGALLYFLWRYFCQLGFLDGRSGLVYHFLQGFWYRFLVGAKVMELELEIANLTDKQEILTELSRLTGHKLN

SEQ ID NO: 4985 - protein, 379 aa, Bacillus toyonensis
MITISLCMIVKNEEKSLEQCLQSIEGIPDEIIIVDTGSTDKTKELAIKWTPHVLDFEWKDDFSAARNFAFQQATKEYIFWLDADDILIVEDREKLLELKRNLDKSIDAVSMIYHALLDKHDNVITSTNRLRLLKRKKNFKWVGMVHEDVSTFSNYNCYNSDIVITHTKKIGSSTRNLSIYEKAVKEGKKFTSQDLFHYARELQINKRYEEAIKYHELFLAGEDIGTELRLFTYHNLACCYFQIGDSEKELELTVESFKYDTPQPVFCCRMGENFIKQKQFKQAIFWYLLAIENGKQNQNHHIEQFIYQTWLPHKQLGLCYYKIGDYRSSYKHNKEVLKYIPDDNETLNNVRVLKEMLYEQGVVLPDSDEWDVNYSQESI

SEQ ID NO: 4986 - protein, 314 aa, Siphonobacter sp.
MTPTPSPLSPTVPDLTVILLTFNEEKHIERCLKSLLLVTDKIFIVDSGSTDRTVALATSLGARVIQNPWVNYANQFNFGIQHCPYQTQWLMRMDADEYILPELAQEIRQTLPTLPASVSGLYIKRRVMFMDQWIRYGGYYPTWLLRIWRSGKGHCEELWMDEHIKLSEGETARMDHDLVDHNLNNLTWWTQKHNLYAIREAIDLLNVKYDFGNVEIVTPKLFGTQEQRKRYLKIKYASLPLFTRPFLYFLFRYFFKMGFLDGKRGIVWHFLQGFWYRFLVDAKIFEVYHRAGTSKEGIAQFFLTEYGKDVLGKR

SEQ ID NO: 4987 - protein, 312 aa, Unknown
  Description of Unknown: Candidatus Shapirobacteria bacterium CG10_big_fil_rev_8_21_14_0 _10_38_14 sequence
MKKLSVILATFNEEKNIKDCLESVHQLADEIIIVDGSSTDKTVEIASSIGRSASGRKKPEIKILIKNNPPMFHLNKQLAIEKAIGDWILYLDADERVSPKLRQEINQKINAKTKFNGFWIPRKNIIFGKWIRHTGWYPDYQLRLFKNGQAFLPCQSVHEQPKLTGEADYLENFLIHYNYRTISQFVTKLNYLYTENDKKVFLAEGKKISWPDALRWPTAEFLKRFFKQEGYKDGLHGLVLSLLQSFSALVTFAKIWENQEFKKIEPENFLVKIEKEFGPIIKEFKYWFLTSRIKQTKSFFKKNFYRLVRKSP

SEQ ID NO: 4988 - protein, 302 aa, Flectobacillus sp.
MQQDISVIILTFNEEKHIARCIKSILPFTHKIFIVDSGSTDKTVEIAERLGAIVQYNPWVNYAQQFNYGIENNPHKTKWLMRMDSDEYIMPELSEEISNKLAGLDDQISGIYVKRRVMFFNKWIRHGAYYPIWLLRIWRNGRGVCEETWMDEHIKITEGITQNFSHDIVDHNLNNLTWWTQKHNLYAIREVIDLLNMKYDFRDFESVEPKLLGSQEQRKRYLKMKYASLPLFTRPFMYFIYRYFFRLGFLDGTKGLVWHFLQGFWYRFLVDAKIYEVYQRVGKDKNAIVDFFQKEYNKNLRS

SEQ ID NO: 4989 - protein, 356 aa, Bacillus jeotgali
MKTLALIMIVKNEQKKIKRCIDSVKDFVSEIIIVDTGSTDNTRDIALEKGANVFEYEWNHNFSNARNFSISKSTCDWNLVLDADEYILSGHHLLNDFINKSDNEIGRINILSKYLVNEQEQIESSYVSRVFPNNGIFFTGRVHEQLDTDLPRVNIPVEVSHDGYYQTDKTERNLPLLLDELSVSPNDDYILYQIGKQYYLKQEYIKANSYFDLSYKKISNNVNYKNKMVIDYIYSLIKSGNFELGLQIIEEEKNNLLFSTDFHFICGVFYMELVFSNVNKYINFFPYIEREYLTCLNIDKNKKQEMVMGTGSFLALYNLGTLYESTGNISKAIDCYKKSWEYMYQPARKRIEALRN

SEQ ID NO: 4990 - protein, 348 aa, Paenibacillus sp.
MATISLCLIVKNEEQNLDHCLSSIEGIPDEIIIVDTGSTDRTKEIAAKWTQHIYDFEWIDDFSAARNESFKYATKDYILWLDADDILTPEDKVKLEHLKNTLTEEVDAVSMNYEIPQDNSRKFISNTTRLRLLKRTKGFIWKGIVHEDITTEDSYHLIKSDITVTHTKTGSAPDATPSRRNLDIYERHLARGYSFNVSDMLNYARECHSHKQFKQAIHYYELCKDHPEIPLENRVFILHKLATCYVYNNQPEKELELTLEALSMDVPYPAFSCRMGEHFLKTGNLEAAIFWYTSAYSSPPGERYAWSAIDNVYHTWLPHQQLSLCYQALGDMSQAKHHQQWAEFHRKG

SEQ ID NO: 4991 - protein, 260 aa, Grimontia hollisae
MSQAQRATISAIIITKNEEHILPECLASLDWVDEIIVVDSGSTDNTVAIAEAAGAKVYVNAEWPGFGKQKQLAQRYATKDWIIAIDADEVVSPALKQSLLKLLENPPAETLVEVNELTWVFGRFLRHSGWYYSHVRVYPREYTQYDDALVHEKIIRPEGAKTLVLDGDLLHYSYRDLNHYLVKSAHYAKAWADARQARGKKSSISQGLLHALGCFLKMYVLKRGFLDGKQGFLIAVLSAHSTFVKYADLWIRANDSRAVK

SEQ ID NO: 4992 - protein, 256 aa, Unknown
  Description of Unknown: Candidatus Curtissbacteria bacterium GW2011_GWB1_40_28 sequence
MKKIKISAALAIFNEEKNIVDCIESLKGFANEIVVVDGSSKDRTSELAKKLRAKVIKTTNKPMFHINKNLAIDNCKGDWIFLIDADERVSKELAIEIKEITSKNPKENGFWINRANWFLGGYLTKGGAYPDSVIRLFRRGKGRLPEVSVHEQVKIDGGIGHLKNDIQHFADPTFTRYLYRADRYTDQTAQYLTKINSGRGPWPVFYNMILKPILTFFDIYFRHRGYVDGFRGFIWALFSAAHHFYAYVKYWETTKK

SEQ ID NO: 4993 - protein, 319 aa, Agathobacter ruminis
MMTFSLCMIVKNEEAVLARCLDSIQDLMDEIIIVDTGSTDRTKEIAAQYTDKIYDFAWVDDFSAARNFAFSKATCDYIYSADADEVLDIENHQRLAMLKQYLLPEIEIVQMHYLTRNEYNTTQNYMDEYRPKLYKRLRTFTWIHPVHEVVRLDPVVFDSDIEIIHLPQSMHNKRDFHIFKNTFEQQGALSPEVFNMYAKELFISGADWDFTEALTIAKSACDDPATPEEMVQEAQCILAHAYLVENKIPEFFDLAFRTLHDFPCSEICFEIGEYFRLRGDCEEAGNWYKMAIEETEPVIDIRRGGTLAEERLRELHKTH

SEQ ID NO: 4994 - protein, 247 aa, Unknown
  Description of Unknown: Candidatus Roizmanbacteria bacterium GW2011_GWA2_37_7 sequence
MISTVIIAKNEEKHIAACIQSVSFTDEIIVIDNGSSDKTTDIAQHLSARVIDMSDIQDFSKLRTRGIEEAQNNWILFVDADEILSTELQSSIIKEIQNPKYVIYYLKRRDHWWGRVLRYGEIQSAYSKGFIRFIRRGTGQWSGAVHEVYKTSKKAGHLSGFIDHYPHVTLHEFVDKINIYSSLRAKELHVYGSSSTILEILFMPFLKFVYTYGVCLGFLDGPSGFVYSFLMSFHSFLVRAKLYMMKS

SEQ ID NO: 4995 - protein, 356 aa, Oceanobacillus jeddahense
MIVKNEEEVLRQCLESIKNICDEIIIVDTGSTDKTKQIAGEYTDKVMDFKWIDDFSAARNFAFKQATSPYILWLDADDVLQEADQKKFKKLKDELDESVDAVSMLYHIAFDEFDNPTFSYRRNRLVKRDRNFKWIGPVHEYLEVYGNIISSDIAVTHCKRDKSDPNTANDRNLKIYEKRLERGEEFSPRDLFYYANELKDHSFYQKAVIYYREFLATRKGWVEDEIRACINMAACYRVLGNPEKEIEALALSISYDVPRPEVSCRIGDLYKGRNLFRKAIIWYRLATEIETDDHQGFQQQSYATWYPHLQLCVCYWQAGEKELAEAHNQKAKYYRPHDSQVKYNERFFKEYKEKNS

SEQ ID NO: 4996 - protein, 348 aa, Bacillus manliponensis
MIVRDEEGTIARCLNSVKEIVDEMIIVDTGSVDRTKEIASEYTPHIYNFEWIDDFAAARNFSFSKATQEYILWLDADDVLPGDSRESLKALKKELDRKVDSVSMLYHLTFDVNGNPSYSSRRNRLVKRECNFKWFGKVHEYLAVYGEILRSDIGITHEKEKEWTNRNLKIYESAVARGEELSPRDVYYYANECVDNQKYEEAIVLYEKFLNDGLGWKEDNINAAGKLGDCYEKLEQWQKAIEACIRSFHYDIPRGEICTQLGSIYMVQEKYKEAIYWYKTATEVPVPTDAPFYNPTNYTWVPFLQLCVCHSRLGQQEKAYYYNELAATYVPDHPAIAYNRNYFKSLFE

SEQ ID NO: 4997 - protein, 363 aa, Lysinibacillus macroides
MISISLCMIVKNEEDVIGRCLASVKDVVDEINIVDTGSTDNTKQIVEQFTDRIFDFEWIQHFAAARNFSFQQATKDYILWLDADDVLLEEDREKLMALKKSLAPDIDAVSMNYHLSFDPEGNVDTLIRRYRLVKKEKQFQWIGAVHEYLEVGGRLFDSDIAVSHLPLTHDHSRNISIYKQLIESGTTLTPRDTFYFANELLDHGQFEDAIYYYELFLTSKLGWVEDNIRACYKLADCYSHLHDNENNISAILRSFEYDIPRPEACCRLGYHFMEQGRNYEAIFWYEQALMIKQNPNAPFQHKSFSTWLPHLQLCVLYDRLQQYELAHAHNELASSFIPNDAKILHNKKYFQRILKQQQEDVSS

SEQ ID NO: 4998 - protein, 367 aa, Sporomusa sphaeroides
MTESDKNAQLPITISLCMIVKNEEATIERCLLSAEGIADEIIIVDTGSTDKTKEIVSKFTDKIYDFEWIHDFAAARNYAFSQATQEYILWLDADDVFLAADRELFLNLKTTLSREITVVSMLYNLGFDQYGKVAFQRRRNRLVKRERNFRWVGAVHEYLEVYDRSFNSEIAVTHQPLSHDADRNLKIYELRLQKGEKFSPRDLYYFANELLDHRLFDRAIEYYQKFLETKQGWVEDNISACSKLADCFYNLNDIENQLKYIYQSFQYDVPRAEFCCRLGYYHLINNQLKQAIFWYKLATQAEKPADSWGMVNFKCQTWLPHLQLCVCYSRTGQYQFAFEHNEIAGTFIPEDPRIHQNRTYLKNLLKI

SEQ ID NO: 4999 - protein, 627 aa, Paenibacillus phocaensis
MDKPTVSLCMIVKNEERCIERCLNSVAPLVDEVIIVDTGSSDRTLELVNKYDAKLFYYEWDNHFANARNYAIEQATGEYILQLDADEWIDDPVHELNQRLDKEIYYIPIRNDLGGGLAEVHKFPRLFRNIPELRYEGALHEQINITTNWHRSSAVLSQVTIHHDGYLNQIVNSKGKKERNLKILYAEIKDNPSAFNYFNLGQQYFTMGEYRKAVDAYKKAYNYGGEFTFTKRLLLGMIQSLMLVKQFKDALSIANDSFQLYPDYVEFKYYEGLIYQEIGYLPDAQECFEECIKTGDSDPSVHFNTYEGTGSYLANARLAEIAYMNFNFEQSEAYLNQAISQAPRVMGLLKSYLDFNRNIDARKIFDQITVLWPQNQEVLQQLIYALYQLRHPAIHYFLDRYNVDCDQEVMAFINMVAGDFAAAEEYWTNKQECKEENLRDVLLLSVAQKNKQLLDRYLGTISLRHEEKRALLAFCEMQDIKCGEFSREFREMVYILLSDLLKIQKYEFLDYFTKQFSTPQMRLVLAQVLYDYGFYEILLEVLVQGSNQEDKFHINLLAAKTLRHLNSWEDSLYYYQEAYKIKPNSEVAFHICNLAIHLNDVDTIKFILGKMMDWDVVSTWMKHQLFN

SEQ ID NO: 5000 - protein, 228 aa, Unknown
  Description of Unknown: Microgenomates group bacterium GW2011_GWF2_47_9 sequence
MKTMLSAIIVTASRKNAARAIKSCAFADEVVVIEKPSISDYAAARNEGIKKSRGEWVLFVDADETVPPELAKEIAHKITSTIYTSYYLKRLDTFLGRTLYHGENGALKIIRLAKRTAGTFSRPIHEVWQVKGRIGTLHHPLIHYPHPSLAVFLDKINRYSSLEAEYRHSRKIKSSLFHILFFPPAKFIKNYLLLAGFLDGMPGAVMAIMMSLHSFLTWTKLYLLPKGR

SEQ ID NO: 5001 - protein, 428 aa, Bacillus sp.
MQNKFPSEFHKQCLKHITKCDSTIFDNLLKGFALNSDLLFSANLMVRNEEDCIERCLNSIIPFFDEIVIVDTGSTDKTIEIIESINSSKIRLYYHKWNENFSEIRNYMLEKSTGDIIFTIDADEFISDNINVYEFKKTISYIISILDDEVVISPTIIDSTKEKYDSLARIFKNSSSFYFYGCVHEELRRIDNIPLKAVSLDFTLFHDGYESKKIIGKNKSDRNIVLLKKTLKMERNNFRWSFFLMRDLYIFKKFDDELLFLANNCIKKIQTGNTNTKPYERAAYVYIALIFIHFGKIDECENIVKLLNSSYPNNADSLYIEMILDEKKLISANKKIEERMFCLKTVENSDSILNIRKAVLISRFFSVKLQLLNFGNFFPLLYEVDGELAQKIIIETEKMVNVLQEECMKVEDSDIYYTNLINDGCYSG

SEQ ID NO: 5002 - protein, 360 aa, Paenibacillus sp.
MIVKNEEKTLARCLSSIAPAVDEIIIVDTGSTDATREIAADFTDRVESFTWVDDFAAARNFAFSLATKPYMMWLDADDVLEVSELHKLKALKHQLDDTVDSVSMDYHLSFDEYGNVVNKLRRNRIVKRERNFQWIGAVHEYLEVYGNIIHSDVIVTHKSLGHDSDRNLTMYENRLRRGEVFTPRDLFYYANELKDNGRYDSAIRYYDKFLATGKGWIEDNILACGRLADCYHELNEPRNMMDSVLRSFYYDKPRAEFCCRLGYYFLQRDELQMAVYWYKQALHVEHTDTTGWGFANIACSTWLPQLQLCVCYDRLGDYESAYRHNEQAASYRPEDERMIANREYLSQRLSKKDEGGIVLV

SEQ ID NO: 5003 - protein, 372 aa, Sporomusa acidovorans
MPDSAKQSHLPITISLCMIVKNEEATIERCLRSVEQIVDEIIIVDTGSTDKTKELVRQFTEKIFDFEWIDDFAAARNYAFSKATQEYILWLDADDVILDQDCQKLLELKATLSREFEVLTMLYYLSFDTDGNVLYQIRRERLVKREKNYQWIGAVHEFLAAKGSQLDTEIAVAHKPVKHDSDRNLKIYERRQLQGEEFSPRDLYYYANELREHNLYNRAIEYYQKSLATKQGALEDNIAACASLADCFYELHDGENELKYIYQSFQYSTPRSDFCCRLGFHHLNNNQIKQAIFWYTLATQLKTANSSWGLVNNQCATWLPYLQLCVCYSRLGDYQLAYEHNEKAAKFIPDNPMIHHNRKLLQSKLNIEPSKE

SEQ ID NO: 5004 - protein, 248 aa, Unknown
  Description of Unknown: Flavobacteriales bacterium sequence
  MOD_RES (190)..(190): Any amino acid
  MOD_RES (227)..(227): Any amino acid
MHEISAVIITLNEEKNIGRCIDSIRDVADEIIVADSFSADKTKEICETKGVQFFQREWEGYSKTKNWANEQARFEYILSIDADEELSNELKNSILQEKEKGLGGIYEFNRMTNYCGKWIRHCGWYPDKKTRLFPKEGAVWEGGFVHEDINFVRHPDKKWLKGDLLHYSYYTTQDHIERIEKYSELAAQAXLSQGKNPSIFKLVFSSFFKFFKTYFIALGFLDGIAGXNIAWYSGKAVYLKYKKARANG

SEQ ID NO: 5005 - protein, 312 aa, Unknown
  Description of Unknown: Comamonadaceae bacterium SYSU G00088 sequence
MHEPITALILTFNEEKHIDRCLRSLSGVVSQVVVIDSGSTDRTVEICREHGVEVYTNPWKNYSSQFNWGLDHCDIRGAWCLRIDADEYLSEPLRGALRDRVAAGLVPDAVTGLYVHRVMVFMGRAIRWGGCGGLYMLRLFRTGRGRCEERWMDEHIVLDGGATGRLPGELIDQNLNNIGWWVAKHNGYATREAIDLLNLKYRFDTCSAHNAIGGHSQAARKRWFKERVYAHLWPGLRASLYFLFRYFGLLGFLDGYPGFVFHFMQGFWYRFLVDLKVGELERRAKRTGVPIEEVVMIEYGIRLCRSTDSPCR

SEQ ID NO: 5006 - protein, 362 aa, Lysinibacillus sphaericus
MVSISLCMIVKNEEDVIGRCLESVKDLVDEINIVDTGSTDRTKQIVAQFTDRIFDFEWIHHFAAARNYSFQQATMDYILWLDADDVFLEEDQEKFKALKSSLSPTIDAVSMNYNLSFDSEGNVDALIRRNRLVKKEKSFQWIGAVHEYLEVGGELIESDIAVSHLPLTHDHSRNITIYKTLVESGETLSPRDTFYFANELLDHGQFEEAIYYYELFLTSKLGWVEDNIRACFKLADCYSNLNDPENNFSAILRSFEYDVPRPEACCRLGYHFMEQYKNYEAIFWYEQALIIKQNPNAPFQNKSFSTWLPHLQLCVLFDRLQQYELANAHNELAGSFIPNDAKVLHNKKYFEQTLKSNQTDCQ

SEQ ID NO: 5007 - protein, 306 aa, Unknown
  Description of Unknown: Candidatus Levybacteria bacterium GW2011_GWA2_37_36 sequence
MNKKNTLSVVVSVFSGEKVLDECLRSVSWIKEIIVVNNSSTDKTLEIARKYTDKIFTRPNNLMLNVNKNFGFSKASSDWILSLDADERVTPELKAEIESRIKNYESGINGFWIPRKNIIFGKWIEHAGWYPDPQLRLFRNGKGKFPEEHVHEMVKVEGDVGHMKNNIVHHNYESISQFLNKVSTIYGPNEAEQLIKKGYNFDWRDAVRFPVKEFLSRFFAREGYRDGFHGLMLSLLMAFYHLIVFAYIWEKHNFKQINDGEILAETKKEIAKASKDLFFWFSKEEAKFIKNPLKQIFHKILRKIKP

SEQ ID NO: 5008 - protein, 358 aa, Clostridium symbiosum
MATVSLCMIVKNEEKVLGRCLDSAKEIADEIIIVDTGSTDRTKEIAAEYTEKIYDFKWNDDFSAARNESFRKATKDYCMWLDADDVIPEREQQKIKKLKEQLTPDVSAVMMKYVTAFDDTGKPAFLFDRERLLKNGDGYLWGGRVHEAVAVRGKVLYSDAVIEHHSIKKEYSDRNLRIYERMIEEGEELEPRHQFYYGRELYYHGRNEDAVRIFETFLRDREKGAWLENLVDACRFCALCFYRMGKREEALEKLFWTFSYDVPRPQICCDIGKHFLDENRLKEAEFWYRQAMQTSYEPIPGAFVEPEYREFIPAIQLAVCLDRQGKYVEAARYNELASYYKPDSEAVKQNRIYFEGLK

SEQ ID NO: 5009 - protein, 362 aa, Paenibacillus sp.
MITISLCLIVKNEENSLGRCLGSVHDLVDEIVIVDTGSTDRTKEIAASFNARLFDFEWIHNFAAARNYAFDQATMEYIFWLDADDVLEEKDRVLLRELKATPDFDYDSVTMHYHLSFDASGKVTSSLRRNRLVKRSCGFRWHGIVHEYLAVGGRIMDSAIAVTHRKDVPHTSRNLDIYRNQQKAGVPFSPRDQYYFANELRDHGHYAEAAGMYERFLSGKQGWVEDNINGCYKLADCYAHLEEKEKQLASLLRALTYDKPRAELCCKLGDWFQQAGNWEVAIHWYQTATMLKLPENSWGAIDHAAWTWLPHLQLCVCYDRLGKRDKAYLHHELCKMHVPDHPSVKFNEAYFQKLGYPHQGGA

SEQ ID NO: 5010 - protein, 275 aa, Unknown
  Description of Unknown: Acidobacteria bacterium sequence
MTLSVVIITHNEEANIGRTLLSVQPLVSDGKGEIIVVDSGSTDGTVEIAELFGARVFVEKWKGYAAQKNSAIEKATGDWILSLDADEEVDEDLRGALRHYILGDSTTTVKDGVPNYQTSWFATTITGLLIHRKNYFLGRWIKHGGFWPDPKLRLFRRGAGRFEDRAVHETLQVPGGGRQFPRGALIHRSYPTLSDYLDHMNRYSSLGAEMVNAKGPVRFSAFNIVVRPAATFIYNYFFRLGFLDGREGLLLHLYHAAYVSWKYAKAWELRNNRSV

SEQ ID NO: 5011 - protein, 258 aa, Unknown
  Description of Unknown: Candidatus Woesebacteria bacterium GW2011_GWA1_39_21 sequence
MVNNKQISAIVIAKNVEKKIGKFLESLRWADELVVIDTGSTDKTKETASKHNAKVYTFAKGSFPDWRNYGREKANCDFLFYLDTDEVVNDELKSEILETVKNWPAGVACFAIPRKNVIFGKVMMHGGWYPDYVIRLFEKGRLIRWVGDLHEQPQYRGGLKYTKNTIIHYKENSLAEMLEKTNKRSEIEARLMFDANHPPMTVLRFMTAMCREFFFRFVKNAAFLDGRKGIIMGIYQVYSRFISYAKLWEMQMKNEKKD

SEQ ID NO: 5012 - protein, 265 aa, Leptospira fletcheri
MPLPISACIITLNEEDNISRCLSSLKFVDEIIVLDSGSKDRTKELAENFGAKFVFREFDDYVGQKNHVISLARNAWILSVDADEEISPDLEAEIREVLGGREPDEDGYSIPRLTMYMGKWIRHGGWYPNRRVRLFRKSKGRFIGEKVHESVKLDGKMGKLKNPVLHYSYQNLFDHVNFINSYSELAATEKFAKGKRSGLFLALAEAGYKSFWMYFVRCGFLDGRRGLILAVMGFYYNFLKYTKIFEMFLAEQIGKNTKKKGSKQD

SEQ ID NO: 5013 - protein, 370 aa, Unknown
  Description of Unknown: Peptococcaceae bacterium BRH_c4a sequence
MKKISISLCMIVKNEENTIARCLNSVQDIADEIVIVDTGSTDRTKEIVGRYTDKIYDFPWIDDFAAARNHAFSHATMEYILWLDADDVLSELDRLKFLTLKKNLDPLMDAVNMPYHLSFDQFGNVTFSLRRNRLLKRSRNFKWTGAVHEYIEVNGPILNSDIAVTHKGEAHDANRNLNIYEKRLARGESFTPRDLYYFANELNDHRQYERAVVYYKKFLDTGEGWVEDQISACGKIADCFQNLGDHENEHAYLYRSFEYDIPRAEFCCRIGFNNLQAGRYKQAVFWYKQATELERPLDSWGRMFPACWTWLPHLQLCVCYDRLGKYELAYKHNEIARTFRPEDPKVIYNKNYLEGVLGIGASKKNEIPNE

SEQ ID NO: 5014 - protein, 253 aa, Succinivibrio dextrinosolvens
MNKLPLSVIILTHNEEDNIRDCIESALFADEILVLNNDSHDKTVEIAQSLGAKVIERDLNNDFSAQRNFGIENAKHDWIFMLDADERITEELAHDIKICVEVNKDICYQVSRENHFMQGKVLHGVLRPDNVERLFKKEGSFYEGIIHERLHSPYPKQKLKGRLIHYPYKTWEIHLDKTNRYSTLLAQKYHDKGKTCGFASIMFKPLWAFIKMYIIHGGFLDGKLGFEFCVAHYFYTMEKYLKLYSLNKYKGRI

SEQ ID NO: 5015 - protein, 355 aa, Clostridium sp.
MTPVSICIIAKNEEKNMDKFLSSIQKSMKNYPHEIVIVDTGSSDSTLEIIQKYNVKLFHFEWCNDFSAARNYSLQCASFQWVLVLDCDEFITHIDVSCFDKLSRNFPKSVGLITRNNHCWSGNNDRIYTDEVNRLFHKNSFHYEEIIHEQLVSNDGQPYQMLQVPITVDHVGYIGSSDELHAKALRNNQLLFKMLEKNPNDPYVYFQIGQSFNLIDDSENAYKYYKKGLEFDIDPSLEYVHLMILGYGESMLELGKYQEALTLESVQDVFDVSPEFACLMGRIYRLNGQYINAMKEFLKATTYSTADLEGSNTYIPLYQMGYINELMGQTEEAKKLYQNCGNYPAALERLTLLLK

SEQ ID NO: 5016 - protein, 273 aa, Unknown
  Description of Unknown: Rhodospirillaceae bacterium sequence
MGDLGKTISAVVIAENEAGIIKRCLDALSFCDEIVLVDGGSTDGTQDIAKACGARVIEHSSSEKGIHFNKNLGAEEAKNDWILSIDADEVVSQKLAEEIRNVAERAAVTGNECFRIPRKTYFLGKWIKHSGWWPGYVIRLWKKGHTEWPLEVHGVPQANGPMGTIQNPLDHFSYESISDWVRKADHFSGCEAEEAINRGEAIEGRRLLMGLTIYPAAAFLRKMTVGQAYKDGIHGIVVAGSAAFAAWLRAAKAWEVNETGRHHNLGGREKLDR

SEQ ID NO: 5017 - protein, 252 aa, Veillonella atypica
MATVTVIILAKNEEQNIRDCIETVQFADEVLVIDDGSTDKTIEIAESMGARVIHHAMNGDWGGQQTFGIKQAKSKWILFLDADERISKELANNIIKAVQKDEPKAFWMQRRNKFHHNKATHGVLRPDYVLRLMPAEGSYVEGYVHPAIITPYEEDKLKGPMYHFTYDNWHQYFNKFNNYTTLAAEKYKDAGKSCSFIKDIMIRPAWAFFKVYILDRGFLDGKMGFILSVNHYFYTMIKYVKLYYLLKSNGKL

SEQ ID NO: 5018 - protein, 640 aa, Unknown
  Description of Unknown: uncultured Sporomusa sp. sequence
MKISACMIAKNEEKVIARCIESYREAVDEIIVVDTGSTDQTVAIAKSLGAKVFYFQWIDDFSAAKNYALSKAKGDWIVFLDADEYFANGTGSNIRPFLKKLDKDFGGVACRMHNFNEVSGKITSEITHIRIFKNAKHLRYINPIHEKLNYRRQGAKLQVYVADRQELIIHHTGYSTNISKEKAERNLALLLKQLDGDTAAKPEYYYYIADTYFALEEYDKVIRYIRLFLATGDKIANLNTRAHGILIDAMKNLKYPSNEIREEVAIAAGKFPQNPFFRFYQAQFLYEDKCYDAAWLEVRQARQLHETYKDIEMNLMPANLGSLYNMLGAISEFKGDYGAAVGYYLDALKWDKYEATAFDRLIKLVRTQPLAEIVAFLNTVYDLDKEADLDFLATSLINQAVPQVLAYYTALREKKYPKQDYVVLQMLVANRHYDKAFVAISECYERDKDERLALVAAAAASLSGNRDYIARVVQQLPPTYGKILEAYQGDSILFDKDDKAAFIKLVRIFILWADDEARQKLLSLADRFPDNMNAAVGYLFLQEGHYQTSLIYFNIAVQNSLHAGVLVHPILYYNQAYCLHRLNNPIAAATAFVKAYEAGYRANDIYEYLQWNVGKLDDGSLKARIEEILRTEVEKNAIVH

SEQ ID NO: 5019 - protein, 583 aa, Unknown
  Description of Unknown: Candidatus Brocadia caroliniensis sequence
MMDKERQTARDKNRPSISACMIVKNEEKFLSQCLTSIKGAVNEIIIVDTGSTDKTVEIAHSFGASVYHHPWNNSFSEARNHSLKYAKGDWILQIDADEALEQADIPLLQKLINDDLYNVIFVAIYNELPGGYAKHYFQRIFRKGKAHFEGIVHNQLIFEGKALQSEIRFYHYGYNLSGQDMQKKYKRTGDLLRQQLAENPDNLFILANLVRNYRNEYDFDKVIALAENGLEISSSKTDLVSKNQRQRLSIDLAHALLNKNQIDRAVLVCKKALTENSDSFDILLVLGEVFMKKGVYHDALPCFKKYLILKEKENREPAFSLLSSDFYHYEPTVYSHIGECYRHLGQIHEAIVAYKNAIKSNNKNPLYYSNLIDLYLSQDSLNDAKDLAFAAIKSGITNHLTYLLLGKIYALEGKIDDAIDACKQSIRIDNANIPAQVYLINLLIEGHLLEEATETIKNMLSLYPEEFAFLCLLERVKYRKGNRESPLSFVKNILQSDPSDQLIYLQLGDLCMEMEQYTTAIEVLEKYLKNTSSADAKVIANIAVCYAKQGKLKPALFGFQAALKLDPNCRCAVQNLAALKIHA

SEQ ID NO: 5020 - protein, 253 aa, Unknown
  Description of Unknown: Candidatus Woesebacteria bacterium GW2011_GWA1_39_12 sequence
MKKLRTLSAVVLTKNQEKNIVECIKSLTFCDEVLVIDDNSIDKTIYLARSNGAKVFSRSLNNDFSSQRNFGLEKAKGEWVLFLDADEKVSDELQKEILRELNLKDNPYTGYYFRRSDFIWGRELKFGETGNIKLLRLAKKGSGKWKRKVHEVWQIEGRIKTLRNPLIHHPHQTLSEFIADINFHTNLDISAKIQEGKRSSLLKIIYWPIAKFKLNWLLRLGFLDETQGFVIAILMSFHSFLSWSKLWQNQKKN

SEQ ID NO: 5021 - protein, 343 aa, Celeribacter ethanolicus
MDRLPRQPSADPETARKISKGTPMTETLTALILTFNEEKHIERCIRSLDGIAERVCVIDSYSTDRTVEIAKSLGAEIVQNAWHGHAAQFQWGLNTLGICSDWTLRIDADEYLDEELRESMSAWLAAPQSTINGVYLRRQIVFLEQPILHGFFYPLNILRLWRSGEGRMEQRRMDEHVILKSPNTTVLKGGDLVDHNLNDLSWWIAKHNTYATLEMISRVEARHIKEASEEVLTGQAARKRWLKEQVYARLPATLRASFYFAYRYVIGRGFLDGKAGFFFHFLQAYWYRTLVEAKYFELQQRAKTAGLTPYAMLQKEGVFPSENEAAVYREGKMEGKNGETAPS

SEQ ID NO: 5022 - protein, 361 aa, Desulfosporosinus hippei
MITITLCMIVKNEEDTLDRCLQSVGDVVDEVIIVDTGSTDRTKEIAGKWTTNVLDFAWIDDFAAARNFSFSNATMDYILWLDADDILLPEDSQKLSRLKQFMSPELDAVSMMYHCDFDDQGNVTLKVRRTRLVKRAKNYPWKGVVHEDLVIKDGTCYDSDIVVTHRKNHASYDPDRNIKIYERLIAQGKEFAPRDMLHYAMELHQHRSYQKAIEFYLQFMEMKEISDEDRIYGCSKLADCYHYLENRKKEREYIFRSMEYDTPRSEFCCRLGYYFLEKSQFSQAAFWYKLATELSATNNLWAIQNHASRTWLPHMQLGLCYYQLGEYELSYHHNKIALSYRPTDQSIISNVKLVEEIINKK

SEQ ID NO: 5023 - protein, 256 aa, Unknown
  Description of Unknown: Planctomycetes bacterium sequence
MKPRISATIICMNEEKHIRACLESVAWCDEIVVVDSGSTDKTVEIAKEFTPKVIHHDWPGFVGQVNFALSQATGDWVLCIDADERCSPGLKEAIQRVLPELDGLGGFELKRHTWYMGRWINHGGWYPDWKARFVKREGTQCVGHEPHYRLVPVGPVQKLDADIYHYTYDNFKDQLRTVDKYSDVVSKDMQDKGDTFRLLKAVFHPWAKFMGCYFWKLGFLDGWAGLVIAVTSAFYVFAKYVKLRERVDPQGTRSLP

SEQ ID NO: 5024 - protein, 288 aa, Pedobacter sp.
MLDRSLSIIILSFNEEKNIEACLQSILALNCPIFLVDSGSTDQTLGIVEKYPVQVFHHPFENYGAQRNWAFEHLPIQTPWILNMDADHRITPELAIELLQIFSNTISEEIKGFLISRRTLFMGKWMKYGGHYPVYHAILFRKGFGKCEDKLYDQHFVVEGTCETIKTDMIDTLTDSLQSFTERHNRWSTLEAEDQFYGYAAKNTAQLVQAKANGNAQQRRRYAKSLYEKFPLFIRPFVYFIIRYFIKLGFLDGGRGLIFHFLQGFWFRFLVDAKIYELKKKRLGEMKR

SEQ ID NO: 5025 - protein, 305 aa, Pseudovibrio sp.
MRPDISSQSKIISIAEKRAQQGAATTDGRADEKRIPLSVFIIAKNEEERIGRTIASCIQWADEVIVIDSGSTDQTVTVAQRMGARVLHNDWNGYGLQKRFGEDQCRHDWILNIDADEVVTPALRDEILGLFQTSVLANYDFWEVDIRDVWPHEETAARHAFSHKQIRLYRKSIGRFSASSVHDTVRPPSTAKIGMLKGHMDHRSIPSITFHYDKMNRYSTMQVQEMRGRGRRLPRYRLLFEFPLAFLKGYLVRGYCRYGWWGLIASTNYAVSRYLRLAKFVEAELMEQSGRPAKHPSPSAQHKKA

SEQ ID NO: 5026 - protein, 251 aa, Sutterella sp.
MLSALICAKNEINNIEACIQTLAFADEVVVIDDHSTDETVSKARSCGAKVFVRSMNGDWSSQRNFGINRCNGDWVLVVDADERVTQELADSVLEKINKGEKKAYEVRRNNCFRFNKATHGILRPDWVVRLFPKDNSEYIGLVHEKLETPYSKEKINDGVLLHFTYDNWDSYFGKFDRYTRLMAKQNYSDGKRAHFFLDIVLRPVWAFFKVYFLNMGFLDGRLGFIFSVNHYFYTMTKYVRLYYLDKNDGKL

SEQ ID NO: 5027 - protein, 605 aa, Clostridium tyrobutyricum
MKISACMICKNEEKNIEKCINSYKKIVDEIVVVDTGSEDNTVYLAKKLGAKVYDFKWIDDFAAAKNYAIDKAIGEWIIFLDADEYFDKDSSYKIENILKSINNKEYDAVGCKLIDIDDCEKKIIDTFMQIRIFRNNINIRYKNSIHETLSKEHGNLELISYYDELKIYHTGYAQSISKIKARRNLKLLKREANKQVNNKNLYRYFCDCYFSLGDYENALKYAELHMNSDIKLVGYQSRILKVIIDSMWKLKKPKKEIEDKIKYGIRTFPNHPNFYCSYAFFLIDEKRFEEALNNFLLTVKYNSSYKGIEVNLVTGIISTVYEKIGFIYNLKNCEEKAIEYFFKSLEFNKYSKDTFESLYNLIKKEKTEDIILFLNSIYDINSEKDIHFIVDQLVRIKPRGVLAYYTNIWYRKFKNEDISMIFMLLSEKKYETAFKLFLKAYSNKYENSDALFSIISSMLLNNVDRIKYLSDMVRPSLKRILKNYIDEENVIYKEDIEDYISILRELILLDNSNVLNKYLKLSNRFSINIDNKIGAVFMNNLLYEQALQYYKSYNDFNENKNTLMNIGYCSYKLRNYKKAYIYIQRAIEMGYNENDAFEILNWIKV

SEQ ID NO: 5028 - protein, 310 aa, Spirosoma panaciterrae
MTDVSVIILTHNEEKHIARCLDSLLPFTDKIFIVDSFSTDRTVEIARSMGAVVVQNAWVNYATQFNYGIEHTPFQTAWLMRMDADEYVMPELASEINQRLNTLPDPIGGVYVKRRVFFLNRWIRYGGFYPIWLLRLWRRGDGFCEQVWHDEHIKLTKGEPIHFDHDIVDHNLNNLTWWTQKHNHYTILEMINLLNYRHQFDQAEKVQPRFFGTQDQRIRFLKEMYASMPYFTRPILYFVYRYFIRLGFLDGRPGFVWCFLQGLWYRFLVDAKLLELDIRIGNDKEAIINYFKTEYGKDLRAIRPQQVTQS

SEQ ID NO: 5029 - protein, 367 aa, Paenibacillus macquariensis
MITISLCLIVKNEEKTLDRCLSSVSNLVDEIIIVDTGSTDLTKTVARKYTEKLYDFKWIQDFAAARNYAFAQATKDYILWLDADDVVKEEDAIRFKVLKETLDPSVDSVTMKYLLGFDSFGNVTSSNRRNRLVKRSNHFRWIGAVHEYLEVSGNIFNSDVAVTHSSIHHDSDRNLNIYEQRLSKGEQFSPRDLYYFANELLDHRMYERAITFYEKFLDTKEGWIEDNISACGKLSDCYNGLNNKQKELESALRSFQYDSPRAEFCCRIGYHFLHKGQINNAIYWYDTATKLEPASNNLGFQNLSCSTWLPHLQLCVCYDRIGNYQLAYEHNEEARKYRSDDPSILQNKTYLEAILCKTEEAPPGESL

SEQ ID NO: 5030 - protein, 654 aa, Pelosinus sp.
MSTRISLCMIAKNEEHNIGRCLRSVKGVVDEIIVVDTGSSDKTCQIAQGFGAKVRSFIWNDNFSDARNASLDLATGDWILFLDADEELAKKSRAILRQAVLQPGVEGYFIKIVNVAGNDSCPETNADTVFRLFRNRPDYRFRGAVHEQICNVIIEKKGQVQFPFIEDLIINHYGYLNSEIEGKDKKRRNRALLEKELINNPDDCLVRFHYAVELFRMGENLSAAQEFERISTIVNPKEVIYGPRLMRYIALAYYGANELPTALTAVQRGLALFPDYADLYYYGGALYYQLKEYGLSYEYFQKAIEALDQPVYYATGSGIQGFRSYYYLGQIAEKFCNEEEALRYYIESLRDNSSFPAALESIMGILQPRENPDYTKYAIGKICDVSVPQAKLLMGNLLFRYAAYGLALEYFEDVPETLVTNELLLYKAICLMQQRRGLEALTVLELIERSDSFNPNVKFNKLLCFWLEDNRQKVWEFGGELLSSGLTEDTATVVELLRNSHADKTPKVLGREGMTPILEALSRALDLGEYNRCTLLLSGISPQSLRNYYLTLGELFYRYRHLELAEQYLCQYIEENSGGERAYFLLAEIKQSQGAYFAAIDYYQQAMQFAPQEPKYYVKLIKLYEKVRSELLKQATEKYPQFPILATLLEETRA

SEQ ID NO: 5031 - protein, 272 aa, Rhizobium sp.
MQHSFPISAYVICLNEEPYIGSCIESLAGFAEIVIVDSGSTDGTASLVQSFIDRGWPIKFMYEPWRGYAGQKQFALEQCTQPWCFNIDADERLDDDLRSVLPDLIDAPLSVVGWRFARRPYLIGYGYTPANVRERKNLRLIRNSMGSYDLAQKVHEGIVAKGQVQNSKRGSLLHYRPLIMDEQILKENRYSTLKADQKIEEGARPKLYKIWFSPLVYFGRLYFHNGLWRCGTPGFIEAATGGVYAFLTEVKIYQRFTLLRRQNFDNSNSRGV

SEQ ID NO: 5032 - protein, 365 aa, Bacillus cereus
MITISLCMIVKNEEANLEQCLQSIEEIVDEIIIVDTGSTDRTKEIALKWTPHVFDFEWSNDFAAARNYSFQQATKDYIFWLDADDVLLPQDRQKLLELKNSADGTMDAVSMIYHTLFDEHNNVITSTNRLRLLRRSKNFKWTGMVHEDVNTSGNYSCYSSDVVVTHTKKDGFSNRNLEIYEMAVKEGKKFSAQDLFHYARELQVHKRYEEAVQYHNLFLASKDISTELKVFTYHNLASCYYQLGEFEKELELTLETFKYDTPQPVFCCRMGEYFIKKEQFRQAIFWYLLAVEDGQENEKNQIEQHIYKTWLPHKQLGLCYYRIGDYKHSYIHNKKVLTYLPDDQATLSNLENLEEVLSEQGVQIP

SEQ ID NO: 5033 - protein, 300 aa, Prevotella stercorea
MGNTIAAIILTKDEEKHIERCIRSLQGVCEEVFVIDCYSKDNTKAIAESLGAKVYEHPWKNYATQFNWGLHNCPITADWVWRIDADEYLDKGLGENVKKAISECGDDVNGIYVRKRIDFMGRPLMHGGWYPSYHLKVWRRGHGECENRWMDEHIRIFDGRAVTIEQGDQVDANLNNLTWWMEKHNGYATREMADMLMMEYGLDASAQEVVPKFFGTEEQRKRWLKVKYIKAPLFMRPFINFMIRYVLKAGFLDGKEGFIWHFLQGFSYRFLVDAKIFELKKRFGFDKEKIKEYLIDTYMK

SEQ ID NO: 5034 - protein, 373 aa, Paenibacillus sp.
METPVISLCMIVRNEADCIGRCLSSVSPYVDEMIIVDTGSTDDTPAICKEYGAKVLDYTWNEHFAEARNFGLHQARGQWILWLDADEELGEGGELLKQLATEAEYDLFSFELNNYYGTEVDEHHIIQISHPRMFRNGLGFQFRNKIHEALNVEEVFGSGSQMLQRMGNAPVTLWHYGYLESQVQVKDKAKRNLQLLQQALSDNPEDPWLHYHMASECYRLKKLNESFQHTNRSIVAFLSNRLTPPSLLYKLKYSILISVGSYDGAYPAIEKAIMLYPDYVDLVFYKGVVLMQLKKFEAALEAFEQCLEIGDSNLAHLTQKGLGSFQAWHYKGMCQELLKNNPEAKKCYEQALMIYPQHAESIEALNKLKLKSK

SEQ ID NO: 5035 - protein, 359 aa, Bacillus toyonensis
MITISLCMIVKNEEKVLERCLQSVKGIPDEIIIVDTGSTDRTKEIAEKWTPYVYDFKWIDDFSAARNESFRHATKDYILWLDADDVLLEKDKMALQSLKSSLHSEIDAVAMKYHAHFDNQGNVISSAYRFRLLKREKQYRWIGVVHEHIPITERDNTYQSTIVVTHQKENPKRSVRNLNIYEKYVARGGTLTSHDLFHYGRELASNHRYEEAVDIFHQFLDSPHVSDEMRLFIFNELASCYYFLQNIEQEHQITLQSLSYDMPQPVFCCRLGEHFLRQGKVEVAIFWYQLAIQIPVSYSWSVDKNPFRTWLPHKQLGLCYEMKEEDRQALKYYQQVLEFLPDDPEAKQKIQYLQQKMKA

SEQ ID NO: 5036 - protein, 245 aa, Ferrovum sp.
MSLSVIIIAKNESHDIVKCIESVSFADEIIVIDGGSSDDTVAKAQACGAIVHVNSHWQGFGFQKNLALHHATQEWVLSIDADERVSPELKEEIQQVIARQSFTVFRIPRSSSYCGHFMRHGGWWPDYVVRLFKRGDATFSLDRVHERLESDKPLGTLRHPLIHYTYDTLEEVIAKTNHYSTLGADMLFDKGRKASLTIATLKGLWAFIRTYFLRAGFLDGGFGFLLAVSNAQTTFYRYAKLWLKR

SEQ ID NO: 5037 - protein, 355 aa, Brevibacillus sp.
MTKLSLAMIVKNEEKHLERCLQSVRNIVDEMIIVDTGSQDRTIEIAHSFGAKVVHYKWNHNFSEARNVSINHASGEWILILDADEFVLGGQKEKIESFISGKKAVGRVSLISKFEHNGEVRYSTSFLSRLFPRGVFYEGFIHEQVVTDLPHLKTGIEIFHEGYYKTEKSNRNLPILLRQLEVNQSDPYILFHIAKNYKNMGLAEKALEYFVSAYNYRNRNEGYTPLLIVEYLQTLLEARRFSEGLEIINNESDYLSAYPDFHFAVGMFYLDYVSQDVMNRLHFLDDVERSFLTCLEIGDVSNFDSVNGTGSYLALYNLGVLYEVTGDIEKAILCYEDASRFNYAPAEERLALLEI

SEQ ID NO: 5038 - protein, 251 aa, Unknown
  Description of Unknown: Bacteroidetes bacterium sequence
MIRLSAAIIAFNEEKNIGRCIESLLPVADEILVLDSFSNDKTEEICKSYGVRFERMAFKGHVEQKNHAISLATHDHIISLDADEALSDELAVSIKQIKANWQSDAYQMNRLTSYCGKWIRHGGWYPDRKIRIFRRGTGQWGGENPHDRFMPDNPSAAMFIKGDILHYSYYTIEGHLEQVNKFTTIAAQSAFKAGRRSSWLNILFNPKIKFLKDYFFRFGFMDGYYGLVIAAISAHATFIKYIKLKELQKNN

SEQ ID NO: 5039 - protein, 304 aa, Bacteroides finegoldii
MLDITAIVLTFNEELHIKRCIESLSDIVKQICIIDCFSTDRTIEIASHYQNVQVLQHKWENSYSKQFNWGLNNAPIKSKWVLRMDADEYLTDELKAEMMTKIPNLSDDVTACSIVLRHVFMGRILRRGMPVYRQMRLFVYGAAECEARLMDEHIQLTRGRMIELNGEFADDNLNNLSWWAHKHVNYAIREAVDLLDIEYDLTGAARLEKQLTTDALIKRKRKHSYAKKPLFWRSFAYFLYRYIFRFGFLDGKEGFIWHFMQAWWYRALCDAKVYEIKKACGDDKKKMIDLLKEQYNIDLKSVIE

SEQ ID NO: 5040 - protein, 355 aa, Bacillus toyonensis
MVTISLCMIVKNEEGVLNRCLQSVKGIPDEIIIVDTGSTDATKKIAKKWTKQVYDFKWIYDFSAARNEAFSYATKEYIFWLDADDILMPEEVQKLHVLKNALNLHIDAVSMNYHADFDTQGNVTGSVIRNRLFKREKQYQWTGVVHEHIDVAPTDTIWASDVVVTHRPKNNERSVRNLDLYERYLKRGGTLTPHDLFHYGRELSMHERYMDAITVFEQYLETPEIVTDIRLFVLNELASCYFFIQDIQKEEQISVQSLLYDLPQPIFCCRLGEAFLRKGIFQTAIFWYEIALQVPVTYSWSMDKIAFRTWFPHKQLGVCYEQLDELEKAIHHYEQVLTYLPEEESQRKLQKLRKK

SEQ ID NO: 5041 - protein, 415 aa, Paenibacillus nuruki
MGNVIDAIFIVLQVMLAVIGVYQFSFSLFGIVKRKKRPDHAPQKSFAVLVAAHNEETVIGALMENLKNMDYPAELYDVFVICDNCTDGTADIVRSHGMNACVRTNPAERGKGYAIEWMLRELWSMPRQYDGIVMFDADNLADHRFLTEMNNDMCEGARVIQGYIDTKNPEDSWITAAYGVSYWYINRLWQLSRHNLNMANFLGGTGMCFENELLKEIGWGATSLVEDLEFTMRCAEKGIYPRFSYDAKVFDEKPLTFKASSRQRLRWMQGHFTVARRYFFPLLWKSVKEMSIIKFDLALYSVNVYIVLVTFLMTAAMWIDTAILGGPHIATIYNYLPMWVAITAIGANVVTFILAMALEKVKSWKVYLYLLLFPIYGLSWWPITFYAFFTQNNKQWSHTQHTRVVRLEEVQSKQG

SEQ ID NO: 5042 - protein, 275 aa, Unknown
  Description of Unknown: Desulfobacteraceae bacterium sequence
MKINLTAIILTCNEEKNIQGCLKNLNWVSRIVIVDSGSTDHTTKYAEEFGCDVYRNPWKGFANQRNWALQEVGINTEWIIFIDADEVVTSQMREEITAALKSRDCNAFYLCYKVIFLGKWVKYSSGFPVWHPRIVRNGFVHFRESITGHGETWEVNGRAGYIQEPYIHYCFSKGITSWFEKHNRLSTMEMEVSISDRKPFLKCIMGLLNQDSHKRRQSLRALSYYMPFRPFVRFFYQFILKGGILDGKAGWAYCCLYLAYEIMISVKILERKYSG

SEQ ID NO: 5043 - protein, 355 aa, Unknown
  Description of Unknown: Lachnospiraceae bacterium MD335 sequence
MSKIPISVCIIAKNEERYIEGCLQHLKPFGFEIVVADTGSTDRTKEIAEKYADKVVDFEWIDDFAAARNFCAEHASNNWILALDCDEYMDSFDIAKVRILMQRFVKSVGRFQLKNLLKGNDGRDRFTVDDVIRFYNKKRFKWENAIHEQLVHIHDSEDMKYHCFDVPMEVIHHGYNISAEEMQEKQLRNLRLLEKQLESDPDDSYTWFQAGQSHFLLHDYEKAVEAYETALSIETNIRRYFVEILIESLAKAYINLDRPQDAIALLLKYGEQFKTAKYSAVLSDAYLQNKDVLKALMNYIRTVSLEDRDTLGDGLLVCYSRIIDIYRGMGQHDMADMYTDLHEKCRLERERIINK

SEQ ID NO: 5044 - protein, 255 aa, Hydrogenobaculum sp.
MLARKISFVILTKNEEKNIKRALESIKDVADEILIVDSGSTDKTIDIAKSYGANVIFNEWVSYPSQVNFGISKAKNDIVFVLDADEELSSELKASLKDFLSSDYEIGLVTRRSFYMGDFLKHVWNNEKLIRVFKKDVCKYTGELHETVVCSSNKTYELKGYLNHYSFKSLKDQFERTLKYAKISADIMCKKNKPFHFYNLIVNPIWIFFKFFILKSGYKEGVKGLIIAFSGMFYVFMKYAFLYECYKSKEKDLWK

SEQ ID NO: 5045 - protein, 295 aa, Xinfangfangia sp.
MPQPETLTAIIMSLNEEQHITRCIESLRPVAERIVVVDSFSTDRTIEIAQRLGAEVLQNRFVSHAHQYQWALDRLGVTSAWILRVDADEYLETVLQQSILEFLADPGAVNAVFLRRKIVFLGRPILHGFFYPLKILRLYRTGQGRMEQRRMDEHITVDTPVCRTLDGDLVDDNLNCLAWWSSKHIGYARKEAWEIIACRQGGQSAPPLSGAARRKRFLKNRVYNRLPSALRSTLYFFYRYVIGLGFLDGKAGFFFHFLQAYWYRTYVDATLYEIERQAAAEGLSAYQMLRRDGIL

SEQ ID NO: 5046 - protein, 304 aa, Bradyrhizobium sp.
MVNLAIIILAYNEELHLARALEGVVGIAKEIFVIDSGSKDRTREIAEVYGAVVIEHPFVNYAKQFQWALENAPITSDWVMRLDADEIVEADLATEIVEKLPTLPREVVGINLKRKLIFMNRTIKHGGRGTLVLLRLWRRGYGRIEDRWMDEHMIIHGGRTVTFEGGFADCNLNNLSFFTDKHNKYATREAIDALNQRLGFMKRDDSLSIEASSHQAAVKRFVKEKFYNRVPFQLSALAYFLYRFVFRLGFLDGKEGAIYHVLQGFWYRFLVGAKLEELSRAIRGHRTPSEIRDTLTRLTGLTLH

SEQ ID NO: 5047 - protein, 257 aa, Unknown
  Description of Unknown: Flavobacterium hydatis sequence
MSQNVIVPKISVLAFCFNEENNIKKLIENVSFAHEIILIDNNSTDKTVAIAKELGATVIIQTTDNKAQQQNLAINQAQNDWILLLDINEYISPELKDEILTKISDPKSNPLYYIKQTLFFFKKKIEHGEFNNKKRIFLFDKKRHSFSSNEESNPSITLFGGSNLLKNRIDSYAYKSFDEYNYQLSLLSKKEALELYAKNVKPNFYHFLMKPFFSFMNQYFIRLGFLDGKEGYILAYINSFAVLKRYLILWLAHNKME

SEQ ID NO: 5048 - protein, 294 aa, Unknown
  Description of Unknown: Candidatus Woesebacteria bacterium GW2011_GWA1_41_7 sequence
MSKLMPNKTLKLSVVLATRNEEENIGRCLASVKDIADEIIVVDEYSTDKTREIAEKYGAKVFTEPHHDIFHITKEKALDKAVGEWILQLDADEVVTPELASEISSVVNSQSLTINHQPLEINSLFTRHQKLIEDRDGKIGKPTGEIVGYFIPRRNMFLGRPLIHAGVYPDGVIRLVKKGFAHFPQKSVHEQISLNGDVSWLSKDLLHYDSPTLKKYLMRLNRYTDLHAGELKNRKAPKNPFYFIYYCLFRPFLVFINLFLRHLGILDGARGFLWSFLSATHFPIAYFKYITGKV

SEQ ID NO: 5049 - protein, 342 aa, Paenibacillus senegalensis
MIVKNEEHTLDKCLSSLNGIPDEIIIVDTGSTDRTKEIAAKWTKHVYDFEWIDDFAAARNASFQYAAKQYIMWLDADDILKPEERDKLEKLKASLGEEIGAVSMKYEIPQDDSGIIMSHTTRLRLVKRDLGFQWHGIVHEDLAVDVPYRYLNSDIIVTHTKTRNVQGPASRRNLDIYERHLARGRELSISDMFHYARECNVHKQYDKAIHYYERCMDSPEVSLENKVFILHKLATCYVLANQPEKELELTLRALTMDIPYPAFSCRMGEHFLKKGHVEAAIFWYRTAYLQPLAERYAWSVVDNAYHTWLPHQQLALCYDVLGDSEQARFHRKQAEAYRSARQ

SEQ ID NO: 5050 - protein, 365 aa, Brevibacillus laterosporus
MATISLCMIVKNEEKSIARCLRSVKGAVDEIIIVDTGSTDKTIKEAKAFTKKIFHFKWVNDFSKARNFSFQQATMDYIMWMDADDVLEEIDRKKLQLYKHKIDPNIDVIIMPYHTSKDEFGNVILPYSRERIIKRTHKHSWVGMVHEYIEYSFGRSFKIDIAVTHRPRQQKNHQRNLQLYENAIADGILLTPRDKYYYANELKDHERYEEAIEIYQKFVNKELPRVEEPELLMEHICFCYERLHLPEEEIRYALKSLEYGLPRAEACCRLGYYWLQKNQPKRALFWYDLATTLTKPKSWGFRKEACWTWLPHLQLCVCYDRLEQFEQAYKHNELARAYRPADPIILGNRAYLTNRLEEVGIPIPS

SEQ ID NO: 5051 - protein, 367 aa, Bacillus jeotgali
MQTISLCMIVRNEEEVLEGCLNSVYPICDEIIIVDTGSTDRTKEIAAKFTDKVFDFKWTDDFSAARNFSFSKASMDFILWLDADDILKEKDFLEFKKLKKELHEAIDGVAMKYDIDFDDDGEPTFSYRRNRLVKRSKQFRWIGPVHEYLEVSGNIIPADIAITHRKSDKKRQVNSSDRNLNIYEKRLKNGEEFTPRDLYYYANELKDHGQYQRATIYYHEFLATKKGWVEDEIRACLNMADCYKKLGDYEKEMKALTSSMNYDVPRPEVSCRIGDIYKNKNQYKKAVIWYRLAVEVEIESDFGFTQKAYSTWYPHLQLCVVYWQLGEIEKSIEHNNLAKKYKPHDRQVLYNEKFFNDYLASEKKGKS

SEQ ID NO: 5052 - protein, 309 aa, Rudanella lutea
MLDLSVIILTHNEEKHIGRCLESLRPMTDKVFIVDSFSTDRTVEIARAMGAVVVQNPWVTYATQFNYGIQHTPFQTAWLMRMDADEYILPELAEEITHRLPALAAQVGGVYVKRRVMFMDRWIRHGGYYPIWLLRLWRRNQGICEQTWMDEHIKLSPINGAPAQTVQFANDLVDHNLNNLTWWTQKHNQYAIREVIDLLNIRHNFEQAERVTPSLTGSQEQRKRYLKERYASLPLFTRPILYFLYRYFVRFGFLDGRRGFVWHFLQGLWYRFLVDAKMLEVYRRAGNDREAIIDFFKTEYGKDLRAGVR

SEQ ID NO: 5053 - protein, 627 aa, Paenibacillus sp.
MKNTVSLCMIVKNEALFIERCLKSVKDEVDEIIIVDTGSTDDTIALAERFGARIYHFPWKNDFASARNYSLQQATCPYILVLDADEYLDESSHIQDILHSQKKGYSIRVRNQLEDGMVKTTSILRVFQSSPSIRFTGQIHEQIMLDSSEIEETGFLIHHVGYRKDVYALKNKAERNIRILLEEVASSPSAYAYYNVGKQYLVDGENELALEFLIKARNEMSYQESIDVLGMEIDYNLADCYYRLHQPEYGIPVLNRTIQQWPEYTDLYFMQARLFEQMGYWKDAEQYFKKCISLGDMDGEVAREGVGGYLAHFLLSRLYESQGNLQGALEHAFHALHLKKDYMPCLENYISLAQKAGVAFEVQKECLNFCYPVKKVDELTTLIGLLYKYRHPLLQEYITQYGIHNDIALTACGLQYSGQYEEARLKWCEVDGLHKNNLEDVILLSLLIDGERMMEKIRTIPLLTEQQIKTIISVIKKENLSQDRVDAFLGQVLLTLCERCIRLGEFDCFEYVSGLIRSCGLDIQYQLALLLDQSGFKDVAFDFMVSVFESQERTAEIEQFVGSRCLERGYREDAKHIFLQLAHTAPSYDVYLSLYELLLLEEAPSQARELLSDMKNRFPLSAVIQSL

SEQ ID NO: 5054 - protein, 369 aa, Ureibacillus thermosphaericus
MPTISLCMIVKNEEEVLANCLSSVEDICDEIIIVDTGSTDRTKEIASKFTDKIYDFTWIDDFSAARNYSFSLATKDYILWLDADDVILPEEQKKFKKLKKNLNSNIDAVSMNYIAATDGNGNPTFHYRRNRLVKRSKGFKWIGPVHEYLAVHGNILEADISIHHKKREKKVDTQSIGRNLRIYENRIKNGEEFSPRDLFYYANELKDHKQYNKAIIYYQEFLDGKKGWIEDNIRACIYMADCYARLGEKENELMALFKTFNYDEPRSEACCRIGDIFQARKDFKTALFWYQLAVKMKHKKTGGFHHTSYTTWYPHLALCVCYWQLGNVEESIKHHELTKQYIPNDPKVLYNEEFFQSYLKNQNRKDSVK

SEQ ID NO: 5055 - protein, 272 aa, Unknown
  Description of Unknown: Microgenomates group bacterium GW2011_GWC1_41_8 sequence
MCHGIIVTETIFPPFSMKKNITLSVALATFNEEKNITRCLNSVKKLGDEIVIVDGGSTDKTVYLARNFTDKIFVTDNPPIFHINKQKAIEKCNGQWILQLDADEEVTSELADEITRTVHAHNDINGYFIARKNFFSNQWMKKGGMYPDYVIRLFRNGKGHFPCKSVHEQIVIDGNVGYLKEPMNHYPYATFQEYLKKADTYTSLTAQELEKNKTSISVISYLKYVVIKPLHTFINLFFRHRGFMDGRRGFIWALFSGLHHAQAYVKYIKNKR

SEQ ID NO: 5056 - protein, 365 aa, Unknown
  Description of Unknown: Flavobacterium sp. ov086 sequence
MVTISLCMIVKNEEDTLANCLNSVKEIVDEIIIVDTGSNDRTKEIAYSFTDKVYDFEWINDFAAARNFAFSKATMDYQLWLDADDIIIEKDKAAFLDLKKTLSPEIDIVLMNYNYVVDNNNNPIYSFHRERLLKRLNNYQWNDPVHEYIEYRDNYLISEIAVTHKKIDAFSDRNLKIYEEQLRKNLPFSSRSLYYYARELRDHKKHIEAIKFFNKFLDTKQGAPGDNINACLEIGKIYKVLGDNDNALKYFFQSFSYDIPRAESCCEIAAIYKENQDYRKAIYWYEHILTLEIPNDASIIMVDSWNFVPAIELAVCYYNNGDIEKAVYYNEMAGKFKDKHESVLHNREFFKKERSKDFFYKEYKH

SEQ ID NO: 5057 - protein, 594 aa, Clostridium homopropionicum
MKNEVSLCMIVKNEEKYLPQCLKSIKDIVDEIIIVDTGSTDRTVDIAKSFGAKVYYFQWNNNFSEARNESLKHATKDWILILDADDELYTKDQENLKDLLTKQLDENAIYFFETLNYYGSTIDDNSITVNLNPRLFKNNQGTHYEGEIHNQLVHSENKYNLIYKFVQIHHYGYMENSISSKNKRNRNITLLKKQIEENPDDVFAYFNLGTEYAALNDERTALEHYYKSFENFDPLNGYSFLLILRIAILNHKIKDYNTSLKFINIGIEHYPKFTDLYFLKSLIFRDTNMPMYQIKALEKCIELGEPSPDLKCFYGVGTFKAYYELGNAYIKLKDYDTAYNYFIEAMKSKPDFIEPIYCIGHILKIQNIPIDDFKKIIEKFFIDSPKSNFIIANLFYNEQYYKTALEYIEKCEKANISTTDLLLLKAKCLVMTGYFNDCINIKCIDEKNSSYLYLNMYKIISSILTNNNVNALSLLSNFKEDTLSGHDKKLLRVYTQFINLFIKKPTLIISEEENEADYLPIILEICEILLINDKFDELAIAVNLLNLVNNKFVLLNLGKLYYKHGYIDLAKKEILRSIKELEVYDKEGLEILMH

SEQ ID NO: 5058 - protein, 252 aa, Unknown
  Description of Unknown: Bradyrhizobiaceae bacterium sequence
MISPKLSLIVITKDEEACIGRCLGSVPCADEIIVIDSGSRDRTVEIAQSLGAKVIVTPDWPGFGPQKARALALANGQWVLSLDADEWLDPSAIAPLLAAMAGATPPAAYRLSRRSRFCGKIIKHSGWSPDYVTRLFQRGQGRFSDDLVHERVIVDGDVRTAAFRIEHDSITSRADAEDKIVRYSSAAAAQMFSRGRRAGSAQASLHGVAAFIKAFVLRAGFLDGAAGWDVANYNRRYAYEKWRRLAELSRSA

SEQ ID NO: 5059 - protein, 396 aa, Hafnia sp.
MKIIIIVVMRFQEAGMRKDYSHLTITAAVIVKNEERCIARCIDSLLPVFDEIIVIDTGSQDATLAILSESKYCQTVKLFQTTWDDDFSKPRNLAIGKAHGGYIFFIDADECVISSKDEVLNEFYKIDALTYKDKIVLCPTIQDHNGNESKSVRRAFINNRKFYFFGVVHEELRLTDNTPPFDAHINVTLSHDGYRSDVIAAKNKKVRNNMLNEKNLVLEPNNLRWAYFYARDKLESTCLNEIYVFLENKIKVDKDIRITRGNIREDNYTFSILDIMVQAKLRLMDFDSDFESLIELMNEFIPYNSNGIYYSLVSDIFRWKVNVRHRVKEIIEYKKDVRIVNNDMLHSGGLHLDSILAIYLYEMGMAQQAKKLLISVKSSGFQTELSENYLNTMLNK

SEQ ID NO: 5060 - protein, 368 aa, Bacillus tequilensis
MKRPKLSVCMIVKNEERHIVRCLESVQHIADEIIVVDTGSNDRTEDICRSFHAKVYHHKWEQDFSKARNAGLQHVKGEWILILDADEELDHDTGSLLPSLLTDDSLPSLGCMKVVNYTGKQWDENEAFEQRQFRLIRNQRNITFTGRVCERPEGEEASAAFSLPCIIHHYGYLEQEAQRKHKRNMSLLNAALLTSSADAFFLYHKAAEYDRGNEQDKALRLSVDSISKCKRKKQIPPPAFYYLKYKLLIDTKRYEEAARDINEALAHYPDYCTLHYYKGIIMYQLKKVREAITAFEACLQADSDNYPYIQVKGAADFRSSCWLGVCYAELHQPMTAVLYVKKALKANPKCSRAQRLFTELTKDQAVHA

SEQ ID NO: 5061 - protein, 593 aa, Unknown
  Description of Unknown: bacterium (Candidatus Blackallbacteria) CG13_big_fil_rev_8_21_14 _2_50_49_14 sequence
MLRPRSSPIPENLPGYHERERSLKQVLIAHDYLSALALCRFQLETLLAPEPLISLHIALMGLGWPVLAERLRVLGHLLFPQRFLPIEPSAQPIETDAPDWLCSWLAPQTPMRLSVCMIVRNAEDTLVTALESIADLADEIIVVDTGSQDQTLALAAAFSPQVKVLQTVWQDDFSLARNLSLRAAQGDWILVLDADERLEPEGSSCLRKLLAFGVMGWNLFVFQQKHLRDQAENSFWVQVGRLFRAHPDLRFHGLLHEQLHRFSFPWYLHQIYLPQVILEHSGNLSAQVEKHQKPLRNLLLDRALALPEYQTPYLWFQKAHVLLEQTVPPALPEARDWLEKALPPSVAGISKIPVSATWSLAPPSLALFYLLKCLYLQQEIPALAQTALNYAEWNLWAEGRALAGWGLSKNDQIVRAKPILGSFFEPGLPALRTDLSLFLRLTLEGLLECALAEQDAWLALAYLKQLLKLRPHPALETIQARLFRLLKLSESDMLSTLRALIAAAYQAENWFELIRYFFVALQWGLPWEADFFVFLLIALQKTGYLQLCAYLARTGSHRFQEPSIFACFCRQSFSRDPDLAELPGQWQWYQLLN

SEQ ID NO: 5062 - protein, 249 aa, Unknown
  Description of Unknown: Tenericutes bacterium sequence
MNLSLVIITLNEEDSVGRCIGSVTFAGEIIVVDSGSTDATVAVAESNGAKLLFHEFQDYSTQKQWAIKQASGDWILSLDADEYLNDELAAEISSIVNSDTAHSGFSLPFRIQYMGRLMRFGPWSGESHVRLFRNGHACFPNAGVHEGLKVSEGTTGDLGKGYVIHESYSSLSHQMEKMLQYSNLWAEEEFTKGRRSGLFKIVFRPAWRFLSAYLLRGGFLEGMPGLVSSIVSAYYVFLKWTILYEMKRH

SEQ ID NO: 5063 - protein, 256 aa, Unknown
  Description of Unknown: Candidatus Gottesmanbacteria bacterium GW2011_GWA1_34_13 sequence
MEEKVNLSIVLATHNEEKNIGECLRLVKNWCKEIIVVDGGSGDKTVTIAKNLGAKVLIVPNLANFHINKQKAIDLATSDWILQLDADERVEEKLKLEIIQVIKNGTFDGYWIPRKNHFLGRFLMKGGVYPDYTMRLYRRGKGKLPQKDVHEQAYVEGEVGYLKTPLIHMSDVNFQRYLLRWNRYTDLIAGDLLTRQFNLVITGINYLIIKPIFWFLNIYVRHKGFMDSWQGFVFAFFSGLRFPMAFIKYLNKKICA

SEQ ID NO: 5064 - protein, 279 aa, Unknown
  Description of Unknown: Candidatus Pacebacteria bacterium CG10_big_fil_rev_8_21_14_0_10 _56_10 sequence
MTHSVAHPSPVSITAVVLARNEAAMIANCLATLKWCDEIIVVDNGSSDDTVALARQQAGVRVVAAQSGSFAELRQLGAKRAKTDWLVYIDADERVTPALADEIKQQLSDSAVQALQFKRDNIMYGRRMRHGNWQKDLVTRAFRRASLQGWSGIVHESPRYQGDTCLLAQPLIHLTHRSTSENLRKTISWTALEAELLYRSELAPVGFLTMLRKGVIEFVRRAWWWGGWRDGSPGLVESLVQGINKILIYIQVWELQRRPTLPEVYDRVEQDVARQWRQR

SEQ ID NO: 5065 - protein, 357 aa, Clostridium beijerinckii
MITVSLCMIVKNEEDVIANCLESIKDIVDEIIIVDTGSQDKTKEIVKKYTPKVYDFKWIDDFAAARNFSFSKATKDYILWLDADDVILPKDAENFKALKKTLDPSIDSVTAKYNIGFDEYGNVTASYRRNRLVKRSNNFKWYGFVHEYLAVGGNIMNSEIAVTHKKLKQTPKRNLEIYQNKLKEGVDFTPRDILYYGNELYDHKMYDESLKYYNKFLDSKQGWFEDNIRVCGKICDYFQSIDNVEEGRKYAYRSFEYDTPRAEACCKIGFSFLHEKKYKQAAFWYEEATKLEKPKDSWGFFNDACWTWLPHLQLCVCYDRLGDKKLAYEHNEIASKFRPNDERMLYNKKYFQGLGFN

SEQ ID NO: 5066 - protein, 301 aa, Polaribacter sp.
MKSSNTISAIILTYNEEQHISRCIASLKNTVDEIFIIDSYSKDNTVAIAENLGAKVYQNAWVNYATQFNWALEHCDIQSEWVWRIDADEYYESKKKIYLKESLANLENDVTGVYIKRKIIFMGKELLYGGWYPVWHLKIWRNGKGFCENRWMDEHIKLTEGTTKQIDLVQVDENLNDLSWWTDKHNGYASREMVDLLDTQYQIFSTSSVTPKLFGTGEQRKRYLKLKYLKLPLFVRPFMYFFYVYVIKLGFLDGKSGFVWYILQAFWYRFLVDAKIYELKKEFNNDEKKIIAHIKEKYQTK

SEQ ID NO: 5067 - protein, 1160 aa, Thermoanaerobacter siderophilus
MKKVLIGTTVRQKPEILKEYLLSLKNLKKQNLKVDYCFIDDNVDPVSKSLLKEFKDNDSIIFILDSKKIDIEYIKDSNTHYWNEELVWKVAENKNMILNMANDKGYDFVFFVDSDIVLHPNTLEHLVSLNKDIVSEIFWTKWEKNSIELPQVWLSDQYNLFYKNRERNVTNETISRQIDEFLNLLKVPGVYKVGGVGACVLISRRAILKGVSYDEIYNISLWGEDRHFSIRAVALGFELYVDTHFPAFHIYRDEDLTRLEKYKKYIKKYKNHIFLPGDRIVKKSHNKLTLSMIVRNEASRYLSNVLRQAAQFITNAVIIDDASTDDTENVCKEILKDIPLIYHKNEYSKFSNEIELRKQLWELTISTNPDWILCLDADELFEGKIVKEINNLINQPVYDVIAFRIYDFWNDKQYREDKYWNAHKRYWPMLVRYQPFFEYRWKETPLHCGRFPVNIIELPIMKSNVRIKHFGWAREEDRINKYKRYLALDKEFKYGIKEQYYSILDKNPNLVDWIEEENTESNQSLSLCLITKDEEKNLARCINSVKDIVDEIVVVDTGSKDKTVEIAESFGAKVIHAKWEDDFSKARNIAIENATGDWILFLDADEEIRKDDVSRIRLLLNDDTVEAYIFKFINYGGTNIANGLTEVHYNFRLFRNNGKLKYIYPIHENLRNVEENRLPIFKKADVTILHYGYLLETRIEKNKTEKYIKLISKYLEEHPDDKFQHGNLAVEYYNAKEYHKALKHLLIATKGMNVNSPIATRLIRYLIATYTALKDYDTALKIANDAKAFYIDIPDFKFLEGMIYAEQKRYEKAIEMFKECVAMGEYNGDFITMGGTGSYRAKYMAALCYEKLNKLNDAVREYIEILKENPSYQEVFIKFFDVLIKNEPPEDVYRFFEKHVDTKNPVNNAILAKLYINLGMFEMAKRYIDNINIDIEGLNSLKGSVYLGLKDYKKAIEYFDMEYGKAKEEATYQKVLCYILLKEMDKAKNLLWEISESSDKKLYMTIVGEMKAKFDDIKDSYFALLDLLISLKEFDLYNDVLNLYVNKFSREEYEKYGQLMIKYGLEELAVEAYIRAANLNSQNSEVYRYLAERALEQGMYDEALSLAANAFNIDRIDVDNYVLIYKIYKTIGKHDEAEEIDRMIKEIYPEINLKDRTGLY

SEQ ID NO: 5068 - protein, 358 aa, Viridibacillus arvi
MVTISLCMIVKNEEEVIGRCLTSVKDIVDEINIVDTGSEDKTKDIVKEYTDRIFDFEWIEDFAAARNYSFQQATSDYILWLDADDIFTDENREKLKILKETLKPSIDAVSMTYNLSHDAEGTVISSLRRYRLVKKDNDFKWVGSVHEFLAVSGNLFDSEVAVSHMPLSHDRNRNIQIYEKMLKDDQPFSARDTFYFANELKDHARYEEAITQYDSFLESKLGWIEDNIRACFNLADCYGFLEDKEMAFKSSLRSLQYDVPRPEACCRIGFHFMEQNKNTEAIHWYEKAISYKNELKLSFQNKSFFTWLPHLQLCVLYHRLNQLKKSYEHNEMALKYNPTNQTIINNKKYFEDNVNLEE

SEQ ID NO: 5069 - protein, 303 aa, Prevotella stercorea
MQRDSRISFVVLTYNEEKHIARCINSLLPFAKEIWVIDSFSTDRTIEIAEGLGAKTVKHPFENQAQQFNWAIRNCEIAGDWIWRVDADECISEECGRKVTEAIATCDEDINGIYVNKAIVFQGHKLKHGGWYPAPQIKVIRKGYGESENKVMDEHLIITSGRTIYVDGDQTDENLNDLTWWTDKHNKYASREAVNMLMMQYEMDADAEGVEAKLFGNDAERKRWLKVRYARMPLFLRPFLYFLVRYIVKLGFLDGKLGFIWYVLQGFWYRFLVDAKIYEMKRDFGFDENKLKAYLNGLCQTSR

SEQ ID NO: 5070 - protein, 258 aa, Unknown
  Description of Unknown: uncultured bacterium sequence
MKKLSVVLAVYNEEESIGRCLESVKDLVDEIVVVDGTSNDRTVEIARRFGARVKITTNKPNFHINKQMAIDMAEGSWILQMDADEVVSPRLASEIKSKIQNPKSEINGYWMPRKNYFLGRFLMKGGQYPDYTLRLYKKGKGRLPQKDVHEQAVVEGKVSYLENALLHYPYKSFSFYLLKWNRYNDLLAGQIREELGNKNKIERIAYAIAYLFIKPSHWLLTTYLRHKGFMDSWQGFVFSFFSALRFPVSFIVYLTSKS

SEQ ID NO: 5071 - protein, 324 aa, Unknown
  Description of Unknown: pseudomallei group sequence
MSHSLFTAPPRSNRLADLTAIILTFNEEKHIERCIRSASEVARCIFVIDSFSDDRTVAIAESFGARVRQHEFVNHAAQLDWALDNLPLNTEWVMRVDADEVITPTLAEQIRAKLPLAAKNVNGFLVCRYPTFMGTIIRHGGFPQWSLRLWRKGTAEIERRWMDEHMVLTTGESERLQGEYIDDNLNNITWWTNKHNGYATREAIDLLNRKYEFLPKLADAGKLASQARLKRWLKDHFYLHLPLGLRAFLLFFYRMSLRLGFLDGMGGGFAFHFLQGFWYRFLADVKVREVERRMHSDNVDCVEAIKRELGIDPICATENNCKSA

SEQ ID NO: 5072 - protein, 288 aa, Unknown
  Description of Unknown: Candidatus Hydrogenedentes bacterium sequence
MTERRRGPSEEKSSNGNAGCPERLPITAVVITENEEERIEACLRSLRFCAEILVVDGGSVDRTVERARPFADRIIEHSASEVGLNGNKNLGAEEARHEWILSVDADEIVPLELADEIRDVLKDPQYDGYEVARRTYLLDCWIRSCGWWPGYVVRLYRKEKVSWPPGVHETPSVPGGAGRLKTPLEHYSFPSIGLYLRKLDHFTRCEAREKWERGERLTAGNAPWHLFFKPMIVFVKKYLFQRGFFDGLAGFFVSVSAALAVFFNYIRLWEIQRTGKIPSQGGRGRSDG

SEQ ID NO: 5073 - protein, 255 aa, Unknown
  Description of Unknown: Fastidiosibacteraceae bacterium SYSU SYW-5 sequence
MMNVMASKDTLGVVVITKNEEKNIARCLQSVKWANEIIVIDSGSTDKTVEIAESFGAKVIIRHWPGDGPQKYFGISQLTTKWCLVLDADEEVTKELAESIQKTIQSGKNTCYKLHRRSFFLGKIIKYGDWGRDWIVRLFIREKHEYTQDIAHSKVNVKKSQASALKGKLIHHTQEDIYLSIKKYNDYSTLSAQMMAKKGKRSSLLKAMLRGHLAFIRSYVLRLGFLDGARGYMIARNIAFGAYLKYLKLTYDIKP

SEQ ID NO: 5074 - protein, 250 aa, Unknown
  Description of Unknown: Candidatus Levybacteria bacterium sequence
MRISAIIIAKNEEKRIAKAIASISFVGEIIVIDNDSNDSTKKISESLGAKVFSFSGDNFSDCRNFGLEKSTGEWILYIDADEIVTDELMQNINFVIQSENLISTYKIKRKNFYLGNNEWPRIEIMERLFRRKFLKKWVGVLHESPIFEGNIAILDGFLLHYSHRNLSEMLVKTLEWSQKEAKLRYDANHPQMKWWRFPRVMIPAFYKSYISQGGWRVGSVGLIESIYQSFSIFITYAKLWELQEKHGVEK

SEQ ID NO: 5075 - protein, 284 aa, Unknown
  Description of Unknown: Bacteroides sequence
MTDITAIILTKNEEVNIERCIKSLSGVADRICVVDSGSTDKTIEIAESLGAEIFHHEPFNHYAAQFNWALDNVGIKTTWVYRIDADEVVTPELAAEIVDACNEHRNDDVNGFVMKFLIAFMGKFLKHGGMYPFYNLTIFKFGKGRYENRAMGEHVILSEGRSLDLKNDCLHYDFKSLDAWINKHNWYATREVADYFSTRAIGQVDPNSLYHEAKKTSKLRDGLYYRMPKYLRAKLYFWYRYYIKLGFLDGKAGYVHAFLQAYWFRFLVDAKIMEQEIKSSHDKK

SEQ ID NO: 5076 - protein, 645 aa, Paenibacillus sp.
MDKLISLCMIVKNEEKTLSRCLDSVQGLVDEIIIVDTGSIDTTKQIAKRYTNQVYDYEWTNDFSAARNESIRRATSEWILILDADEYIERDDIDVLRHYLPTIKNESISRIALTIPITSFVGGGHNVAEGYVARIFPNNSGITFIRPIHEQLSCDSGELEYRSFSFYVYHTGYTQETMLEKNKSQRNLKILEQYSSNHKLEPYDYYTIGNEYKMIKDYENAYINYMNAFKGLSSATPWYVGCLISLIDCLFGLDRMKEVNELIESKLVQWKQYPEYFAIKARWFNQLGFYDEARVQYEEAVQIAEKLSMQNIPFWLISSDYGRIIPFNQLVQYYSRKQDLSQTVFYLIKVLNDRPYHYLSLIKLINLLVQTESIDAILQLLYKLYPNRNSVEIGLLFQVSLEVGNLSLSNHFFGISQEMSIDISPSQMLQFAVLTGDQDKYIQIMKNLDLSSDMKLDIILPLVIASVRWREPDYLLVIANDPTFYQLYILASACINEEELIISPTDEEVDMLMRLFIELFNYKLYEEYDLLLKRVSSSMLINSLANYYYTHHHLELALDYYSILLDSDELNAEGYEHLAHLHLNQGEKDDGLKFLGKASELRPDDIVLYTNMWLNCKDSLTRLKYKNELFRKFPHYVGIPIFNIK

SEQ ID NO: 5077 - protein, 275 aa, Leptospira brenneri
MEGKRKRKLSVAIITFNEEKNIGDCILSIEPIADEIIVLDSLSTDRTKEIATTFPKVKFYESPFPGHVEQKNKAIGFCSNDWILSLDADERADKTLVNSIQVFLESDSTVADGFKIARLTYHLGRWIRFSGWYPLRRFRLFRKKAATWVGENPHDYIELKPGSVGKIMKGDILHYSFTDFSHQITTINQFSSIVAYTRYAKGERFSLAKTILKPLGKFLEIYIFKFGFLDGIPGLWIAIASAFSTFLKFAKLYELDKKHIERPSNIRKEYGKNEK

SEQ ID NO: 5078 - protein, 369 aa, Marininema mesophilum
MIVKDEEDILDRALQSVKGFPDEIIIVDTGSSDNTMEISRKWTEKVFAFEWVEDFSAARNYTFEQATMDYIFWLDADDVVNSNNLKKLIHLKRTLNPSFDAVRMDYHTTFDSYGNVTTTARRIRLIKRKSPFRWIGVVHEDLSWEGKGGNPTILESDIIIIHKKMKPSTEKRNLQIYEKHLAKGLTLTTQDIFHYAQELKGDKQYEKAIGYYEEFLRKKNNSSSWRTFTYNQLATCYHLIGDTKKELEITLQSFAEGLPLPEFCCRLGEHFVKKKEYDAAIFWYELAVNVPCDKNIQGSTSETFRTWFPNKQLALCYLQLGQYSKVYRHYKKALSFRAGDEEMLRNLKLVKELMDKKKEKKRTGRKKKR

SEQ ID NO: 5079 - protein, 627 aa, Bacillus sp.
MKPYLSACLIVKNEEDMLRRCLESLKGGVDEIVIVDTGSTDKTKEIAKEFTDKVYDFEWTNDFAEARNFAGSHATGEWILALDADECVDLENVAAAIEEIKSHNNKFDTYTIDIINFVGERGERSVINKMARIYKNDGTVHFEGAIHEQIVSLKNQRNLAESLLKVYHYGYLSNVVEKKNKRTRNMNIIKKMLQSEKENGFTYFNYGQELRALGKTEEALNAFISAYKYKGDIYKEWVGICLFFIIESLVELKRYDKALVIIKDAEKVLPTAPDFPFWKAEIYFRQKRFDDAREVYTNIVMERQTYKDIVYLVESQALLPYLRLGEIYKYERLDQKALQYYVEALNENSSSLEAIANVIKILSNYHTPKEVYEFLNSRCIIKADDIRIEILKLILDLGLGELALLLTNDFTTQEQLMVSTLQLKAKMILGQELLQFTTEELMYGVKTEVIDVADLAVLYEVTNDARVQNVFENSKFKHVFYSIFNEKKQGKKMKQVEYLPILDKALRFQKPEFAERLISYINIFPKQVYAKVADLFYENGYEEIALEFYELADENHVTKQGYVNIIEYLLAQGNGEEAHRIALEALKKFKKDFRFYKYAIELGQTEQRSIVTKSLQEFPDSNWLKLK

SEQ ID NO: 5080 - protein, 363 aa, Paenibacillus prosopidis
MITISLCMIVKNEEQVLSRCLDTVKDLVDEIIIVDTGSTDRTKEIAANYTTHIFHFDWIDDFSAARNYSFRHAAGDYILWLDADDWLQESDQEKFKALKQTLDPNVDSVCMDYYVAFDPLGQPTAVIKRNRLVKRSRQFQWHDPVHEQLEVEGRIIFADIAVSHGRVHTNTERNLSIYEGLLAQGGILSSRQLLQYAMELTANGYYEKAIGIYQTIISDPTSYFEDKLQSCDRMAHCNHELGNKEQELQSLLKTFNYDIPRADYVCRIAYYFQENSDFEKAVCWYQLALKLEKPKKRLFGMNTMAWTWFPHLQLVACYGKLGQLEQAYEHNEIALSYAPNDPNVLNNKKLLEAALRKRRSEDA

SEQ ID NO: 5081 - protein, 371 aa, Unknown
  Description of Unknown: Candidatus Woesearchaeota archaeon CG10_big_fil_rev_8_21_14_0_ 10_44_13 sequence
MASISMCMIVKNEEKFLGKCLESVKGLADEIIVVDTGSTDRTIEIAKKAGAKVISYEWNDDTAAARNAGLKEAKGDWILILDADEIIGKESFEPIRKLTGMDFDAFYLVQMNYTNNTKDINFVPARKTPYSMDFSGFFPVEIIRLFRNSKGIEFTSIVHERLNESIKRLGLKTARTDIPIHHYQSLKGEAEMKRKQLAFLRLFEKKIKEFPDDEKMYHDMGIIYYNYENDEKKAVECFEKAMKLNPKYLAPMFSLAAIYSRKKDNAKAKGMYEKILAIDQKHAQTHYNLGNILAEEKNYRDAIMHYTESAKLKPNPLVFNNLGNIFVILARWDAALLSYRTAIQLNHPRKEQLQKKADEIERMIEKKKEKN

SEQ ID NO: 5082 - protein, 285 aa, Unknown
  Description of Unknown: Candidatus Daviesbacteria bacterium GW2011_GWA1_38_7 sequence
MKLSVVLATFNEESNIGDCLSSVKDIADEIIIVDGSSTDKTVEIAKSFGARVVVTENHPIFHINKQKALDLAKNIWVLQLDADERVTKKLSEEILKVVNMADEEIDKYQNTIKKRKLFIKHQKLLENRDGKIGEDTNEYCAFFIPRLNFFLGRYLRYGGVYPDGVIRLVKKNKAFFPCKSVHEQIVVKGKVGWLQNDLLHLDSPTFKRYLEKNSRYINLIVDEFRRDNVSKDIVQAFKFIVYKPIEWFLVTQIRHKGILDGFQGIVFSFFSALRFPRAFMRYLKS

SEQ ID NO: 5083 - protein, 625 aa, Paenibacillus polymyxa
MMKTISLCMIVKNEEQVLERCLESVKNIVHEIIIVDTGSTDATLDIARKYTDKIHFFKWINDFSAARNESIKNATSDYILVLDADEYLEADADLNKDLSRDCDYYVFNIKNKMSLGMSFNHTAVRLFKKSLDLHYENRLHEHLNIPDNHIKFTNGVASNVIHHVGYADEMLLEDKKMNRNLPLMELEVKENPNAYNLYNMGQTYFGIQEYEKSTNYFKKAYPLSKNRVFLPELLTKLAYALAEMKQIDEALSILTDAALLFPKETEMHYILGVIYQRAGYYRDAEACYRNCIKLGDQGYYVTEGSGGYMAHLRLSELYMQTGRLEDSLKEVIRVLELKTNFVPALQQYLRLVPKLNMKSEDVQNGLKKLYKLDSVEDLQYLLNNMYGMRSPLLDYFLTRYKINVQPNITACAKIYSKKYEEARLLWSQLDNKEEENGKDLLLLSILLKENIFLKDIQYLLNLSNKEMEIIKQMVSGHRGKVALTTVLENILLEICQYMIILEEFELFQAVAEKMIAVKRETKLKLSKILSDYGFDELAIDLLIEVFKEQPNDVEMVRLLGDLCFRNNYLQDAQLFYSKLLTLDPQYSSYERSLNYFEKINDDDAFYKTKSEINKRFPRAFHYEQE

SEQ ID NO: 5084 - protein, 308 aa, Unknown
  Description of Unknown: unclassified Pseudoalteromonas sequence
MVNCKNLTIIVLTFNEELHIKRCLESFLSLNARIIVVDSFSNDKTCHIAKSFGAEVFKNPFINQAQQFQWAIDNCNISSDWVLRLDADETVDNVLVENINSFILKNGNGHNGAIFNRKHIFLGKWVKYGGRYPLPMLRLFRRGTAHIEQRWMDEHIVLDEGSSCLLKGGFADDNLNSVSWFIDKHNKYASREVVDIMLKRLLPNSDSKINAATSLSIKLKRFFKQSVYMRLPYFVRPFVYFNFRYFLQLGFLDGSRGFAYHFMQAFWYRTLVDLKCIEIEKEWNNTNTNNEKLAILERLTGYSLDKYK

SEQ ID NO: 5085 - protein, 279 aa, Unknown
  Description of Unknown: Acidobacteria bacterium sequence
MQVSVVIITYNEEANIGRTLASVQPLVADGKGEIIVVDSGSTDRTVEIAQSYGAKVFVEEWKGYAQQKNSAIDKAAGDWILSLDADEEVDSELNEELTPHRGDNLPRASGEWRFTTEQSRNPECLNGAPVAFLVRRKNYFLGRWIKRGGFWPDSKLRLFRRAEGRFEDRAVHEDVRVNGPRKLIARGALIHHSYPTLSDYIEHMNRYSSLGAEMVVAKGKVRFSFSNIVLRPLFTFIYNYLFRLGFLDGREGLLLHLYHAVYVSWKYAKAWELSRKKPD

SEQ ID NO: 5086 - protein, 422 aa, Unknown
  Description of Unknown: Lachnospiraceae bacterium JC7 sequence
MKEKIRLSQAMIVKNEEKNIERALRWGKDIVTEQIVVDTGSTDRTVELAEKMGARVYHFDWIDDFSAAKNYAIEKCSGNWIAFLDADEYFNSEDAGKLMDYIRETEENGGEGIFTLLVNLDEHGNVGTSASHIRIFKNLSDLRYKRRIHEQLVHSDGHNIRVLDATQELTIWHTGYAGETGKEKQKSNRNLNLILKDIEDYPENYEMYLHLGNEYYGREMYPEAEKAYAVYIEHLPVEISGTDVDAANAFLYHIYALLQQDKDAGTILAAYDRAVQRIKENADIPYIMGRCLYDAKFYGEAMECLREALDRLEKYGTLNKSQNAMQNVNSIYEMLGEGSLKTGDIKSAVKYASALISVNKYSVSGLVVLLRAFKGNGTDQVPVKDVMPYLSKIYDLKNEKDKGLLMAAADAVAYEGMSEYLL

SEQ ID NO: 5087 - protein, 313 aa, Spirosoma sp.
MTDVSVIILTFNEEKHLARCLQSLQSFTDKIFIVDSFSTDRTVEIAQSMGAVVVQNTWVNYATQFNFGIANTPFKTGWLMRMDADEYVLPELAGEITQRLPTLAADISGVYVKRRVMFFDRWMRRGGYYPIWLLRLWRRGQGLCEEIWMDEHIKLADQQGSPAQTAHFQHDLVDHNLNNLTWWTQKHNQYAIREAIDLLNIKYNFEDAKRVTPKLFGSQEQRTRFLKLQYASLPLFTRPFLYFLYRYIIRLGFLDGRPGLMWHFLQGLWYRFLVDAKLYEVYHTVGHDKQAIIDYFQSEYGKNLKPGRPHPVG

SEQ ID NO: 5088 - protein, 366 aa, Bacillus sp.
MNYPITISLCMIVKNEERVIERCLSSVKTIVDEIVIVDTGSTDRTKEIVKTFTNYIYDYKWIDDFSDARNFSFSKATKDYILWLDADDIITEENREKFLLLKQNLSFDVDAISMAYHLTFDNEGKPNFSSRRNRLIKREKQFKWYGIVHEYLEVSGNILDSDVAIVHKKESAHSDRNLRIYEKAIEDGKQFSPRDKYYYANECMDHNMYEKAITWYQAFLDEGNGWIEDNIEACGKMADCYIHLQKWPDAINSCLRSYNYDAPRGENCCRLGFIYLQQNHIKQAISWYELATVLKIPETKSPFINRACYTWLPHLQLCLCYSILGDYNKAQKHNDLAASFVPHNPKVQHNQNFLSSILKRGKEKDD

SEQ ID NO: 5089 - protein, 248 aa, Unknown
  Description of Unknown: Candidatus Woesebacteria bacterium GW2011_GWB1_38_8 sequence
MISAVILTKNEEKNIKSCIDNISFCDEIIVIDDCSIDKTTEIAKNMGAKVFLRMMNKDFSAQSNFGMQKASGDWILLIDADERVSNELKQEIQNSLNNDRTVYKFRRIDYIWGRWLKHGESGTTQAVRLVKRNSGKWIRRVHPYFRTTKDVALLSNPIFHYPHQNVRLFLESINRWSTWHAIANQEECKQSSLVKILFFPLGHFVKNYLFRLGFLDGLAGFVYAVMMSLHSFLAWSKLWIQQKNFKIN

SEQ ID NO: 5090 - protein, 254 aa, Unknown
  Description of Unknown: Candidatus Omnitrophica bacterium CG11_big_fil_rev_8_21_14_0_20 _42_13 sequence
MSAKLTVVILTKDEEDKISRCIESVKWADEVLVIDDESMDRTREIAKGAGARVIVNKSNGNFDNQRNIGIDNASGEWILQMDADEVVTDKLGSKIVEAISSPEDFAAFQFRRKNYFLGHFMRYAEQYHYWLRLFRKENGRYIGADIHEKLKIDGKTGVIEADMEHFAFTSISQFIARQNHYSSFEAQAMFVREGALPEKVIRYNIKIKPLKIFWKNYIKKNGYKDGMHGLIWCVLLAFRHIMIWTKYWEIIKQK

SEQ ID NO: 5091 - protein, 638 aa, Paenibacillus sp.
MGKPGILIGSPIRQKPEILKQFLRSLGDLITDGFDVEFYFVDDNDDPASRVLLAGFAEEHPGSFIQAHEPPTVPYVRNDNTHHWPEELVWKVAGMKDGIIEYARSKAFDYLFLADSDLVLHPHTLLQLANAKKDIVSTVFWTKWQPDSPEMPQVWMSDHYTLYENRGGEKLDDQEIARRTHEFLNKLRVPGLYEVGGLGACTLISRHALEAGVCFRKIPNLSLWGEDRHFCIRSAALGLSLFVDTHLPAYHIYRDSDLAGVDAYRQASSPAIRKERSVTVSLCMIVKNEEEALERCLSSVKDLVDEIVIADTGSTDKTREVAASFGAVIVEFPWIDDFAAARNHVFSKATKEYIMWLDADDIILAKDRQLLAETLYTLNPAIDSVTMPYNIGVNANGKVSYSLRRNRIVRRERGFRWIGAVHEYLEVFGNIVHSEAAVTHRKEKAYTDRNLQIYRKQQAAGKDFSIRDLYYFANELRDNQLFEEAAVYYKKFLATGLGWVEDQINACLKLSACYSRMYEQDKALQALFRSFHFDKPRAEACCRIGKFFYDQSPKRLDQAIYWYELATVLPKPKGALAFVEHDAWTWLPLLNLCLCYDQLGQYEKANEYNNRALAYNPEHPSMLHNKKYFEGKFAKEAQ

SEQ ID NO: 5092 - protein, 359 aa, Unknown
  Description of Unknown: Thermoanaerobacterium thermosaccharolyticum sequence
MDDSITISLCMIVKDEELSLDRCLSSIKDAVDEIIIVDTGSTDSTKNIAKKYTSKIFDFKWIDDFSTARNFSFSKATMDYILWLDADDYVEPLDLEKLTKLKNNFDQSVDSVTMKYVLAKDSNGTPSFISIRNRLVKRSKNFKWIGAVHEYLEVYGKIYDSDIHIVHDKIKNTPNRNIEIYEKMIKSKKDFSPRDMFYYANELADHKRYAEAIDYYNMFLDSKRGWIEDILYSLGKLADCYEALGDLTRRDDVLFKSFEYDIPRPDFCCRLGYKFLQENKIRQAIFWYELATKVEKPNHGFVNIACSTWIPHIQLCICYYRLGDIEKSYMHNEEARKYNPNNPMVLQNKTLLESILNKR

SEQ ID NO: 5093 - protein, 254 aa, Thalassospira lucentensis
MADKAPRLSVVMCAHNEEERLPSCLAHLTFADEIIVLCDKCTDRTEEIAREFGAKTIVGSWDIEGERRNRAIAEATGDWIFEVDADEHVNEELAKSIRKAMETDEFDRFVIPVDNYIGRRLVRYGWGASFGTSAVWRLFRKGCKKWGPQRVHPSIELLGRAGPRLDGALLHYVDRNISDMIKRLNSYSSARAADLRASGNIGSFANNFRRIFSRFFRCYVSRKGYKEGGMGFLIALLAALFPLLSYLKARYDDE

SEQ ID NO: 5094 - protein, 253 aa, Brumimicrobium glaciale
MEHKITSTIITFNEERNIARCIDALAPISDEIIVLDSFSTDRTIEICRSKNVRIEQREWKGYSNAKNHLNQLATHEYIFSVDADEAPDEILQNAIFFIKKEGLIGVYEVNRLTNYCGKWIKHSGWYPDVKIRIFPKSTSQWEGAYVHEELVVEGNPVAKNLAGHLLHYSYYSQKDHRQRADKYSELTAIKMHEKGKRVGPLKPYISAVGRFVAMFFIKKGFLDGKAGFTIARISALSNIYKYKELRRLQHENS

SEQ ID NO: 5095 - protein, 657 aa, Unknown
  Description of Unknown: Desulfitobacterium hafniense Y51 sequence
MYTLASILDFKRSQIPNRREDGKMKISACMIAKNEEKVIARCIESYRKAVDEIIVVDTGSTDQTVAIAQGLGAKVFHFDWIDDFAAAKNYALDKAKGDWIVFLDADEYFAHSTGGNLRSFLRKLDKTVGAVACRMLNMDEVSGKVIDEITHIRIFKNDKQIRYIRPVHEGLVYHREGAQLQARLADRRELMIHHTGYSANVSKEKAQRNLTMLLKLMENDTLANPEYYYYIADSYNTLGDYEKVVTYIRLFLATGVKLTNLNVRVHSILINAMLNLQYPAHEVMEEVESAIAIFPRHPLFYFYKAKFLHDDSCYEAAWVEAQRARQLHDTYEDIEINDLPTNFGNLYNMLGAISEFKSDSGAAMGYYLDALKLDKYEALAFSRLMKLIRTQPLEEIVAFLNTLYDLDNEADLDFLAMSLVNHAVPQVLAYYTSLREKKYPKEDYVVLQMLVANGRYDKAFATLLDCYIKDGDERLALVTATAAALSGNVVYMLQAIEQLPSAYANILKAYQGERVLFDEEDRAAFMKILRTFILWADDAAKQKLFELADQFPDGLAVIGYQFLQEGHYQESLAYYSAAVEQALAAASFAVHPLLYYQQGYCLHRLNNPVAAAEAFVKAYEAGYQANDIYEYLRWNADKLPSGSRLKEKVLKIIYRIQ

SEQ ID NO: 5096 - protein, 362 aa, Bacillus sp.
MGGISISLCMIVKDEEDSLSNCLASVRELVDEIIIIDTGSKDNTKQIASAFTDHVYDFEWIDDFSAARNFAFSKATKEYIFWLDADDILTEENQEKFSTLKKELPPHFDSVMMFYHLSFDGNGNPSFSSRRNRLVKREKNFQWIGFVHEYLEVTGLTFQSDIAIHHKKEKSFNDRNLRIYKKLLQSGIDFSPRDKYYYANECNDHGLYDDAIKWYRKFLEEGKGWSEDNIQACGKLADCHIQFKDWVSAVQSCLKSFEYDTPRGEICCRLGYIHLEQHDYERSIFWYNLATQIEIPETKSPFIERNCYTWLPHIQLCVCFDRIGKLEESKRHNELAADYFPDHPSIDYNRRYFKSIEKKEKS

SEQ ID NO: 5097 - protein, 486 aa, Enterococcus faecium
MTDRYFLSILFDCIKNKVSKSQSILHNMTEACIRGDQMKKVDKYISNEWFDYDRVKNADCNLYLYNQHENLIGTWIKILQELHFSEELFLKTERLSKQTLFLKDTAEVSVCIISKNEEKNILRCIDSIYNLADEIIFVDTGSTDHTRDLIEEVADTKFKIFDYEWSNDFSAARNFSIEKATKEWILVIDSDEYILPKEIIKIKLLISMFDRYEKKENIRISCAIKQSNGVITHSQSRLFRNNGLIKYFGLVHEELRINKKINSLINIESGVSVFHDGYSDTVSTHKEERNTNLLLKMMKIEPTYIRWTYMYCRDSFKILPELNIKKLLLPFILKNYDEGLVKENIQNTRYTNLILLLILKKSFMEEEEQTINKCISILEARIPNSSDIMFYKLMKTQQEIFYQQVDLLKTAIRYRKRRITDEFSQIGSNLLHFDLFISSILFDIKSYENSFSYFETLNKKDYFKNLEIPFEYKLLSAVFKGEKYES

SEQ ID NO: 5098 - protein, 361 aa, Lysinibacillus sp.
MVSISLCMIVKNEEDVIGRCLASVKDLVDEINIIDTGSTDNTKEIAKQFTERIIDFKWIHHFAAARNFSFQQATKEYILWLDADDVFLAEDQEKFKSLKESLNSNIDAVSMNYHLSFDSEGNVSSLLRRYRLVRKDKQFQWIGAVHEYLEVGGNLLNSDVAVSHLPLSHDHSRNINIYRQLVQSGEPLSPRDTFYYANELLDHGQFDDALFYYETFLTSKLGWVEDNIQACYKLADCYFNLKDKENYLSSILRSFEYDIPRPEACCRLGFHFMEQFKNYEAIFWYEQALVIKQNPNAPFQNKTYTTWLPHLQLCVLFDRLQQYELANAHNELARSFIPNDEKVLHNKKYFEGILIKEHKDS

SEQ ID NO: 5099 - protein, 357 aa, Lysinibacillus parviboronicapiens
MVTISLCMIVKNEESIIERCLDSVQHVVDEINIIDTGSTDRTKEIVQNYTTRIFDFIWCDDFAKARNFSFQQATKDYTLWLDADDVLTTEYQQKLLQLKKSLNPNIDAVSMDYYVQLDEDGEIEISEKRYRLVKRSRNFQWQGAVHEFLHVKGKLFHSDVVITHLPLKKDRDRNIQIYERLMAAGHSFSARETFHYANELKSHQRFLEAINHYNTFLDLDLGSAEDKIQACLNVSDCYQHLRDSKQAIQSLLQSLLYERPSPETCCRIGHLFMEQFKNETSIYWYSQAIQQSSTTLGTQRRAYSTWLPHLQLSKLYDRLGLYENAHEHNEAARRYKPNDKRILDNEKYLYSRLNKGK

SEQ ID NO: 5100 - protein, 299 aa, Teredinibacter turnerae
MSTVSAFVLTFNESLHIERCISSLSRICKKVYVIDSYSTDNTVDIAVSAGAEVFQNSWVNHANQVNWAIKNLPIETEWVMRLDADEYLTEELAEEMKLAIKQNGGHTHYYIKRKVIFMGRWIKHGGYYPTWLLRLWRHDSSASCESRLMDEHIKVQVGSSGHLREDIVDCNLNDLTWWIQKHNRYATNEAIEVFKALFKFNDDNIKPSLFGTQERRKRWFKSLYAIFPLFVRPLCYFVYRYFLLAGFLDGKQGVVWHFMQGLWYRFLVDAKIFEIKLKCGDSETLIKKYIFEKWGVKIE

SEQ ID NO: 5101 - protein, 362 aa, Anaerocolumna jejuensis
MPTLSLCMIVKNEEEYIRAALESVKDVVDEIIVIDTGSSDNSREICALYTDKVYEAEWRKDFSAARNMSLEKASGDWILWMDADERLVIKEKEAFKELLEGDREIYWVKLLHLIDSEGEEKEYYISYHNRLFKKKEEFYFKGSIHERLVTESGIMPEPGDTGNCMEILHYGYNTAHMREKALRNLRICLKEREKDKDNPWLDYYIACELYRLGNIKDALELVNHGILGFLSQGKLPPALLYKLKYDILLTNGNLESVCEGLSKAVNLYPDYVELHFYRGSALLKLNRYEEAKKEFSYCVLLGEDNGNYLIRSGSGSFLAYFYMGEACLKAGEKENACEAYEQALLNNPGLEEAKNRLEVLRT

SEQ ID NO: 5102 - protein, 249 aa, Turicimonas muris
MSVVILAKNEEKNIEDCLESCKFANEIILIDDGSSDRTVELAKKFNAKIFERSLNGDWGSQQSFGINQTTQPWLLLLDCDERITSSLYQSIKDVIGTGEKKTYLIQRENHFKHYHAQHGTLRPDWVQRFFPNEGIRVEGFVHPKIISSFPEKKLQGRMIHFPYENPDQYYRKLNQYAKLSAEKYFKEERKLSFFRDIVLRPAWAAFKVYFINLGFLDGKIGFIFAANHYSYTLQKYIRYYLLRHSGGKF

SEQ ID NO: 5103 - protein, 302 aa, Chitinophaga sp.
MDLAVIILTYNEEKHIGRCLESMRRVSDEIYIVDAFSTDETVAIAESYGAKVFQHKWVNYAQQFQWGLDNCGIKAPWVMRMDSDEYLEPGLIREINHKVHQLPADVSGVYIRRKVLFKGKWIKHGGFYPHNLLRIWRNGVGSIEQRWMDEHIVLSQGKTVQFKEHIVDYNLNAIHWWVNKHNNYAIREMVDLLNIKYRLLDADKRLLEMESTQAKRKRFLKERVYSSLSPGMRASFYFLYRYVLRFGFMDGYHGFVFHFMQGYWYRLLVDVNLEEFERKLNGDKGKEKMLAVLKEDYNIVLN

SEQ ID NO: 5104 - protein, 642 aa, Bacillus kyonggiensis
MKPFLSLCMIVKNEEKVIERCLSSVAHLIDEIIIVDTGSTDHTKEIVAKYTSNIYDFEWNNDFSAARNYAASKATGEWIIALDADEYIDEENFKDFIQELIEDDAHFDAYSAKILNFAGKFGENLVQNFHDRIYKNNGDISYYRNIHEQFKNNKGKPLKNKNSSLLIFHSGYLNQTVYEKGKSERNKELLDREMSNGGNKAFDYFNYGNEYCSIGDYENALESYLKAYKMKADFRLSWVSTTLVQIIICLMNLKRYNDALNVIKDAENMYSTSPEFSYLKGEIFFLRGQLEDAKRMFLQIINNEDKYSHIILRPDLKNQRPHIRLGEIFLHQEDYNGAIYHFTSVLNINKYHEVGIKKVVFILNKFHTVEEISGFLISKELVNNKNVKSYVRACFEVGNPSLASCLLDRFHEENKLLSKVALLKKQLIKHEGYTEDFSEILQNEVIKSLNEANWINIIDFYLLRELKSEDEKLPSFLAPFEKNKSFQSLMNLLSGEAPDGNIDEELLLFSLQTLLSYKKSSLCDVILSNIQNAEKNVISKIAALLFSHGYKVEALQLYDKGDWNHFTEQDFINIINSLMETNNKPNAIEFAKYAMMIFENDFRFYIYILENAENYNLLVTTLEKAKNIFRDSFYLENFKLLG

SEQ ID NO: 5105 - protein, 301 aa, Arcicella aurantiaca
MQDITVIILTFNEEKHIERCLKSLLTFTDKIFIVDSGSTDKTVELAESLGAKVTQNQWVNYATQFNHGIKNNPYQTKWLMRMDADEYVLPELSEEINQSLHNTPAEISGMYIKRRVMFFDKWIRHGSYYPMWLLRIWRNGQGICEESWMDEHIKLFEGKTIQMKYDLVDHNLNNLTWWTQKHNLYAIREVIDLLNIKYNFRDFEAVEPKLFGTQEQRKRYLKVKYASVPLFTRPVFYFFYRYIFRLGFLDGKQGLMWHFLQGFWYRFLVDAKIYEVYHRVGRDKQAIKDFFKTEYGKDLEK

SEQ ID NO: 5106 - protein, 264 aa, Unknown
  Description of Unknown: Candidatus Woesearchaeota archaeon CG10_big_fil_rev_8_21_14_0_ 10_44_13 sequence
MKKQKLSVVIAVKNEEDNMGRCLDSVRWADEIIIINNGSTDKTAEICKRYTKNIYSYPKKALIPQIQNEGIKRATKEWVMILDADVVVPAAAKSEILDKITRGNNDGYYLYHKHYCFGKFLSHNNTNDIMKLFRRDKGRFECEAAHCHIKIEGRIGSINSPLLHYAHPDISTQVKKSNLYSSQDAEMIFRTGKGGLLNKRIRKINIYTLLIEPVMFTFYMYFFNRLYKEGLRGVILSILMGNYLFMERAKVLELQFKAISSKQG

SEQ ID NO: 5107 - protein, 282 aa, Unknown
  Description of Unknown: Microgenomates group bacterium GW2011_GWC1_44_37 sequence
MASFNNEDCIADCLNSVKEWVDEIIVVDGTSSDKTAEIAKKMGAKVLIRENNPVFHIQKNIANKEAKSNWILQLDTDERVTPAMRKEIVGLLEGKYFGYDSWLSPLKSSINKIVRLFPEPIKLSQPAVAYWLPRKNFFLTRYQKHAGQYPDPVIRLFQRGKAELPAKDVHEQMVVHGTTGWLVSDLDHYATPTFSRYLLRENRYSSLKATQMKAAGVKINFFNTLNYLFFKPFGTYFSLYFRYRGFLDGFPGFVFSLYSGLHHAFSYMKLWELYKDEEYAPR

SEQ ID NO: 5108 - protein, 368 aa, Cohnella phaseoli
MITISLCMIVKNEEQVLERCLASAAPLVDEIIIVDTGSTDRTREIALRFTDRLLHFAWIDNFSAARNYSFDAATQDYILWLDADDVIAPDNQQKLLELKRTLSPDTDSVSMIYELSRDEYGNVAHSLRRNRLIKRSNRYSWQGAVHEVLIVGGHIVTSDIAVAHCPLTDADPGRNLRIYSQREAQGLPLTPRDRLYYAHELLEAQQYRQAAAHYERFLDEGEGWIEDEVTACSKLADCYHALGEAEQEWNAICRAFRYDTPRPEFCCRIGFSLLHRGKYEAAAHWYRLAIELPAQEKWALENHACRTWLPHLQLCVCYDRLKLHDLAYAHNEIARTYRPDDAAILQNKAYLEPLVSRQDSASDNQEAG

SEQ ID NO: 5109 - protein, 361 aa, Bacillus cereus
MVTISLCMIVKNEEKVLERCLQSIKGIPDEIIIVDTGSTDCTKEIAKKWTPHVYDFKWIDDFSAARNESFRHATKDYILWLDADDVLLEQDKTALQTLKHSLQPQIDAVSMKYHAHFDTQGNVISSAFRFRLLKRERQYRWIGVVHEHIPVTEQDQTYQSNIVVTHQKENPQRSVRNLTIYEKYVAGGGTLTSHDLFHYGRELISNHRYEEAVDVFHKFLDSPDISDEMRLFIFNELASCYYFLQNIEQEHQITLQSLSYDMPQPVFCCRLGEHFLRQGKVEGAIFWYKQATQLPVSYSWTVDKKPFYTWLPHKQLGVCYEMKKENRQALKYYQKSLTFLPDDTEVQQKIQHLKKQMKKKK

SEQ ID NO: 5110 - protein, 253 aa, Unknown
  Description of Unknown: Candidatus Roizmanbacteria bacterium CG_4_9_14_0_2_um_filter_38 _17 sequence
MVKKVTISVAIAVYNEESNLARCLKSVKDWVDEIVVVDGGSSDKTVEIAESFNAIVIHTDNPQIFHVNKQKAIDACKGIWILQLDADEVVTAELKSEILEKVETGVDGYWIPRKNYFLGHWLKKGGVYPEYTLRLYRNGKGRLPCKTVHEQAQVDGEVGYLKSDLLHYPYANFAGYLAKAEAYTSLTARLWKDQSIKINPITTIKYMIAMPIYTFFNIYIRHLGVLDLFPGFVWALYSALHFPQAYIKLWRNK

SEQ ID NO: 5111 - protein, 603 aa, Clostridium chromiireducens
MSLSLCMIVKNEESTLGRCLESVKNIVDEMIIIDTGSTDDTIKIAERYGAKIFHYEWDNSFANARNYSLSKASKDWILIMDADDELRSEDKDKVIKLINDDNKLNAYFGETLSYSGDSSDYNIYSNLNIRFIKNGKGYKFSGAIHEQIIPGTEDAKKQAFLGIADIKFYHYGYLNKTVNEKNKRKRNMDIIEKILKENPDDTFMLYNMGVEYSAKGDYAEALKYLKKAYRNFNPSLGFGAKLLLKMISCNNVLQQFDECLTLIEEGLKYYPSCTDFEFYRANIFYIKKKYYSAIESAKKCISMGEPPILLREVSGVATYRPYYLLGIIYSTIDDYDESYKCYDEVLKTNPKFSDAIYRISEIMTIKNMCLDEMQKKLESYFDNLNQETNLLLSKIFYIQNKFDIAYNYAKKAESLNKDLLEVNFYKGLYSFYLGDYKEALENLYKINDGENHNNAIYCSILCELFIKNYEQADNLINISRKFNEPEETMVYETFISIIKEDKYIQLADDKENSKKFIKPIFNLLEVLLRANCFQGFKKAVKLLNLIDDDSIFMLLGKLYYKYGYFSFAYKEFIRSINLHEIIDADALRMMQTILLSQNESKIN

SEQ ID NO: 5112 - protein, 361 aa, Pseudogracilibacillus auburnensis
MITISLCMIVKNEEEVLAGCLNSVKEYCDEIIIVDTGSTDETKKIASKFTKKIYDFKWIDDFSAARNFAFSKARMDFIFWLDADDILLENDQKKLRNLKKSLNTDIDAVSMNYILQFDEYGKPSFYFRRHRLVKRINNFQWKGQVHEYLEVGGNILQADIAVTHRKNKKNKDQQSSDRNIKIYEKRLEKNEKFSPRDLYYYANELKDHRQYNKAIQYYQKFINCDQGWYEDKIRACLYMSDIYRVKKEHENECKLLLQTFKYDKPRPETCCKLGDYFLRKKLYYPAIYWFETAVRTKYKNPQGFHHEAFSTWYPHLSLCFSYWRIGNKEKSIYHHEIVKNIRPNDPKVLYNEQFFNGTAKK

SEQ ID NO: 5113 - protein, 322 aa, Unknown
  Description of Unknown: unclassified Bacteria (miscellaneous) sequence
MVSISLCMIVKNEERVLARCLDSLMPAMDEIIIVDTGSTDATKEIAGRYTEQVYDFKWTGSFADARNFAASKATKEYIYTADADEYLDEENQAKLKQLKMILLPEVEMVQMLYCTSAENNTVYNFEKEYRPKLYRRLRPFVWIDPIHETLRIDPVVYDSQIEIMHCPEGNHASRDLQALLQAGKRKERFSGKLHHMYAMELYHSGTDKDFTDAIPVFEKTLSEDNRTMDEVKEAMCVLARAYRIAGNLPKFFGFALKDAVTSSCAEICCELGKFYEGSGDTEEAILWYQNAATETESILDIRTSQDIPREGLKRCGVEETDG

SEQ ID NO: 5114 - protein, 354 aa, Bacillus sp.
MIVKDEEDVLERCLLSVKNLVDEIIIVDTGSTDRTKEIASRFTHKIFEFEWVNDFSIARNFSFSKATKDYILWLDADDVIDEKNQEKFLQLKQELSSLVDSVMMPYHLMFDSEDMPIYSTMRNRLVKREKGFAWRGIVHEYLEVHGNIIHSNTSIHHKKLKAYTDRNLRIYRELVQKGEMLSTRDLYYYGNELCDHAFFEEALMVYEQFLQTKKGWIEDEISACINMAHCYANLNNNEEQIKSLFRAFLYDKPRAEVCCQLGQAYFDLQKWNQAIFWYNLATTLESAPQFRGLSYREEAWTWLPHVQLCVCYDKVGNIEKAMQHHRIAVEYNPNHPAVIHNEKYFSKLVEAGGV

SEQ ID NO: 5115 - protein, 282 aa, Unknown
  Description of Unknown: Cytophagales bacterium TFI 002 sequence
MKLPITAIILTFNEEKNIRQCLRSIHGQVDQIIVVDSYSTDNTLEIIAEFEGVELNQHEFVNYSVQRNWAFDNLTIRNEFIFNLDADHRPSNELFSELSEIFRNGISNEINGFMASRKTMFFGRWVKYGGHYPIFHAIIFRKGHGYCEHKEYDQHFVIEGPSITLKNDIEDTITSSLGEFTLRHNRWAELEAKEAIKLLDESKKVKADKNGNEMEKRRYLRLKYYSYPLFWRVFAFYFYRMIIKGGFRDGVQGLLFHTLQGFWFRFLVDAKIWEMKNIKNDD

SEQ ID NO: 5116 - protein, 247 aa, Unknown
  Description of Unknown: Candidatus Roizmanbacteria bacterium CG_4_9_14_0_2_um_filter_39 _13 sequence
MISTVIIAKNEEANIASCIKSVLFSDEIVIIDNGSIDDTVSIAKKMKARVVEFPLEKDFSNLRNRGLEEAQFEWILCIDADERVSEILKHSILSELASPRYSSYFLKRRDHFWGSIMKYGEVRNAYVRGYIRLMKKGEGKWSGVVHEIYQDSKPSGFLEGFIEHYPHGSLSEFIRDVNQYSSLRAEELHKKKKTTNMIEICIVPIFKFFYTYILKFGFFDGHAGFVYSFLMSFHSFLVRSKLYMMKS

SEQ ID NO: 5117 - protein, 622 aa, Unknown
  Description of Unknown: Desulfobacteraceae bacterium sequence
MKRGINMPGKGSISACMIVKNEEKYLPSCLRSIGDYVDEIIIVDTGSTDNTVSIAESFGARVYHHPWENNFSKHRNQSFSYALGEWIFYIDADEELLPGSGEALLEAGRAKEDVDAVAVVLECIFDRGQSRAYNNAIRFFRNHRGLYYKGRVHNYIVGVKKSICAPIHLFHHGYNLDKKTSLLKFQRTTGLLKLDIQEDPENPRAHHFLSASYLSEDMFQEAAKEASEAIRLYEKRHSLSPNYLWSLYIASSANFSSGRIEEAEFYARKALAVFPNHMDSHYMLSLVAYGNKNRAMFERHMEGYLKAKDAFEKNPISFGETVNNTFGSEWIMFLFRGFFLLDEGKEQEADEALKRASSLCLDQFFFHFKLGEFFRMKRRWQAAERELCKALQIKQDEPRAIYALSTVYGEQRRLGDRKALLEKILRIDPQFKDARFNLALVHMELGEFERSLALFREVLDGDPAHQRAGINEALCLRGMGRYEEALERSLQIEARDRDELLTLVENVAQCYEALGKAESAVEWFQQMTEIAPRDPAPRVHLSKLYLGMNQVEPCVLQCDRLLSLLDLNHNRILNSVKDLGGLFQEAGKQLRLLNRPELGELSLQVAKTLQDFPPADTGEERV

SEQ ID NO: 5118 - protein, 301 aa, Sphingobium sp.
MPTLSVIILTFNEERHIERAIASVRSIASDILVVDSFSTDQTIELARNAGARVLQNRFVNQAKQFQWALDHGDVRSAWILRLDADEVIEPDLAEELMRDLPSLPEDVVAVNFKRKHIFMGRWIRHGGRYPLVLLRLWRNGHGRVEDRWMDEHIVTWGGRTVTARGGFADICLHDLSFFTAKHNSYATREAVEILNARYGLFGQDRERNLGSAQARVKRFIKTNIYNRMPLFAGPALFFFYRYIIKLGFLDGREGLIYHFLQGYWYRFLVAAKVVELEQGLKQCGANTDRLDRLRQLTDLKL

SEQ ID NO: 5119 - protein, 252 aa, Unknown
  Description of Unknown: Veillonella sequence
MATVTVIILAKNEEQHMKDCIASAQFADEVLLIDDGSTDKTVEIAESMGARVVHHAMNGDWSQQRRFAVEEARSEWIFFLDADERISPELQREIQDVLAKDDKKAYWIERSNVFHHNKATHGVLRPDYVLRFMPKEGTNIEGFVHETISSTYPEAKLHGKMYHYTYDNWHQYFNKFNNYTTLAAKKYKENGKSCSFVKDILIRPSWAFFKVYILDRGFLDGKMGFILSVNHYFYTMIKYVKLYYLLKSNGKL

SEQ ID NO: 5120 - protein, 319 aa, Unknown
  Description of Unknown: candidate division KSB1 bacterium sequence
MKELLWKAKKYKNIYLIMGKVDHSDLSLCMIVRDEGENLKRFFENTKGYFGEIIVVDTGSTDDTVNIARKYGAKVYFKEWNDDFSEARNESLKYATGKWIVVLDADEFIDRDNYNKLLEYLNSGEGIAYYLNFRSQVPESKAGSVFINSHPRVFKNGLGIYYEGRIHEQIIVSVMKAGGKILPTCVMVEHYGYQKDETTRKRKIERNINILKKEISEKPECGINYYYLGEEYSLLFDWEKAINFYENGILKGDLSSFNRSVLHQNLGSAYLNTGRLDKAIKEAEVSIELNDTLFTPYLIIAEAYFKKGNFNGVIWHLKK

SEQ ID NO: 5121 - protein, 391 aa, Enterococcus faecalis
MKLNLGLILSYPDVYKNILEKDYTITKFPNISVCIMVKNESRCIKRCIESIYQLSDEIIIVDTGSTDNTIEIVSSYSKTRIFKKYWNDDFSEIRNFMIKNAKNEWIFQIDADEYINEKDISNYKEIISILDVANITPKVVSPKILDYDNNETYSTFRIFKKEPKLKYHGLIHEELRYNNTTTFPTISIDLAINHDGYRPKIICDKDKYSRNYRLLKKMIQIEPRNIRWYFFLVREALLFNEKSKIIEKYIEQALDITSENNEYKAGILIKYIELKLDSDPNFALDIINQYINIFPNCIDFIYYKLLLASRNAFEIVSSENKNSINELREIDNQYSFIDSNGSHIFEVLGWNYFLLGDLEIAQFFFKQIKNPNIQKSVNDKQEFIKKFLEGE

SEQ ID NO: 5122 - protein, 642 aa, Bacillus sp.
MKKTSLSVCMVVCNEEHYLTRCLNSVKNLADEIIIVDTGSTDQTVTIAEAFGATIINYTWNDDFSEARNRGVNEATGDWILILDADEELDILCHPKLVDLITTSNAEGYYLNFINYYGKFDKAHYFTDRACRLFQNHFHIQFRGKIHEEITSSMNELKLQIKESDLTIFHYGYLDDMITLKKKNTRNVRIIEKALQVTPENIRMKYALGVEHLQASQNSQALNTFVELLEQLPPTSDYVPDLLLKTVHLMRLFHQDSKALLLIEQGLTYYPDFPDLLDVKADLHLFLNQYESAKNTLLRSLNSYRDNSNYSSLSGSGSYRSAYILGTIYEKLLEPTEALYYYEVALDFHPAYIPAWSRWVLGHLFFSSSSEMMNKLTSWKEQLTKEQWIVLIRSLTYNGKFHFLEEIWGLVPLDIRAELISTIKPLSVSIKLFIEGHKQEALAALHSEKRELKMEEILFQWAIVYEENQDGIDLLNTYSSKYLVLRNLNEVLEHGQQSDEHKYALYLAKLMLIETQCWKGYLRLINTTQALTSEDMLYPLSHFYLILASPQWFIKGIVKQLTSILLHLNEREKLTLSILLLKLKNYHGAKEILNSLITHSPTNPLPRITLSYLYYLLAKQHGSSEKLVDENRLIAIAFHLSS

SEQ ID NO: 5123 - protein, 284 aa, Unknown
  Description of Unknown: uncultured bacterium F39-01 sequence
MQPADLDLIILTLNEELNLEYCLRSVQGLPKNIFVVDSGSTDKTVEIAERYGAVVVTHEFITQAEQFNWALDNLPLKSQWILRLDADEVLLPELRDEIAATLPGIRSDVTGLYLKRRMMFLGRWIRHGGYYPTWILRLFRKGKARSEQAELNEHIVLLEGTSERLKNDFVDHDHEGLASWTNKHEGYASRHARFLNGLKNGHDDTFIQPQIFGPQAHRKRWLVQNVYGPAPLFGRAFLYFAYRYFFRLGFLDGVPGLIFHYLHGCWYMFYTDAKVYEQRTKQNI

SEQ ID NO: 5124 - protein, 364 aa, Paenibacillus solani
MNSISLCMIVKNEELVIERCLTSIADIVDEIIVVDTGSTDRTKEIVQSFTKSIFDFEWIDDFSAARNFAFSKATQNYILWLDADDVLLEEDRNKLKSLKEALSPTVDSVTMLYHLSSDEYGNVTFSLRRNRLVKRERAFRWIGPVHEYLEVYGHVINSDIAITHLSSDQDSDIGRNLRIYQNREIAGESFTPRDLFYYANELKDHRQFEKAIDYYERFLHTEKGWIEDIITTCGKLSDCHHELGNKQLALESSIRSLHYASPRAEFCCRIGYHFLENHHYDTAIFWYKLAIQLDLPPDYMGFHNPSYSTWLPHLQLAVCYDRIGSYMLANEHNETALAYRPEDKTMLANQAYFRNKLQELESQS

SEQ ID NO: 5125 - protein, 500 aa, Unknown
  Description of Unknown: Ignavibacteriae bacterium HGW-Ignavibacteriae-2 sequence
MLSLSMIVKNEEKYLKDCLESVKDVADEIIIVDTGSTDGTLGIAETFGAKIYKYDWENDFSAARNFSLSKCTGKLILYLDADERLHPDSKKIINKIKKTDKPNGYNCKIINLDEVNNRPSVMTYIRLFPNNKNVSFSGKVHEQIETSLLKNNYKIEESDISILHIGYSIGREGLKIKAKRNLIILLNEYEKNKSSYYAFHLGQTYNILEHKEEAMRFFKIAVKDKNIKKEYLSTSLRVLAVYESEMGNLEQAVTFIEKAIYYDKDQPLNYMVASNFYKKSGDIKRSILFIEKALGINRESSKNNYKSSQNILLDDYLIICTGLLLSIEGSDNTSKKYFSNELINLSNQKPGLKAEINFLLILLEGKAALTNIRDIKEYTNDSNLELVIKLLTLSSDIQTVGSLFESLAEKHYDSAYVLKEYAMYSLKMGDTKKAEKLFDKAIELNTNDPSVYFYLVSLYIQSNRIDKLRGVLNKAQELFANNPAVISQLNKLRQKLSQII

SEQ ID NO: 5126 - protein, 358 aa, Paenibacillus agaridevorans
MLGISLCMIVKNEEESLGRCLSSVRDVVDEIVIVDTGSTDRTKEIAASFGAAIYDFEWIDHFAAARNYAFDRATQPFILWLDADDVVEPEDRARLKTLKEENDEDFPYDSVSMNYHLTFDHKGNPVFSLRRNRLVRRSLGFRWIGPVHEYLAVFGRILHSDIAVTHRKERLHTDRNLRIYLKRRDAGETFSPRDQYYFANELRDNRRNEEAIEWYGRFLDGGKGWVEDNIGACMKQADCYGRLKNSKGQLASLFRSFGYDTPRPEICCELGSVFIRQERFEQAIYWFRQALTVERPAGNMGSTDHATSTWLPHLQLTVCYDRIGNRAKALEHHRQAMTFNPDHPSIRYNENYFNKTKT

SEQ ID NO: 5127 - protein, 360 aa, Unknown
  Description of Unknown: Lachnospiraceae bacterium A4 sequence
MSKIPVSVCIIAKNEEKYIGECLKRLEPYGFEIVVTDTGSTDQTVEIAKQYTDKVFEFEWVSDFSAARNFCVSHASNNWILALDCDEYVHSIDVPSLRRIMQQYPRALGEIQMKSLVQSRGVTSYAVDVVRRFYNKNYYFFEGAIHEQLQAKDEKQRGKAFEEITLPMEVIHHGYNLTPEEMKKKSERNLTMLYQALETDPNNTYMLYQAAHAESMRGNYLEAIPLYERALGMIDTVTCEFERLMIMALGVDYVRTGQFQKAVALMERYADQCKTAKYMFTHANVLLDSGDHLRALLLYIKTIMMPDADTLGVNKLHCFENIIRIYTEMGNTEMAALFQQRYEECRQENDKIVTGTPSGE

SEQ ID NO: 5128 - protein, 254 aa, Unknown
  Description of Unknown: Candidatus Curtissbacteria bacterium GW2011_GWA2_41_24 sequence
MKKIKISAALATFNEEENIVDCIESLKNFADEIVVADGSSTDRTRELAENLGAKIIKTTNKPMFHINKNLAIDNCTSDWIFLMDADERVSKELVGEIKGIISKNPKENGFWINRRNWFLGGYLTKGGAYPDSVIRLFRRGKGRLPEVSVHEQVAIDGEVGYLKNDILHMADPSFARYLYRADRYTDQTAQKLREIDPGRGPWPVFYYMVLKPLVTFFDIFVRHRGYVDGFRGFVWALFSAAHHFYAYVKYWERR

SEQ ID NO: 5129 - protein, 460 aa, Caldithrix abyssi
MKKQTLSVCMIVKNEERFIADCLKSVQAVADQIVVLDTGSTDQTVEIARGFGAEIHHFNWRDDFGAARNASIKYATGDWILWLDADERLLPESVPALKKVLKPEKKAVAYVVNIRNVMADGKTFKLSTGHRLFNNRKKIYFEGRVHEQIVYSLARNGGEERPSEIQLLHLGYALSSEEQSKKDRRNRQLLLKMVEEQPHNAYAHYTLGQNYNLSGEFEKALKHYLIALEKNRFQPSLQRQLLNNISEAYLKLNDLANARSFALKSAQLQEDQIGAYYLLYKIAQQQNQPDEAIKWLQTLREKNLAAQHGRLKLENDVLLSDADVLLSLGELFIKNEQLKRAQMCFDEIFQYGDNNRAYVNRIVDIWAQNRHFARAEQFLEAHLSSNDGQFLELKGLLQIKQENYIGAIQTYTLLFQLQPNNLDIIKRLAGLFYKIGEKEKAESLIKMAADLNALTQKARV

SEQ ID NO: 5130 - protein, 508 aa, Unknown
  Description of Unknown: Candidatus Melainabacteria bacterium HGW-Melainabacteria-1 sequence
MIVRDEADCLAACLDSVLPLAPELVIIDTGSVDQTRDIAKAYGAKVIDYDWHDDFAAARNVSLAAANGDWILVLDADERLESDSLPLLQAFLKQNPEPALINLRLISRQSNGQVLTVYHLVRLFANRPSLRYRQAFHEYLADTGELRLPQHFRSDLRIEHIGYQAEICQAKDKASRNRRLIEKMLTLEPHNQIWRHYSANAWYTQGQTQRALNEALSLLALGQSQPEIRNSFYYPRSLIEALIACRELRQTQLGLELAAANQTRCQNMPDFWFVRGTLFRQLGDDAAALNCFEICIGFRDQEASFDFQYTPAVLGPQSLMQILQIHRVRLYDPERSTPRSTALAACLQAANRALNLDAEQPLTWLAYLLEAVWLSAEEQACAPLRIWQQHLTSLQSAHQQLTHAARQLLSRLTEPDWRERLLAMPGQSEALVGLAEHCDGFWQAEMTSLICHLAYVISGDTRWPQLMATVYQADGQRTQARQWLAEALLLQPGNLDLQHCLEQQLAAN

SEQ ID NO: 5131 - protein, 251 aa, Veillonella sp.
MNTVTAIILARNEEQHIAECIKSVQFADEILVIDDGSTDCTVSLATDLGATVICHSLNGDWSQQRRFGISQAHGNWILFIDSDERVSPELAADIRKAVQGELRAYWLRRFNLFHHNKATHGVVRPDKVLRLMPRDGATVEGAVHETFISPYPQSILSGKLYHYTYDNWHQFFDKFNKYTTAAANKYKEQGKSCNFLGDIIVRPMWAFFKIYILQRGILDGKIGFLLSVYHMMYTMTKYVKLYYLNKFNGQL

SEQ ID NO: 5132 - protein, 360 aa, Unknown
  Description of Unknown: Anaerolineae bacterium sequence
MAKPLLSLCMIVKNEEANLPHCLDSVKDVVDEIIIVDTGSTDRTKEIALSYGAKLYDFEWIDDFSAARNFSLEKATGEWILVLDADEKLEKRTAKKLRELAKVSDVDAYVMIQQNFRSSQIQPVLDFQTIRFFRNCSYYRFRGRYHEGVHHSIQEHNGKIALDRQELVILHDGYLQNTAQGELRRKRAIRHLKAILDDDPHDVWAHLKLGMELYHDGDKDEAYNHLIKLFQSGSTVDLKHLPPIDTHEALVHLAQLAIYRGDFTLAKRCGIASRPLTQIFEFCLYSEFAYIVGSLGEIEILYRDGKQVGEEEYFELASIMSKISDLRKNYYDKLETAHKNLLDYLHNKCLLLASKSSGGK

SEQ ID NO: 5133 - protein, 262 aa, Unknown
  Description of Unknown: Alphaproteobacteria bacterium sequence
MSGKPPISCYIRTKNEERLIGEVIRAALPAVDEVVLIDSGSTDKTIEIAEAAGARVVREQWHGWGKQKRLGEDAAKHAWVLDIDADEIVTPELAAEIRALFANGEPAFPVYQLMMATAPPVGKPWMDYNLVDRRKLYDKRVIRIPDHAMDDQFKVPSGMKVGHLKARLLHRSFTELAQLEEKFNRHSSAAARDTKLKPFWLVGLRLLFGKPFYFLNQYARRGLWRAGWYGFMVANIAAHGRWLKDAKMMEIHLRKRETKTGD

SEQ ID NO: 5134 - protein, 358 aa, Clostridium chromiireducens
MITISLCMIVKNEEDVIANCLESVKDIVDEIIIVDTGSQDKTKEIVGKYTSKLYDFKWIDDFSAARNFAFSKATKDYILWLDADDVVLPEDAEKFKILKETLDPSVNSVTAKYNIGFDEYGNVTATYRRNRLVKRSNNFQWFGFVHEYLAVGGNIINSEIAITHRKLKQTPKRNLEIYQNKLKEERVEFTPRDILYYGNELYDHRMFDEALKYYNQFLDSKQGWFEDNIRVCEKICDYYQSIDKVEYGRKYAFRSFEYDTPRAEACCKIGFSFLHEKKYKQATFWYEQATKLEKPKDSWGFFNDACWTWLPHLQLCVCYDRLGDHKLAYDHNEIAAKFRPDDSRILYNRNYFKSIGIG

SEQ ID NO: 5135 - protein, 301 aa, Paenibacillus vortex
MSKPSISLCMIVKNEERFLARCLKSVQGLVEEIIIVDTGSTDNTKEIAECFGAKIYTFEWVNDFSKARNEAIKYAQSDYVLVLDADEYLESADQILLLLESLEKDIYFLSIKSFLRGGISTIHPVIRLFRNVPELKFFGRIHEQIIIPADSLFTQDHLEVMINHDGYMKDVITEKNKEQRNLKILLEDLEEQETGFGLFNLGIQYKMMGQYEQAIKTFEKAFPLSMEYSYICKLITSLIQCYMELEQFDKALVICHESIEAYPNYTDLYYLQGQIYESLHYINDASESFNHCLKIGVCKEP

SEQ ID NO: 5136 - protein, 370 aa, Lucifera butyrica
MSALPISVSLCMIVKNEEQNIARCLSSVYPLMSEIIIVDTGSTDKTKEIVSQFTNKIYDFKWIDDFSAARNYAFSLANGDYTFWLDADDVLIPEDYNKFHQILMALNSDVDAVSMLYNLAFDERGNVTCQLRRNRLVKTTKRFRWVGAVHEYLEVYGNVLNSDIAIYHKPHTHDAYRNLCIYEKRLLNGDTFTPRDLYYFANELSDHKLYNRAIEYYEKFLATKQGWVEDNIAACGKLCDCFYAIKDSNNQLKYIFKSFEYDVPRAEFCCRLGYYFLEQNVINQAIFWYRLAIQVGKPPNPWAVTNCACYTWLPHIQLCVCYSRIGEYVLANQHNEAAAVFNPDFPAVDHNRKYLQQFIASDKQSNDRNM

SEQ ID NO: 5137 - protein, 1269 aa, Unknown
  Description of Unknown: Thermoanaerobacterium thermosaccharolyticum M0795 sequence
MIEELLIEKLNRLKIEDDEKILLDLSLLNASVGNNEVAKLYLNEFKSRKKDGNIDNDIMISSVLIDYIYDDKFHLKWNNYRRERNQNEKKMFAVTASICQGNVLEIGCGNGDLSSYISMYGNRVFGIDIDPIAIEIARYKVWNYGLSDCFFTVEDANEIKLPDSYFDTVVLAEVLEHVEKPEKVIREAIRLCKNNGKVLISVPNGYKIPSPDHINIFNIDLIVKLLKSLGVAENNINFDNRVPSEWIFCWFYNKKDENKYSNCLNIIDLESYFLPPHPLEDLNKAGKVSVILPTFNGESYINESIDSILKQTYKNFEIIVIDDGSVDKTFKKLKPYIDKNQIKYLYQENLGKPVAVNKGIDISNGDFIWIFDDDDTAFPRKLEVQMRNFLRNPNIDLIHTGSIYTDSDNRLPLMVWEPSKIDQMDLLKGKLHGCLFHGGSVIVRKKCYSEVGMWDERLIRAQDYDMWIRMIRRFNIYRISIPTVTYRQHKKLRGSKSNPVPYEKIAIATKEYEKIIMDKIYNNIPLDEIFPEIKENPDNEGLKVSALIERAYAMAKRELFEYTLSDLKEAFDLAIEKYPVALTYRAIYFINKFNEMISNIPVDNIKHIISYFTLLINNHDVSNFPRKMNLTLSLCLITKDEEKNIARCINSVKDIVDEIVVVDTGSKDKTVEIAKSFGEKVKVINAKWEDDFSKARNTAIENATSDWILFLDADEEIKKEDVEKIKPLLYDDTVEAYMFKFINYSGASVSSGLSEIHYNFRLFRNNGKLKYVYPIHENLKNIEEDRAPIFKNADVTILHYGYLSEIRIEKNKTQRYIDMISKYLAKHPNDKFQQGNLAVEYYNAGEYNKALKHLLIATKSMNLNSYATPRLFRYLIMTYIALKEYDTALRVINDAKRYYEDIPDYKYLEGTIYFNQKRYEKALEIFKECALMGEYKGQFVTMGGTGSYRAKYMIGQCYEKLGKLNDAVKEYMEILKQYPNYQDVFIKVFDMFVRNEKPEDVYEFFRKHVNTKVPLNYIVVARQYINIGKYDIAKQYIDSIDIDLEGLNNLRGIIYMGLKDYENAIKHFEMEYGKAKEEANYREALCYIILKDIDKAKDLLWKITDSSDKKLYMTIVGEMKVKFDEVKDSFFNLLDLLIKLKEFDLYNEVLNLYVGLFTREEYERYGQMMINNGLDDLAVEAYIKAADLNSQNTEVYKYLGQKAYDQNMFNEALSIVGRAYNIDKTDVDIYRLIYKIYKALGQDESADEVNEMVKSMYPEVDLSESYALT

SEQ ID NO: 5138 - protein, 1459 aa, Unknown
  Description of Unknown: Flavobacterium pallidum sequence
MKKLSVCLIVKDEEEVIERCLSSILPIADEIIVVDTGSVDNTKAICEKFGVKLFDFKWCDDFAAARNFSFEKATKDYILWIDADDVIKPEEAAKLQSLKQNLTADVYYLKYDYAQDAHGNSNCILDRERIVKRENNYRWKYSIHEVIDCKQAFAKIHTDIIITHQRTSNGMEHDRHRNLSILEKAIRLPEYAHDARMQYYLGKEYQENGQFEKAIQSFKIALGINTGWIEDHISAQIKLAQCHLALSTTGKEATLNKSLASHHAKQAVKTDSRWAEAYFILGQMAFEEKSYEEAVFWFEKCVQPLPDVMSPVNNKYYGLFPYTQLMFCYDALKDYAKASHYNELALSVKPDDSGLLYNRTYFSNMANKLLDSFPTKALHFCNGVFRKEKYLNCSHTANEHVDFVIDPERLLFKDNTVSEINEEYYLSYLPIAKTETILAEWFRVLSPGGTLRIREHDLNACAEKFSGSKTTAEKNWYRHILYGFQNDDDSLHPNLSKKSGFSKQEWIQMISRTGFETEFVDSKDIHATPSIEMHLTKPKVTLQKIGWIAGNPLPDVNFPTYRIRAYNINKALRKTGFSSDLIHDLSDFGVADYQMLAFFRAINETDYNLMKHYKTLGKKVVFDVAEDLFDYQSEFPFYLPMLELADTVICCSDKLAEKISAYNQHVEVVEDAIENENTFKKDYENDGLLKVGWVGMPDNLHHPEALRPLIEACGYELVIISKGEKADLEWSESGWQQQLLQCDIAIAPIDAEKQPCKSNNKVSAYMALGLPVIASPLHAYQKIIRHGENGFIAENIPDWENTMRLLKDPSLRKKTGTAGRQSVLRFRPENMALKLARILVPEAYNSKAIDIIIPTIYNPGHLKVCVESVIACTQSPFHITVINNGIYNEMHDKCVKMIAADNLNFSQSINLGIKHTSAPYICIMNDDVIVSDGWAEPMKKSLSDPNVGFCNPLSNCEYGILHHHQMEVNGIKLLHHNNALIGLKVAEKQNPDISIRPESIQTYVPPFERKTVLVAWVAFYCTITTRKVIESIGLLDEQFNNGSEDVDLCHRAKKMGLQSVVNEESFVFHFGGTSTDKYRAEPGRMGETQKVIAAKYAAPLLVIYTGFSFEPWNAETIAKEGIGGSETAAAKMAKEFSLLGYRVVVFCHCVNLEGHFDGVEYQDLSCFNRFIDMHYMDVFILSRHIDVMQHKIRAVKKYFWVHDVWAKGTNFGDGDLVRKYQKEFDGIFCLSNWHKSFFQKTHGIDDSNMIVTQNGIDISNFGGSVVKEKNRFIYSSSPDRSLDVVLDLFPKIRKVLPDATLHIYYGFENFEKSLQYSSNPAQKTLYEKIKSGMQQEGVFYHGKVGQKDLAKAFLKSDIWLYPTQFTETYCITALEAQMAGALCICTAVGALETTVGDRGILISESPSDPDYHTRIVDKIIAIQNNPEKKQELILKAKAWAKEQSWANVAKKWNSFFSLQ

SEQ ID NO: 5139 - protein, 254 aa, Unknown
  Description of Unknown: candidate division WOR-1 bacterium DG_54_3 sequence
MPEISVVIATKNEERNIRDCLESVKWADEIIIVDDASSDKTVEVCKVYTDKIFINDSKGSFHKNKNFGLEKAVGDWILSLDADERIPEDLSKEIRIAVKDERKVGYYISRKNFFLSKWIRGCGWYPDYIIRLFRKGVTKWPLEIHDVPMIKERDKVGYLRNSMIHISYTSLEQYFDKSTRYTTRLAQEEYEKGARITKTNFLILFLAKPLAWFFRKYFLMRGYRDGFRGFFISVSSALTIFMTYAKLWEMCRRD

SEQ ID NO: 5140 - protein, 346 aa, Paraclostridium bifermentans
MITKNEELKIRRCLESVKDFVNEIIVVDTGSTDKTKDIALEFGAKIFDYEWNNNFSDARNFAIKQSTGDWNLILDADEFITHIDLNTIYNTINSTSNFIGQIKILNTFEQDGEIRKSIDFISRFIPNQVYFKGSIHEQINSNYPRIKLPICIEHDGYLNTNKFDRNINLLLNEFKSNKNDLYLSYQIAKTYYSNKMYTEASYYFDIFFNNISFYNSNFIYDGIVLYLYNLTKLKDFKKGLNVIDSVFDDMKNCCDFYFICGVLFTEAVAYNTDKYINYFQYIDKCYINALNLSESNGLEIVEGTGNYLSAFNLGLFYELSKNQNLALKYYKLSASYRYMPAMNKLK

SEQ ID NO: 5141 - protein, 446 aa, Enterococcus faecalis
MYSENFIANDWFNVEVFNKNKYTLTNQENKDVTELWLQILKGLKFPNELKETVSYSKNLKELSLKTHAEVSVCIIAKNEQDSIRKCINSIYEFSDEIIFIDTGSIDLTKKIVKEIASEKVKIFDYTWQDDFSDARNYSIQKASKEWILIIDADEYVSSDELTKLRLLIDMLDRFKFKDSLRVSCAIYQLDNVITHGQSRLFRNNNKIKYYGLIHEELRNNKGLDPIFNVESEITFFHDGYKEILRKEKCERNIRLLAKMLEKEPDNVRWAYLYCRDSFSINANIDFEKILLPFLIKNMDESISYENILLTNYTHLILFLITKKYIIDGKSSLASKCIEVLEKMLPNSSDVTFYKFLNKQHSLYEQQFEFLKEVIQFRKNNEYDQYSQIGCNLLHYDLLISGLLFDVKSYDYSYQYFLKLDLANYFSELEIPDEYKMLINKYRENES

SEQ ID NO: 5142 - protein, 348 aa, Geobacillus vulcani
MIVKNEEQNLGRCLQSIKNIVDEMIVVDTGSTDDTREVAYSFGAKVFNFAWRQDFSAARNYALEQSTCDWNLVLDADEYVVNDCGREIRHFLENGCQRIGRIKRIDEFIQNGEKRHAQSYLSRLLPKGVKYTGKIHEQVDSTLPRENINVEVYHDGYIQTNKTERNLELLLQELKKHPEDDYILYQIGKQYKLLQQFVRSEIYFEKSHSLASSYAWYRHSLVVDYLYVLMANRSFEKGLQLIAMEQEKLQDLPDFHFACALFYMEAAFCNSDQYAHLFPFIEKSFVRCLEIGETDNYDRVRGTGSFLAAYNLGVFYEVTGQTEKAISFYKRAANEGYEKAVERLNMLI

SEQ ID NO: 5143 - protein, 328 aa, Bradyrhizobium arachidis
MTDIHAIILTLDEEKHIARCIESIRSQCASILVVDSGSKDRTREIAAGLGAEVIENPWINYATQTNKAISACAGKTGWLMRIDADEYLTPESAAGLHDLLDRQPRDVGGIVVRRQIVFLGRRIKWGAIEPSWQLRLWRAGQGSCEQRWMDEHIIVTGRVVRSNIDLVDENLNSLDWWTSKHNRYASREVIDILASRGLLGENMDIQRHSASWQAKLKRFVKERVYEKLPGGVRPLLFFLYRYVARLGFLDGKQGYYFHVLQGFWYRTLIDAKLDEVMALAKRRRIPVSEAVRLATGFDPNVAVPAPAQPLPRIVAAEGERSRERAVAH

SEQ ID NO: 5144 - protein, 342 aa, Butyrivibrio sp.
MITVSLCMIVKNEEDKLATCLDCLKDLVDEMIIVDTGSTDRTKEIAESYGAKVFDFEWTGSFSDARNYSFEQATCDFIYSADADETIDEENQERFRQLKEDIDELNIDIVQMYYCNQLSHNTVYNYDRELRPKLFRRIRKYVWHDPIHEMIKLDSTVCNSEVEIKHNPTEDHGQRDLAAFRRAIREGEYISKRLHNMYARELYMVGTDEDFMLAKEFFEESIEDNGRDLDQIKEAACVLAHIAVIDGKAEEILKYSLKDLTTIPSSEMCYELGSYYRNKGDLVEAIVWYYNAAYETSPILDIHRGGDMALHKIAECYREMGNLEQAEDYENEANHWVVPDPS

SEQ ID NO: 5145 - protein, 357 aa, Bacillus sp.
MKKSITISLCMIVKNEEQTISRCLESVKDIVNEIIIIDTGSTDKTKEIVKKYNAKIYNFKWIDDFSAARNFAFSKATKKYILWLDADDIIEQKDQKEILHLKSTLDTKIDAVSMKYNLTFDTEGNPTFSVKRYRLVKRNKNFQWYGFVHEYLEVYGNLIDSDISITHKKEKIYTDRNLKLYQKHLASGKKFSPRDTYYYANECKDHQLYEIAIEWYTKFLDEKKGWIEDNIQACLKRTECYLKLSNTEGALYSSLQSFIYDNPRGEICCQLGSIFLEKNEYDKAIYWYHTALKISKPTNAPFLKEPCYTWLPHLQLCICYYRINNNEKSIYHNEQAAKFVPNHPSVKYNIDYFNNLK

SEQ ID NO: 5146 - protein, 761 aa, Ethanoligenens harbinense
MFSAKYAIMVLRGECMKAYTRKKGDVKISACTIAKNEAKNIARCINSYKEFVDEIIVVDTGSTDDTVRIAEECGATVLHFDWCDDFSAAKNFAIEAASGDWIICLDADQYFSENCGTQVRRVIENAERKGKNCVMAREVNLDDASGRQKSEVGVIRIFRAGLRYRFPIHESIFSPQGLEIATVPKLQFFYYHTGYSSDRFEGKLARNLRLLQKELETHPEPTREAALHAYMCDCYSGMNRHEETRAEARAYLEGRRKTGVRMLGLEAKPYINSINSLEKEEGPLEELDEWISMLERDFPGYPDAAYARARYDYRRRMFAQALEQFDRAVKRSAVYDGADCDSVGAEMERIDYFRGLCKWALGDAVGALDLFADLSRHAKNNAAMLRMLAIVKPMGDLHADAFAQDFFLSLDDAVKPQMLGAVMMYYMSKPATFGYAYMRDRQGAKDIDATLSGFIQAGNGDYLGASNFFYLNAVGAKNKDSAMRALLCAVLAQNADALEHAKSVAPPCQQAALGVADAPVAEDDIPQIASLVVEADRLRGGALSAQIARTAAEQLGTGLAQAFAEQLEKSFAYSAALAAVEAAPLSPETVFLRGYYTCRLGRMGEAEDLLRLAKAQGADGPAADGMLESAEKRLRAFRADKQPDMAAEQARVAAHLERGDFHTAQAALAVLRDLAEPDAPWYSMAAVTAYYLGQDERAALIVRAGLLRFPDDADLLYNAGDIYSRMGLKKCSKIYYEQALERCGDEALREQIRAALVSMPA

SEQ ID NO: 5147 - protein, 583 aa, Unknown
  Description of Unknown: Candidatus Brocadia sp. BROELEC01 sequence
MIDKERRAALNNNRPTLSACMIVKNEEKFLSQCLTSMKGAVDEIIVVDTGSTDTTVEIARSFGANVYHHPWNNSFSEARNHSLKYARGDWILQIDADETLEQSDIPLLHKLINDNSYNVIFVAIYNELPGGCAKHYFQRIFRRGKAYFEGIVHNQLIFEGKVLQSEIRFYHYGYNLSGQEMQKKYKRTGDLLRQQLTENPDNLFIMANLIRNYRNEYDFDKVIDFAENGLKISASQTDIVSKNQRQRISIDLAHALINKNLIDKAELVCKKALIENPDSFDILLVLGEVFIKKGFFKDALPCFKKYLILKEKDNKDPSFFLLSSDFYQYEHMVYNHIGECYKHLGETREAIVAYKKAIELNNKNPLYYSNLINLYISQNSLSNAKELTFTAIKSGVANHVIYYLLGRIYAVEGKINDAIDACKQSIKMDNTNMPAHSHLINLLIQTNRLDEATIILKGILSLYPDEFTFSCLMERIKYKQGDKESPACFVRNILRSKPSGRDIYLQLGDLCIEMEQYAAAIEVFERYLEISSDTDATVIANIAVCYAKQGKLESALFGFQSALKLDPNCVVALQNLAALKTNA

SEQ ID NO: 5148 - protein, 252 aa, Thermocrinis minervae
MLSVLIRTKNEEENIARAIKSVLDIADEVVVVDSGSTDRTVQIAKSLGAKVFFKEWEGYSQQLNYGLTLCQGPWILVLDADEEVSAELRDSIRKELKKPRYDAYYISRRTFYLGAFLKHAWYPEWRLRLFKKGTVKFEGALHERAIFNGRAGKLKGDIFHYSFKDLRYQYIKTLEYARIVAQELRKKGRKFRLYNLLLNPVWAFIKVYFLQLGFLDGIRGLSVAFSALVYVFLKYLFLWEMEHVERKDEGRT

SEQ ID NO: 5149 - protein, 299 aa, Vibrio breoganii
MKVNKVDVTVLVLTYNEEIHIERCIQSLKPFAQRIIIVDSYSTDRTVDLSKNLGAEVIQNKWPNNHSKQVNWALGNIIITSEWVMRVDADEYITQELGKEIAVNLRTPGDYSGYYLLRGHVFMGKKILWGGSAKTKMLRIWRTGSAKCEDKIMDEHMIMNDPQSKIGIFKSRFWDHNLNSLSWWTEKHNSYSTKEALMQMKLEASNEDFSSLNQYLKSHVYQSFPVWARSFIFFLYRYIFRLGFLDGFPGLAWHVLQGFWYRFLVDCKVRELKYNKPENVTIERWVEQRIEDIEKGDIK

SEQ ID NO: 5150 - protein, 260 aa, Vibrio harveyi
MITAVILTYNEEKHIKRCIESLIPVVDKICILDSFSTDKTLEIASKYQIVEFKKNSFLNYATQFNTALDVFDIETDWVFRIDADETIDSQCSNWLKFELQNVQQSITGIYLNRYMTFLGKTMTYGGMSTYWALRIWRNGYGRCEQRWMDEHILLSTGDTIYAPGKLIDDNLNNLSWWSHKHVDYSTREAIDILLKESLDNKLQIRSDFFGSSSERIRYLKSIYNAVPLFVRPFLYFFYRYILKAGFLDGREGFLWCLLQG

SEQ ID NO: 5151 - protein, 269 aa, Leptospira ognonensis
MRKLSVAIITFNEEKNILDCIHSVESFADEIIILDSFSTDKTKELASSISKVKFFENPFYGHVEQKNLAISHCKNEWILSLDADERADNVLQTEIINFLSNSEDESTQGFQIARLTYHLGRWIRHSGWYPQRRYRLFKKQSAKWVGENPHDFIEITDSKFGKTMKGNILHYSFSDFSHQLTTINQFSSIVAFSRFSKGQRFSLIKSILKPLGKFVEIYVFKFGFLDGIPGLYIALSSSFSTFLKYAKIYELEKGVIERPSNIRKDYGKK

SEQ ID NO: 5152 - protein, 368 aa, Bacillus subtilis
MISISLCMIVKNEEAVIGRCLDSVQEIADEINIVDTGSVDKTKDIAARYTDRIFDFKWIDDFAAARNFSFQQATSDYILWLDADDVFTKKDQELLLDLKRTLDPDIDAVSMKYHLAFDEENNVTSSLRRYRLVKREKSFKWIGAVHEYLEVYGKLHHSDAAVSHLPLSHDADRNLRIYEKMASSGKDFSPRDLFYYANELCDHGKMEQAIEYYLRFLQTKQGWIEDNIRACNKLADCYHSLGLKEKELSWVLHTLVYGPPRAETCCRLGYSFLEKNDFQSAVYWYEKAIENKGAENLAFQNRACATWLPHLQLAVCYDKLGQHQLAYQHNESALQYRPHDSRMLANKKYFEDILKMQTGSGGEHHGNQ

SEQ ID NO: 5153 - protein, 270 aa, Algoriphagus boritolerans
MNIPVTVIVSVKNEEKNLPSCLTQLSEFDEVFIIDSGSTDRTPEIVKDFGYTLVNFEWNGKFPKKRNWALRNLSFRNDWILFLDADEQVTSEFIKEVSLKILSTDDVGFLISYHNFFMGKKLRFGDKMTKLSLFRKGAGEYEQIEEDSWSYLDMEVHEHPILKGKIGVLKSPLIHNDYKGLEKYIERHNAYSTWEAKRYLQLKRDRKVNLTFRQKLKYGLLETGFLPYFYFIGAYFFKLGFLDGIEGYYLAQYKKQYFFQIQTKLKEFKS

SEQ ID NO: 5154 - protein, 545 aa, Unknown
  Description of Unknown: Deltaproteobacteria bacterium sequence
MKLSLCMIVKDEEDNIRECLKNIRKAVDEIIVVDTGSSDKTPVIAEELGAKVYHFRWCNDFSAARNESIRHATGDYIIYIDADDRISEDDAEKIADLRNKFPKKKDIAYSLKIMLPSPEKILNSAYQVRIFPNLPDVRFEYPIHEQIVPSLKRKGIRGLFTDIVIEHKGYEDYTLLRKKAKRNLRILKELLSKDPDSWFAHYFLAQTYEVLNEKELCEFHIKNSLTEECKKLDPNWFIGASLKYSQLLTEKGDRKAAIELLRKLEEEFPDHDIVRFFIAEMDMEEGNYREALNRYITVRPEKLSLVTIPISEDKIRYKYYLHIGQCNEAVEYNRLAMDAYKKAYELAYTSEFKKEALIKIIRLFIKMDKLGEAIPYMEKYAELHPSARSYNLLALGYMKEGLYEMAENSLKDAISIDPRYWKAILKLAELYIQTDKFPKAEEILNELLENRSIDKQHRLTVLLMLAFIHVSRVDLEGFLHNTDLILKHLNIRASVGSFQDLYYIYERISEQFGGLSQIWIESIKKYLNMLSAGGSFSYAHSVTQA

SEQ ID NO: 5155 - protein, 305 aa, Methylobacter sp.
MNKPDISVIILTHNEELHIERCIRNLLPIAREIFIVDSFSTDKTVQIAESLGAKVFQRPWKNYADQFQWGLDNCPVQTSWVMRMDADEYLESPLIDEIIRKFPVLPNDINGIYLKRKHHFLGRWIKHGDRYPLVLLRIWKTGQAHIENRWMDEHIVLDSGKAITCAGDFVDDNLNTVEWFIAKHNRYASREMLDILNHKYQLFSRDESIAEAESGQAKLKRFVKETLYNKLPLFVRPLLYFFYRYILRLGFLDGPEGFAYHFMQGLWYRCLVDLKCLEAERILKGADSREEKVARLTELTSLQLK

SEQ ID NO: 5156 - protein, 367 aa, Bacillus subtilis
MKRPKLSVCMIVKNEERHIARCLESVQPIADEIIVIDTGSNDRTEDICTSFHAQVYHHRWEQDFSQARNASLQHAKGEWILILDADEELDPDTGSLLPSLLTDSLPSLGCMKVVSYTGKEWDENEAFEQRQIRLIRNQQNITFTGRVCERPEGEEESSIFSLPCIIHHYGYLEQEAQQKHKHNMSLLNMELLTSSTDPSLLYQKAAEYDRGNEHDKALRLAMDCIKEYKRKKQIPPPAIYYLKYKLLIDAERYEEAERDIHEALRHYPDYCTLHYYKGIIMYQLKKVREAITAFDTCLQTNNENHQYVQVKGAADYRSSCWLGVCHAELRQHMTAVLYLQKALKANPKCIRAQRLLSELTKDQAAHA

SEQ ID NO: 5157 - protein, 644 aa, Hydrogenophaga sp.
MFNKLIKVTGIFSEAMRDAALFLRFNSYSPFVDKSKRAFYKIIIEAHTIEKGLSLKDPKLLFGKDKIRFVMAALSRYDIQHSSVPVHMSLGALEAYVNFHARAGISDPLLDEISGYLKAWESKLPKPWKGGTRDYSFNGQSPSNLQHLMASRSSIRTLQSAPLNPDLIFEAIALAQLAPSQCNRQSSRVHAYQDPTRIRELLALQGGSRGFAESVGNLFVVSSEICAWGGPGQRNQAYVDGALFAMCLMFACRSMGWGACPLNLAIDHKTESAIRRVGGIPAGERLIMMIAFGEPIAPETRVAFSREGLRRKSPPCMHEAFPMSITAIILTYNESRHIGRAIRSIQMFTDQICVVDSGSTDGTTDIAKQLGAEIYTHPFVNQAKQFQWALDNLDVQGEWVLRLDADEIIEPDLAREIAEKLPLLPTEVAGINLKRKHIFMDRWVRHGGRYPLLMLRIWRRGQGRIEDRWMDEHMVVWGGRTVTFGGGFADHNLNDLTYFTDKHNKYATREAIEVLSQRLDLFARDEALNTKSTSFQASFKRWAKENVYNRIPFTLSATLYFLWRYIFQLGFLDGRSGLIYHFLQGYWYRFLVGAKLMELERAVANLSDKAAICAELSRLTGYKLVAQTEPTEVGAQTSAQKARA

SEQ ID NO: 5158 - protein, 570 aa, Bacillus sp.
MKNSISLCMIVKNEEDFISNCLNSVKEVVSEIIIVDTGSTDRTIEIAKQHNATIIEEEWKNDFSLSRNIGLEHANGEWILFLDADEELCSESIEELKKWIVYPDADAYFFRVYNHFGEKGKEASVNPTIRMFQNRPEYRFSGAIHEQIADSIQRFNPEARFVMTSVCVDHYGYQPTIRDQKNKTTRNITLLKEELQSNPNNPFHLYNIGIEYLQLSDFENALRCFKKSRELVDPKVNYTHLLYKCEARCLGALNRIDEAITCCNAGIEAFPEYTDLHHYKGSYFMASGDFPSAKESLTRAIQLSEPKYYHTEAGIGTFSTHYLLGLVNESLSEDNEAIDHYYCSYQYLPTSHRPLYRIFQLLRSTERQNDLLTLLTSKIQLDSKEQRQVILNILLRTHCYSTAEQLLTLWLEENNSSIADQDLWRQIKEECRLLDTSYQNKEKNSPKPLLINEQLSRLFLLQNSSETNLPSDIHPRLDGHSLTSILNTERIARILYSQGFHRAFQQYIEKWKEEHATKEMKFQTHSVLQIVQTLSFNAEHHFDKVLKNHPSFELIRAAKMTLPFEEGLIE

SEQ ID NO: 5159 - protein, 357 aa, Anaerospora hongkongensis
MITISLCMIVKNEEDVIGRCLTSVQNIADEIIIVDTGSTDKTKEICGAFTPKIYDFAWIQDFAAARNFAFSLATMEYILWLDADDVILEEDRKRFLQLKETLNPAVDSVTMPYHLSFDQNGQVTSSLRRNRLVKRVKNFTWLGAVHEYLAVHGHIINGEVAITHQPLSHDANRNIEIYDKRLAAGEDFSPRDLYYYANELRDHQRTAEAIEYYQRFLATKQGWVEDNIAACGKLADCYAGINDRANSFRYMLESFAYDTPRAEFCCRLGFHHMLDAKYKQAAFWYELATRLEKPSENWGTINHACWTRLPHLQLCVCYDRLGRYQEANTHNEAAAQYIPNDPKIAYNRQYFQRMFDK

SEQ ID NO: 5160 - protein, 363 aa, Bacillus subtilis
MKRPKLSVCMIVKNEERHIARCLESVQPIADEIIVIDTGSNDRTGDICTSFHAQVYHHSWEQDFSQARNASLRHAKGEWILILDADEELDPDTGSLLLSMLTDSLPALGCVKVVNYTGKEWDENEAFEQRQIRLIRNQQNITFTGRVCERPEGEGESSTFSLPCIIHHYGYLEQEAQHKHKHNISLLNTELLTSSTDPSLLYQKAAEYDRGNEHDKAVDCINECKRKRQIPPSDAYYLKFKLLIDAERYKEAERDIHEALRHYPDYCTLHYYKGIIMYQLKEVREAITAFEACLHTDNAHHKYVQVKGAADFRPSCWLGVCYAELRQHMTAVLYLQKALNANPKCVRAQRLLSELTKDQAAYA

SEQ ID NO: 5161 - protein, 308 aa, Dyadobacter sediminis
MIDLSVIILTHNESKHIGRCIKSLLAVTDKIFIVDSFSTDDTVVLARSLGATVIQNPWVSYSFQFNFGIRNNPFNTRWLMRMDADEYISAELADELNNTINSIPEDVSGLYVKRRVMFMDKWIRRGGYYPIWLLRIWRNGHGTCEELWMDEHIKLSSGSTAQLQNDIVDHNLNNLTWWTQKHNNYAIREVIDLLNIKYNFDNKETVTPGFWGSQEQRTRFLKIKYAGLPLFTRPFIYFVYRYLIKAGFLDGVKGLIWHFLQGFWYRFLVDAKIYEVYYKAGKDKQQIISHFRTEYGKDLKNPNQSVRV

SEQ ID NO: 5162 - protein, 308 aa, Dyadobacter beijingensis
MVDLSVIILTHNESKHIGRCIQSLLQVTDQIFIVDSFSTDDTVAIAESLGAVVVQNPWVSYAFQFNFGIRNSPFQTKWLMRMDADEYITPELAAELNASLTQVPETVSGLYVKRRVIFMEKWIKRGGYYPIWLLRVWRRGLGICEELWMDEHIKLSSGTTAQLQHDIVDHNLNNLTWWTQKHNNYAIREVIDLLNIKYNFDSKETVEPSFWGSQEQRTRFLKIKYAGMPLFTRPFIYFTFRYFVKLGFLDGTKGLMWHVLQGFWYRFLVDAKIFEVYHRVGKDKEAIISHFRTEYGKDLRSPNQSVRI

SEQ ID NO: 5163 - protein, 250 aa, Unknown
  Description of Unknown: Proteobacteria bacterium sequence
MSTLSVTVIAKNEEASIARCLESVSFADEIILVDSGSTDRTIEIARSLGAKVTQTSDWPGFGAQFNRAIDRATQEWIFSLDADEWIEAPLAREIQKVIGDTSSVTGYRVPRRSRFCGNVVRHSGWWPDYTPRLVRNGHGRFSEEIVHLHLIINGTIGHLTNPIEHDSITSWEDANDKIERYSTAAAIQLASRGRRAMPTTAPLRGAAAFLKAYLLRAGFLDGRTGLMVAEYNYRYTYQKWHKLARMSKQS

SEQ ID NO: 5164 - protein, 272 aa, Bdellovibrio bacteriovorus
MVSSRESFDKTLIQRESGWVTKLPISLVIITFNEEAHIERCIRSCPFVDDVVVVDSFSTDRTVEIATKMGARVFNEKWKGFGPQKAFATAQAKNPWILSLDADEALSPELAAEIIAKFSGLDPEAGFLVPRRSYYLGRWINHGGWYPDYQLRMFNKDKSQWNSAALHEKVEVKRQLKFQHDLHHWVFDDVADQVQTNNRYSSLGAQGLADKGRRFSYFNLLTKPATKFVETYFFKAGILDGLPGFLISVSAAYSVFLKWAKLWEIERVQKRS

SEQ ID NO: 5165 - protein, 459 aa, Unknown
  Description of Unknown: Candidatus Chrysopegis kryptomonas sequence
MNKPKLSLCMIVKNEEKFLPGCLESVKNIADEIIIVDTGSTDKTIEIARRYNAKIFHLDWKNDFSIARNESIKHSTGEWILVLDADERLNPNQETKLKKYLNSNFDALYVKVINLGKDGKPDVINEYPRLFRKKDWIKFEGRIHEQITPSILRNCGKIAKTDITITHLGYAQSDEIMSKKYERNLNLLLEEIKENPDNAYAYYHIGIIKILTGEKENGIEWLKKAISIQKEKSNLGDSLLASIYNIIGKYELQNERYQEAIDYFVKSSKLAPTQLTSYYLSGIAHAKLSNFHIAKNFFEIALKNLKAISNGKSLDVSLENMVEENEIHFKLMICYFKLGNYQRMKEHLLKVIHDEILYKATIDFLVEEYKLGVGNAINVLKEISTIKPSFEIFKILSGIYQINGELEDAVKNLEIALNFKDDDDEIRYNLGMCLVGLRRFDEAIRVLSDFKVRENSKFF

SEQ ID NO: 5166 - protein, 284 aa, Unknown
  Description of Unknown: Cyanobacteria bacterium QS_9_48_30 sequence
MLLSVIILTKNEEANLPTSIASLQKLDAEILIVDSGSSDRTVEIAQQTGCQVFEHPFENYAQQLNWALQNLPITTPWIVRLDADERLTPELVEELNRILPQTPDDITGYQVKRRVFFMGRWIRHGGYYPTWLLRVWRTGVGTCEQRWMDEHIVLSEGKIASLRHDIIDENQKGLSFWIDKHNRYADREVKDMLNVATESDELLANNEQHSQASQRRWVKKNFYARSPLFLRAFLYFLLRYTIGLGFLDGKEGLIFHFLQGFWYRFLIDAKIYELQKKNMLIDEQ

SEQ ID NO: 5167 - protein, 366 aa, Paenibacillus sp.
MITISLCLIVKNEEKTLGRCLSSVKDIADEIIIVDTGSTDSTKQVAGEYTDRIEHFTWIDDFAAARNFAFSLATKSYIMWLDADDVLKEKDQQKLINLKRNLDPSVDSVSMEYHLAFDEFGNVTSKLRRNRIVKRERAFQWIGPVHEYLRVYGNIIHSDAAVTHSSLHHDSDRNLNIYEKRLAEGEVFSPRDLFYYANELKDHGEFDAAVRYYDKFLATGKGWLEDNIAACSRLADCYNKLQEVRSMVDSIFRSFHYDNPRPEFCCRLGYHFLQQREPKLAIFWYKLALSAERNDHSWGFENLACSTWLPHLQLCVCYDRIGQYEKAYEHNEKAAQFRPSDERILANRSYLSTRLGKDFDKTSVKP

SEQ ID NO: 5168 - protein, 366 aa, Clostridium isatidis
MIVKDEEATLERCLNSVIDFVDEIIIVDTGSTDNTKKIAKNFKSKIFDFEWIDDFAAARNFAFKKASMDYILWLDADDYIDDINREKFKLLKESLNKNVDSVTMDYSLIRDAAGNTSFSLKRNRLVKRERNFQWIGRVHEYLEVFGNIIDSDITIMHDKLKAATDRNLKIFLKMAEDKLPFSPRDRYYFSNELYYNGRYEEAIRNYELFLSENKGWIEDNKAAYNNLIRCYRIQGNDEMAINTILRYLKEYKPTGEICCSLADIFSSQNKIEEAIFWYEAALKCEPGERHLGFNNKAYYTWVPALSLVVCYSKLQNYEKAYYYNELAGLQGGDMNKINYNRRYFQHKFLELKKELPKLKLDLRFDI

SEQ ID NO: 5169 - protein, 370 aa, Bacillus sp.
MRGGRDLVNENITISLCMIVKDEEQTIARCLESVKEVVDEIIIVDTGSTDQTKEIVKEHTPYIYDFEWIDDFAAARNFSFSKATKDYILWLDADDILMETEKDKLLQLKENLDPNVDAVSMSYYLAIDEKGKPTYSSVRNRLVKRIQNFQWIGFVHEYLAVYGNIMKSDIAIMHKKEKEHTDRNLRIFENSLREGRTFTPRDIVYYANECFDHNKYEKAIELYKQFLDGKEGWIEDCIHACGKLADCYKQLQKSEEALQACFHSFQYDIPRGEICCRIGHIFMGKEDYKQATFWYEMAINVPFQNSTRFIDYASYTWIPHLQLCVCYSRLGDNEKANYHNEQAAVYVPDHASVKYNQEYFRNLLKEDTQK

SEQ ID NO: 5170 - protein, 367 aa, Sporomusa silvacetica
MPEYAKQSHSPITISLCMIVKNEEATIERCLQSVDQIADEIIIVDTGSTDKTKELVSQFTNKIFDFEWIDDFAAARNYAFSKATQEYILWMDADDVFLSQDLQQLVELKATLNREFDVVSMLYNLTFDQFRKVISQLRRSRIVKREKDFRWIGAVHEYLEVSGNHLETTIAVTHKPLGHDSERNLKIYERMQLKGEVFSPRDLYYFANELRDHKLYNQAIEYYQKFLATRQGWVEDNIGACARLADCYYQLQDVENELKSIYLSFQYDTPRADFCCRLGFYHLNNNQLKQAIFWYKLATQLDIENSSWGLVNYRCATWLPHIQLCVCYSRIGDYKLAYEHNEIAAKFIPDEPLIQHNRKLLQEQLGN

SEQ ID NO: 5171 - protein, 260 aa, Unknown
  Description of Unknown: Candidatus Gottesmanbacteria bacterium CG1_02_37_22 sequence
MTKNTISAVVLYKDEEDTIDRCIRSLSWCDEIVLIDDYSTGKKLIQIKESFPSVKVFKNHLNDDFASQRNYGLTKSSGLWILFIDADELVCEKLKLEILSIIKNNHIYRDEVNGYFIPRLDNIFRKKLKHGETAKIRLLRLGRKGKGIWKGKVHEVWEIEGEKGLLEYPISHYPHPTISAFLKSINRYTDIRARNLYVMGKKTNIFSVVVYPLGKFIYNFIFRLGFLDGMQGFVVSIFMSFHSFLVRSKLWMLRHNNDNE

SEQ ID NO: 5172 - protein, 377 aa, Desulfotomaculum reducens
MAKTISLCIIAKDEEQNIARCINSAKDYVDQIIVVDTGSTDYTVELAEELGAEVYHFIWQDDFALARNKSLEHATGDWILFLDCDEELDPDTAPLLKGVIENENFNGYSLKIINMFNNQPGTRFLGFRMFRNSPLHRFECPIHEQILPSVIRNSSRDKIGQSDITIYHYGYDIDEAANKNKIERNLRILHKAHQDYGNTGFIPFYIAVEHQKMGDYQKALDYYTLSLGRSDINENYVPSMIRSMVTCYINLQQYQEGLDFADKFLKVFPNYTDLVYLKGILYSHLDNIPQALECMNQCIAMGPPPINLFSVHGIADEKPKSFIQNITEGLIRQGLELFIQGNKAQAYTALDTAFQQLKKTPDEECYTQMIETMISFL

SEQ ID NO: 5173 - protein, 373 aa, Ruminiclostridium sufflavum
MITVSLCMIVKNEEEVIERCLSSVSDLVDEIIILDTGSADKTKAIISKFTDNIYDFQWIDDFAAARNSAFDKATMDYILWLDADDVMDDINRNRFSALKESLETDVDSVTMEYQLSFDEYGNVIFSLRRNRLVKRANKFRWIGPVHEYLEVGGKIYNSDVSIAHKSLHHDSDRNLRIYEKRLSKGEKFSPRDMYYFANELMDHKKYKRATQYYKQFLGTGKGWVEDNISSCSKLADCYHYLGDYDNELDAVLKSFRYGGARAEFSCRLGYHFLQDKDLSSAIFWYKLATMLKPTREQAGFQNQSFYTWLPYLQLCLCYSQLGEYKMAYLHNEVALQYRPNDQRMLQNQKFLEEILGPEVPGINNTEGKDDTPE

SEQ ID NO: 5174 - protein, 359 aa, Bacillus sp.
MSSISLVMIVKNEERVLGRCLDSICDLVDEIVIVDTGSEDRTVEIAGKYTKHIYSYEWTNDFAAARNFAFQKAGKEYTMWLDADDIIFPEDREKFLHIKESLSHKPDSVLMPYVLGRDPYGQITSSLKRNRLVKTSRGFQWKGAVHEYLEVHGTIIEVDICITHLSVKSKKTDRNLKIYEQLEQQQKQLSPRDLYYFGNECFEHGLLEKCLKLYREFLDTNAGWQEDCIAAIDRAAEALLQLGRTEEAEELLFESFKYDIPRANISCKLGYIYFSKSLYHQAIYWYKAAAECDLERVKETGALVNYAYYTWLPHIQLCVCYDKIGKKELAYCHNEMARFYNPTNNLVLQNKQYFEKIIT

SEQ ID NO: 5175 - protein, 376 aa, Paenibacillus odorifer
MALSKWGFDLTSSLYSGTRKVTVSLCMIVKNEEHTLGRCLSSVRELVDEIIIVDTGSSDGTKELAASYGARVYDFEWVNDFSKARNYAFSLATQEYLLWLDADDYLQLEDAKAFQSIVSELPWDIDAVSMHYYLDCDKDGSVTSSLRRNRLLRRNCEFRWIGVVHEYLEVAGNVFYAELGITHDRKHTQSSRNLLIYEGMLKAQTRFTPRDLFYYANELYDHGQWQRAIKQYDAFIVMPNGWLEDKLLASRRAGDALSQLGLFQEAKLKVLQAFALSPPRAEACCQLGSYELIEQRFENAAFWYKLATEVPKPTELNARVDLPAWTWLPHLQLCVCYDRLGQYEQAHYHNEIAGGYVPDYPSVMVNRDYLKQYITL

SEQ ID NO: 5176 - protein, 296 aa, Unknown
  Description of Unknown: Candidatus Roizmanbacteria bacterium GW2011_GWC2_41_7 sequence
MQKISVVISAYNEEEVIESCLKSIAWADEIIFIDNSSLDKTASIAKKFKAKVYSRPNNPMLNVNKNYGFTKATGNWILNLDADESIDQELHQEIHKILQSKQSEYQGYKIPRKNTLFGKWIKHAGWYPDYQTRLFRRGRGTFAEKHVHEHIQVTGETGTLSGHIIHHSFRTVSQFIKKHDLYSSNEAENLMKDGYHFDTFDIIKLPRREFISRYFAREGYKDGLHGLALSLLMAFYHLLIFLKLWEKQQYAEQSLKVSDVEKELNAVHDEMGHWFLETSESKSLSKIISAKLKRLL

SEQ ID NO: 5177 - protein, 300 aa, Unknown
  Description of Unknown: Flavobacterium sp. sequence
MTTPISTIILTFNEEKHIERCILNARRFSKEIFVVDSFSTDNTIEIAKRLGAIVYQNKWEKNYARQFNWGLTHLPVTSEWVFRLDADEYLSDELIDELSEKMPALDRQISGISFERKMIFMDKMITRGMPQMHMLRLFKIKDGHCEDRWMDEHIVLTKGKTARFEGSFVDHNLNTLGWWIAKHNGYAIREAVDLLLLESSIHIVDAEQEKLTSIDAMVKRKNKLRYSRLPLFWRSFAYFIYRYIFKLGFVDGKVGFIWHFMQGWWYRSLVDAKIFEIKKHCGQDESKLKNYLSTNYQIEI

SEQ ID NO: 5178 - protein, 304 aa, Unknown
  Description of Unknown: Cytophagales bacterium sequence
MLDLSVIILTHNEEKHIGRCLESLRPITDNVFIVDSFSTDQTVEIARAMGATVVQNPWVTYATQFNYGIQHNPFQTTWLMRMDADEYVLPELAEEIAHRLPTLPDTTSGVYVKRRVMFMDRWIRYGGYYPIWLLRLWRRGQGICEQTWMDEHIKLTAGQPINFANDIVDHNLNDLTWWTQKHNNYAIREVIDLLNIRHNFDQTERVEARLSGSQEQRKRYLKERYAWLPLFTRPVLYFLYRYFVRLGFLDGRRGFVWHFLQGLWYRFLVDAKLMEVIRKTGHDREAIIAYFKSAYGKDLRAGVR

SEQ ID NO: 5179 - protein, 296 aa, Unknown
  Description of Unknown: uncultured bacterium sequence
MLSSVKYINMKLSVVLATRNEEENIERCLESIKSIANEIIIFDEYSTDRTKEIAEKFGAKVFLEPHHDIFHITKQKAIDMAKGDWILQLDADEVVSPELSMEIQGIINHEVTSSAYNQSPIIKQNKLFDRHQKLIEQRNGPIGKQDGEVVAYFIPRRNMFLGKPLIHAGVYPDGVIRLIRKGKAYLPAKSVHEQMVIDGKVGWLNGDLLHFDSPTLSRYLNRLNRYTDLKAQELKSSKTPKNLWSFLQFTILHPTYYFLLLFIRHLGFLDGVNGFLWSFFSALHFPIAYFKYITNK

SEQ ID NO: 5180 - protein, 363 aa, Amphibacillus xylanus
MNEISLCMIVKNEEEVLRECLSSVKEIVDEIIIVDTGSTDKTKEIAREFTDKVIDFEWIDDFSAARNFAFSHATKDFIFWMDADDILLKADQDKFKKLKEELNESVDTVSMLYHIAFDDYGNPQFSFRRNRLVKRSNNFKWKGAVHEYLEFGGRVIKSDVAIRHRKKDKKNVNVQSDRNLKIYENRLRKGEEFTPRDTFYYANELRDHRQFEAAIQFYQKFIDMEQGWVEDKIRACINLAACYRELGDLENEIEALIKSIVYDVPRPEVSCRLGDLYKERKLYNKAIIWYQIAIQANVEEIQGFRQESYSTWYPYLQLCVCYWHTGQKELAVEYNNKAKKYRPNDQAILNNEKFFEEYFSNKS

SEQ ID NO: 5181 - protein, 301 aa, Citreimonas salinaria
MHLTVVILTKNEERHIERCIDSVTSFATDILVVDSGSTDRTVELAEAAGARVLSNPWTNYATQLNWGIDRVGLDAEWVMRLDADEIVQPDLAEEIRTRLSGLPPEVDGVYVSRHMTFLGRPIRWGGVFPVRMLRLFRNGRGRCEMRWMDEHILVEGAVANFRGSILDDNLNSLTWWIEKHNSYASREAVDLLNLEYGFIPHETVADLSSGQQAGVKRWLKEKVYTRLPGGVRAFMYFFYRYVVRLGFLDGKEGAAFHVLQGLWYRYLVDAKIYEVRKEIRAGDGDPVAAIRRVLNIDLTAS

SEQ ID NO: 5182 - protein, 343 aa, Synechococcus sp.
MKSPLLSLCMIVKDEAHQLGRCLESVQPYADELIVVDTGSTDDTVKIAAEFGAKVFEFAWGNDFSAARNHSLDQACGSWILVLDADEVLRVETPDFKAQLQDRPEIEVYTLTRQEFATQSQFSPFRITRLFRNQSYLRYAEPFHEQLVSLRPEIPQVEHLPGLVIDHYGYGPDVMMSKIKSRNIPILEAIRASRGLSLTLLFALSDLYEATDQAAAAQACQEELFERILPHLLDNAPITNFPALPEALYRLGCKLLELEDWETVRLIGQRGLAWYPHYPPLNYLAGLFLNSLQFPLGASAYFQNCLDLGQTQTYDQSFPFNQAYMGQFAANMLSQCHPELSLQ

SEQ ID NO: 5183 - protein, 362 aa, Bacillus patagoniensis
MVEISLCMIVKNEEAVLERCLKSVENVVDEIIILDTGSTDKTKEIAARFTEKIYDFKWVNHFAKARNKAFSYATKTFILWLDADDIFKADDAKKLKELKKKITPKTDAISMDYHLGFDGNGGVTSSIRRFRLVKAENQFKWHGAVHEYLEVFGNLEHSDIAVTHLSLDDGHDSTRNLEIYEQMKRNNETFSPRDLLYYANELTDHSKFEEAIKYYIQFIQTEKGWSEDVIRACNKLADCYSNLGIVEKARDWSFRALEYGKPKPETCCRIGHIFIEKQLFPEASYWYEQAIVNKETVGYFQNIACETWIPHLQLAVCYDKMGLTEKGNQHNELAGKYLPNDERVAYNRTYFTKRLALLETDN

SEQ ID NO: 5184 - protein, 630 aa, Unknown
  Description of Unknown: unclassified Paenibacillus sequence
MSKTISLCMIVKNEEQVLGRCLESVKDVVNEIIIVDTGSTDMTLDIARKYTDKIYSFEWVNDFSAARNESLKYATSDYILVLDADEYLEVGADFQKDLEKNCDYYLFRIRNEISWDRNFTFAAIRLFKNHISLKFENRLHEHLNIINGTAEYTMGESNLLINHVGYTDDKMLEKDKHKRNLPLMELEVAENATAYNLYNMGKTYFAIQEYKKAVDFFKQAYPLSKDRLFLPELLTKIAYALAEINQMEDALSILTDAVMMFPRETEMRYILGMVYQKAEYYRDAEACFRKCIELGDQGSLITEGSGGYMAHMRLSELYEEIGLLEDSYRELACVLSLKKNFAPALQRYLNLTLKLNMSSQDIQTGIQQHYTLKSVDDLQQLLDIMYGVRNPLLDYYLTTYNITVQPNVLATSKIYNKKYREASILWNEIADKEIENGQDLLLLAFLLKDVSNLVHVQNLLNLSNKERNALEKMIIGQDGKYLLTPVIEGLLLENCRQMIILQEFEQFQILVERMIEIKSEIRLNIGKLLSDYRFDELAIDMLITMFKAKPNNVQLVRLLGDLCLRNNYFEDAHLFYTKLLALDPKYDSYERSLNYYEKVIDVEGTMKIKREMEKRYPYASHVKKTNEEQK

SEQ ID NO: 5185 - protein, 368 aa, Paenibacillus sp.
MITTLPISACLIVKDEEMYIEQCIQSLKPVVNEIIVVDTGSTDQTLAKLEQNSINVFHYEWNNSFSEARNYAISLASEPTILVIDADETLDPSTVPSLNEYLSHSRNLPASVNIVSKLDRYRNVNSRITRLFPNSEDYRYHGMIHEQLYYKGNSINEVKTTNVVLHHFGYDEAEVKKKQKINRNLELLEKQLKSEPESTYLRYQIGQTYYVGGHYHQAIENFDEVLQLISSQDTIPSFLPTVFLSYGYCLHNTSQYPILDRLLNDAFEFFPDYTDLYFLYGVSLIQRGNLKDIEVIKETFEHCIAMGEVTNPIYESVEGVGSYRSYYNLGVYYEATNQVEIAINCYNESAEMNFEPARIRVENIKKHR

SEQ ID NO: 5186 - protein, 344 aa, Lachnotalea glycerini
MITISVCMILKNEGAVLERCLESLLPIADEIVIVDTGSTDKTKEIAARYTDKIYDYEWQNDFAHARNYSFSKAQMEYIYTADADEYLDRVNIERFLTLKRAMLLEIEIVQMKYTNQLQYGTTYNYETEYRPKLFKRLREFVWINPIHETVNLEPIIFDSDIEVIHMPVKSHATRDFSNILKIIESGRKLSKKLFIMYAKELFIAGSDQDFLNAKNYFECSLEEETKGVEELKAAQCVLTKCARLTKDYNMILKNSLKNIADGKASAEVCYEIGEYFYEVEDYIEAAIWFYNAAFETECELNIHYAGDYPLKRLTEVYRILGNYSLEEEYAKLLDEWILPQSPDV

SEQ ID NO: 5187 - protein, 304 aa, Methylomonas koyamae
MHGLTVIILTYNEQLHIERCIKSLPPIVRDIFVVDSYSTDKTIEIAESLGCKVLQNTFVNQSVQFQWALDNCPIQTDWIMRMDADEYLLPDLADEISTRLPNLAEGINGIFLKRRHYFLGRWIRHGDRYPLILLRIWKTGQAHIENRWMDEHIVLDSGKSVIFEYDFVDDNLNTVEWFIAKHNRYASREMIEVLNNKYQLFGHDDSIQESQTGQAKVKRIIKEKLYNRLPIFVRPVLYFLYRYFLRLGFLDGKEGFAYHFMQGLWYRCLVDLKCLEAEQLIKDADSRQEKIARLEKLTGLKLGN

SEQ ID NO: 5188 - protein, 637 aa, Anaerospora hongkongensis
MKISACMIAKNEEKVIARCIESYRAAVDEVIVVDTGSTDQTVAIAKSLGAKVFHFTWIDDFAAAKNYAISKAKGDWIVFLDADEYFVEGTGGKLRTCLEKLDKAFGAVACRMINIDEVNGKTISEIVHVRIFKKDKQLRYVNPIHEALHYRDKDGNINAYLADKGELLIHHTGYSATVNQVKARRNLELLLKQVDDNIAAKPEYYYYIADTYFTLDKWDKVITYIRLFIDTGAKLTNLNVRVYNILIDAMMELGYSLNEIMREVNIAITQFPQHPLFHFYKGKLLYDDKCYDAAFTELRQALQLHENYQDIEVNSLAVNLGTLYNLMAVISEFRNDAGTAIEYYLETLKLDKYDATAFDRLLKQIRSQPLQDIISFLNTLYDVEYEADLDFLATSLVNHAVPQVLAYYTSLREKKYPKQDYVVLQMLVANGHYDKAFAALLECYSRDGDERLALVSATAAMLSGNGAYMEKASEQLPSAYAKLLKAYRGDIILFAEEDKAAFLNLVRTFIFWAGDDAMQKMLNLIDQFPNGMGISVASLFVQEGYYQAGLQYYDYAVQRSVYAGIQVHSGLYFNQGYCLHRLNNPVAATEAFLKAYEAGYRVNDIYEFLRWNIGKLDADSLRVRVNEILQHSSEVEP

SEQ ID NO: 5189 - protein, 319 aa, Clostridium sp.
MTTFSLCMIVKDEEEVLSRCLNSLCDIMDEIIIVDTGSTDRTKEIAKKYTDKVFDYKWCNDFADARNFAASKAVGDYIYTADADEYLDNENKEKLRQLKKIMLPEIEIVQMIYHTPAELSTVYNFEEEYRPKLYKRLRAFTWIDQIHETLRIDPVVYDSDIIVEHRPLTNHATRDFKAFERIAADGKRFSKKLHHMYAMELFRSGEDKDFLKAERLFKRTLEEDGRSIDEVKEAFCVLARCYRLKGDAVAFMECALKDAATTLCAEICCELGVYYESIGNVSEAVMWYQNGLTETESILDIRSSGEIPKLALRRLGMDV

SEQ ID NO: 5190 - protein, 382 aa, Paenibacillus ferrarius
MSRPTISLCMIVKDEEELIAACLNSVKDWIDEMIIVDTGSTDRTVEICQSFGAKVLAYEWNNHFADARNHGLAHATGDWILYLDADEELAPLGDYDLHAQLRQEHASILSLHLINYIGEVPNEDEAFHIAHPRFFRNYRGLKFKYPIHETLNVDEIYENQDLSAIMGHVPLKLWHRGYMDSITQQKNKYERNMTLLLQEANEQSSNPWTQYHMASEYYRVHRYDKAFEYVNLSIVRFIQSGRMPPSLLYKLKYAILFNTGSIDGAWPGIDKAIALYPDYVDLHFYKGVIFYLKTWYAGALDVFQHCLVLGETMGQHLTLRGTGSFHAWYYIGLCSENLGNSQQAAQAYEAALRLSPTYTLASDALLKLRIGRANKEGTESRG

SEQ ID NO: 5191 - protein, 361 aa, Clostridium botulinum
MKITLCMIVKNEEKNIERCLESTLKIVDDAIIVDTGSTDRTLDIIKTFGEKIQIINYNWENDFSKARNLSIKNANGDWILVLDADEELICDKEKLISKLKDTNLNSFNVTWINVLDNKGELDSFAYNRVFRNKGYRYYRAIHEQLDVNEKESGILEEEIFKIIHYGYTKESMEKNNKISRNLKILLDCYNNDSEDPFVCYHLGATYASSRDYRNALDYFIRSYELGLNRGFGAYYYELIKRMSECIYLLHDYKLCIDFITQLLSKEDIRNFTDLYYIAGSCFYKMKDHENAKKMFNKCIELGESKNLPTFTGRGSFLSELMLARIYVDKNDSKNAKMFYLKVLEAKQSLSKDIIKEIYRYI

SEQ ID NO: 5192 - protein, 262 aa, Unknown
  Description of Unknown: uncultured bacterium sequence
MSNALSLSYVFITYNEEKNLGRALESIKDTADEIIVLDSGSSDKTVEIAESFGANVLHNKFVDFASQKNMAISHACKDYIFVLDADEELSEDLKRWVEDFRGGKLEPFHYNAAGFFVARKSSFLGRWINHSGWFPDYTLRIIKRGAGSFKKARVHESFEVHGDKIKIDKNNFMWHYTYQSLEQYFDKFNAYTTLAARDLHDRRLRPSPVRIIFNPLFGFIKQYFIKLGFFDGFHGLVLAVLSAFYVFVKYCKHYFLSAEGKR

SEQ ID NO: 5193 - protein, 287 aa, Syntrophobotulus glycolicus
MSDVTAIILTMNESKNIGDCIKSIQNFVSRIVVIDSGSSDNTVEIAKSLGADVYFHEFENYAKQFNWGLDNTNIATKWALRLDADERFTHELSEEAKQAIAEHNDDDVNGFVLRLRVFFLGRWMRHGSVYPFRKLMLFKFGIGRIEQRNMDEQTTLSCGKSIELNNDALHFDFKNLNYWINKHNWYATREMQDYLEMKINKNIQQISDEHIKNRRRQKLIYYKFPIFIRPLFYFIYIYFIKLGFLDGKEGLIYHFLRIFWYRFLVDAKIYEHEKIGGEIERTGALRS

SEQ ID NO: 5194 - protein, 351 aa, Tumebacillus permanentifrigoris
MIVKNEENTIACCLDSVKDLVDEIIVVDTGSTDRTKEILRSYTDKVFDFPWIDDFSAARNFAFRHATMDYIFWLDADDVLLEDDRKKFSSLKDTLNPHVDSISMIYSLATDEHGSVTSSLRRNRLIKRKNHYRWHGAVHEYLEVWGNIINSDITVTHTKVHHNSDRNLRIYESRMARGEKFSPRDLFYFANELVDHQYHEQAIEYYQKFLETGQGWVEDMISACGKMADCFQHLGDHERERQSIFKSFEYDTPRADFCCRLGYQFLNKNQYPLAVFWYKLATQLDKPVEKWGLLNHACWTWLPHLQLCVCYSNLGQYKLAFEHNEIARKYVPTHASVLHNKSFLESIFEQK

SEQ ID NO: 5195 - protein, 301 aa, Bacteroides stercoris
MHHNSIAALILTYNEEKHITRCINSLKDVCEEIFVIDSFSKDKTVEISKILGAKVYQHPFENQARQFNWAIKNCPITSDWIWRVDADEYIEPALAEKVVISLPHVSLDVNGIYVNKKIVFMGRSLLHGGWYPAQQIKIIRKGYGTSEDKWMDEHLIIFSGTTISIDGDQTDENLNDLSWWTQKHNNYSNREAVNMLLMEYGMNNQGEEVASKLFGTDAERKRWLKMKYVRAPLFLRPFINFFIRYILKAGFLDGKQGFIWHFLQGFWYRFLVDAKIYEIKKQFDFDDERIKQYLIENYLTK

SEQ ID NO: 5196 - protein, 373 aa, Sporomusa malonica
MSEFAKQSQSPITISLCMIVKNEEATIERCLRSVKQIVDEIIIVDTGSTDKTKELVSQFTNNIFDFEWIDDFAAARNYAFSQATQEYILWLDADDVFLDQDRQQLLDLKSTLSREFEVVSMLYNLGFDQYGKVTSQIRRRRLVKREKNYRWLGAVHECLEAYGTQLETTIAVTHQPLGHDSDRNLKIYERRLLKGEVFSPRDLYYFANELKDHKLYNRAIEYYQRFLATKQGWVEDNIGACGSLADCYYQFNDVENQLKYIYISFQYDTPRADFCCRLGFHHLNNNQLKQAVFWYKIATQLDIANASWGLVNYPCSTWLPHLQLCVCYSRIGDYKLAYEHNEMAAKFIPDDPRIQHNRNFLRSQLGNENKQDT

SEQ ID NO: 5197 - protein, 658 aa, Paenibacillus sp.
MKLLSICMIVKDEERVLERCLSSVQDLADEIIIVDTGSTDKTKEIAKKYTDKVYDFKWCNDFSKARNESIIHATGQWILVLDADEYIAAEDHQDWRDFLHKEELLPHLAYTLPVINFTGEKEYEDEITTAPVTRLFPNNMGIMFERPIHEQLTRGLQGDLYYKAINLNIYHTGYQISRILEKNKHERNMGIFEQMMADQELTSYDWYTLGNQYRYAKDAIKAIECYEKAMRDVDRNEAWYPHCLMGLVSLYYSQDQLNRSWELTEKRLIRYNQYPEYYTVKGIHYETLGFFQDAELQYLKAIDVAEKRAQKNQDIWLIDPMYSFDSPVQQLIGLYFRLNDNKNAIYWMSKQLNKNNKNPGHLVKMMEWLLQNEDEESVIRFFEKIYVSPTEGEYLLLFKVSLVLGNKGLVSHYKKLVSIDVGLSLADQLKLSVINNDSARMHALLNDITVITDDEELVWLQVIIGTLVWKDYSLLEKLSRKLDNNRLSSASKVILGVFGQNEVSNDTVIETDILFAIARQLFLTQEFEIFDQLVNGVNNSDVINRLANYFYDVNRVELAMNYYSALLTRNELNGMSLENLGYYHANQNYRDDAYEFFNAALEDESAKRHIYKTLISLAPNEEKMKVVNDFNNRFPDFKEISFVEEFFNNEIKLVNNTV

SEQ ID NO: 5198 - protein, 368 aa, Massilibacillus massiliensis
MTTLEENSAKPMTISLCMIVKNEEATIERCLGSVAKAMDEIIIVDTGSTDTTKEIVRQFTNTIYDFTWIDDFAAARNFAFQQATQEYILWLDADDVMLTDDLEKLLTFKQSADKTVDAYTMNYNLSFDTNGNVASKLRRNRLVKRTNHFQWIGAVHEYLAVGGKIVNLDISVTHKKEKSDTYDRNLKIYENRLANGEEFSPRDLYYYANELNDHQRYEEAIVYYKKALATKACWIEDNIAICGKLADCYSALGDDENKLNYTYRSFNYDTPRAEFCCRIGYHFLSLKQYQQAIFWYTLATNLQKPKDSLALLNNSCWTWLPHLQLCVCYANIGEVPLAIQHNKIAEAYVPDHPSILHNNKYFAQLSAN

SEQ ID NO: 5199 - protein, 300 aa, Unknown
  Description of Unknown: Candidatus Woesebacteria bacterium GW2011_GWB1_38_8 sequence
MKDHHSPLTVHQSLKLSVVLATRNEEGNIGRCLESVKNLADEIIVVDEYSTDKTREIAEKFGAKVFLEPHHDIFHITKQKALEKATGDWILQLDADEVVTPALARQVSLVVNHHSPFTIHHSPKKELFARHQSLIEQRDGKIGKSTGEVVGYFLPRKNIFLGKPLIHAGVYPDGEIRLVKKGKAYFPQKSVHEQIIVNGKVGWLGEDLMHYDSPTLKRYLTRLNRYTDLKAQELTQDHIGKNPWSFLLFTVYYPLFTFLKLYFRHLGFLDGVSGFLWSFFSAMHFPIAYFKYLTTNYNRK

SEQ ID NO: 5200 - protein, 356 aa, Lysinibacillus fusiformis
MSTISLCMIVRNAQCTIERCLDSVQHLVDEMNIIDTGSTDRTKEIVQNFTSRIYDFSWCDHFAKARNFSFQQATKDYILWLDADDVMTKENQHKFSQLKQSLFPSIDAVTMDYYLTLDCDGEVECSERKFRLVKRANHFQWEGAVHENLRVSGQLYHSDIAVTHLPLTKDIHRNISIYEGLIKNGHSLSAIESFHFANELKLHHRYLEAINQYNLFLDSNLGTTDNRIEACLHVGECYRRLHDDQQAQQAVLQSFLYDRPKPEACCRMGQFFMEQLKHKEAIYWYSQALQQAPADTMTIQKRAYSTWIPHLQLSLLYRELRLFENAFQHNLEAQKWKPNHQEIINNEKYLLSQLKI

SEQ ID NO: 5201 - protein, 251 aa, Unknown
  Description of Unknown: Candidatus Roizmanbacteria bacterium CG_4_9_14_0_8_um_filter_34 _12 sequence
MSITAVILAKNEEKLIGQCIKSIDFCDEIIIIDDFSTDKTKSIAENAGAKVFQHKLNDNFSQQRNFGIEKANSDWVIFIDTDEILNEDLKEEIKNIVSRDGDLSSYRLRRRDYFWNHEMRFGEIIEARNNGIIRFIRKGKNRWFGNVHEKYIADNRIGRLNGFINHYPHQTIKEFIISVNFYSTLRAKELYKQDKIMNIFQLIFFPFGKFIYNYFFRLGFLDSSAGFVYSFMMSFHSFLVRAKLLQYTLYD

SEQ ID NO: 5202 - protein, 288 aa, Unknown
  Description of Unknown: Flavobacterium sp. sequence
MTDFSFIILTFNEEVHLPRLLNSIKDLKAPIYILDSGSTDQTITIAQDFGAEIKINTFENHPKQWDFALKNFTIQTPWIIGLDADQIVTPSLFSHLEKFKDSNYTGTNGIYFNRKNYFKGSWIKYGGFYPKYLLKMFRNGIGYSDLNENMDHRFIVNGETMIWNNGHLIEENLKENQISFWINKHNRYSDLIAQEEVERMNNLRSQSNRADFFGNPDERNAYLKKLWWKLPLGLRPFLYFGYRIIFKLGILDGSTGILFHFLQGFWFRLIVDVKIKEILKSKNVNSLN

SEQ ID NO: 5203 - protein, 265 aa, Terriglobus roseus
MRPTISVAMIATNEEKNLPRTLAALQGWVDEIIIVDSGSKDRSPQIAVEYGAKHSYNRDFRGHAEQKNIAIAQCTGDWILLLDADEVVTPELATEIQSTVATSAFNAFWIPRLNIFITRWMRHGGLFPDEKLRLFRRGMATVDESIGPHGTPQYNADKGHLRAHLEHYGYPDFANYLDHMNEYSTGTVVALSRRKSKTSSAALLFQSIANPFFGWLKNYIFRGGFLDGAEGLIFHLNHAVYAHWKYVKVWEARKHAATTAAQPRP

SEQ ID NO: 5204 - protein, 299 aa, Unknown
  Description of Unknown: Cytophagaceae bacterium BCCC1 sequence
MSITAVILTFNEEKHIERCIASLKPICERICIVDSYSTDTTLEICKRLDVEVFQNKWENNHSKQMNWAIENCHITSKWTMRMDADEYVLKELQIEINSKIETLQSNIAGIELKRRVYFKNKWIKHGGFYPIKLIRIWKTGKGYSEERFMDEHIVVNSGEIICLEHDIVDENLNDINWWTAKHLNYARREAVDFLSNKYSFGLNTEKDINITKQAERKRKLKDNFYYKLPYGLRPMIYFFLRFIVQLGFLDGPKGWIFHFLQAFWYRIVVDINIYEIEKACEGDSRKIEEFIIKKWGINF

SEQ ID NO: 5205 - protein, 253 aa, Unknown
  Description of Unknown: uncultured bacterium sequence
MLSAVVIVKNEEKNIVDCLDGLSFCQEIIVVDDYSTDKTIEILERQSLENSKIKVFKRRLDNDFSAQRNFGVEKTAYDWVIFVDADERISEELASEIKENLSLPDFGGFLIPRIDFMWGKELKHGETGNIKLLRLFDKNKGSLKGKVHEVWETKNKVGVLINPIKHYPHPTISEFLKEINFYTTLRAEELHRKKVKSNFLTILLYTKGKFFVNYFLKRGFLDGTPGLVHALLMSFHTFLVRGKLWLLWQKRAS

SEQ ID NO: 5206 - protein, 366 aa, Geobacillus sp.
MITISLCMIVKNEESVLARCLDSVRHLVDEIIIVDTGSTDRTKEIAQGYGARIIDFPWNDDFSAARNFAFSHATMDYIFWLDADDVLLSEDQEKFLSLKCTLPSDIDSVTMIYSLARDERGTTISSVRRNRLVKRSNHFRWHGMVHEYLEVWGKILNSDITVLHQPIHNHSDRNLKIYEKQLAQGKELSPRDLFYFANELFDQQQYERAISYYEQFLQTKKGWVEDCIAACGRLADCFYALGDEKQALRYVYQSFEYDTPRAECCCRLGYYFLKKKKYRLAVFWYNLATQLTIPSDSWGFIHHACWTWLPHLQLCVCYFYLGEYELAYKHNEKAKEYVPDHPDVLHNQCLLESILSIHSTFPQTDQ

SEQ ID NO: 5207 - protein, 584 aa, Desulfotomaculum nigrificans
MKDTVTLVMIVKNESQNLGTCLDSVKNHIDEIVIVDTGSTDSTLDIASRYTDKVYTYPWNGDFAAARNYAIARAGGDWILSLDADESLICAPGQLKELVRRKNNIDAYMLPLLYPVAECTGEYNQFLVLRLFRNKKGYQFRGKIHEQVVVHNNEVVEIADDIVIKHNMASPKERNRKRGRNLAALKKAYLEDPTNYFLQYYLGIEWLGLAKPDKALPFLQNAYRNLTDDHLLFRAPTLRYLLICLNILGQLDEMICLSLEAALKYPDYTDIYYLGGIALEEKKEYKIAVKWFDQAIQCGVPPSIYSHMNGTGSFLALYHMGFCYEKLGMPENAQACYERALHENNQYIYPAGNLFLLILKKRGPRYTLEYFKEKGYLNNLRLALTVADLFFLAGYPDLSERCLGRCSVSSDKSEEVFFQLGRYNIYSGRLKKGLNYMEQIPEGSDFFIDGQTHKAVALLLMGRFNDCRSLGLQMWKNKLTRTTARVILSLSRSMQDGQSPDASTKFIGADLIRASLNILDLCYHYLPGKSTEGSHLTQIINILESIIRRSIPMGDRALQEYYQDRTNSLREFFDYKFGNGGIRT

SEQ ID NO: 5208 - protein, 507 aa, Unknown
  Description of Unknown: Candidatus Kryptonium thompsoni sequence
MPKLSLCMIVKNEEKFLAGCLESVKNIVDEIIIVDTGSTDKTIEIANSYNAKVYHFEWKNDFSLARNESIKHATGDWILILDADERLNPGQEMKIKKYLNLNFDGLYVRIISTDKNGELYVTEYPRLFRKIDGVKFERKIHEQISSSILKLGGKLAKTDITITHLGYSQDDETMRKKYERNLRILLEELEENPDDAHTCYHIGITKTLIGEQEEGIKYLKKAISIPREKSNINDSLRAFIYNIFGNYEFKRGNSSQALNWFTESIKLAPVQVSSYYHGGLVHLKDSNFILAKNFFEKALKNLHSILKGKPSDLTIEAFIEPGDIHFKLAICYFKLGNYHKLNENLAEILPNEKLYEAFLNFLVEEYKEGNKNVTQVIKYISKLKPSFHVFKILSGIYQVEGELENAVESLRNALKFKDDDEIRYNLGTCLAGLKRFDESIKVLVDFLNRRNSPFFESALKVLVLSYIGEGNFYDALSCYKLILERNPEDEAIKLRVHSIAQKLANPH

SEQ ID NO: 5209 - protein, 256 aa, Unknown
  Description of Unknown: Candidatus Woesebacteria bacterium GW2011_GWA1_43_12 sequence
MITAIVLARNEEKNIERCIKSLQWCNEIIVIDDESSDRTVELASKLGAKVFKRALKDDFAAQRNFALEKAANSWVLFVDADEVVTTELSNEIMEKVKKVEYKGFKVKRIDYLWGKKIRHGDIARFNYVRLGRRGVGKWRRRVDEVWEIEGKIDQLNNPLLHYPHQSVAEFLQEINFKSSLNARQFYEEGKSTNLVDWFKPLATFFRSWIFKLGFLDGMAGFNIALLMSFHSFLVRSKLFLFTKSGGQTLNVKSTGL

SEQ ID NO: 5210 - protein, 365 aa, Brevibacillus laterosporus
MATISLCMIVRNEEKSIARCLRSVKGAVDEIIIVDTGSTDKTIKEAKEFTKKIFHFKWVNDFSKARNFSFQQATMDYIMWMDADDVLEEIDRKKLQLFKHKIDPSIDVVVMPYHTDKDEFGNVILPYFRERIVKRTHKHCWVGMVHEYIQYSFGRSFEIDIAVTHRPRQQKNYKRNLSIYENAIADGVLLNPREKYYYANELKDNERYEEAIGIYQQFVNNELPRVEEPELLMEQICFCYEKLQLPEQEIKYALKSLEYGLPRAEVCCRLGYYWLQKNEPKKAVFWYELATTLPKPHTWGFRKEACWTWLPHLQLCVCYDHLQQFEKSYKHNELASAYRPADPAILGNRAYLTNRLKDLGIAIPT

SEQ ID NO: 5211 - protein, 340 aa, Butyrivibrio sp.
MVTISVCMIVKDEEANLSRCLNSLKGIADEFIIVDTGSTDKTKEIAESFGAKVYDFEWTGDFSEARNFAFSKASCDYIYSADADEELDEENRERFLKLKEDLLKLDIDIVQMYYCNQLAFRTVYNYDRELRPKLFKRLRRFVWEDPIHEQVAIEPVICNSEIEIIHRPAENHAGRDLESFRKAISEGRYLSKRLHNMYARELMMAGTKEDFIKARSFFEDSLKDNNRTIDEIKEACCVLAHIAVIADDTKTLLKCSLKDANTEMSSEMCYELGEYYYGQKDYDEAIIWFFNAAYECESILDLRKSKELPRLALAKCYRALGNDEQAADYEREAAEVEKEE

SEQ ID NO: 5212 - protein, 367 aa, Bacillus cereus
MMVLNKQRPTISLCMIVRDEENTIGRCLDAVENIVDEIIVVDTGSIDRTKEIVARYTSNIYNFPWIDDFAAARNFSFSKATQEYILWLDADDVLLEDAQEALKQLKEELDSNVDAVSMPYYLVMDSNGKPLYCTKRYRLVKREKQFQWFGKVHEYLAISGEILNSDVAITHKKEKKVTNRNLKIFQNAVAAGEELSPRDLFYYANESMDNEKYDDAVLLYEVFLNQEEGWHEEKIYACGKLGDCYAKLGDWEKAIESCTKSFRYDIPRGENCTRIGYIYMEQEKYNEAIFWFKLATEVPLAKDSPFHSPASYTWLPYLQMCICYSKLGDQEKAYYYNELAASFVPNNAAIEYNRKYFRGIFDEQYKV

SEQ ID NO: 5213 - protein, 283 aa, Rhodovulum marinum
MSKRKLPVTVAVPVKNEEANIARCLERLGRFEEIVIIDSGSTDRTREIAEGFGARVVDFQWNGEFPKKRNWFLMNKPIATPWVLFLDADEYVDDAFCDALEAAVTREDIHGYWLHYDNFFLGKPIRHGLVQRKLALFRVGKALYERIDEHNWSALDMEIHEHPIVEGKVGEIDARIDHRDFKGLAHFISKHRDYAQWEARRYALMRDEPETWTQLTDRQKFKYTHLTKWWYPPFYFAFTFIAKRGFLDGSAGFHYAMYKAWYFQTIRLLIQEYAAEPALQKAI

SEQ ID NO: 5214 - protein, 363 aa, Bacillus sp.
MCTITLCMIVKNEEEVLHQCLSSVKEICDEIIIVDTGSMDKTKDIAKNFTEKIFDFEWIDNFSAARNFAFSHATKDYILWLDADDILLKEDHQKFKILKKNLNASIDAVSMIYNIAFDEYGQPTFSYRRNRLVRREKKFKWIGLVHEYLEVSGNIYTADIAITHRKSDKTKSVQSDRNILIYENRLKNGEDFSPRDLYYYANELKDHADFQKAIKYYYNFLDTKKGWIEDEIRACINMAECYRNLGNLIKEKESLVMSFIYDVPRPEASCRLGDLYKGNKEFNKAIVWYRLALEKEAVNNPGFRQEAYSTWYPHLQLCVCYWETGEQKLAEEHNNRAKVYRPNDSSVKTNEKFFKNYFKNYDV

SEQ ID NO: 5215 - protein, 297 aa, Thiothrix caldifontis
MSTISVIILTYNEEQHLSRCIASVKSIAQRIIVIDSYSCDKTIEIAKNHGVDIYQNKWFNYANQFNWALENTQINTDWIFRLDADEYLTEQLKDEIKIKIPLLEPNIAAINIKRRVYFLGKWMKHGGIYPTYLPRIWKTGYGKIESRNMDEHLVLSGGKFHDFEYDLVDENLNTLDWWSNKHIKYALREALDISLKEELEKKENITSKITGSQAERKRFIKNIYLKFPLFIRPSIYFLWRYIFRLGFLDGREGFVWNFLQAYWYRVFVDCVLLEAEKKSSIEGVSASEWIKNKIYSP

SEQ ID NO: 5216 - protein, 264 aa, Paenibacillus sp.
MIEISLCMIVRNEEKSLPRCLTSVRAIADEIIIVDTGSTDRTKEIAETFGAVIYDFTWIEDFSAARNFAFSKATKEYIFWLDADDYLKESDQVLFRELKQSLPENVDSVNMQYNLAFDAEGKVVTSLRRNRLVRRSCGFKWIGPVHEYLEVYGPSYSSDVCITHEKDKAYTDRNLRIYRKREAEGESFSPRDQYYYANELRDHGIHGEACQYYEQFLNGGQGWIEDNIQACLRLAECRERLGDKEAAFTAITRTLQYDSPRRLD

SEQ ID NO: 5217 - protein, 438 aa, Clostridium saccharolyticum
MKKKARLSQCMIVKNEEKNIARALTWGKNIVYEQIVVDTGSTDRTVEIAKSMGAKVFHFTWVDDFSAAKNFAIEKAAGDWIAFLDADEYLLDKDAKRIKEILIQLESADPKLKPHILRTSLVDLKEDGTTNGITVQDRFFQNLPKLRYQNRIHEMIAITSGKLIICDLTKEISVLHTGYTEAVYKETNKVERNIRLLKKEVEDNPENYDAVAYLAETLKVSGNADEAEVLYRDILKNGVSHINSARLITTYYGLMHTILMRDKAEEEDEFFLLYEDAVKFSPEYPDYDYFMGVWHFRKECYGETVTYLENCLKKLEDYQGINVTHVPDVLTDIYTALVRAYVEISNFSQAVRYCVLILRIDRYREIITNTLVDMLKQEGDSAGAIAAIIGFLQKIYDLNSLKDRLFVIRSAKKTGYKALEDALIETMSDEDKSWYFSE

SEQ ID NO: 5218 - protein, 250 aa, Tenacibaculum finnmarkense
MNVSGLVITFNEEVNIKDCILSLKKVCNEVIIIDSFSTDKTIEIAESMGAKVYSQKFLGDGLQRVHGLQFCKNDWILNLDADERLDEDSYQFIKSQKYLKQPYDAYNFRRKNFLKKQPINFAGWYPSYTCRFFNKQTAKPATTKVHQSIQATNLKKTNLHLLHYGWKDFHQIIGKYNLYTTWQAEEYFEQGRKVHFFTPITHGVWSFIRCYILKKGILHGLDGITFSMLQAFSSYIKYAKLRKLYEESKL

SEQ ID NO: 5219 - protein, 348 aa, Brevibacillus formosus
MIVKNEEKYLARCLQSVVNLVDEMIVVDTGSTDQTKFIAEQFGAKVYDYHWDNHFANARNFALQKASSDWNLVLDADEYLVGDAEKCLRSFIETKRAIGRVLIVSKYLDNGEVKYSRQLASRLFPKGAYYKGRIHEQIASDLPHFATSIELHHSGYYETDKTDRNLPLLLLELEDQPDNPYILYHIAINKKNKKNYSAADQYFERAYSLLTGKEGYAPVLVVDYLYNIMANGNLDKGITIIDKEKERLTDFPDFHFVKGLFFMDYIQKDLENRLHMIDWIEQSYLTCIELGESNHNDSVVGVGSFLAAYNLGVLYELFGIIDSAKHYYRESSNLGYQPAADRLNQLLM

SEQ ID NO: 5220 - protein, 614 aa, Paenibacillus selenitireducens
MKKLLSLCMIVKNEEKVLERCLNSVSRLVDEIIIVDTGSKDRTKEIAFHFTDQVYDYQWDNDFSAARNIAISYATSQFILVLDADEYIDLTKYNQIINFLSSLPNKSPIAIIVPIYNFVGSPNSGNLNQIEAVRIFSNDPQVKFDRPIHEQVISTKEELEFVRFDLPIYHTGYTTESMEQKQKSKRNLNIFEHLKTNKQLNCYDNYTLGNEYFALSNYSLALQHYSLAYKNQEYGKTWMPQCLAQMLQCLFKLRQYSEMYELCEHAIELWPSACDFYWFKGSLFMEIGADEYAIQALHQCIHIAESSESSQTWIISPNYGSNLSYQLLSLIFLRQHDIENAVHALTKLLYINVNNQGVLLKLLPLLLDHESIDQIIMFLNQVYKQPEDYQLIMLFETSLLLASVELSHYYWKLCKHLNFQNRPDLPFYYAVITKNNELIMEYETNNTNTTGRLQQISKILKSILIEGNMDISINEDLKSSLLISLFRLGQYEMYDTLLKVTDYNHPIIINDLADYFFDNQHIDLGIDYYSTLLDNNQINLSGILNISRYYIKQGYLLDASDFIRNTIQLQPDHLTLYILYFLTSEHPTKRIVQQFYDLFPNYIQLPFVPPIHNN

SEQ ID NO: 5221 - protein, 348 aa, Unknown
  Description of Unknown: Lachnospiraceae bacterium Marseille-P3773 sequence
MITISVCMIVKNEEEVLARCLESLKPIADEIIIIDTGSTDRTKEIASYYTDKIFDYEWQNDFAHARNFSFSKASMDYIYTADADEVIDGVNIERFFQLKRAMLFEVEIVQMKYTNQLQYGTTYNFETEYRPKLFKRLREFAWINPIHETVNLEPVIYDSEIEIIHMPLKSHAERDFSHILKVIKDGHRLSKKLFIMYAKELFIAGQDKDFLEAESYFVCAAENEIRSAEELKAAQCVLTKCARLTRNHNLLLKSSLKNFAGDGASAEVCYELGEYFFKEKDYNEAAIWFYNAAFETECELNIHYAGDYPLKRLAEIYEILQNPEQQVEYERLFSEWELPKSLEHGELR

SEQ ID NO: 5222 - protein, 387 aa, Clostridium akagii
MKISLCMIVKNEEKYMKMCLENAMKLVDEVIIVDTGSTDKTKEIIEKISGNIKIIDYRWQDDFSKARNISLENATGDWILMLDADEKLLCDPDKVRETLANTKAAGYKIPLYNIINTKTVVYSAVYIKFFRNNKGYKYKGRIHEQINLPDAGLNENIIDEKIAKVMHYGYLESIVKGKSKSERNLRILKKELKEDPNNPFIYYNIGVGYHMAGDYEKSLKYFFKCNSIASKKSLTRITLYEIDMSKRIAECLAQLKKYDECIDMIDELLSDNCYKRFVDLEYLKGMCYYLQKQYKEAIKCFHKCTEMGETKEFLSVLGMGSFKAKFMMARCYVELKDELKAINCFMESVFDTNNFLNEGLDDFRIFLKNTNRVEILEQLNKLVSEKN

SEQ ID NO: 5223 - protein, 294 aa, Bacteroides plebeius
MLDISVIILTYNEKIHIERCINNAKKFAKEIYLVDCYSEDGTVEMAQSMGAKVFQHPWENYSKQFNWALQNLPITTEWIWRMDADEYLSDDLISELHQKLPSLPNNINGFTAPCLRIFMGKYIKHGIIPLILLRLFKIKYAICENRYMDEHIQLSEGKIGSLKNPFYDDNLNGLTWWTNKHNGYATREAIDLLLTEYDLLPQESVVNSGAHSAAIRKKKLKYIKLPLFWRAFAFFILRYIFRLGFLDGKEGFLWHFLQGFWYRTLADAKVYEIKKNHGFDSERIKTFLKENYLK

SEQ ID NO: 5224 - protein, 251 aa, Unknown
  Description of Unknown: Chlorobi bacterium OLB5 sequence
MGISAIVITLNEENNIRECLESLKWCDEIIVVDSGSTDKTVKIAEEFTKNIIISGNMSYGEKRNLGIDKAVNKWILWLDADERITSELREEIRLKVNGSNTNAFYINRKSFFINKFIKHCGWYPDFTLRLFRKDSGIRFDSSLVHEKAIFSGNTEKLNNEILHYTDRSFEHYINKLNKYTSLSAEELRKKGKNASIIDIIFRPVFTFFKMYFLKLGILDGYTGLVLCTLSSVHVMAKYSKLYLMNKPNSIN

SEQ ID NO: 5225 - protein, 375 aa, Unknown
  Description of Unknown: Candidatus Desulfosporosinus infrequens sequence
MVDKSITISLCMIVRNEEGTIARCLDSVKGIPDEIVIIDTGSTDRTKEIVNQYTDRVIDFVWIDDFAAARNFAFSKATTDYILWLDADDVLADSDREQFLKLKKNLDPLMDVVNMPYLLAFDQSGAVTFSLRRNRLVKRSKNFRWIGAVHEYLEVYGPVLNSNICVTHKGMASNDSDRNLKIYEKRKAKGESFSPRDLYYYANELSDHQLYNQAIESYQEFLKTGLGWVEDNISSCGKLADCYQKLEKKDKELEYILKSFEYATPRAEFCCRLGFYFLGAKQYEQGVFWYKLATQLERPVDSWGPVIEACWTWLPHLQLCVCYDRLGKHELAYEHNEFARNYRPEDSQVLYNKNYLEGVLKKVSAEKNALDFLLN

SEQ ID NO: 5226 - protein, 359 aa, Bacillus cereus
MKKNITISLCMIVKDEEQTISRCLESVKDIVDEIIIVDTGSTDKTKELVKKYNAKIYNFKWIDDFSAARNFAFSKATKKYILWLDADDIIEQKDKKLFLQLKSTLNTKIDAVSMKYNLTFDTEGNPTFSSKRNRLVKRNKNFQWHGFIHEYLEVYGNLMDSDISITHKKEKTHSDRNLNIYKKHLAAGKTFTPRDTYYYANECKDHQLYEIAIEWYTKFLDEKKGWIEDNIQACLKRAKCYLQLNNIEKALYSSLQSFIYDKPRGEICCQLGFIFLEKKEYDIAIYWFHTAIKSSRPTNAPFIEEACYTWIPHLQLCMCYYHMKNNEKAIYHNEQAAKFVPHHSSIKYNRDFFNTLTKK

SEQ ID NO: 5227 - protein, 338 aa, Unknown
  Description of Unknown: Firmicutes bacterium CAG:95 sequence
MIRISLCMIVKNEEKVLDRCLASIFDLMDEIIIVDTGSTDRTKEIAGKYTGRIYDFAWCDDFSKARNFAFEKAACDYIYSADADEVLDEENHEKFRLLKENLMPEVEIVQMYYRNQLANGTVYNFDRELRPKLFKRLRNFVWTEPVHETVRLLPVVYDSEIEITHKPEHNHGDRDIAIFEQLLARGEALSKRLSDFYARELFVAGTKEQLIHAKDYFISIVKDSETDADRLKTALAVVVRSCFEAGDVLTMYQYAMKDAASEASSEVCCILGEYYQNRQDYEEAILWFYNAAYEQQSILNIRYQREIPLEGLIACYHALSMSEQEAYYQKELSCIEPG

SEQ ID NO: 5228 - protein, 280 aa, Unknown
  Description of Unknown: Candidatus Koribacter versatilis Ellin345 sequence
MLLSAVIICKNEEQNIARTLASVVDLADEVILLDSGSTDHTLDVARTFGDKVKIFQEEWKGFAAQKNSAIAKASGEWILSLDADEEVSPLLGRELKEALGKKEEPQQKPGENAGQIIAGDGPFCGVTIPRDAYSIPRKNFFMERWIRRGGFYPDRKIRLVKKELAVFEDRAVHEDMKVSGQILPLHGAILHHAYPTLSSYIEHMNRYSSLGAEMVVAKGKHGFSFFNIVVRPWATFLYNYFLRLGFVDGREGLLLHLYHAVYVSWKYAKVWELSRKVRPT

SEQ ID NO: 5229 - protein, 252 aa, Unknown
  Description of Unknown: Flavobacterium sp. FPG59 sequence
MAISGLVITFNEEKMIGACIDALLKVCDEVIIVDSYSTDGTVEIAKNKGAVVIQQNFLGDGPQRSFGLPYCKNDWILNLDADEFLDYDSVGFIQEKKYLNTAHDAFSFRVKNFLQDKIIDFAGWYPDHKIRFFNKKSAHPSSDKVHQKIIATNPKKLKTHILHYGSHSFFQIIAKKNQYADWNAQQLFDQGKKVSYIKPVLNGLVSFIRCYFFKKGILNGIDGLTISLTQGYFSYIKYANLIQLHKISQKKL

SEQ ID NO: 5230 - protein, 252 aa, Fluviicola sp.
MKISATIITLNEERNIGRCIESLVGVADEIIVLDSFSEDRTKEICEKAGVRFEQRKWEGYSASKNYLNSLAQYEYILSLDADEALDADLREALLACKNDDEPGIYSVNRITNYCGKWIKHGGWYPDVKIRLFPKAGSQWVGAHVHEELEYPAGLKERQLPGHLEHYSYYSFKEHRERADKYSALTAAKFYEQGKRVGAMKPYVSAIGRFIGMYFVKKGILDGRMGFKIAWISAQSNVFKYKELLRLQRENAA

SEQ ID NO: 5231 - protein, 257 aa, Unknown
  Description of Unknown: candidate division Zixibacteria bacterium sequence
MPNLSAVVITRNEEANIKRCLLSLQIADEIIVVDSGSTDRTIEIAENLGAKVYVKEWAGYGFAKKEGVSKAFGKWIISLDADEELSPELAKEISTAVLSETGDSGFYIKRKTNFLGRWIYHCGWYPDYILRLFKKEDGDFNESVVHEKVILNGRVGYLKAEILHYSYNTIEHYFEKFATYTTLGAEQAYKSGKKSRWFHIVFKPPVSFIKHYFIKLGFLDGLEGFIISAFSAMAVMVKYSKLRHLIKQGKSGDDTNA

SEQ ID NO: 5232 - protein, 252 aa, Flavipsychrobacter stenotrophus
MIKLSVAIITFNEEENIGRCLASLKDVADEIIVVDSNSTDKTAEIARSYGATVILNPFEGYGQQKNLATDSAANDWVLSLDADEELAPEITKSILQVKEHQQYNVYEIARFTNYCGQWIKHSGWYPDKQTRLYNRTKGRWIEKKVHEYWDLFEEGKKGLLKGDLLHYSYTSLEDHLSKIDRYSELSALDAVARGKKASLLTIIFSPFWHFFNEYFIKLGFLDGFHGYTICKLSAYATFSKYTKIRMFSKMQK

SEQ ID NO: 5233 - protein, 255 aa, Unknown
  Description of Unknown: Candidatus Shapirobacteria bacterium CG08_land_8_20_14_0_20_39 _18 sequence
MTKAQTISVIINSGNEEREIGPCLESVGQMADEIIVCLSQLSNDKTGEIAREHEAKVIVQEPVEMNYAAWHNQGMKIAKGGWLLWVDADERIPLPLKEEILSVLNNSQYSAYAIPRRNFLLGKELHWGGWYPDYAKRLFRKNDLKRWEGELHEQPIFSGDLGKLKNPMLHYQPEKIEPALQKSIRWSGLETGLLFKANHPKSTWWRVLRMGLTTLFERLIKKQGFRDGVEGWIESIYQSFHTMIVYLRLWELQHQ

SEQ ID NO: 5234 - protein, 747 aa, Clostridium cellulosi
MKAHIKNPYNIKITACTITKNEEKTIARSINSYKKYVDEIIIVDTGSTDNTVKIAKSLGAKIINFKWCNDFAAAKNAGLDAATGDWIIFLDADEYFADDTCKKVRAVIAEAIRQNKNAVGCRMENYDQDTGVNLVEGFSVRIFEKGTRYRYPVHEEIYNPKGVNVLTVGKSYFYLKHSGYSSKIIAKKCKRNLDIMLKELDELSDERRRIIYYSYISDSYFGINKLNEAIKYAKMYLEGSKEKNIRILGCELRPYMNIIQGMETLKEDPEKIVPYATEFLETFPDSPEAHFEAGRSYRRMFMFNAALDELNKAVEMAKNYSGVYVDTVDAKKASVYNECGMCCEALHNPVKAMDYYYKAYNEGNDYQSALFNLIRLVRNMPAEEVDSFIRSLYAGVSQKKHLAVLAALMTHYMVPQIIECYAAYRMDKKDDPINGEVTAFVMAGKGNFKSAAEMFLLSYKVSKSKNTLARCLICAVLSNDSEAIEEIRKDCSKPRLFMFGLADKKPQLKNKDLYDIATLLAECRNMGQADFAMQRLEAMAEQLSGKELLRLSRFLADTFFFEAALYAARYADLSAKAIFMQGYCLYNLHRYNEAIDLLLLARHLHLEPSYINDIYNRIKAIKESAPVDKPNDLSALKTLITQEIESGNIEKAVMDIEEYKELAEPDADIYAAEASAMYYICEYKRAAVAVQCGLLKDDKNVDLLYNAGCIFEKLGNKKRATSMYKKALKYCTDAELTTEIEQMIKAL

SEQ ID NO: 5235 - protein, 272 aa, Unknown
  Description of Unknown: Candidatus Shapirobacteria bacterium GW2011_GWE1_38_92 sequence
MNKTTISVAIATFNEENNIKRCLDSVNSWVDEIVIADGNSSDNTTEIASKYNNVKIIKTVNKPLFHINKNIAIDSCKSQWILQLDADEVVSPKLANEIQNILSKSPDEIIENGFWIKRQNFFLGTFLKKGGQYPDPTLRLYKNGKGKLPCIDVHEQAKIESPVGILKNDLLHYADPTFSRYLLRHNRYTTLLAKKYQEEKLPLNFINFLNYFCLKPKIWFLSTYLRHRGYVDGFPGFVFSLFSALRFPISYIKYWELQKSHRSINLSQDWDK

SEQ ID NO: 5236 - protein, 641 aa, Bacillus megaterium
MHPFLSLCMIVKNEEKVIDRCLSSVAHLVDEIIIVDTGSNDKTKKIVQQFTEHVYDFVWEDDFSAARNFAASKASGKWLIVLDADEYVDEENFREFIKEIKDDKDKFDTYEIKILNFAGQRGETLLQNYHHRVYKNNGEIIYYRKIHEQFTHVYKDNNFTSKRSSLVIFHSGYLNNTVQEKDKQQRNKQLLDRELLRGKNKAFDYYNLGNEYFSLQDYSIALECYKKSYQLQSDFRVLWVSSTLMQIVNCLIHQQRYNDALTVIYDAEQVYSETPEFQYLKGEIYYLKGQIEDAKLVFNYLLNNQKKYNNVILRPDWKDQMPYKRLGEISLYENNYEEAIYNYISVLNINKYCKLSIEKVLFLLNKFHSNEEISNFLENNQLIDEMNIIDYVKICFDLGNPELSILLLKGTKNDFSVLYKVAEIKKIALGRTGNLYDFTGSINEHFIQELNKSGWLNIIDIFTLNEYLEESFDSEWNLNVFKQDPNFEILFNLKDNSLAYNRIDEGVFIVFFRIFTAYKRFDYVNLLLKYATNLSAHLTPAIAAILYENGFKVEGLQLYEKGNWDTFSKEDFLNIISSLLETENELGASQVAEYARALYPDDFRFYKVILEYPTNEDTVSQILPVVSQRFPKSTYMEKYYI

SEQ ID NO: 5237 - protein, 315 aa, Gramella salexigens
MQNLLNIVKYLNKPSLAAIILTYNEGIHLERCLKSVSKVCSEIIIIDSYSTDSTKQIALNYSAKFYQNSWINYSSQFNWGLDNAEINSEWILRIDADEYLTDKLIENIQTNLPEIKSHYTGIMVNRLMYFMGKPLKRGGMYPIRHLKIWRKGKAICEQRWMDERMKLLNGDITFLEGDLIDHNLNNLTWWIQKHNGYATREAIDILDKKFNFTDFIVLRSSLMGNSEEQRRWLKGIYLDLPLFVRPFVFWFVRYFIQLGLLEGKRGFIWNLLQCGWYRFLVDAKIYEAYNKVGKNRENLIQYFKDEFDYDVTKIG

SEQ ID NO: 5238 - protein, 355 aa, Bacillus toyonensis
MKLSLVMIVKNEENNIKRCINHVKEYVDEIIVADTGSTDQTKSILEKLLVRVVDVKWNDNFSDARNSAIEHSTGDWIIMLDADETITYFDKATIKEFMKKERIGAIKSTAKFEYQGSEKESYIYTSRLFPRHVRFSGIVHEQLDTNLEHYKVPIQIDHAGYYKTDKTSRNLPLLLKVLEKQENDPYYNFQIAREYRNIGDLEKRLYHLSVFFKNMDDGAYTKGGIVEYLYALLEAKQYDTMLNVISETDYMMSEYPDFYFVRGLLYMEYVQQDPESRFDLICEIERSYQTCLSIGENHSNGGVIGTGSFMASFNLGVYYELMDGIIPDGKKKAIQFYEQSQEHGYAPAIERLSHL

SEQ ID NO: 5239 - protein, 256 aa, Unknown
  Description of Unknown: Ignavibacteriae bacterium HGW-Ignavibacteriae-4 sequence
MESSNSIKLSAVVITYNEEDKIGRCLDSLIGVADEIIVVDSQSTDRTVEICNSKGATVINQEFLGYAAQKNFGIERANFEYIMSIDADEVLSTELIDSIKNIKISSNTYAYEFSRMTNFCGKWIKHGGWYPDTKIRIWEKGKGKWIGEGVHETLQLDENTKVIKLNGDLLHYSIDSISQHIDQIQKFTTLAARELHQKGKTTSVVTILFNSWFKFVRDYFIRLGFLDGFYGFVIAFNSAYATYLKYLKLYDLNKSK

SEQ ID NO: 5240 - protein, 387 aa, Unknown
  Description of Unknown: Clostridium sequence
MKISLCMIVKNEEKYIKMCLENAMKLADEAVIVDTGSTDKTKEIIREFDSNIKIIDYKWENDFSKARNISIENASGDWILILDADEKLLCDAAKVREILKDAKVEGYKIPLYNIMDASMILYSAVYTKIFRNKKEYRYSGSIHEQINIPDIQKNDFILDDKICKIIHYGYLASVVKKRNKSDRNLKILKKQLKEKPNEPFVYYNIGVSYEVAGDYKKALQYFFKCNELAGKKDPTGITLYEIDMAKRMAEALVKIEEYDACIEMVDNLLSDECYKGFVDLEYIKGFCYYLKKDYKTAIKVFKECIDMGETKKFVSVFGMGSFKPKRMIAQCYVNLNEEVKAINAFMECVFDTNNFVYDGLNEFRKYLIINKRAEILNELNKLVGEKH

SEQ ID NO: 5241 - protein, 675 aa, Unknown
  Description of Unknown: Peptococcaceae bacterium CEB3 sequence
MEKRISLCMVVKDESKYLGRCLRSVQGSVHEIIVVDTGSTDATREIAEAFGARIKSFPWNDDFSAARNASLEAASGDWILFLDADEELCLAGEHVLPGLTAGAEPEGYFIKIVNHLGSEGRGETCPDLVFRLFRRGSDYRFRGAIHEQIADVILERNPQAKFQVAEGIEIAHYGYLDERVKEKNKKKRNLVLIERELRRAEDDRLLRYHYGVELFRAERYAEAAQELTRAAAGIDPNSIYLPKLLRYVVMSRQNAGQFEQALEAAVLGLRFFPDYADLYYYAGLISLDLKSYGSAQDFLEKASSMPSQPPQYASFPGVRGFRCFYHLAVLAETFLDEESALKYYLAALQDNSAFTPALESILRILRPQQEPGYAKACLDKIFLLEDAQARQKMAELCFRQNAYHLALLYWEEADALGESTTAHPAPAGNELWLRRAICLIQDERYLEALKILAVFPPENSLYPLAKVNMLFAFRLLGKMRRVRSTLAELRLAGLTEDSAKVLNLLSLPEGEGNFSPRPAANRNIAVDSDTIPLDSDGVALLSQILSRLLALNRPNLAASLLAGVEPSTLARQGLNFAQMFLAYGFRIKAEYLLRDYLAGGPEGANAEAHFLLGEIYRETDRFAEAEGSYRRALAKDPSQPKYWLRLESLYTGHTADWGAPLPAERTGHFSPIPEN

SEQ ID NO: 5242 - protein, 642 aa, Thermohydrogenium kirishiense
MNFTLSLCLITKDEEKNIARCINSVKDIVDEIVVVDTGSKDKTVEIAKSFGEKVKVINAKWEDDFSKARNIAIENASSDWILFLDADEEIKKEDAEKIKPLLYDDTVEAYMFKFINYSGTSVSSGLSEIHYNFRLFRNNGKLKYVYPIHENLKNIEEDRAPIFKNVDVTILHYGYLSEIRIEKNKTQRYIDMISKYLAKHPNDKFQQGNLAVEYYNAGNYNKALKHLLIATKSMNLNSYATPRLFRYLIMTYIALKEYDTALRIINDAKKYYEDIPDYKYLEGTIYFNQKRYEKALEIFKECALMGEYKGQFVTMGGTGSYRAKYMIGQCYEKLGKLNDAVKEYMEILKQHPNYQDVFIRVFDMFVRNEKPEDVYEFFRKHVNTKVPLNYIVVARQYINIGKYDIAKQYIDSIDIDLEGLNNLRGIIYMGLKDYENAIKHFEMEYGKAKEEANYREALCYIILKDIDKAKDLLWKITDSSDKKLYMTIVGEMKAKFDEVKDSFFNLLDLLIKLKEFDLYNEVLNLYVGLFTREEYERYGQMMINNGLDDLAVEAYIKAADLNSQNTEVYKYLAQRAYNQNMFNEALSIIGRAYNLDKTDVDIYKMIFRIYKALGQDENADEVNEMVKSMYPEVDLSESYAAV

SEQ ID NO: 5243 - protein, 1264 aa, Fervidicola ferrireducens
MKSELTKRLQRLKLEYTPKEIVDLALLNVAVENFDVFKLYLKELKEYVELSSESNKISISSNILQLIIDYKNHSKNLKYRHNRSQSEKKKFAVVASLCTGDVLEVGCGSGDLSSYISMYGNRVFGIDIDPVAVEIARFKVWHFGLSDCFFDVVDANTNNIPIPDSSFDTVVLAEVLEHVKDPLKILMEAKRLCKSGGKIIISVPNGYRILSPDYLHIFNLDVLKELLSKIGVNEDDINWDDRVPDEWILCWFNNNKEDIKEKKDEDLAKYFLPPHPLEDLKGAGKVSIILPTYNGEKYIQESIDSILNQTYKNFEIIVVNDGSTDKTYEKLKPYIEREQIKYISQENKGKPCAINTALEFATGDYIWIFDDDDTALPRKLEVQMRHFLRKPHLDLIHTSSIYTDSSNKVPLLVWEPSEIEQNDLLKSLLHGCIFHGSTVLVKKEAFLKTGKYDERLIRVQDYDMWIRLVKNHCNVGKILLPTVTYRQHNKVRGSKENPIPVEKVAEATMEYEKIIFEKVYNEIPLSEIFPELKEENCNSGLRVSALIERAYAMARRRLFDYALNDLKEAFELAQKYYPVTITFRGIYFIKKFSEMLTHIENEEIKNMVTYFSLLIGNHDVRNFGKKGKITLSLCLITKDEEKNIARCINSVKDIVDEIVVVDTGSKDSTVEIAQSLGAKVIHAKWEDDYSKARNIAIENATSDWILFLDADEEIKKEDVGKIRPLLNDDTVEAYMFKIVNYGGASVSSGLTEIHYNFRLFRNNGKLKYVYPIHENLRNIEENRVPVFKNADVTILHYGYLSETRIEKNKTERYINMLLKYLMKHPNDKFQHGNLGVEYFNARDYKKALKHLLIATKGMNVNSYSAPRLLRYLIQTYTALKDYETALKLINDAKAYYIDIPDFKFLEGMLYVEQKRYKKAIEMFKECIAMGEYKGLFITMGGTGSYRARYMIAYCYEKLGRLHDAVKEYIEILKSNPNYQDVFVKLFDLFVQNEKPESVREFFDKYVDKRNPANFAILAKLYMNSGRFDIAKEYLDEVDMDIAGLNTLKGIACMGMKDYQKAIEFFDKEHEKAKSEALYHKILCHLILKELEMAKRILWEIEDSTDKKLFLTIIGEMKARYDEVKDSYFKLLEKLIQFGEFDLFNKLLKLYSGLFTRDDYVRYGHMMKDKGFDELAVAAYIKAADLNCEDSSVYRYLAKKALEQNMTDEALVFTARAFNIDRMDVDNYALMYKIYKVTGRNDEAERVSKSIKEIYPEIELEEIVQ

SEQ ID NO: 5244 - protein, 392 aa, Unknown
  Description of Unknown: Anaerobacterium chartisolvens sequence
MKISLCMIVKDEERYIRQCLESALPLVDEAVIVDTGSTDGTLDILDKSFGDRVRVIRHEWKEDFSEARNKALENATGDWILVLDADEKISFERKELFDIMDKEGDSGLKIPFYNFFSNGMVEFAIGMIRLFKRRPGVCYAGAIHEQLTLNGERMKFKILDSKVCRIFHYGYLGKVMDDKDKIARNLSMIEEELKKAPDNPFNWYNMGIMEMVRKRYDPAIECFLESHKLCKGVRYNFVENIVVKLAECMLALNRHSACREYLENVLEDSVMKGIPDLHLSLGRAYKGLRMYEKAMRSFSKCIELGENSLSTVSMKGAGSFIPMIEWAGALVAQKKISEAVIKYMEAVFNKNNYAKAGLPELVSLLKQYNMTDVLTELGTYVDLKSVMPETGT

SEQ ID NO: 5245 - protein, 287 aa, Unknown
  Description of Unknown: Firmicutes bacterium HGW- Firmicutes-9 sequence
MADVTAIVLTQNEEKNIGECLKSVAGFCSRVVVIDSGSTDRTLEIAREYGADIYEHEFTYYAAQYNWGVDNANITTAWTLRLDADERFTPAVCARCEKLMQEHAADDVNGIVMESDFFFLGRLMKHGGSKKRKIMVFKTGKGRVEDRKRDAHTILHEGRTIAISDRYLHYDFKDLTSYISRYNWYAIRELQDYIAYEQGASYSANTDPALMQHRKKKFTIYYRAPMFLRAWLWFVYNYYFRLGFLDGKEGYLYHYFESYWYRFLVDAKIYEYRKTGKTDGDLRALGK

SEQ ID NO: 5246 - protein, 476 aa, Paenibacillus sp.
MKSTYAPIIELLQKQRYKEAEVVAKDLIRTNPLEGQAWVFLGETLMHQGYGLTAKRVFNRAWLLDPEASWVKSVYEALEQTPEGEERVDIEGLLHVPKVTVAAAILARNEEQRIEKCITALYEAVDEIILVDSSTDRTREIASKFSKVKVVSIEWRDHFAAARNEGLNHIQSDWVLWVDTDELLLEEDVCGVRELAGIFHHHPTPPVLHIWHLNQIRGEVHYDFSQTRMFPMKRGLQFWGRIHEQISSSLGIYEEETYRRAVRIRFLHDGYDPSVIKEKNKLERNLRLLKMMIEEEPNDPGNWLFLGRESLLIGQEEQALVALLEAERIGMQTPRFGRMLDVYKLLTHYYMSRKDWKQAEITCLKALEHNNQFPDAHFLLAQIRMKQADELYLQADFHLKKAKTSIKEYRGSVSADYQIGQWKADLAVADLALRAGKLAEARHIYQVHAMRYPNIESLSQRIDMIEKQKHLLNRPI

SEQ ID NO: 5247 - protein, 1023 aa, Bacillus camelliae
MKPFVSLCMIVKNEEKVLERCLSSVKDVIDEIIVVDTGSTDKTKEIAAKYVNHVYHYDWNDSFADARNFAQSKATGEWILVMDADEYVDSSNLESAIQELKSFEIETFDACEVKVFNFTGNYGETIVQNHSVRIFRNLPTIGYSRSVHEQVTRTDGELRIKSLGLILYHSGYLNNVVGTKKKNERNTKLIEKQMSITGQSGFDYFNLGNELLSQGLTEKALESYIKAYQKKPDFRFSWVSFCLIQIINCLYVLKRYQDALNVIADAENIYLESPDFKCFKAIIYVAQNRSDDAIIELESLLDHTDQYQQIVTSVDFKEYRPHQMLGSIYKDKGNYEKAVFHLVKALNLNQYCYRSLLNLMEILLETSTVEEVSEFLHQNGFIKSSNDVIKFIRVFTILAETEIARKYLKELDQASDLRKSYEIKIDLIEGHAESLTYFFEKETFEDLRAMIENGVIDIYDLLLADIAYLKDKRIPVLLSNLTNEENIKELINYVVFDNVPTNTDMIKDDFLALLEKTLQMKKYDLFEMIVSKADAFKNIDLSIGHLLFRFDYQNKAKEYYEKVDPHLYDDKTFINLVKYYKEQGDFKLASEWLIVAISFGKTDYRLFENALEMHLEGNETYLWDIDQILTIGIQLYPGSPKLLYLSNKIHQGNNSQTSSEYIVGFFLETTQHYFVYESIIDELVKQGVNCHLVLNDKYGDTPETQNMFNDLLSFIGNIDRNDIEAYTITAIKDSQFQYDCMVSCYYSAWLNDVAKVHVRTPYGLLAKEYWNYSWWNVFYDKILCYSEYDASRLTIKDNCAVVGVPKFDKWFRKEIDNMDQVKQKFQLDESKETIMYAPTYGHLSSIDDWLDEIKLLEEYYNVIIKLHPGTAHRESETSRRNKIMNNFNNVTGDPRDLIPLLEIVDYVITDTSSMIFEAMITQQNILLLNPVNNPPIEENTGEHFLRSNVINLNIGENIHEYLMNKALFEEQGKRIAKELQSVYNLTDGHSGSRAAQEIITLLENRSTEPNKFLLSLRQRIFEK

SEQ ID NO: 5248 - protein, 229 aa, Unknown
  Description of Unknown: Elusimicrobia bacterium CG06_land_8_20_14_3_00_38_11 sequence
RCLESVKWADEIIVVDSGSTDKTVEIAVRFGAKVFENQWQGYGAQKNFAIDKASNNWILSIDADEVVTDELKEEIRGIIKNSAGYAAFKIPRMLYFQGRLMKWSGADYQIRLFLKGRAKFDLEPVHEKLLVDGDIGKFKNSIIHYSYENLTDYFNRFNRYTSLDARKRYQKGARFNLWHCILPFHKFISMYFLKLGFLDGRQGLDWAVLCAFYDIVKFMKLRELQNEKK

SEQ ID NO: 5249 - protein, 379 aa, Unknown
  Description of Unknown: Chlamydiae bacterium CG10_big_fil_rev_8_21_14_0_10_42_34 sequence
MKQFDITLCLILKNEAQYVATCIESVQPLVDEIMIADTGSTDDTVAICKQYTDHIETIDFSMGFSNARNHLVKQVKTKWILFLDADEYFDSIELNRLADFLNYASPDVDAFSVLRYNFFSSGAFYTSDTIKLFRSHPDIFYTGIVVDSVKPSLMKRGGKIQQIPVILNHFGHCRPILIRDQKAYKYLEMMDQDLAQNPNNFKVIGYKALILRTLGRLEEAQFWLEKALKCAPHEGHPYFVKGHVDRAFNRHEQAVAAYSRAIELDGMNPIYLNSRGIANLTKESFDEAAHDFELGQKLFPNHVHFTINLGLVDQARGDYQMAAKRFGEIGSKYPAFLKTHFEGCSEVDPYSGYIYDTVFNFHGLAYHLTFCEAKATGRI

SEQ ID NO: 5250 - protein, 359 aa, Bacillus cecembensis
MITISLCMIVKNEEDVIGRCLASVKDIVDEVNIVDTGSTDKTKEIVGQFTNRIFDFQWIDHFAAARNFSFQQATKEYILWLDADDVFSEEDQEKLKALKKSLTSDIDAVSMNYHLSFDADGNVSSLLRRNRLVKREKQFQWIGAVHEYLEVGGNIYQSDVAVSHIPLSHDHNRNIDIYNQLVKSGEELSPRDTFYYANELYDHAQYEKAIFYYEQFLTSQLGWVEDNIRACFKLADCYTHLNEKENKLSAILRSFEYDIPRPEACCRLGFHFMEQFKNFEAIHWYEQALLTKPQPHAPFQNNTFTTWLPHLQLCVLYDRLKQYEIAHAHNELAGTFIPNDPKIQFNKDYFARIFKKDDE

SEQ ID NO: 5251 - protein, 275 aa, Vibrio sp.
MIKLSSYIICKNEEARIKDAVMSLLHHVDEIIIVDTGSTDRTINIVKDIDTSKIKVFEIEWRDDFAAARNFALGKVNYNWVVTIDADEVMKEPCRLKEMIASLPEEINAIYPCIVSVGEEEEKGYSIPRIFKKDEFYYHGVVHEQLTPLKSKEQYFSELEILHYGYENETIIKKQKLMRNFLLSLDNHRKDASDEFFMMYLVIDWSAYPNSEQYVSAQKLVQCLGKINNMKYFEKAIYAVFDRYTTDLNALTTLLSTLDPETQMKAIQCFEVAYG

SEQ ID NO: 5252 - protein, 661 aa, Paenibacillus curdlanolyticus
MAAHTKLISLCMIVKNEAACIARCLRSAIGTADEFIVVDTGSTDETIAIARSFGAKIIEAEWRGDFAAARNVGLEQATGEWILFLDADEELSAGAAQELRTLVQSQASPGILLPIWNLLGEEEETATINPVLRLFRNDPRHRFEGRIHEQIAASILRAAPDAQLRLGETVIRHYGYRPSTVAEKDKIERNTRLLLQAIEEEPEQPFHRFNLGVEYLRAGRPAEALASFRSAKGAASFERLSYAHLVFKYEVRSLQTLGAWQEAAAAAREGAKLFADYADLWHCLAESLCSAGRWREAISGACSALRAGPPTGVYHTEDGMGAHRTAFLLGSLYERGGRVDAAVHWYVESVRMKPSLLPPLLRLCRLLRVNGRGDELPALLERRFAFSTEEGSLKIASLLLDSRCYAEAVQWLRQRAAGPCWGEASAAWLMLAEAELAASEGRFAQARRWAAKALDDGHGYWHEPEPEPGHGHGLGQADGEMPVWLGGRHPEQGSPLGEVTKPGVEKSQTQASEYAKDRRQSYSMGEAKCRLRLLYAAVLQITEGAEAAAAFCQGYGADVRGSLAQELAACVAGILREEKAEQAASSGASGDRLARVLQAVGESIRHGSDEAAHGGVEGLAAWADARLEQLEQSLQSRSAGATVQRVLRSARLRLAGCEGEA

SEQ ID NO: 5253 - protein, 254 aa, Unknown
  Description of Unknown: unclassified Thalassospira sequence
MSDKKPRISVVICAHNEEERLPSCLEKVTFADEIVVICDKCTDKTEDIAKGFGVKTVVGSWDIEGDRRNRAITEASGDWIFELDADEHINAELAAAIPEAVLSDKFDSYLIPVDNYVGKRLVRYGWGASFGTSAVWRLYRKGCKNWGDERVHPSFELTGKKGPRLDGALVHFVDRNISDMIRRFDSYTSARAADLRATGKIGSFAHNFRRIISRFWRCFVSRKGYKEGGLGFLIALLAALFPMVSYLKARYDDE

SEQ ID NO: 5254 - protein, 302 aa, Unknown
  Description of Unknown: Candidatus Levybacteria bacterium sequence
MNNKKISVVISAYNEDSMIKDCLESVKWADEIIFINNSSQDNTINIAKKYTDNIFNRENNLMLNINKNFGFSKAKGEWILSLDADERISPQLVDEIQKKIKEDDRFTSYNIPRKNIIFGKWIEHAGWYPDYQIRLFKNGKGRFKEEHVHEMITSEGDVGTLENSLTHYNYTSIRQFIHKHANIYAPNEADQLLKNGYIFSWQDVIRLPFKEFLSRYFAREGYKDGFHGLILSLLMGFYHLVILSYIWEKKGFPQIVEANMIMVKDEIKKSSKDLNYWINDHDIKKEENIIKKIYKKIKYKYL

SEQ ID NO: 5255 - protein, 640 aa, Bacillus acanthi
MKISGCVIAKNEEQFIENCLDSLKKVCDEIIFVDTGSTDRTIEIAKELGVQIYHYKWIDNFSAAKNYAISKAKGEWIIFLDADEYLVDTRKEVYSELALNSKNYDSILCEIINVDEHNDIQSSHIGNRFFRKDNFIKFEGMIHEDLRKKGDLLKSINGSNYMKIIHKGYSREQIQNKNKFERNLKLLLKQLDKDPENPAIYYYIADTYGLEKDFEKQYEYCKKSISKGQINQLGFAELPYILLIQSMIDSKSFASSIQFEINKAIKIFPESPVFRYFDGLIKFNEKRYHLSLESLLLSQMLNETYDYFSVDYMKNYSVSIYRMIGYIYEIQSKKMDAVSMYTKCLNIDKKQKDVLQHLLKLLSDVSEVEIIQFLNRIYSSNKEEDIEFLIEALSSLNNGILLSYFQKKLFDLTGEGNNAILLSLLFNNEHNKAYEISFDLYKETYRHDLAILMVYSSMLTKDEGKYKKIRGIVSPTLFRIINSIQKNEELYEEDLADYLKLLNYSNIFGDSEATNMLLGLSRNFIIDINEKIGEVFYLHQKYKAAIKFFENALFNTLYSRKGQLYKKIGISYYHEKEYLGARDNLIKSIEHGVLENEIFEYLIVVYTKIEEEFRDKIKDLFESLPESKYLLEIIGSVENA

SEQ ID NO: 5256 - protein, 362 aa, Cohnella lupini
MITISLCMIVKNEEHSIGRCLDSIHDLVDEINIVDTGSTDQTKSIVSLYTDRIFDFEWIEDFSAARNFSFEQATKDYIMWLDADDYLFENDRQALQKLKHSMKPEFHAVLMDYVLSRDQTGSAQNMTRRHRLLKRDCHFRWIYPIHEYIPVQGPVKISDIEISHSPFLEKKDRSRNIRILRQAILRDGGQLSRRYHFYLANELIGNGQIDEAIATFESFLAGETQYFEDHIAACGTLSNFYHERNQPDKELQYLLKTFEYTKPRPDYCCRIGIWFEEHKAYDKAVFWYELAIQVKSGDEYSLGLINKVCWTWGPHAQLAICFGKLGELDKAYEHNEIALTYLPDEPNLLKNKAQLDAARASL

SEQ ID NO: 5257 - protein, 306 aa, Bacteroides stercoris
MLDISVIILTYNEEIHIERCLNNAKKFAKEIFIVDSFSTDKTVEIATEMGVKVYQHPFKNHSAQFKWGLENLPIKTVWVWKQDADEYLSDALIEELHNKLPNLPDNVNGLTAPCLRIFMGRYIKHGIIPLILLRLFKYKYGSVENRIMDEHIQVSQGIIMDLKYPFYDDNLNGLTWWTTKHNGYATREAIDLLLTEYGMYESGVVNSGEHSSAVRKKKLKYIKMPLFWRAFVFFFLRYFMRLGFLDGKEGFLWHFLQGWWYRTLADAKVYEIKKVCNYDKDSIMRYLEKYYDIPTNGMLTNINRGG

SEQ ID NO: 5258 - protein, 370 aa, Unknown
  Description of Unknown: uncultured Sporomusa sp. sequence
MPDYTKQSHSPITISLCMIVKNEEAAIERCLQSVEQICDEIIIVDTGSTDKTKELVSKFTNNIFDFEWIDDFAAARNYAFSKATQEYILWMDADDVFLSQDLQELVKLKANLNREFDVVSMLYNLTFDQFRRVSSQLRRSRLVKREKKFRWIGAVHEYLDVSGTHLQTMIAVTHQPLGHDNERNLRIYERRQLKGEAFSPRDLYYFANELRDHKRYDQAIEYYQRFLATRQGWVEDNIGACARLADCYYQLNDIENELKAIYLSFQYDIPRADFCCRLGFYHLNNEQFKQAIFWYKLATQLGIETSSWGLVNHRCATWLPHLQLCVCYSRLGEYKLAYEHNEIAAKFIPDEPLIEHNRKLLQDYLGNEPR

SEQ ID NO: 5259 - protein, 308 aa, Dyadobacter sp.
MVDLSVIILTNNESKHIGRCIKSLQLITNKIFIVDSFSTDNTVSIAEDLGATVIQNPWVSYAFQFNFGIQNNPFQTKWLMRMDADEYITAELADELKTSLSTIPETISGLYVKRRVFFMDQWINHGGYYPIWLLRIWRHGLGVCEELWMDEHIKLSSGTTAQLQNDIVDHNLNNLTWWTQKHNNYAIREVIDLLNIKYNFGNKETVTPDFWGSQEQRTRYLKIKYANLPLFTRPFLYFIFRFIFKGGFLDGKKGLIWHFLQGFWYRFLVDAKIYEVYQRAGKEKENIVSHFRTEYGKDLQSPNQSVKI

SEQ ID NO: 5260 - protein, 465 aa, Eucalyptus grandis
MAPPHFLLVTFPGQGHINPSLQFAKRLVRVGAHVTFATAIRARPRMAESESIPEGLSFASFSDGYDDGFDNWDEMEEYMDKIKRRGTETLSDLIASNLKSGRRFSGVLYTILLPWAAEVARSHGIPSTFVWIQPATVLDFYYYYFHGYGDLIRSTGGNPSVPIQLPGLPPLMACDIPSFFNSKNEYNFSLPLFQWHFKILLEEAKPRILANTFDALEPDAIRAINEFEVIGIGPLIPSAFLDGQDPSDTSFGGDLFKSSSGYMEWLDTKPKASVIYVSFGSISVLSKPQKEEMARALVEAGRPFLWVIRESGKEERDEDRLSFKEELDKIGMIVPWCSQVEVLSHPSVACFVTHCGWNSTSESLVCGVPMVAFPQWSDQQTNAKLVADVWRTGVRITPNEQGLVESGEMRRCLELVMGDGKEGEEMRRNARKFRDLAREAVKEGGSSDKNLRAFVDEVREASELE

SEQ ID NO: 5261 - protein, 517 aa, Myzus persicae
MEMINCNSYIVILQLFILSFFKEALCADILGVFPIEAPSHQIIFDSYMSELHRRGHNVTVYSHFPDIASEQYKRIQISNTSSVLDPSYVTMDHMYSPSTLNSYKHMFHIVSNGEKYTQSDALRQLYDQPEDAYDLIVTETCNTDLYLALIDRFKAPFIAWTTSPLFVWSADRMGASTHPAYIPVLMTTYGPHMNFAERIYNTLMRSVAFYKYYTGSSISSQKIASKRYKDSSHLDQLVLRTSLLFVNTYHALWGSRPLPQNVVEVGGLHVKPPKPLQEDIQKYIDEAEDGVIYFCMGSLLRGETFSAEKRQMFLNVFNKIPQRILWKWEGELPGKPSNVMIRKWMPQRDILAHPNVKLFISHGGLLGTTEAVYEGVPILSMPIFGDQMTNIKAVVSKGGAEMMNYGDLNEDEIFTKITSMLTNPKYRQKAKELSEAFRDRPTSPLETAVYWTEYVIRHKGAPHLRSAAAGMPWYQYYLIDVLVVIVLSITTIFVLLYYLIIKVILRLLNKKSKEKQS

SEQ ID NO: 5262 - protein, 471 aa, Morus notabilis
MAILPGPGPGMGHLIPLLEFAKRLISHHRFHVTCIIPTIGPPSATLKQVLNDDYTNPNDSKLNAVYLPPVNFHGLTAVKVETQIFLAITRSLSPLREVLKSLKANYSENLVGLVVDSFGTDAFDIAEELNLSSYIFITSSAMILSFSLKLPQLDERVTGEYRAMGEPVRLPSCVPVHSGDLLDPVQDRSDLAYKLMVYHTNRFRLADGIILNSFIKLEEKGYTSFVERRRTGSSGPVLEDQSECLKWLDGQPSGSVLFVSFGSGGTLSFRQMNELALGLEMSGQRFLWVVRSPNDKVSNGSFFSLRNDNDPFAFLPNGFLETTKARGLVVTSWAPQAQVLAHISTGGFLTHCGWNSTLESVVHGVPLIAWPLYAEQKMNAVLLTESAQIALRPNVNDENGLVGRGEIAQIVKSLMEGEEGKRLRERVEEVKNAVQRVVGEHGSSTKALADLALKLKKRTCIYICRFIWKFV

SEQ ID NO: 5263 - protein, 480 aa, Zea mays
MAATPTIVLVPVWGIGHFVPMLEVGKRLLARSALPLTVTVLVMPLPAEAKRASEITEHIRQQEASGLAIRFHHLPAVEPPTDHSGIEEYISRYVQLYSPHVKAAVAGLTCPVAGVVVDIFCTALFDAAHQLGVPAYVYLITSAAMCALLLRSPTLDEEVAVEVEFEQMEGGVDVPGLPPVPASCLPTGLENRKIPTYRWFLYNGRRYMEAAGIIVNTIAEAEPRVLAAIADGRCTRGVPAPPVYSIGPVIPSTPPAEQQAQECVRWLDSQPPSSVVFLCFGSGGCFTAPQAHEIAHGLDRSGHRFLWVLRGTPEPGTKLPSDGNLAELLPADFLARTKDRGLVWPTKAPQKEILAHAAVGGFVTHCGWNSVLESLWHGVPMVPWPLGAEQHYNAFTLVADMGVAVALNVERKRKNFVEATELERAVKALMCDGETARKVRDKVMEIKAACRKAMEEGGSSNMSLQRLCDALVEGAVHPGK

SEQ ID NO: 5264 - protein, 474 aa, Centella asiatica
MEKDSTPPHVLIFPLPLQGPVNSMFKLAELLCLAGIHVTFLVTDHIHSRLLRYSDIHSRFNRYPGFRLETISDGLPEDHPRGDKFMELFDSLRMNTKPLFKQLLTSGSLVSDDLPPMSCIIADGIMGFTCDVANEVGIPIIYVRTISACCLWVFFCLPNMIESGEIPFTGEDDLDTPIKSVPGTESFLRRRDLPSFCRSGDLSHPNIQLYKSESEENPRAYGLILNTFEDLEGPILAQMRTFCPNIYTIGPLHTLIKTKLAGELTSSKTSSNSLWEEDRSCITWLDSQSPKSVIYVSFGSLALMTRDQLMEFWHGLVNSKCKFLWVIRPDSVAGNNEIPAEVAEGTKERGYIVGWAPQEEVLAHPSVGGFLTHSGWNSTLESVIEGVPMICWPYFMDQQVNSRFVGEVWKLGLDMKDTCDRVIVEKMVKDLMVERKDEFIKSAEHMAMLGKKSLSEGGSSYCHLNRLIEDIKLM

SEQ ID NO: 5265 - protein, 462 aa, Arabidopsis thaliana
MEESKTPHVAIIPSPGMGHLIPLVEFAKRLVHLHGLTVTFVIAGEGPPSKAQRTVLDSLPSSISSVFLPPVDLTDLSSSTRIESRISLTVTRSNPELRKVFDSFVEGGRLPTALVVDLFGTDAFDVAVEFHVPPYIFYPTTANVLELTEPLMLPGCVPVAGKDFLDPAQDRKDDAYKWLLHNTKRYKEAEGILVNTFFELEPNAIKALQEPGLDKPPVYPVGPLVNIGKQEAKQTEESECLKWLDNQPLGSVLYVSFGSGGTLTCEQLNELALGLADSEQRFLWVIRSPSGIANSSYFDSHSQTDPLTFLPPGFLERTKKRGFVIPFWAPQAQVLAHPSTGGFLTHCGWNSTLESVVSGIPLIAWPLYAEQKMNAVLLSEDIRAALRPRAGDDGLVRREEVARVVKGLMEGEEGKGVRNKMKELKEAACRVLKDDGTSTKALSLVALKWKAHKKELEQNGNH

SEQ ID NO: 5266 - protein, 286 aa, Unknown
  Description of Unknown: Oryza sativa Japonica Group sequence
MDATFLAWNFMGNRDAERMVFHYLTSSARAAAAKADILLCNSFVELEPAIFTLKSPATILPIGPLRTGQRFAHQVEVVGHFWQTNDDTCLSFLDEQPYGSVVYVAFGSLTIMSPGQLKELALGLEASGHPFLWVVRPGLAGNLPTSFLDATMGQGKGIVVEWAPQEQVLAHPAVGCFVTHCGWNSTVESIRNGVPMLCWPYFTDQFTNQIYICDIWRIGLKMVQTCGEGIVTKEIMVERLKELLLDEGIKERVQRLKEFAETNMSEEGESTSNLNAVVELMTRPMS

SEQ ID NO: 5267 - protein, 202 aa, Vigna angularis
MEWLDRQPPNSVLYISHGSYLSISSAQMEEIAIALHDGNVRFMWVTREESPKLREICNEKKMGLVVAWCDQLRVLLHHAVAGYWTHCGWNSVMEGIFSGLPFLTFPIALDQPLISRLIVQYWKVGWRVKKDENMEDLVTRDVIVVLLRKFMDLQSDVGSEIRRRAKELQRMVQLAISENGSSHTNIRTFLDNIVQTGAKRLD

SEQ ID NO: 5268 - protein, 470 aa, Unknown
  Description of Unknown: AGM61070.1 Sequence 29 from patent US 8420889 sequence
MEHTPHIAMVPTPGMGHLIPLVEFAKRLVLRHNFGVTFIIPTDGPLPKAQKSFLDALPAGVNYVLLPPVSFDDLPADVRIETRICLTITRSLPFVRDAVKTLLATTKLAALVVDLFGTDAFDVAIEFKVSPYIFYPTTAMCLSLFFHLPKLDQMVSCEYRDVPEPLQIPGCIPIHGKDFLDPAQDRKNDAYKCLLHQAKRYRLAEGIMVNTFNDLEPGPLKALQEEDQGKPPVYPIGPLIRADSSSKVDDCECLKWLDDQPRGSVLFISFGSGGAVSHNQFIELALGLEMSEQRFLWVVRSPNDKIANATYFSIQNQNDALAYLPEGFLERTKGRCLLVPSWAPQTEILSHGSTGGFLTHCGWNSILESVVNGVPLIAWPLYAEQKMNAVMLTEGLKVALRPKAGENGLIGRVEIANAVKGLMEGEEGKKFRSTMKDLKDAASRALSDDGSSTKALAELACKWENKISST

SEQ ID NO: 5269 - protein, 477 aa, Indigofera tinctoria
MEITKQEEGQTITGMVAMLPSPGMGHLIPMIEFAKRLVLHHNLAVTFIIPTDGPPSKAQKTVLQSLPAAISHTFLPPVDLSDLPPDAMIETIISVTVLRSLPSIRDLFRSLSPSVLVLDLFGTDAFDIAKEFNVSPYIFFPSTAMVLSFFLHLPHLDQEVHCEYGELTEPVKIPGCIPVQGSDLIGAVQDRTNDVYKWILHHAKRYREAEGIIENSFLELEQGPIKELLKEEPGKPPYYPVGPLVNVETAGRAGNGSECLKWLDEQPHGSVLFVSFGSGGTLSTAQVNELALGLEASEERFLWVVRSPNDQIANASFFSAASAADPFDFLPKGFVERTKERGFLIPSWAPQPQVLAHGSTGGFLTHCGWNSILESVVNGVPLIAWPLYAEQKMNAVMLTQDVKVALRPNDSNGDLVKREEIANVVKRLMKGDEGKKVRNQMKDLKEAAAKTIGENGASRNHISNLAQKWKNKATVTN

SEQ ID NO: 5270 - protein, 478 aa, Citrus unshiu
MSRHALMLSLARISNDYIFKLLKKIITCGYKGQPTQLLKSIAQVLNLDQFTIALVNMLHHNRFIRNKGPDSLKGLPRFRFETIPDGLPPSDREATQDLPALCSSIRKTCLAPFLELLGKLNSSGNVPQVTCVVSDGIMGFGAKAARILGIPDLPQFHELSNRGIVPFEDEKFVTDGTLDAAVDWVPGMSNMRLKDFPSLMRVTDANDILFNYMKTEVQNCLESSAIIFNTFDEHEGKVLEAIASKSPNIYTVGPLHLLCRHLPESEFKSFRSNLWKEDPECLKWLNEKEPNSVAYVNYGSITVMTDEQMKEFAWGLANSGHPFLWIVRPDMVTGDSAILSQEFYEEIKDRGMIANWCPQDKVLSHPSVSVFLTHGGWNSILESVSGGVPIICWPFFAEQQTNCRYASTTWGIGMEVNRDASREDIAALVKEIMEGDKGKLIRQNVQDWRKKAEAATDVGGASFNNFNKCIKEVLHYHH

SEQ ID NO: 5271 - protein, 477 aa, Cephalotus follicularis
MSTSNSSTATTKKRPHILIFPYPAHGHTLSLLDLTHQLSLQNLTITILVTPKNLPTLSPLLSINPSIQTLTLLFPSHPKLPPGVENVKDLGPTGNVAIISALAQLFDPIIAWFNSHPNPPVAIVSDFFLGWTLHLANKMGIPRLAFFSVGALLASVSDFCWNNIVTVSGCEHVSFPCLPRSPVFKEEHLPSVFRLYREGDPDWELVKDGMLANTLSYGCVFNSFHALEGEYLDWVKLKMGQDRVFGVGPLSLVGPEYSWRGSSDPSNGGSVLTWLDGCLDGSVLYVCFGSQKLLNREQMEALASGLDKSGGRFVWVVKPGGTTRQVEDGYGVVPDGFEERVAGRGFVIRGWAQQVKILGHSAVGGFLSHCGWNSLMEGIVAGVMIMAWPMEADQFVNAKLLVEDMGVAVRICEGADSVPDSDKLGRVIREALSEGGVQVREKAKELRDEALAAVRAGGSSKIDLDRLVNEFVNLKSV

SEQ ID NO: 5272 - protein, 498 aa, Citrus unshiu
MQSTKLKPHICLLASPGMGHLIPVVELGKRLVAHHDVQVTVFVVASHDDASNSNVHAVPNNNNLFNAVTLPLANISSLVNPDASLGEKILVLMHKSLPALRSAISAMKFRPTALIVDFFGTEAMDVADEFGLLKYMFIASNAWFLACFIHAPAIDKKLLTDEHFNLEKPMELPGCMPVRFQDSLELFLHPNEPIFDFISSIGMKMSLSDGILVNTWDDLEPKTLGSLRDDNLLGRVCKAPVYAIGPLVRSPDVASPSTKTSPSDSRVIILDWLNEQPSQSVIYVSFGSGGTLSAKQMTELAWSLELSQQRFIWVVRPPVENDVSGSYLTVVDNNSAGKLEDYLPHGFLTRTDKVGLVVPAWAPQAEILAHPSVGGFLSHCGWNSTVESIVNGVPMIAWPLHAEQKMNATMLTEEIGVAFRSKELPTESLVTRQEIEMLVRKIMVDKEGHSSIRVRAMELKYGAQKATSNSGSSYKSLSQVAKQCEKSLQELVTLGQGA

SEQ ID NO: 5273 - protein, 394 aa, Manihot esculenta
DDFKDLGFIDKQKAHVKEAVSKLTARSDSSLAGFVLDMFCTSMIDVAKELGVPYYIFFTSGAAFLGFLFYVQLIHDEQDADLTQFKDSDAELSVPSLANSLPARVLPASMLVKDRFYAFIRIIRGLREAKGIMVNTFMELESHALNSLKDDQSKIPPIYPVGPILKLSNQENDVGPEGSEIIEWLDDQPPSSVVFLCFGSMGGFDMDQAKEIACALEQSRHRFLWSLRRPPPKGKIETSTDYENLQEILPVGFSERTAGMGKVVGWAPQVAILEHPAIGGFVSHCGWNSILESIWFSVPIATWPLYAEQQFNAFTMVTELGLAVEIKMDYKKESEIILSADDIERGIKCVMEHHSEIRKRVKEMSDKSRKALMDDESSSFWLDRLIEDVINNLS

SEQ ID NO: 5274 - protein, 483 aa, Glycine max
MGSNYGPLHIFFFPFMAHGHMIPLVDMAKLFAAKGVRTTIITTPLNAPIISKTIEQTKTHQSKEINIQTIKFPNVGVGLPEGCEHSDSVLSTDLFPIFLKATTLMQEPFEQLLLHQRPNCVVADWFFPWTTDSAAKFGIPRLVFHGISFFSLCATKIMSLYKPYNNTCSDSELFVIPNFPGEIKMTRLQVGNFHTKDNVGHNSFWNEAEESEERSYGVVVNSFYELEKDYADHYRNVHGRKAWHIGPLSLCNRNKEEKIYRGKEASIDEHECLKWLDTQTTNSVVYVCFGSAVKFSDSQLLEIAMGLEASGQQFIWVVRKSIQEKGEKWLPEGFEKRMEGKGLIIRGWAPQVLILEHEAIGAFVTHCGWNSTLEAVSAGVPMITWPVGAEQFFNEKLVTEVLKIGVPVGVKKWSYSGVDCCAKWDVVEKAVKMVFAKEELEGMRKRAKVLAQMARRAVEEGGSSDSNLDVLIQELGTLSSLSR

SEQ ID NO: 5275 - protein, 471 aa, Polygala tenuifolia
MVANKNQIVHVIVVPYPSQGHINPLLQFAKRLASKGVKSTIATTQYTVKSICAPNVGVEAISDGFDEGGYAQARNVGLFLESFKVNGSKTLSQLIQKFENSSCPVTCIVYDSFLPWALDVAKEHGIYCGAFCTNSASICSIFSRIHQGLLQLPLKVEDGLTLVPGLPPFQHQDLPSFIRLPDSYPDYLAMKLSQFDNLHKADLIFINTFEALEAEAVKDVSKLWPAKLIGPMVPSAYLDGRIKDDKGYGASLWKPLSEECTKWLKTKPSNSVVFVSFGSMVSLTTEQMEEMAWGLKESGMNFLWVVREKEWINLPNDLMDTIKEQGLILTWCNQLEVLAHQATGCFVTHCGWNSTLEGLSLGVPMVGVPQWADQMTNAKFIEEIWEVGVRAKEDSNGVVRKQEIVHCLKEVMQGKRCEFFRQNARKWKESCKQAIDEGGCSDKNIDEFVHHLMHANANANGFINITSVKSS

SEQ ID NO: 5276 - protein, 472 aa, Brachypodium distachyon
MDSTGTGSSVAHEGGEGANVFFLPVPGAQGHTNPMLQFGRRLAYQYGFRPTLVVSSYTLSTTPPPDAPFRVAAISDGFDDGGKPSGPDMTEYLRRLEAVGSDTLARLLSDEARAGRPVRVLVYDPHVSWARRVARDAGVPAAAFFSQPCAVNIFYGEVHAGRMAMPVTESDACALVGGGTLGVELRPEDLPPFVALPEWHPVFTKTSIRQFDGLEDADDVLVNSFRDLEPTEVEYMESTWRAKTIGPSLPSFYLDDDCLLSNKSYGFDLFSGDDGVCMEWLEKQTISSVVFASYGTFSKYDESQLEELGNGLYSSGKRFLWVVRSDEAHKLSQELKTKCEKKGLIVPWCPQLEVLAHKATGCFLTHCGWNSTLEAISNGVPLVGIPHWGDQPTIAKYMESAWDMGVRVQTGLNGQVRREEVVRCIKQVMDGERKDEYKRNAMKWMQKAKEAMHTGGSSNKHIADFATKYSSS

SEQ ID NO: 5277 - protein, 471 aa, Centella asiatica
MIEVFFFPMFLHGHMIPMLDIAKLFASRGVRSTIITTPLNVPFFSKSVERVKDLGYEMSIRTIKFPKVDGLPEGCENGDKLTTPEMFQVFFKATFVLQEQLEQLLQDFRPDCLVSDMFFPWTTDSAAKFDIPRLVFHGTSFFAVCASEQVRMHKPFENLSDDSEPFLVPNIPHEIKLIRSQIPPHQRAKTDFTDVLAKAHESMIKSYGEITNTFYELEPDYVEYYRNVMKRKAWHIGPVSLCNRKVEEKAERGKKSAIDEHECLKWLDGKDPSSVIYVCFGSVCSFPSTQLYELAMGLEASGRDFIWVVKKVKNGEQKDDWIPEGFEERIKGKGLVIRGWAPQVLILDHEAIGGFVTHCGWNSTLEGISAGVPMVTWPTFAEQFYNEKLVTEILRIGVAVGAREWVQLGADGVKREAVEAAVKRVMVGDEAEEMRNRAKELKEMAKRAVGEGGSSYSSLDDLIKELETYHS

SEQ ID NO: 5278 - protein, 363 aa, Medicago truncatula
MGSEVPLHILLVSFPAQGHINPLLRLGKCLAAKGASVIFTTTEKAGKDMRITNKLATPIGDGCLTFEFFDHCLLDDAFEHDIPSALSWNNSSAVFATYYNYVHKLVPFPSETEPYIDVHLPFIVLKYNEIPDLTHPFNPYPILGTLITSHMNNLSKIFCVLADTYEELEHDFIDYLSKKSVLIRPIGPLFKNPTIKAASNIRGDFVKSDDDCSIIEWLHTKPTGKVVKWSPQEEVLDHPSVACFVTHCGWNSTMEAIASGVPVLAFPAFGDHLTNAKFLIDVFGVGIRLGYSLMENKLVTRDEVKKCLLEATTGEKAEELKKNAMKWKKEAEEAVAVGGSSDWNLDAFMEDIKKRGVVNIHKV

SEQ ID NO: 5279 - protein, 495 aa, Barbarea vulgaris
MASITNHKSDPLHFVLFPFMAQGHMIPMVDIARLLAQRGLTITIVTTPHNASRFKNVLNRAIESGLPINILHVKLPYQEVGLPEGLENIDCFDSMEHMIPFFKGVNMVEESVQKLFEEMSPRPSCIISDFCLPYTSKVAKKFNIPKILFHGMCCLCLLCMHVLRKNPKILENLKSDKEHFVVPYFPDKIELTRPQVPMDTYVPGELKEFMEDLVEADKTSYGVIVNTFQELEPAYVKDYKETRSGKAWSVGPVALCNKARIDKAERGNKSDIDQDECLKWLDSKEERSVLYVCLGSICNLPLAQLKELGLGLEESTRPFIWVIRGWDKNKQLVEWFSESGFEERIKDRGLLIKGWSPQMLILSHQSVGGFLTHCGWNSTLEGITAGLPLLTWPLFADQFCNEKLVVQVLNSGVRAGVEQPMKWGEEEKIGVLVDKEGVKKAVEELMGESDEANERRRRAKELGELAHKAVEEGGSSHSNITFLLQDIMQLAQSNN

SEQ ID NO: 5280 - protein, 479 aa, Theobroma cacao
MDQEQQPQAYPHVLLFPLPAQGHVNSMLKLAELFALAGLEVTFLNSDHNHERLVRHTDVGFRFAKYPRFKFETIPDGLREDHPRLGVSFMELFESMELRTKPILREMLVKINPPVDCIIGDGALGLVLDVADELGIPIFQFRTISASGIWAYFAIPDMIEAGELPIRGNEDMDRLITRVPGMETFLRCRDLPSFCRDSDMTDSNLQLIAKETRKNLSAPGLILNTFEDLEGAILSHMRSKCPKIYTVGPLHLHLNTRLAETNGTMVHQSPNSLWEVDRSCLSWLDEQPKESVVYVSFGSIAVLSREQIMEFWFGLVNSRKRFLWVFRPDFMPEKGSIPAELVEGTKQRGYMVGWAPQEEVLAHCAIGGFLTHSGWNSTLESLVAGVPMICWPYFADQQLNSRFVSEVWKLGLDMKDVCDRRVVEKMVNDLIVDKREEFVKSSAEIAKLAKACVNVGGSSYCNLDRLIEDIRSMNRNCSK

SEQ ID NO: 5281 - protein, 284 aa, Oryza sativa
MVQLMPPIDAAEIPWVSLGSTQERRRYNIQNVFKTNRLMALAEMIICNTFREIESEALELLSNALPVGPLLAPASGPTGHFLPEDMTCLTWLDTQAPGSVIYVAFGSSTIFDIAQFHELANGLAVSDQPFLWVVRPNFTNGIQEDWFNEYKDRIKGKGLVISWAPQQRVLSHPSIACFMSHCGWNSTMEGVLHGVPFLCWPYFSDQFCNQSYICNVWKTGIKLFRDKQGVVTQEEIKNKAAQLLEDKEIKERAVTLKTTARASIQEGGSSHQNFLELVNLLREQ

SEQ ID NO: 5282 - protein, 474 aa, Cyclamen persicum
MANEASPPRIVIVPSPGMGHLIPLVEFAKRVVSSHGLTATFAIPTDGPLSEAQKGFLKALPRGIDLVVLPHAELDDLPPDVKIETKISLTVARSLEQLRDTIKSLKATTRLVAMVVDLFGTDAFEIAKEVNISPYIFYPSTAMALSLFFYLPTLDHSTPSEYRDLPDPVQIPGCIPILGSDLIDPTQDRKNDSYKWLLHHAKRYTLAEGIMVNSFKELEPGAIGALQEEGLLGNPPVYPVGPLVGMGHANGMVDRSGCLEWLDGQPHGSVLFISFGSGGTLSSGQITELALGLELSEQKFLWIVRSPSDKTSTAAFFNPSTENDPLAYLPKGFVERTKGVGLVFPSWAPQARILSHGSTGGFLTHCGWNSTLESVVNGVPLIAWPLYAEQKMNAAMLTEDVKVALRPKYSKNGLVERTEIATIVRSLMEGEGGKQLRNRMRDLKDASAKTLSTDGESTRILTELSRKWKNRTSG

SEQ ID NO: 5283 - protein, 287 aa, Manihot esculenta
TLNLIPGMSKIQIRDLPEGVLFGNLESLFSQMLHNMGRMLPRAAAVLMNSFEELDPTIVSDLNSKFNNILCIGPFNLVSPPPPVPDTYGCMAWLDKQKPASVAYISFGSVATPPPHELVALAEALEASKVPFLWSLKDHSKVHLPNGFLDRTKSHGIVLSWAPQVEILEHAALGVFVTHCGWNSILESIVGGVPMICRPFFGDQRLNGRMVEDVWEIGLLMDGGVLTKNGAIDGLNQILLQGKGKKMRENIKRLKELAKGATEPKGSSSKSFTELANLVRSRGSYEN

SEQ ID NO: 5284 - protein, 466 aa, Helianthus annuus
MQKKPHIAIVPSPGMGHLIPMVEFAKRLKNYHNISATFIISNDGPLSTSQNAFLDSLPNGLNYLILPPINFDDLPQDTQAETLISLMVTRSLHSLREALRPLVVETNMVALFVDLFGTDAFDVAIEFGVPPYVFFPSNAMSLSFTFYLPKLDQMVSCEYRDLPEPVQIPGCIPVHGQDLVDPVQDRKNDAYKWMLHNVKRYMMAEGIVVNTFKELESDALKVLLEDGAGKPRVYPVGPLIQTGSSSDVDGLECLRWLDGQPCGSVLYISFGSGGTLSTNQLNELAMGLELSEQKFLWVVRSPNDQPNATYFDSHGHKDPLGFLPKGFLERTQGNGLVVPSWAPQAQILSHSSTGGFLTHCGWNSILETLVHGVPVITWPLYAEQKMNALYLTKGLKVALRPTIGENGIVGHAEIARVVRGLFEGEEVQSIRSRIRDLKNEAANVLREDGCSTKTLEQLASKLKYKI

SEQ ID NO: 5285 - protein, 386 aa, Unknown
  Description of Unknown: Oryza sativa Japonica Group sequence
MITCLARVFEFARASGPDLCDFLRSTSPAVLIIDFFCYSALDVGAELRIPTYFFLTTCIASLAFLLYLPVIQEENTMSFRDLSGDLVHAPGIPPIPADHLPMSQLDRDSVSSRHFLALSEQVCNSHGVMVNSCHSLERRAADAIVAGLCTFPGRRTPPLHCIGPLIKPREEDSTERHECLAWLDAQPKASVLFLCFGSLGVFSVEQIKQVAVGLETSGHRFLWVVRPPPGLEHVTGPDLDALIFPEGFLRRTKGRGLVVISCSPQREVLEHGAVGGFVSHCGWNSVLEAVTAGVPMLAWPLYAEQRMNKVFLVEEMRLAVGVEGYDKGIVTAEEIQEKARWLMDSDGGRELRERTLAAMREVKEAPSDKGESKMTLLELVSQWKSD

SEQ ID NO: 5286 - protein, 518 aa, Eutrema salsugineum
MTNAMTESFYTWVCKTQILFSQQQKMGTSGEGSELHFFLFPFMAHGHMIPTLDMAKLFATKGAKSTILTTPLNSNLFEKPIKSFNNENPKLQDISIQILSFPCTELGLPRGCENTDFIFSSPDLGRGNLNQKFLLAMTYFKEQLEQLIETVKPDCLVANMFFPWASKVAEKFGVPSLVFHGTGYFSLCASHCLRLHKPYKKAASSCEPFVIPDLPGNIVIIEEQVIEKEEESVMGKFMKEIRDSETNSFGVLVNSFYELEPAYSDFFKSFVAKRAWDIGPLSLGNREFKEKAERGKKASIDEHECLKWLDSKRCDSVIYLSFGTMSSFNDEQLIEIAAGLEMSGHDFVWVVNKNCSQGEKEEWLPEGLEERTKGKGLIIRGWAPQVLILDHQAIGAFLTHCGWNSLLEGVASGLPMVTWPVGAEQFYNEKLVTQVLKTGVSVGVKKMIQVVGDFISREKVEKAVREVMVGEERRKRAKELAVMAKDAVKEGGSSDIELDRLMEELKLVKLQNEKEQGS

SEQ ID NO: 5287 - protein, 536 aa, Caenorhabditis brenneri
MRLTNFILLLVVWYSSVEGFNIVFYINAIGKSHIDFSDSLVDSLVDRGHTVDIIIARMNDQVKGHGKSKADRFYVFGFKNGSNWDKMHHLTSPFEDRHFPINGFNPYYVIGNDLCQSMRRKLPFNLFYLAVALHDPELHEFLSYRKYDIGIVSTFDYCGVGILKQAGIPSIATFNAVPIMPIQTVTIGLPNAASQILPLFYSFDLNTLYGRFWNLVGWGYINWVQIPTLKYEQELLFKKRYGGHFKIEEVLNKVDLTFVNSNEVMEKPRPLHHRIQYIGGINLKKPKPVNADLDALLSKSKNGVVIFSFGTQIPGVAYPRYAVRNFLNVFKKYPEYTFLWKYDVQPGEENMFKNVKNVVLLDWLPQTDLLYDPRVIGFISHVGLNSFNEASYAGKPIIAIPLFADQPHNAENGVARGTTYVLNKSKLTEESIEKGLRAILLDKSYSVNAKKLQKMLIEKPAQPKDRFVEWMEYAAANPGLHRVFALPGASMGIFQYYCVDAVAVLIAAVGLSLYGVKKVLELLTSKIIFLRKIKRA

SEQ ID NO: 5288 - protein, 469 aa, Theobroma cacao
MIDIAERPIVNAYIRSCVATATDINFINLPPVDPPSTDEYQTYLGYICLLIAMHKLHVKNAIAHLISTESTSDSDSNTVRVAGLFVDMFCTSMIDVANELGIPCYLYFASPVSFLGLMLYLPTLDAKFATEFVALDSGLMVPKDPAAASASGLTIPGFANPVPYRVLPNSVLYRKQDGYFWYLHHARRYKETKGIVVNTFRELESYAIDSVSNGNDDWPPIYPIGPVLDLVGPAQWHPQQAQHGSIMQWLDNQPPSSVVFLCFGSMGSLSEAQLREIAVGLERSGFRFLWSIREPPKMKLDLPGEYTNVEEIEMLPPGFVDRSRRAGTGLVCGWVPQALILSHQAIGGFVSHCGWNSILESIWYGVPIATWPLYAEQQLNAFELVTELELAVEIRADYRKGSDLVSPEELERALRRLMKGNDEVRRKMREMKQKSRVALMPNGSSYKSLASLIEELTAEIAIKKVEILE

SEQ ID NO: 5289 - protein, 469 aa, Gossypium raimondii
MPQPHFIVVTYPAQGHINPTLQFAKHLIRLGVRVTYITSISASRRMTKVPTAEGLSFLPFSDGYDYGIKPGDDTDHYLSEFKRRGKDAISEYITSSENEGKPITCIVYSLCLHWAAEVARKHHIPSALLWIQPATVFDIYYFYFNGYESAIKAQADETNPKCSIKLPGLPPLFPRDLPSFVIASNVYQSALSLFQEQMDVLAEEPNAKILINTFDALEHEALNAIEKFKTVGIGPLVPSSFFNSKDALDNSLRVDLFQSDSKDYIQWLDSKPKSAVVYVSFGSIAALKKQQVEEIARALISSRRPFLWVMRNRKDRGEEEKEEDKLTCREELEQIGMVVPWCSQVEVLSHPSLGCFVTHCGWNSTLESLVAGVPMVAFPQWTDQGTSAKLIEDVWGTGVRVSTNEEGMVERDEIVRCLDVVMGDDEKGMEVKKNVEKWKGLAREAAMEGGSMDMNLKAFVDDVSQGYCK

SEQ ID NO: 5290 - protein, 468 aa, Glycine max
MKDSIVLYPALGRGHLVSMVELGKLILTHQPSLSITILILTPPSNTPSTPKGCDSTSQYIAAVTAATPSITFHHLPPTQIPTILPPHILSLELSRSSNHHLPHVITSLSKTLTLKAIVLDFMNFCAKQVTNALNIPTFFYYTSGASSLATFLQLPVIHETTTKSIKDLNTHLSIPGLPKIDLLDLPKEVHDRASQSYKLFHDIATCMRDSDGVIVNTCDPIEGRVIKALSEGLCLPEGMTSPHVFCIGPVISATCGEKDLNGCLSWLDSQPSQSVVLLSFGSLGRFSRAQVKEMAVGLEKSEQRFLWVLRSELVGVDSVEPSLDELLPEGFVERTKGRGMVVRNWAPQVRILSHDSVGGFVTHCGWNSVLEAVCEGVPMVAWPLYAEQRLNRVIMVQDMKVALAVNEDKDGFVSGTELRDRVRELMDSMKGKEIRQRVFEMKIGAKKAKAEEGSSLVAFQRLVQLWNQ

SEQ ID NO: 5291 - protein, 470 aa, Helianthus annuus
MSPTPHVLLFPLPMQGPVNCMLKLAELLCISGITVTVLNTDYIHRTLIRHSNVLTRFSSYDNLRFKTISDGLPEDHPRSGQRFLDLFDGMKTVTEPVFREMMVSGCFSFKSDPPVTIIIPDASFSFALDVAEEVGIPLFYFETVSPSALWTYLCLPKLIGAGEVPFNGNDLNVLIKNVPGTETFLRRRDLPSFCRLDDVDNLVTKIIMKEARCVPRAHGLILNTFQALDETVLVHMRKLCPDIYCIGPIHTLYKSLVTTQSSVSNSLWEENATCLSWLDTQVTRSVVYVSIGSMAMMTVEQLFEFWHGLVNSGKPFLWVQRPGSVIGEYDHNLVPKRLIDETKQRGFITTWVPQEAVLAHSAIGGFLTHSGWNSTIESIIEGVPMICWPQNVDQQVNSRFVSEVWKVGIDIKDTCDRGIVEKAVRDVIDVRKTEFIESTRMLAELGGQSVAEDGPSVMDLNRFIKTITTL

SEQ ID NO: 5292 - protein, 468 aa, Unknown
  Description of Unknown: Oryza sativa Japonica Group sequence
MADSDGSVHVLLLSYPAQGHVNPLLQFGKRLAAHRRVRCTLAVTRSLLNSCCRAPPSPGGGGGVHVATYSDGCDARGYDELGDEGAYLSRLESAGSATLDELLRGESGEGRPVRAVVYDAFLPWAAPVARRHGASCAAFFTQACAVNVAYAHAWAGRVELPLPTSAPAPPLPGVPPELEPADFPTFLTAPAAGRSAYLDLLLRQCQGLEVADHVLVNSFHELQPKEAEYMAATWGAKTVGPTVPSAYLDGRLPGDASYGFDLHTPMAAESKAWLDERAASSVVYVSFGSLATPSAVQMAELAHGLRDSGRFFLWVVRSSETGKLPDGFAGETAAKNTTGLIVPWCPQLEVLAHGAVGCFVTHCGWNSTVEAVSAGVPMVAVAQWSDQPTNARYVEEAWRVGVRARADGEGVVRKEEVARCVAGVMDGETGMEFRTNAARWSAMARAAMSQGGSSDTNISEFLTKLCSK

SEQ ID NO: 5293 - protein, 466 aa, Aegilops tauschii
MASAAESSGGATATRRVLMFPLPFQGHLNPMLQLADVLHARGLRVTIFHAAFNAPDPERYPAGYRFVPVGAGVPTADLVPTGSNADFAGAVLRINERLQAPFQDSLRAVLEEDEEGAAVCLVLDSNLRGMQVVADRLGVPTLVLRTAGAACLVAFMAFPALCDKGLLPPQDHSQLNMPLDDLQPLRVRDMVFSTTSPHETISTCLECIVESVRCSSGVIFSTFCDLEDVELQKVNDSVGVPVYAIGPLHKISSGPQSSLLAPDRTCLDWLDKQEDESVLFVSFGSLASMDKEELMETALGLANSRIPFLWVIRHDLLHGSEKVGLPDGFEEAVQGTGMVVSWAPQQEVLGHQAVGGFWTHNGWNSTLESISEGVPMLCRPHFADQMINARYVQEVWKIGFELEGKLERGEIERNVRNLLCQEVGGEMRRRAKDLKDKATRCIKKGGSSQTRVDLLVNFITSLPSSI

SEQ ID NO: 5294 - protein, 493 aa, Medicago truncatula
MVSQKIHSVLLASPGIGHLIPTIELGKRLTTHHNFDVTIFVVTTATSDSDKTKSHILQQISNLNSLDIIVTPPVDVSDKLDPNNPSLGLQIVLTMIESLPFIRSEIQSMKNPPSVLIVDIFGTAAFPMARELHMSSYVFFATNAWFTAVNINLPFITDEAFSRHAKNHEPLSILGCEPVRFEDTLETFVAPWGPIHKRYVEVTREIIAIDGILVNTWHDLEPGATKAVIENGVLGRFVKGPVYPIGPLVRTGEPEKGGDSENLILSWLDQQPAESVIYLSFGSGGTMSKGQMRELAYGLELSQQRFIWVVRRPTEDNASATFFNIAGADGTIMVDYLPKGFLNRTKDVGLCVPMWAPQAEILKHPSTGGFLTHCGWNSVLESIHNGVPMVAWPLYAEQKMNATMLSEELGVAVKATKTVAEGGVVCREKIAEVIRKVMVDDEGVAMRVKVKEYKVSGEKALSVFGSSHESLCKMAKDCELHLHHGSEAKGRGA

SEQ ID NO: 5295 - protein, 486 aa, Polygala tenuifolia
MDSHDSQLHISFFPFMGPGHMLPTIDIAKLFAFRGLKVTIITTPSNAAVDSTLQKTKELGFEIKLLFIKFPYAELGLPEGCDAKLMFQPQLRRKLCKIIPSMQHSLEELLQQHRPACLVADTIFPWATDAAKKYGIPRFVFHGSCFFSVCASICLYKHKPHHKAISDSEPFLIPDLPDEIKLSKNQLPDYIKQEEVDEIIYAFYKSALEAEFTSDGAIVNSFYELEPAYADHYTKLTGRRGWHIGPVSLCNEDFDEKAQRGNEAGNNQNKYCLRWLDSKPPSSVIYVCFGSMTNFSDSQLMEIAAGLEASGQHFIWVVKKEKEDKGNGKWLPEGLEKRVEEKGLIIRGWAPQLLILNHVAVGGFVTHCGWNSTLEGVAAGLPMVTWPVSAEQFYNEKLIIQVLKIGVSVGAQKWIRVFGDYVKKEAIAKAVTRIVIGEEAEGMRKRARALADKSKAAVTEGGSSHNELNHLIQELKALRTEKLMLQ

SEQ ID NO: 5296 - protein, 480 aa, Oryza sativa
MEADPNPMVVLHTCLGVGHLIPMVELAKLLLRRGLAVVIAVPTPPASTADFFSSSAPAVDRMAAANPSISFHHLPPPEYPDPDPDAFLQMLDTMRLTVPPLLAFLRSLPSVAALVLDLFCVDALDAATAAGVPAYFYYTSSAGDLAAFLHLPHHFATTEGSLKDMGKTPLRFPGVPPIPASDMPHTVLDRADRTCATRLGHYGRIPEARGILINSYEWLEARSVRALREGACIPDRPTPPVYCIGPLMAKGEEAANGERHACLSWLDAQPERSVVFLCFGSLGAVSVKQLKEIARGLENSGHRFLWVVRSPPQDPAKFFLPRPEPDLGMLLPEGFTERTRDRGMVVTSWAPQVEVLRHAATAAFVTHCGWNSVLEAASAGVPMLCWPQYAEQRMNKVLLVDGMQLGVVMDGYDEELVKAEEVEKKVRLVMEFEEGKKLRDRLTMAKEMAAKALADGGSSSLAFTEFLKDLNFGNTTKEKA

SEQ ID NO: 5297 - protein, 387 aa, Unknown
  Description of Unknown: Oryza sativa Japonica Group sequence
MRRFVPQLRALVVGIGSTTAAIVCDFFGTPALALVAELGVPGYVFFPTSISFISVVRSVVELHDDAAVGEYRDLPDPLVLPGCAPLRHDEIPDGFQDCADPNYAYVLEEGRRYGGADGFLVNSFPEMEPGAAEAFRRDAENGAFPPVYLVGPFVRPNSNEDPDESACLEWLDHQPAGSVVYVSFGSGGALSVEQTAELAAGLEMSGHNFLWVVRMPSTGRLPYSMGAGHSNPMNFLPEGFVERTSGRGLAVASWAPQVRVLAHPATAAFVSHCGWNSTLESVSSGVPMIAWPLYAEQKMNTVILTEVAGVALRPVAHGGDGGVVSRKEVAAAVKELMDPGEKGSAVRRRARELQAAAAARAWSPDGASRRALEEVAGKWKNAVREDR

SEQ ID NO: 5298 - protein, 479 aa, Citrus unshiu
MKKAELVFIPSPGAGHLVSTVEIAKILVDRHERICITVLIIKLPFDNKVAAYTESLAACNLPSRIKFIFLPDDNQSPTPGKVPYSSLETKKTHVKEAVAKLTGSPDSPTLAGFVLDMFCMCMVDVADELRVPSYVFFTSSAASLGSFLNGQALYDQNKLTTELIDSGADLQVPTLVNSIPARLLPSSFFDKEWGEFLFGQARRYRLVKGIMVNTFEELEPYAVKSLYDGKIKIPPVYAVGPVVNITGDNYALGPGGIEKKAEVMTWLDDQPVSSVVFLCFGSRGCFDVDQAREIAHALEQCGHRFLWSLRQAPTEDKTELPSDYADLKGVLPGGFLDRTAEIGKVIGWAPQVAVLSHPAVGGFVSHCGWNSTLESIRFGVPIATWPMYAEQQANAFQLVIELGLAVEIKMDYRKDIFNKIPTMVTAEEIERGIKCLMNPESEIRKRVKEMSEKAGRAVMDGGSSFSSLGRFIDDALDNM

SEQ ID NO: 5299 - protein, 454 aa, Cephalotus follicularis
MQTNKIYVVTGSGQGHLYPCMELCRFLSSRNYHTTLVISSNLSTAIPSSFTENPLHEIAQISPSPRPIPGSAPLSHQSAHELEAHLVTHARVPDLPPPLCAIIDFQMGWTKRVFWKFDIPVIGLFTFGACAAAMEWGAWKVHAGDLKPGETLPVHGLPEEMSLTHSDLLRKSFGQPRGSGGPKPGGGPPKPGDRPPWVPEIQGSIGLMFNTCDYIDRPFIEYMADQMGMPAWGVGPLLPQQYWNSSGSLIRNRERQSNFTEDEIIQWLDSKPRGSVLYVAFGSEVGPTMEEHQQLACALEELDRPFVWVIQPGSGGLDKKVGDRGLIICGWAPQLLILSHKSTGGFLSHCGWNSTMEAIGRGIPFLAWPIRGDQYFNAKLVVSYHKVGYRVAHDLSLLITKDDIFKGVERLMGDIQMKRRAEALSAQFEHGFPATSVAALDAFEDFISQKQKPV

SEQ ID NO: 5300 - protein, 501 aa, Centella asiatica
MDSQFQQLHFVMIPLMCPGHLIPLVDMAKLLAQRAVTVTIVTTPRNAIRFGAATSRAIQSGLPIRLLELRFPTLEAGLPEGCENVDQLSSFDFSKNFIDASKMQQGPLEKIFGDIKPSPSCIISDKHIMWTAKTAKKFQIPWIVFDGMSCFNQLCTEILHTTKVHENVSESEPFVVPGLPDVIEFKRAQLPGLFNPGSNPGSANVNDIREQIRATEVGAYGVVINSFEELEHDYVREFKKIKEGKVWCVGPLSLCNTDDIDKAQRGNNVAMDQQHKCLQWLDAEKNGSVIYVCLGSLSSLSNLSGAQIIELALGLEMSGYPFIWALRPGIKHKEIEKWVIEEGFEERVKGRGMLIWGWAPQVLILSHRAIGGFLTHCGWNSTIEGICAGVPMITWPLFAEQFVNEKFLVQVVKTGVRVGVEAVVDMGYKEEFGVKVKREDVKNAVECIMSEDEEGEYRRNRAKKLAEMAVKAVEEGGSSNLNMTLLIQDIIEQVKDRLALS

SEQ ID NO: 5301 - protein, 511 aa, Citrus unshiu
MGTESLVHVLLVSFPGHGHVNPLLRLGRLLASKGFFLTLTTPESFGKQMRKAGNFTYEPTPVGDGFIRFEFFEDGWDEDDPRRGDLDQYMAQLELIGKQVIPKIIKKSADEYRPVSCLINNPFIPWVSDVAESLGLPSAMLWVQSCACFAAYYHYFHGLVPFPSEKEPEIDVQLPCMPLLKHDEVPSFLHPSTPYPFLRRAILGQYENLGKPFCILLDTFYELEKEIIDYMAKICPIKPVGPLFKNPKAPTLTVRDDCMKPDECIDWLDKKPPSSVVYISFGTVVYLKQEQVEEIGYALLNSGISFLWVMKPPSEDSGVKIVGLPDGFLEKVGDKGKVVQWSPQEKVLAHPSVACFVTHCGWNSTMESLASGVPVITFPQWGDQVTDAMYLCDVFKTGLRLCRGQAENRIISRDEVEKCLLEATAGPKAVELKENALKWKKEAEEAVADGGSSDRNIQAFVDEVRRTSVEIITSSKSKSIHRVKELVEKTATATANDKVELVESRRTRVQY

SEQ ID NO: 5302 - protein, 464 aa, Helianthus annuus
MKMEKTPHIAILPSPGMGHLIPMAEFAKRLVEHHHISATIIIPTTGTPPKAQTTVLESLPENIHHMFLSPVNNLPENVRPEIKINRIMQGSLSSLRDALSCLKSKTKLVALVFDMFGHDSMEVAKEFNLCNFLFFPMSAMALSFTFTLQKLDEETTGEYKDLPYPVKVPGSVSFHGRELMAPVQIRTDEVYKGYLLLSKRLTLLDGIMVNSFVELEEETICVLRDDVAGQTPIYPIGPLIRSDPSNGSDRHECLKWLDDQPSGSVMLVSFGSGGTLSLEQIHELAHGLEMSNHRFLWIVRSPSKASNASFFTGSSQNDPLGFLPEGFLARIVNRGFIVPSWAPQIKILSHEAIGGFLTHCGWNSTLESIVYGVPMIAWPLYAEQHMNAKVMTEALDLALRLETDENGLYQREEIKKVVKGLMEGDEGKKISKRLKELKSAAMKALSDGGSSMESLSKIAFQLKK

SEQ ID NO: 5303 - protein, 478 aa, Saccharum hybrid
MDASGGSMHVVMLPWLAFGHILPFTELAKRIARQGHQITILSTPRNTRRLIHIPPDLAGLVRVVDVQLPHVERLPEDAEASIDLPSDDLRPYLRRAYDAAFADKLSDILQEPGPGKPDWVIIDYAAYWAPAAAARHGVPCAFLSLFGAAVVSFYGPAEGLMGRGKYARTKPEQLTVVPDYVPFPTTVAYRGFEAREFFTPVLVPDESGVSEGYRFAKCIEESQLVAIRSSAEFEPEWLQVLGGLYRKPVIPVGLFPPPPTQDIGGHKAALQWLDRQTRGSVVYAAFGSEAKLTSAQLQTIALGLEASGLPFLWAFRQPVDANEGKSGLPEGFEERVDGRGLVCRGWVPQARFLAHESIGGFLTHAGWNSIIEGLARGVRLVLLPLMFDQGLNARHLTEKKISVEVPRDEEDGSFTPKDIAAALRRVVVEEECEVFGDKAKELAKLFGNDEMNDQCVRDFLKCLSLSEYTRQRQSVVGL

SEQ ID NO: 5304 - protein, 478 aa, Medicago truncatula
MEEQKTCIAMIPCPGLSHLIPFVEFAKLLVLHHNNFHVTFLIPTLGSPTPSTKSILNSLPPNIDFTFLPHINIQDLPPNIHIATQMKLTVKHSIPYLHQEVNKMVTCSKTNFVCLVFDLFSSDVIDIAKKFNLMSYIFATSSVISLQFCLNLPKLDESVSFEFMDTTKTFDIPVSNVSFKVKDFPDPVLFGRSSETYKAFLCACQRLSLVDGVIINSFTYLEHDAIKSIQDIICVYPVGPIIQRESKSKENKLECITWLNNKPSKSVLFISFGSGGALTHEQINEIAFGLESSGCNFLWVIRVPNKHSNSAYFSGSSKKDDPLNYLPLGFLERTKDQGLVVPSWAPQVEILSHSSTGGFLTHCGWSSSLEGLVYGVPMIAWPLFAEQRMNAATLTDVFKVAVRPKIDDEDGIVKGEEVARVIKIIMNQYSRDGEGLQLRKRIEDLRVEAAAAVSEDGSSRRALSSLVLKWEERVTLIN

SEQ ID NO: 5305 - protein, 322 aa, Oryza sativa
MHAEEQLTNGFLDAPVDWTPGMSKHLRLKDFPSFFRATDPDEYMFHFALHVTERLAEADAAVLNTFDELEPEALDAMRAMLPPSVSIHTIGPLGFLAEQVVPKGSPLDALGSNLWKEDDSCFGWLDGKPPRSVVFVNYGSVTVMTNEELVEFAWGLANSGHDFLWIVRPDLIHGDAAVLPPEFMESVGGRGLLASWCPQEAVLRHEAVGVFLTHSGWNSTVESLCGGVPMLCWPFFAEQQTNRRYSCTEWGVAMEIDDDVRRDAVEAKIREAMGGDKGREMRRRAGEWTKETGLRATRPGGRAHASLDALVADVLLSGGKAR

SEQ ID NO: 5306 - protein, 485 aa, Phytolacca americana
MGAEPQQLHVVFFPIMAHGHMIPTLDIARLFAARNVRATIITTPLNAHTFTKAIEMGKKNGSPTIHLELFKFPAQDVGLPEGCENLEQALGSSLIEKFFKGVGLLREQLEAYLEKTRPNCLVADMFFPWATDSAAKFNIPRLVFHGTSFFSLCALEVVRLYEPHKNVSSDEELFSLPLFPHDIKMMRLQLPEDVWKHEKAEGKTRLKLIKESELKSYGVIVNSFYELEPNYAEFFRKELGRRAWNIGPVSLCNRSTEDKAQRGKQTSIDEHECLKWLNSKKKNSVIYICFGSTAHQIAPQLYEIAMALEASGQEFIWVVRNNNNNDDDDDDSWLPRGFEQRVEGKGLIIRGWAPQVLILEHEAIGAFVTHCGWNSTLEGITAGVPMVTWPIFAEQFYNEKLVNQILKIGVPVGANKWSRETSIEDVIKKDAIEKALREIMVGDEAEERRSRAKKLKEMAWKAVEEGGSSYSDLSALIEELRGYHA

SEQ ID NO: 5307 - protein, 478 aa, Cucumis sativus
MENGEMEPHVLIFPFPAQGHVNSMLKLAELLTLSGLRITFLNILRIHQKLTLHTDIQSRFSRFPNFQFQTITDGLDNRLIDKFSDLIDSLKSITMPLLKQMLLSGEFGPTPTCIILDGLFNFIVDVDAHPNIPVFSFRTISACSFSAYSFVPKLIEDGQLPIKGEEDMDRIISGMGGMENVLRCRDLPSFCRLEDPFDPGLQHGVTQTIQSFKSRALIFNTFNDLEGPILSSLRSRCSNIYAIGPLHAHLKTRLSGEISPASSVSSNGLWEVDRSCLAWLDDHPPKSVIYVSFGSVVVIGDDQFREFWHGLVNSGKRFLWVMRPNSLAGKDGVPADLKEKTNERGYIVDWAPQEEVLAHKAIGAFLTHSGWNSTLESIVAGVPMICWPQFADQQTNSRYVSDVWKIGLDMKDVCNRETVTKMVNDVMENRKNELMGSVIEMAESAITSVEEGGSSYCDLERMINDIRLLCKRQRDTIG

SEQ ID NO: 5308 - protein, 445 aa, Crocus sativus
MIPMTNVARIFASRPNVKATIITVPSHVNHFKPALDICPYPIHLLTIKFQLPAHDKLVSSDLIPDRLFSDAYFEAIDSLEGPFGRLLDEHCPDCVVSSGNFPWSAALANARCIPRLVFYGSAAITSIVMRTISGLKLTEGRSDHEPFIVPGLPHPLEFTKAQIMSSASYPGDTLARMVKAHAQSYGTVGNSSYELEPGYASKLDKSYFIGPVALCTGDSTGEGGNRDSDEYLNWLDNQKKCSVLYVCFGSIAQFSNAQLFEIATGLEASGHPFLWVVRDTGNTAEWLPEGFVERVGRRGLLVRGWIAQMSVLNHTAIGGFMTHCGWGSVLEGVSAGLPMVTWPLFSDQFVNEKLIVDVLRIGVPVGSKVNSSREKERTFVAGEMVRKAVGEVLSEDGEEAEERRKRARKAAEMSRKAVEEGGSSYNDVSKLIHELREIKKSKATR

SEQ ID NO: 5309 - protein, 484 aa, Cephalotus follicularis
MGSESPQLHIFFFPFMAHGHMIPTIDMAKLFASQGVKATIITTPLNAPLFSKSIQRARDLGFDIHIRTLKFPAVEAGLPEGCENVDTITSNEPNKGLLTKFAVATSMLQEPLEHLLQECRPDCLVADMFFPWANDAAAKFGMPRLVFHGTGFFPLCVSECIKLYEPHKKASSDSEPFVVPGLPGDIKLTRKQLPDFVFEDIQDDRTRFFKQVKESDLKSYGIVVNSFYELEPAYADHFRQVLGRKAWHIGPVSLYNRGIEDKAERGKQASIDEHECLKWLDSKKPNSVVYVCFGSVANFNSAQLMEIAVGLEASGQQFIWVVRRDKADKGNEDWLPEGFEKRMEGKGLIIRGWAPQVLILDHEATGGFVTHCGWNSTLEAVSAGVPMVTWPVAAEQFYNEKFVTQVVKNGVAVGVQQWTRLVGDFVKSENVEKAVKEIMVGDKAEEIRSRAKAVAGMAKRAIENGGSSNSSLKALIEELKLCRH

SEQ ID NO: 5310 - protein, 469 aa, Vigna angularis
MANDKEKVLHIVMLPWLAFGHMIPNLELAKLIAGKGHRVSFVSTPRNIERLPKVSQNLATLIDFVKLPLPKVPNLPENAEATTDVPYDVVQYLKKAYDTLEEPFTHFLESSKADWLFYDFAPFWAASVASKLCIRKAFYSICTPPFLGFLGPPSVLMGHDSSYRQKPEDYIVAPPWVPFPTTVAFRYYEIMRIVDSLSSQNNSGVADTNRFGVSIQNCDIVFIRGCTEFESEWFHLLESIYQKPVLPVGQLPSTAPVGGEDNDTWRWMKGWLDKQARGSVVYVAFGSEAKPTQDEVTEIALGLEKSKLPFLWLLRVQRGPYDPDVLRLPEGFEERIKGRGVVCSSWAPQLKILEHVAVGGFLTHSGWTSVVEAVQNEKPLVLLTFLADQGINARVLEEKKMGYSVPRDERDGSFSSDSVADSLKLVVVEEKGKIYRERIKEMKDLFVNGERQDRYIDNLIHNLKSLSKC

SEQ ID NO: 5311 - protein, 498 aa, Brachypodium distachyon
MESLTSTGAAPARASPPRPRPHVVLVASPGAGHLIPMAELARRLAEQHGFAPTLVTFTTDLSSPEEAMSCLPDSLATRPTIALPPVQIDDLPHDTPIEILLFELVRRSVPNLRALLRSIDGPIAALVPDFFCSEALPLAAELGVPGFLFVPSNLAALALMRRLVDLHHGVDVAPGAEYHDMPENLELPGGVALRRADLPVSFQSSKEPVYARLLEEGRRYLSADGFLVNSFYEMEPATGEELRQAAERGAFPPVFAVGPFVRSRSNDDAASSACIIYWLDLQPTGSVVYVSFGSGGSLSVEQTAELAAGLEASGHRFLWVVRMPTLDGNEKSGRERSDDPLAWLPEGFLERTKGRGLAVAAWAPQVRVLSHPATAVFVSHCGWNSSLESVSSGVPMVALPPRAAEQRMNAVILEQSVGVALRPRVREDHQIDADGGVVARDEIAAVLKELMEGDKGRYVRRQAGDLQQAAALAWTPEGSSRRALEEVAAAWKSALGNK

SEQ ID NO: 5312 - protein, 477 aa, Helianthus annuus
MCKHYTFTTPIRSTQTFNMYHSTNNTHLLLYPCPGYGHVIPSLELAHHLLRRGLTITVIISAADLPLIDPLLSSYPCSLHRLLFSYPKVHPSPQPLIAKILSTQQLFDPIVKWFKSHPSPPVAIVSDFFLGWTSDLASHLGIKRVMFSTSGALGSSIFHALWRDMPDINKQNNDKDENFYISFPEIPNAPKFPWWHLPPASRCFKNGDQDFEAFRTTILANMRSWGIVYNTFEGLEGVYIDHIKKQMGHDRVWAIGPLLPDEHGPMNSARNGSSAVPPHDLLMWLDSKPVDSVVYICFGSRATLSEKQMCALLGALKLSNINFIFSVKASDSSSMILSGFEDDMVARQGFVVKGWAPQLAILKHRAVGSYLTHCGWNSILEGIAAGVMMLAWPMGADQFANATLLVDQLGAGKQVCEGGPELVPDVNELARLLDESLNGDLRERSKVKELSEGAMKAVKEGTSIRDLDLFVKLVSEL

SEQ ID NO: 5313 - protein, 491 aa, Vigna angularis
MSSENSKLNFVLFPLMSQGHMIPMMDIAKILAEQGVTVTVITTLQNASRFKSTFARSIDSGSQIKLLEIQFPYQEAGLPEGCENLDMLPSLGAGLDFFNAANSNTQKEQVEKLLEDLTPPPSCIVSDMCLHYTATIATRFNIPRISFLGQSCFSLFCMYSLGKSRVLSGITSNTEYFVLPGLPDKVEMTKAQLPAQQTDAEWRKFYARTGAAEGVSYGVVMNSFEELESDYASAYKKARKGRVWCIGPVSLSNRDELDKAERGNKASIDEHFCMKWLGLQKAGSVIYACLGSMCNITPQQLIELGLALEASNRPFIWVIREGSQLEEVEKWMKEEGFEERTKGRSLVIHGWAPQVLLLSHPAIGGFLTHCGWNSTLEAICAGVPMVTWPLFGDQFLNEKLIVQILKVGVKVGVEVPVEWGQEEETSILVKKEDVERAINELMDETMESEKIRERVKEFADMAKKAVEQGGSSHSNVTLLIQNIMQQSQRDA

SEQ ID NO: 5314 - protein, 472 aa, Unknown
  Description of Unknown: Oryza sativa Japonica Group sequence
MDDAHSSQSPLHVVIFPWLAFGHLLPCLDLAERLAARGHRVSFVSTPRNLARLPPVRPELAELVDLVALPLPRVDGLPDGAEATSDVPFDKFELHRKAFDGLAAPFSAFLDTACAGGKRPDWVLADLMHHWVALASQERGVPCAMILPCSAAVVASSAPPTESSADQREAIVRSMGTAAPSFEAKRATEEFATEGASGVSIMTRYSLTLQRSKLVAMRSCPELEPGAFTILTRFYGKPVVPFGLLPPRPDGARGVSKNGKHDAIMQWLDAQPAKSVVYVALGSEAPMSADLLRELAHGLDLAGTRFLWAMRKPAGVDADSVLPAGFLGRTGERGLVTTRWAPQVSILAHAAVCAFLTHCGWGSVVEGLQFGHPLIMLPILGDQGPNARILEGRKLGVAVPRNDEDGSFDRGGVAGAVRAVVVEEEGKTFFANARKLQEIVADREREERCIDEFVQHLTSWNELKNNSDGQYP

SEQ ID NO: 5315 - protein, 464 aa, Rosa chinensis
MKQSIVLYPASPGSHYLGSTVELGKIISQRHPNFSITVLVDTSSPRALANSSYINHLLSSDQTSISFFTLPSLNLPHPDAQPKLEYFLTVPNVVQALKTISLTSKVLAFITSAVQQYPNDPEIPTYYYFPSCASVLALCLYLPTFHDQTPESFKDLNDDVVEFPGLPALRGSQMPDPILDRNEAGYDHYLHMASCLPKAKGIIINTIQELEPRAIKAIKEGICVPNHRTPPLYHIGPFISDRDSENRSIQGGSPMPTNCSTLLWLDEQPSRSVVYLCFGSRGTFSEEQFKELALGLERSKLRFLWVVRSQLDLEVLLPEGFLERTKDRGLVVTSWAPQVAILSHESVGGFVTHCGWNSITEAVTYGVPMVSWPLYSEQEVNSVVLVEEMKLAIPIFEVLSKSKQGLVSADEVEKKVLRLMDMESEEGKSLRERCQAVKAMGLAAWRNGGSSFTSFSELVSSWMH

SEQ ID NO: 5316 - protein, 293 aa, Medicago truncatula
MKNFRIKDLPDFVRAKYPNDSMVEFILEASGRAHRPSAYILNTSNELEKDVMNALSTVFPCIHAIGPLSSFLNQSPENHLTSLSTNFWKEDTKCLYWLESKEPRSVVYVNFGSLTVMTAEKLLEFAWGLANSKQPFLWIIRPDLVIGGSAVLSSEFVNEISDRGLITSWCPQEQVLNHPSIGGFLTHCGWNSITESISAGVPMLCWPFFADHPVSCRYLCNTWKIGIEIDTNVKREEVEKLVNELMVGEKAKKMRQKAIELKKKVEEDTRPGGCSYMNLEKVIKEVLLKQNRT

SEQ ID NO: 5317 - protein, 532 aa, Drosophila virilis
MNLRWALHFMLLSLLALQEIHFTAGSRILAAFFLPGKSHFMMTNSIIRELVKRGHEVTFITPFSLAKENLGANYKEIVLPQYDMWTDIKQMSNREIILDMADVSSLKFLRMLQVMGVHSTDFAFEQPEIQALINAEHKVGQYDLLLAEQFYNEGALILGHLYQIPVITVSTFGNTNYFSELVGIITPWSYSPHGFMTFTNRMSLSERLLNVFICGTEHLMRRFLYYPAHDEVLRKHFAKLLDVVPTTKQLERNISAILMNNYMPLEAPRPISFNQISVGGLHILPPKPLPQHLQKFLDEATHGAIYFSLGTQVRSADLPPEKLKIFLDAFGSLKQRVLWKFEDDSFPNLPANVMIQKWMPQGDILAHPNVKVFIAHGGLFGLQEALHYGVPVLGMPVYCDQHFNIHQGKADGYALGLDYRTISTEQLRSSLLELLENPKYRETMKRASRIFRDRPLGAMDTAMFWIDYVIEHQGAPHMVSAGLDLTWYQFYLLDVIAIFVATVVAIIVLPIWILCRILRKSQKQPKRKAKIN

SEQ ID NO: 5318 - protein, 462 aa, Vigna angularis
MALNDQNIPRQTKVVVLMIPFPAQAHLNQLLHLSRQIVAENIPVHYVGTATHIRQATLRHQNSIPNIHFHAFEVPPFVSPPPNPNNQESDFPSHLIPSFEASTHLREPVGKLLQSLSSQAKRVIVIHDSLMASVAQDAINMPNVENYTFHIFSAFNNAVYLWQEKGRPHVGDIHFPEIPSDEGCITTQFKGFLSAQYEFLNFSHGHIYNTSRAIECPYVDFLDRLGGGKKVWALGPLNLLAIEKKDSTRFRHPCMEWLDKQERNSVIYVSFGTTTTLTEEQIQQIATGLEQSKQKFIWVLRDADKGNIFDENEAKRHYLPNGFEERLKGMGVVVRDWAPQLEILSHPSTGGFMSHCGWNSCTESFSMGVPIATWPMHSDQPRNAALVTEVLKVGLVVKDWSQRNALVTASDVENCVRRLMQTKEGEEMRERAMRLKNDIHRAMNEGGVSRMEMESFISHITH

SEQ ID NO: 5319 - protein, 486 aa, Oryza sativa
MASTDRSKKLRVLLIPFFATSHIGPFTDLAVRLVTARPDAVEPTIAVTPANVSVVRSALERHGSAATSVVSIATYPFPEVAGLPRGVENLSTAGADGWRIDVAATNEALTRPAQEALISGQSPDALITDAHFFWNAGLAEELGVPCVSFSVIGLFSGLAMRFVTAAAANDDSDSAELTLAGFPGAELRFPKSELPDFLIRQGNLDGIDPNKIPQGQRMCHGLAVNAFLGMEQPYRERFLRDGLAKRVYLVGPLSLPQPPAEANAGEASCIGWLDSKPSRSVLYVCFGTFAPVSEEQLEELALGLEASGEPFLWAVRADGWSPPAGWEERVGERGVLVRGWVPQTAILSHPATAAFLTHCGSSSLLEAVAAGVPLLTWPLVFDQFIEERLVTDVLRIGERVWDGPRSVRHEEAMVVPAAAVARAVARFLEPGGAGDAARLRAQELAAEAHAAVAEGGSSYRDLRRLVDDMVEARAAGGEAAAAPQPQ

SEQ ID NO: 5320 - protein, 475 aa, Sinningia cardinalis
MEDTIVLYPAPGIGHLLSTVELGKLILRHHHFSTIHVLITTGFDDSPHTATYIDQISKTNPSITFHRLPFLPLNLSPTVSSIATLFEFIRLNATSVLHTLQKILQTSKVRALILDFFCTSAFPISESLGIPVYYFFTSGLAAVAAYLYFPTIDKQVDQSFKDLVDTKFHIPGLPPLPSRHMPQPVLNRNDPAYHDVLYFSHHLARSSGIIVNTFDGLEPIALKAITDGLCIPDIPTPPIYNIGPLIADADTKPADQNLKHHSLSWLDRQPNQSVVFLCFGSRGSFSTDQLKEIAKGLERSGQRFLWAVKKPPFDKNSKEVEELGEFNVMEIMPEGFLDRTKDRGMVVESWVPQVKVLEHPAVGGFVTHCGWNSVLEAVMAGVPMVAWPLYAEQHLNKAALVEDMKMAIPMDPREDDEFMFAEEVEKRIREVMDGEKSKELREQCHKMKNMAIGAWERLGSSTVALDKVVHVWFGN

SEQ ID NO: 5321 - protein, 417 aa, Helianthus annuus
MANNTFAELVFIPAPAVGHIMSTIEMAKLLFNRDQTLSVTLLIINPPYSVLPLTTYIESLAKNAIERMRFIKLRQDQSPPKLNSSAPFVMSFYEFINSHCKYVRNILEDAIDQTCSRSRVVGLVVNILCTSMIDVSNEYNLPTYVYFTSNAAFLGFKLHFEMLFVDQKQDLIELANSEDEIVIPTFVNPVPMKLETHAINSFSGTNFPPVYPVGPILNLDGIGGKPDDTDVFRWLQSLPPSSVVLLCFGSMGGFDEAQAKEIARGLEQSGHLFIWSMRRLPPPEQSLKVLTDDFDDPRGVLPDGFLERTSGIGKVNGWAPQVSLLAHEAVGGFVSHCRWNWMLESLWFGVPTATLPMLWEQQMNAFEMVVELGLAVDLKLDYKINVLNSEGGVVIVTAEEIKRGIRRLMENKEVRKK

SEQ ID NO: 5322 - protein, 485 aa, Oryza sativa
MAKPTVVLLPVWGAGHFMPMIEAGKRLLRGSGGALSVTVLLMPAPTPEAAVDIAAQVKREEASGADDISFRHLPAVDMPTVHTGIEEWVSLILRSHGPHVRAAIAGLDCPVAALVTDIFCTPALDVAAELGVPSYVYFTSSAVMLELLLYSPVLDEEVPGEFSEMDGALNIPGLPPVPPSVLPATMLHKKKMSTYRWFLETGRCYMKATGFIVNTAAELEQSVIDAIADGRCTRGVPAPTVYAIGPVIALTPPPEQPHECVRWLDAQPPASVLLVCFGSKGLLPPPKVREIAAALERSEHRFLWVLRGPPKDSRPGQRVPTDAMLDELLPEGFLDKTKGRGLVWPTRAPQKDILAHAAVGGFVTHCGWNSILESLWFGVPMLPWPLDNEQHANAFLLVSVLGIAVPLRLDRERDNFVEAAELERAVSTLLGGGDGEAGRKAREKAVAVKAACRKAVEKGGSSDAAFQRLTEEIRRGAVNVPKKRN

SEQ ID NO: 5323 - protein, 483 aa, Jatropha curcas
MDSESNQLHIFLFPLLAPGHMLPMLDIARLFAARGVKTTIITTPVNAPRFTKSIQKIPDLATTQLINLKAINFPSEKAGLPEGLENLDLVSNQETHSRFFDALSLLQEPLEEAIKELHPQAIVADLFFPWTTDLALKYAIPRLIFHGTSFISMCCMASIAINQPHKKVSSDTEEFVLPGLPDPIKFTKTQIPDGFPEGPPNVVTNLLSYAREVEKRSYGMLVNSFYELEPAYADYYRNVLGKKAWHIGPVSLCNRNLEEKAQRGDVSGVSQHECIKWLDLKIPNSVIYVCFGTVTKFSQSQLQEIAIGLENSGQDFIWVVRKEKNEEEGEEKWLPDGYEKRIEGKGLIIRGFAPQVLILDHEAVGGFVTHCGWNSALEGISAGLPMVTWPIFADQFFNEKLITDILKIGVGVGARKWVRLVGDYIKSEKIEKAVKEIMVGEKAEEIRSRAKKIGEMARKAVEDVGSSYNDLSTLIQELKSFQS

SEQ ID NO: 5324 - protein, 449 aa, Zea mays
MFPLPFQGHINPMLQLGDALHARGLAVTVLHARLNAPDPARHPEFRFVPVPDGVPAHVAARGNVIDIIEAMNAAMEADGSGPVRAVLESVVADVEQPPAACIVFDANLLAVPRAASAVGLRTLVLRTASAACLGCFMAYPMLHQKGYLPPQESDLYMPVKELPPLRVRDLFYSSWSDHKKMRDLLARANEAMENSSGVVINTLDALEKPELERIREQLHVPIVLAPGPLHKLCSSKSTSSHSTLDHQDHSCIRWLDKQPSGSVLYVSFGSLASLDSDEFSEVAWGLANSGHPFLWVVRADSVRGSVDGPAGLPDGFEAAVHGRGKVIRWAPQQEVLAHHAVGGFWTHSGWNSTLESVSEGVPMMCRPQFADQMMNARYVVDTWGVGLELEGELQRGGVEMAIRKLMKGREGEEMRGRAKELKKIVADCLEARGTSQVATDNLVNYILSL

SEQ ID NO: 5325 - protein, 381 aa, Cephalotus follicularis
MLHSLSSLRDLLKSMIASTRLVALVVDFFGTDAFDVANGVNLPSYLFFPSPAMILSFCFYLPKLDEMVSCQYRDLREPIQIPGCVAIPGKDLVEAVEDRKSDTYKWFLLICKMYSLAKGIVVNSFMDLEPGAIKALQEEPGCPSIYPVGPLVRTGSSGTVGDGSHCIIWLDDQLRGSVLFVSFGSGGTVSRYQLIELALGLEKSGQRFLWVVKSPDDESAKAVFFGVSSLNDLLNYLPDGFLERTKGRGLVVPSWAPQAQILSHDSTGGFLTHCGWNSTLESIVNGVPLIAWPLFAEQKMNAVMLTEDIKVALSPKFDENGLVVREEIAKVVNILMEGEEGKQIGIRMQHLKEAAVKALKHEGSSAKALSELALNWKNLTV

SEQ ID NO: 5326 - protein, 498 aa, Ricinus communis
MVSGAEQIHVMFLPYLAPGHMMPMIDIARLFASNGIKVTIITTTKNAIRFKSSIDRDIQAGRNISLEILRFPSAEAGLPEGCENLASTPTPEMSIKLFHGIGLLEPEIKTIFLKHSPDCIVSDYLFPWTVDVAVELGIPRLAFSGSGFFNLCVANSIECNRPHDSITSETESFVVPGLPDLVNLTRSQLPDIVKSRTDFSDLFDTLKEAERKSFGVLMNSFYELEPAYADHFTKVIGIKAWHLGPVSLFADDKVARGDKTSVCEHTCLRWLDSKKPNSVIYVCFGSLTRFNKEQIVEIASALEDSSRSFIWVVGKVLKSYNDNEKDEDNQQEQWWLPEGYEERLKESGKGLVIKGWAPQVMILEHPAIGGFLTHCGWNSILEGLCAGVPMVTWPIFAEQFYNEKLVTQVVKFGVPVGNEIWKIWATQESPLMSRKNIENAVRRVVGDGGEAMEMRKRARRLAECAKKAVEEGGSSYNDLKSLIDDIRMYKHATTEKKI

SEQ ID NO: 5327 - protein, 482 aa, Ricinus communis
MGSIVRDHDKPHVVCVPYPAQGHVNPMVKLAKLLHYNDFHVTFVNTEYNHRRLLNSRGPSSLDGLPDFRFEAISDGLPPSDANATQDIPSLCDSTSKNSLAPFRNLLLKLKSSDSLPPVTCIISDACMSFTLDAAEEFGIPEILFWTPSSCGVLGYSQYHTLIEKGLTPLKDASYLTNGYLETTLDWIPGMKDIRFRDLPSFIRTTDRNDIMLNFVVRELERTSRASAVVFNTFYAFEKDVLDVLSTMFPPIYSIGPLQLLVDQIPIDRNLGNIGSNLWKEQPECIDWLDTKEPNSVVYVNFGSITVITPQQMIEFAWGLASSKKPFLWIIRPDLVIGENAMLPAEFVSETKDRGMLASWGPQEQILKHPAVGGFLSHMGWNSTLDSMSGGVPMVCWPFFAEQQTNCRFACTEWGVGMEIDNNVKRDEVKKLVEVLMDGKKGKEMKSKAMEWKTKAEEAAKPGGSSHNNLDRLVKFIKGQKN

SEQ ID NO: 5328 - protein, 463 aa, Vitis vinifera
MQPQILLVTYPAQGHINPSLQLAKLLIRAGAHVTFVTSSSAGTRMSKSPTLDGLEFVTFSDGYDHGFDHGDGLQNFMSELERLGSPALTKLIMARANEGRPFTCLLYGMLIPWVAEVARSLHLPSALVWSQPAAVFDIYYYYFNGYGELIGNKGNGSSSSIELPGLPLISSSDLPSFLVPSKVSAHNFVLKLHQKQLEQLNRESNPRVLVNSFDALESEALRAINKFKLMGIGPLLPSAFLDGKDPSDTSFGGDLFRGSKDYIQWLNSNAESSVIYVSFGSLSVLSKQQSEEIARGLLDSGRPFLWVIRAKENEEEEKEDKLSCVEELEQLGMIVPWCSQVEVLSHPSLGCFVSHCGWNSTLESLASGVPVVAFPQWTDQTTNAKLIEDVWKTGLRVMVNQEGIVEGGEIKKCLELVMGGGERGQEVRSNAKKWKDLAREAVKDGGSSDKNLKNFVDEIIQGH

SEQ ID NO: 5329 - protein, 339 aa, Citrus unshiu
MSNTQEDDSFACLITDSAWHFAHAVANDFKLRTLVLQSCSISAHLAFAAYPIVREKGYLPIQDSQLEAPVIELPPLRVKDIPSFKSKDPEDLHKLLLAIDSQLQASSGMIWNSFQDLEKVQLTTIHKQYYNSISGFVVGPFHKYFPASSSSLRSQDQSSISWLEKQAPKSVIYVSFGSVAAISETEFLEIAWGLANSMVPFLWVIRPGLVRGAEWLEPLPKGGLAHPAVGGFWTHSGWNSTLESICEGVPMICQPFLSDQMVNARYVSHVWRIGLHLEGKLQRKEIERAIRRVMVEATEGHEMRERILQLKEKVDVCLKKGGSSYQSRQRLVDHILSFT

SEQ ID NO: 5330 - protein, 467 aa, Oryza sativa
GMGSMSTPAASANGGQVLLLPFPAAQGHTNPMLQFGRRLAYHGLRPTLVTTRYVLSTTPPPGDPFRVAAISDGFDDASGMAALPDPGEYLRTLEAHGARTLAELLLSEARAGRPARVLVYDPAAPWARRVARAAGVATAAFLSQPCAVDLIYGEVCARRLALPVTPTDARGLYARGVLGVELGPDDVPPFVAAPELTPAFCEQSIEQFAGLEDDDDVLVNSFSDLEPKEAAYMESTWRAKTIGPSLPSFYLDDGRLRSNTAYGFNLFRSTVPCMEWLDKQPPRSVVLVSYGTVSTFDVAKLEELGNGLCNSGKPFLWVVRSNEEHKLSVQLRKKCEKRGLIVPFCPQLEVLAHKATGCFLSHCGWNSTLEAIVNGVPLVAMPHWADQPTISKYVESLWGMGVRVQLDKSGILQREEVERCIREVMDGDRKEDYRRNATRLMKKAKESMQEGGSSDKNIAEFAAKYSN

SEQ ID NO: 5331 - protein, 283 aa, Medicago truncatula
MEKEKVYALPELLFGDFNGDLRKTSSCCFSALKPKINRCFPLVCLERCSKKVVSVVADYFAAETLSVAKEFNILSYIYYPGNALSISLFFHLPYLDKTTSCEFKDLKEAIKMPGCRPIHGCDFPSTVQNRSSIVYKSFIYVCKMLHFADGIILNAFTNLEADTIKAVQKKEAKLPSIYLIGPIIQTDSSIKVRESEFFMGWLDNQPCNSVLYVSFGSGGTLNQEQIFELALGLELSGVKFLWVVRAPNKSPNGAYLKEMMKNKDVDPRGRNHASPYFKSNQCG

SEQ ID NO: 5332 - protein, 458 aa, Medicago truncatula
MGSLPPLHIAMFPWFAMGHFTPYLHLSNKLAKKGHKISFFIPKKTQTKLQHLNLNPNLITFYPLNVPHIDGLPDGAETSSDVPFSLVPLIATAMDQTEKQIEHLLKELNPQIVFFDFQYWLPNLTQKLGIKSLQYWITSPFSISYFWNGPRHSQGKGLTVDDLKKPPSGYPDGSIKLYQHELQFLSSTRKLVFGSGVFLYDRLHIGTSLADAIGFKGCKELDEPYAEFLGNFYGKPYLLSGPLLPETPKTTLDEKWESWLKGFKPGSVVFCAYGSEGPLEKNQFQELLLGLELTGFPFLAALKPPNGFESIEEALPEGFNERVKGKGIVYGSWIQQQLILEHPSVGCFITHCGAASITEALVNTCQLVLLPRVGVDHIMNARMMSEKMKVGVEVEKGDEDGLFTKESVCEAVKIVMDDENKVGREVRKNHSELRKFLLSENLESSCVDNFCEKLQGLI

SEQ ID NO: 5333 - protein, 425 aa, Medicago truncatula
MDSIINHKNENENSKPLHVAMLPWLAMGHIYPYFELAKILAQKGHTVTLITSPKNIDQIPKTPKAIQPFINLVKLPLPHIEQLEGAESTQNVPLNKTGYLKLAYDGLQVDVTEILKTSKSDWVFYDCVADWLPSIAKSLNIPCAHYSIVPAWNICFFNPPKDQINIDRSSLSASDEMIRVRLQRKRTEQRKERQRHKQLSCWIASTIHADKRRRKEENNLDWMKIKAWLDSKESSSVVYIGFGSETKISQQDLIELAHGIELSRLPFFWALKNLKEGTLELPKEFEERTKERGIVWKTWAPQLKILAHGSIGGCMSHCGSGSVIEKLHFGHALVTLPYLIDQCLFSRVLEEKKVAIEVPRSEKDGSFTRDSVAKTLRLVIMDEEGSTYRNNAKDMGKVFSSKDLHNQYIEDFIVALQKYRVHSND

SEQ ID NO: 5334 - protein, 465 aa, Medicago truncatula
MENKTCIAMVPSPGLSHLIPQVEFAKLLLQHHNEYHITFLIPTLGPLTPSMQSILNTLPPNMNFTVLPQVNIEDLPHNLEPSTQMKLIVKHSIPFLHEEVKSLLSKTNLVALVCSMFSTDAHDVAKHFNLLSYLFFSSGAVLFSFFLTLPNLDDAASTQFLGSSYEMVNVPGFSIPFHVKELPDPFNCERSSDTYKSILDVCQKSSLFDGVIINTFSNLELEAVRVLQDREKPSVFPVGPIIRNESNNEANMSVCLRWLENQPPSSVIFVSFGSGGTLSQDQLNELAFGLELSGHKFLWVVRAPSKHSSSAYFNGQNNEPLEYLPNGFVERTKEKGLVVTSWAPQVEILGHGSIGGFLSHCGWSSTLESVVNGVPLIAWPLFAEQRMNAKLLTDVLKVAVRPKVDGETGIIKREEVSKALKRIMEGDESFEIRKKIKELSVSAATVLSEHGSSRKALSTLALKWQ

SEQ ID NO: 5335 - protein, 616 aa, Mucuna pruriens
MKKAGRLVFIPSPGEGHLLPTIEFAKLVINRDDRLWISVLVMKSPYDTASVAYTQSLASEHLQVINLPECTSNTVQNSMTTLIEQQKPHVKEAVSNLPSSPPLAAFVVDMFCTAMIDVAKDFEVPSFVFFTSGLTFLGLVLHLHSLREQDNVHFRDSDTELAIPCFANPIPSTALPALVLEKEWDSLFLAYGRGLKKANGIIVNSFQELESHAVQSFSHGALPIYPVGPLINPKPKAHADDILNWLDHQPPSSVVFLCFGSMGSFGEDQVREIAIALENNGSRFLWSLRKPPPNSSYFRTLPTDYSISDLVALLPPGFLDRTAGIGKVIGWAPQAQILAHPATGSFVSHCGWNSTLESIYFGVPIATWPLYAEQQSNAYLLVRELKMAVEIVLDYRLNFKVGPNSLLSADKIEKGIRSLLDMDQDMRKRVHEMSQMSRETSLEGGSSYSNLGRLCRLTSVACGAALLNACAIPPDLYVDKSNDTWSVGRSTTPQASIVHLGWSLDSRPVGRSTTPHAQGHTDDPSIVMIDKNNRGLPYCSRIHNNMKLSLNGASVPTISDCTCNNFNNFQSKSTTVAMSPLDLNPIKTSLDGMRLGNIVVRPLSCQRWQNNSEVMD

SEQ ID NO: 5336 - protein, 480 aa, Morus notabilis
MDQPQTQTRQHVAILPSPGMGHVIPMVEFAKRFVRNHNFTVTFLVPTSGSPSTAMRSVFNGLPDSIEHVFLPPVNFDDLPEGSKLETRIALTVVRSLASLRDALASLFSRRVGVVALVVDHFGLDAFDVAREFNLPSYLFYPSPAMVLSLILHLPELDESTSSEYWELTDPVKIPGCFPIPGKDLLDPIQDRKSDVYKLTLHKAKQYRLVDGIIVNTFNDLEPRAISSLQEREATEKLPRVYPVGPLAKIQRTNLTEEESQCLIWLDGQPRVSVLFISFGSGGTLSSDQTNELALGLENSEQRFLWVVRPPNDRAASAAYFKVNSQNESSFDFLPDGFLGRTRDRGLVVHSWAPQAQILSHSSIGGFLTHCGWNSILESMVNGVPMIVWPLFAEQRMNAFMLTEDIKVALRPKASENGVVEREEIARVIKALMEGGEDREKLRKRIEELKEAGSTALTEDGNSTKALADVADVWKSQIRN

SEQ ID NO: 5337 - protein, 480 aa, Glycine max
MSSSEGVVHVAFLPSAGMGHLNPFLRLAATFIRYGCKVTLITPKPTVSLAESNLISRFCSSFPHQVTQLDLNLVSVDPTTVDTIDPFFLQFETIRRSLHLLPPILSLLSTPLSAFIYDITLITPLLSVIEKLSCPSYLYFTSSARMFSFFARVSVLSASNPGQTPSSFIGDDGVKIPGFTSPIPRSSVPPAILQASSNLFQRIMLEDSANVTKLNNGVFINSFEELEGEALAALNGGKVLEGLPPVYGVGPLMACEYEKGDEEGQKGCMSSIVKWLDEQSKGSVVYVSLGNRTETRREQIKDMALGLIECGYGFLWVVKLKRVDKEDEEGLEEVLGSELSSKVKEKGVVVKEFVDQVEILGHPSVGGFLSHGGWNSVTETVWKGVPCLSWPQHSDQKMSAEVIRMSGMGIWPEEWGWGTQDVVKGDEIAKRIKEMMSNESLRVKAGELKEAALKAAGVGGSCEVTIKRQIEEWKRNAQAN

SEQ ID NO: 5338 - protein, 477 aa, Erythranthe guttata
MADSTTTAHIVIIPTPGMGHLIPLIQFSKKLLHHHPYFSATFLIPNHGPPPSAAQITLLSTLPSAVDYLLLPAVTFDDLPPSDDVKIETIISLTAVRSLPSIRAAVKTLIDGGKKIAAFVVDLFGTDVFEVASEFNIPPYIFYPSTAMALSLFLHLPKLDETVSSEYREVAEKLLIPGCIPVHGKELLDPVQDRKNDAYKWLLHHCKRYRMAEGIIVNSFRELEPGPIQALQEKESGNPVIYPIGPLIQTGSRKPEEDNSECLRWLDEQPSNSVLYVSFGSGGTLSHAQLIELALGLEMSGHKFLWVVRCPNDKSLNATYFDIRNSDDPLAYLPEGFLDRIGARGMVQPLWAPQAQILAHKSTGAFMSHCGWNSALESVVNGVPLIAWPLYAEQRMNAVMLHEDVKIALRPEVGESGLVERVEIAKVVKCLMEGEEGDGVRNRVRGLKNDAEKVLSENGSSTISLGELANKWKSTIV

SEQ ID NO: 5339 - protein, 380 aa, Arabidopsis thaliana
MREMKSTVRDAVKSMKQKPTVMIVDFFGTALLSITDVGVTSKYVYIPSHAWFLALIVYLPVLDKVMEGEYVDIKEPMKIPGCKPVGPKELLDTMLDRSDQQYRDCVQIGLEIPMSDGVLVNTWGELQGKTLAALREDIDLNRVIKVPVYPIGPIVRTNVLIEKPNSTFEWLDKQEERSVVYVCLGSGGTLSFEQTMELAWGLELSCQSFLWVLRKPPSYLGASSKDDDQVSDGLPEGFLDRTRGVGLVVTQWAPQVEILSHRSIGGFLSHCGWSSVLESLTKGVPIIAWPLYAEQWMNATLLTEEIGMAIRTSELPSKKVISREEVASLVKKIVAEEDKEGRKIKTKAEEVRVSSERAWTHGGSSHSSLFEWAKRCGLVS

SEQ ID NO: 5340 - protein, 455 aa, Jatropha curcas
MKNPHVLVASFPAQGHINPSLQFAQRLATMGLKVTFATTIGADRRMAKTGIPDNLSFAALSDGNDDGFKPIVNIGNYMTHDLRLHGSQTLRRLIQQASNDGHPFTFVVYSILIPWVAKVAREFHLPSALLWSQPATVFSIYYHYFNGYGEIIEKTINSATLLLNLPNLPVLSVYDLPSFFSPAKSNEYAFVLPVVKEHLEILDEEIKHNPKSAILVNTFDALEVEVLKSIDKYKLVGVGPLLRSGSFGGSLFQESNGYIEWLNSKPQRSVIYISFGSISVMSEQQIEEMAIALEKIGSPFLWVIRENAIVKEKLNKGGLTVPWCNQVEVLSNPAIGCFITHCGWNSTFESLTCGVPMVGFPQWTDQMTNAKLVQDLWKVGVRVVVNEEGIVEAKEIRRCLELVMGDGDGGKEMRKSAKKWKDLAREAINEGGSTDKNVKAFVDVITSVDEVEEGC

SEQ ID NO: 5341 - protein, 478 aa, Striga asiatica
MASDAASRRSPPHNTVAILMVPFPLQGHLNQLLHLSRLISARGLPVHFAAAPSHSRQARLRATTTAHDHHDSTITFHEIPSLPYSSPPPDPNSTTRFPTHLQPLIEATSSLREPVAEILRDLCAANRRVVVVHDSMMGFVVQDFVRYQNAEAYTFHSVSAYAIFLFLWESAGRPFDLPADLLQEKDIPSLDGCFSPEFGSFVQTQHEFIKLNSGRVYNTCRAVEGPFMELIERAEISGGKQQWALGPFNPIGNSERTGVISPGSRHACLKWLDGLESGSVVLVSFGTTTTFPRKQIHELAIGLENSGQKFVWVLRDADVGDGVITKHDDDIIALPEGFEGRVEGRGLVVREWTPQVEILGHEAVGGFVSHCGWNSCMESISMGVAMGAWPMHSDQPRNAVLVTKVLGVGITVREWARRDEIVGAREVEQGVRRLMGPGEGAEVRRRAAELGRAVREAAAEDGGPMRLEWDSFISHIIR

SEQ ID NO: 5342 - protein, 339 aa, Medicago truncatula
MLSYVYFPSSVTSLSSYFYLLKLNKETSCQYKDLLEPIQIPGCVPIHGQDLVDQAQDRSSQSYKFLLERVEKFRLFDGILINSFLEIEKGPIEALTEDRSGNPDVYAVGPIIQTPTKSGDDDNGLKCLAWLDKQQTCSVLYVSFGSGGTLSQEQINELALGLELSNHKFLWVVRSPSNTANAAYLSASDVDPLQFLPSGFLERKKEQGMVIPSWAPQIQILRHSSVGGFLTHCGWNSTLESVLHGVPLITWPLFAEQRTNAVLLSEGLKVGLRPKINQNGIVEKVQIAELIKCLMEGEEGGKLRKNMKELKESANSAHKDDGSFTKTLSQLALKWRNLV

SEQ ID NO: 5343 - protein, 421 aa, Linum usitatissimum
MIPMVDIAKLLATRGAKVTIVTTPVNAARFKSPIRRSNLRIDLVELRFPGVEAGLPEGCENVDLLPSFAYIQSMMKAAAMMEPQEEIARMVGSDQEYFVLPGMPGEIKFSNAQLPLQIWKNGHQDPEEESRRLHVMKVDSEAYGVIVNSFEELEPEYFSEYKNSRQGKIWCVGPVSLTNLDELDKIQRGNYNISLTHESLEWLNTKESKSVLYICLGSICNLSSQQLIELALGLEASETPFVWAIREKGFTKDLFTWITNDGFENRVAGRGLLIKGWAPQLSILSHSSVGGFLTHCGWNSSLEGISAGIPLVTWPLFGDQFSNEKLIVDVLKIGVRIGAEKPTFRSGKEETTEVSVRREDVERAVRLAMEGGKDGDRRRKRTGELAGMAWKAVERGGSSYKNVDLLIQDIAKHQEERRNHG

SEQ ID NO: 5344 - protein, 491 aa, Medicago truncatula
MEGVEVERPLKIHFIPYLASGHMIPLCDIATMFASRGQQVTIITTPSNAQSLTKSLSSAASFFLRFHTVDFPSQQVDLPEGIESMSSTTDSMTSWKIHRGAMLLHGSIEDFMEKDPPDCIISDSAYPWANDLAHKLQIPNLTFNGLSLFTVSLVESLQANNLLHSDTNSDLDSSSFVVPNFPHRITLCGKPPKVISKFLKMMLGTVLKSKALIINNFTELDGEECIQHYEKTTGHKVWHLGPTSLIRKTIQEKAERGKEGDVNMHECMSWLDSEKVNSVLYICFGSINYFSDKQLYEMACAIEASSHPFIWVVPEKKGKEDESEEEKEKWLPKGFEERNIRRMGLIIKGWAPQVKILSHPAVGGFMTHCGGNSIVESVSAGVPMITWPVHGDQFYNEKLVTQFRGIGVEVGATEWCKNGVAEREKLVSRDNIEKAVRRLMENGDEAKNMRLLAQEFGEKATQAIQEGGSSYNNLLALIEELKRLRDPKRHD

SEQ ID NO: 5345 - protein, 470 aa, Medicago truncatula
MVVSEMEKKAELIFIPSPDIGHLVSSLEFAKLLINTHNNIFITVLCIKFPHTPFSDSYIKSVLNLQPQIKLIDLPQVESPPKELLISPPCYIKALMHTLTPHVKSTIQTILSSHSNHVVGLVLDLFCLSMIDVGNELGIPSYLFLTSNVGFLGFMLSLQNRRVDDVFNDYDPELLIPGFTNLVPSSVLPNAAYSKDGGYEAYYNLARRINDTKGIIVNTFSDLEQYSIDALYDHDEKIPPIYAVGPLLDLKGQPNPKLDQSQLDLILRWLDKQPNKSVVFLCFGSMGVSFGPSQIREIALGLKHSGVRFLWAMKSPPRTNNYEEKRLPEGFLEWMELEGKGMICGWAPQVEVLAHKAIGGFVSHCGWNSILESMWFGVPILTWPIYAEQQLNAFRMVKELGLAVELRVDYRIGSKEIVMAEEIEKGLKNLMEKENILLKKVQEMARNAVLCGGSSFISVGKLINIMIGSN

SEQ ID NO: 5346 - protein, 479 aa, Barbarea vulgaris
MGKKEAEAEIIFVTYPIPGHLLVSIEFAKSLIKRDNRIHTITFLHWTVPLSPQSNHFARSLIASEPRIRLVTLPDVQNPPPLELFFQAAEAYILDFNKKIVPLVRDALSTLVSSPDGSDSVRVAGLVLDFFCVPLIQVADELNLPSYIFSTCNAGFVSMMKYLPERHRRLASKLDLSSGDVEHPIPGYVCSVPTKVLPPGQFVKESYEAWVEIAEKFPSVKGILVNSIECLEKNAFDYFARRPENFPPVYPVGPVLSLVDRPSPDLDPSDRNRIMRWLDDQPESSVVYICFGSFGIHGEPQIEEIARALDLAGHRFLWSIRTNPTEKASPYDLLPEGFIDRTACKGLVCDWAPQVEVLAHKATGGFVSHCGWNSVLESLWFGVPIATWPMYAEQQLNAFTMVKELGLAVELRLDYVSAYGKIVKAEEIAGAIRSLMDGKDTLRKNVKEMGEAARKALIDGGSSFVAVKRFLDELIGGGV

SEQ ID NO: 5347 - protein, 490 aa, Citrus unshiu
MGSEIPQLHVFFFPFMAHGHMIPLVDMAKLFATRGVKASVITTPANAPYVSKSVERANELGIEMDVKTIKFPSVEAGLPEGCENLDAITNEVNKGLIVKFFGATMKLQEPLEQLLQEHKPDCLVADTFFPWATDAAAKFGIPRLVFHGTSFFSLCASNCLALYEPHKKVSSDSEPFVMPHFPGEIKLTRNQLPDFVKQDMGDNDFSRLLKAIDDSDLRSYGVAVNSFYELEPAYADHYRKALGRRAWHIGPVSLCNRNFEDKALRGKQASIDELECLKWLNSKQPYSVVYVCFGSLANFTSAQLMEIATGLEASGRNFIWVVSKNKNDGGEGGNEDWLPEGFEKRMEGKGLIIRGWAPQVLILDHEAVGGFVTHCGWNSTLEAVAAGVPLVTWPVAAEQFYNEKMVNEILKIGVGVGIQKWCRIVGDFVKRETIEKAVNEIMVGDRAEEMRSRAKALGKMAKRAVENGGSSYSDLSALIEELRLSRHQSS

SEQ ID NO: 5348 - protein, 536 aa, Stomoxys calcitrans
MIIFKILLILGISWQIAITDGANILGIFTSHSPSHLIVHLSVANVLAERGHNITVVASSQPKIAIHKNITMIVVPLTKEQEVIMHRSMEKMASNNDGFLTLIRNFFGSLKIFIDAQADILKDPRFTKLYESEDTKYDLVMCGFFMNTFQLGVAAKFKAPLIVTWTSAAMSMVGRMVGNPSGVEYVPSHTVNMDKGQVKMNFLQRLKNFLSYTVFDILTFIMDIRMKQIYNDIFQDEDDSFPTLDEMYKNVSLVFCNSHFSEASIKAQVPAVVEIGGIQVKEKPNRLPENLETFIENSSEHGFILFSLGTNVKGSHVKSEIAKRIFNVLSKLKQNIIWKWDDLKHTPGNSSNILYTKWLPQDDILAHPYLKLFITHAGKGGIAEAQYHGVPMLAIPIFGDQHPNALHMVQAGYGLMVNYFTLSEEVLSSSLQEVLHNPIYRENVQRFSRLYRDRPLSARENVAYWTEYVMRHRGATHMQSPLVHMNFIESSNLDVYVVILLILYIMIVICRCGFLFVKRKVCDKKCKKNSKIKNKMN

SEQ ID NO: 5349 - protein, 336 aa, Unknown
  Description of Unknown: Oryza sativa Japonica Group sequence
MPASHLMPELLEDPESETYRATVSMLRATLDADGILVNTFASLEPRAVGALGDPLFLPATGGGEPRRRVPPVYCVGPLVVGHDDDDERKENTRHECLAWLDEQPDRSVVFLCFGGTGAVTHSAEQMREIAAGLENSGHRFMWVVRAPRGGGDDLDALLPDGFLERTRTSGHGLVVERWAPQADVLRHRSTGAFVTHCGWNSASEGITARVPMLCWPLYAEQRMNKVFMVEEMGVGVEVAGWHWQRGELVMAEEIEGKIRLVMESEEGERLRSSVAAHGEAAAVAWRKDGGAGAGSSRAALRRFLSDVGGRELRSVETLLLWAFHEIVVARIGLPLD

SEQ ID NO: 5350 - protein, 473 aa, Vigna angularis
MGHDRQLHVFFFPFFANGHIIPTIELARVFASRGLKTTVVTTPLNEPFISRTVGKANITIKTIKFPSPEQTGLPEGCENSDRLSGMQIIPFLKSTVLLRDPLEQLLQQELPDLIIADMFFPWATDSAAKFGIPRIVFHGLGFFPLCVSACVRKYKPQDKVSSYSEPFVVPNLPGEIMLTKMQLPQTPKHDLEFTKILEEANASELNSYGVIANSFYELEPVYADHYRNELGRKAWHLGPVCLSNRDNAEKVHRGNEATIDEHECLKWLDTKEPDSVVYVCFGSMTTFPNAQLKEIALGLEASGQPFIWVVKKGSSENLEWLPEGFEERTVDQGKGLIIRGWAPQVMILDHIAVGGFVTHCGWNSAMEGVCAGLPMVTWPMYAEQFYNAKFLTDIVKIGVSVGVQTWIGLMGGKPVKKEVIEKALKRIMVGDEAEEIRNRAKDIAKMAKRAVEEGGSSYSDFNSLIEDLRSRTL

SEQ ID NO: 5351 - protein, 472 aa, Sesamum indicum
MASHHVLLVTFPVQGHINPALQFAKKLINMGIEVTFATTVLARQRMEKAAASSLPKGLTFAAFSDGLDDGFKASNDPQKYMREIRRRGTKSLKDTVLSAAEQGRPITCLIYTLLLPWASEVAREVHIPSALLWIQAATVLDIYYYYFNGFGDEIIASSNDPSWKLQLHGIPILLSQCDLPSFMLPTSSDNYSFALTVFKEQLETLDAETKPKVLVNTYDSLEPDALKAIDRYELIGIGPLIPSAFLDGKDASDTSFGGDLFQKSDDCIGWLNSMPKSSVIYVAFGSILSLPRAQMEEIAKGLLDSSRPFLWVIRVNEKANEEKKEEDEKLSCIEELEKAGRIVPWCSQLEVLTHPSLGCFMTHCGWNSSLESISCGVPMVAFPHWTDQCTNAKLIEDVWRTGVRVRRNEDGVAESSEIRRCIEEVMDGGEKSRELRENVEKWKGLAREAVEENGSSNKNLKAFLEGVGAAGC

SEQ ID NO: 5352 - protein, 472 aa, Citrus unshiu
MSDSGGFDSHPHVALIPSAGMGHLTPFLRLAASLVQHHCRVTLITTYPTVSLAETQHVSHFLSAYPQVTEKRFHLLPFDPNSANATDPFLLRWEAIRRSAHLLAPLLSPPLSALITDVTLISAVLPVTINLHLPNYVLFTASAKMFSLTASFPAIVASKSTSSGSVEFDDDFIEIPGLPPIPLSSVPPAVMDSKSLFATSFLENGNSFVKSNGVLINSFDALEADTLVALNGRRVVAGLPPVYAVGPLLPCEFEKRDDPSTSLILKWLDDQPEGSVVYVSFGSRLALSMEQTKELGDGLLSSGCRFLWVVKGKIVDKEDEESLKNVLGHELTEKIKDQGLVVKNWVDQDKVLSHRAVGGFVSHGGWNSLVEAARHGVPLLVWPHFGDQKINAEAVERAGLGMWVRSWGWGTELRAKGDEIGLKIKDLMANDFLREQAKRIEEEARKAIGVGGSSERTFKELIDKWKCNNNTH

SEQ ID NO: 5353 - protein, 469 aa, Unknown
  Description of Unknown: Oryza sativa Japonica Group sequence
MSPTPRPHFLVLTFPLQGHIAPALRLARRLLAAAPDALVTFSTAAAAHRRMFAEGEGGDGDGRLELLPFSDGTENGFVKRGDAAELGAYMASFHASGRRSVGEMVDALAARGRPVSSVVYTLLLPWAADVARDRGVPSALYWIQPVAVLAIYCHYFHGLGGVVDEHRRDHSFVLEFPGLPPMAAGDLPSFLTEATDPSDYFHSIFTTFRDLFDALDRETPKATVLVNVFQELEADTLAAVGAYDVLPIGPVLPSGDDAALFKQNDAKYMEWLDTKPAGSVVYVAFGSLTVMAKGQVDELLHGLEESGRPYLCVVRKDNKAAVAETGDATAAAAARRNGVVVEWCDQVRVLSHAAVGCFVTHCGWNSVLESIASGVPMVGVPRMSDQQMNARLVERDWRVGVRAEVDGGDGVLRAAELRRRVEEVMGDGEAAEVRRSAAAWKRAVAEALGKGGSSDRNLTAFVEGARSVI

SEQ ID NO: 5354 - protein, 316 aa, Citrus unshiu
MIAHGTIANGYLNTVIDWIPGMKGIRLSDIPSFVRTTNPDDIVLNFILAETERSKRASAIILNTYHELEQEALDALTSLLLPPVYSIGHLQFQLNQIPENDSIMRIGSNLWKEETECIDWLDTKEPNSVVYVNFGSITVMTANQLIEFAWGLANSKQTFMWVIRPDLVVGDSAILPPEFVTETKERSLLASWCPQEQVLNHPAIGGFLTHSGWNSTLESICGGVPLICWPFFAEQQTNCRYSCREWGIGMEIDSNVKREEVEVLVRDLMVGEKGQEMKLEALELKKKAIEAATGPAGSSYVNLEKLITHVLLSPTN

SEQ ID NO: 5355 - protein, 445 aa, Helianthus annuus
MANNTFAELVFIPAPAVGHVMSTIEMAKVLLNRDQTLSVTLLIIYPPYSYIESLAKNVIERIRFIKLPQDQPPSKLVSKAPFMSFYEFINSHCKYVRNILEDAINQIGSRRVVGLVVDILSMFSKPDRTSNRSSYRFSGPTGQTGHVYFTSNAAFLGFKLHFETLFVDQKQDLIELANSESEIVIPSFVNPVPMKVFPEVYQKQDGLDFLICAIGRIRKAKGILINTFLELETHVINWFSRINFPPVYLVGPILNLAGVSTAVFSARCLEQSGHRFVWSLRRLPPPEQSFQVFPDDFDDPRGVLPDGFLERTLGIGKVIGWAPQVSLLAHEAVGGFMSHCGWNSMLESLWFGVLMATLPMLWEQQMNAFEMVVELGLVVDLNSEGDVVIMMTKEIERGIRRLMENKEVRTKVKEMSKMSRETVVKGGSSHSFVGYLLKEIMSNVI

SEQ ID NO: 5356 - protein, 476 aa, Unknown
  Description of Unknown: Oryza sativa Japonica Group sequence
MAAASPELRHVAMLPFMAKGHAMPLLHLTRLLLARGLASKVTFFTTPRDAPFIRASLAGAGAAAVVELPFPTDDGLNDGAAPPQSMDDELASPSQLADVVAASAALRPAFAAAFARLEPRPDVLVHDGFLPWAELAAADAGGVPRLVSYGMSAFATYVAGAVTAHKPHARVGSPSEPFEVDGLPGLRLTRADLNPPIDEPEPTGPLWDLACETKASMDSSEGIIVNSFVELEPLCFDGWSRMSPVKLWPVGPLCLASELGRNMDRDVSDWLDSRLAMDRPVLYVAFGSQADLSRTQLEEIALGLDQSGLDFLWVVRSKWFDSEDHFENRFGDKGKVYQGFIDQVGVLSHKSIKGFFSHCGWNSVLESISMGVPILAFPMAAEQKLNAKFVVDMLRVGLRVWPQKREDDMENGLVAREEVQVMARELIFGEEGKWASTRVSELAVLSKKAMEIGGSSYKKLEEMVHEISELTRDKSM

SEQ ID NO: 5357 - protein, 491 aa, Unknown
  Description of Unknown: Oryza sativa Japonica Group sequence
MAIKDEQQPLHILFFPFLAPGHLIPIADMAALFAARGVRCTILTTPVNAAVIRSAVDRANDSFRRNNGGLAIELTVVPFPDVGLPPGFESGTALTTQDDRDKFFLGIRLLHEPFDRYLSEHHVDAAVVDSFFRWAADAAAEHGVPRLGFLGTSVFARACTNSMLRNNPLETAPDDPDAVVPLPGLPHCVELRRSQMMDPKKRPDHWEKFQSLDAADQRSFGEVFNSFHELEPDYVEHYRTTLGRRVWLVGPVALANKDVAVRGTSELSPDADGYLRWLDAKPRGSVVYVSFGTLSSFSPAEMRELARGLDLSGKNFVWVINGADADASEWMPEGFAELIAPRGERGLTIRGWAPQMLILNHPAVGGFVTHCGWNSTLEAVTAGVPMVTWPRYADQFYNEKLITEVLEVGVGVGSMDFASKLENRRVIIGGEVVAGAIGRVMGDGEEGEAIRKKATELGVKARGALEKGGSSYDDVGILMDELMARRGSVNV

SEQ ID NO: 5358 - protein, 451 aa, Helianthus annuus
MKGHQKNKVLIIAYPTQGHINPSLCFATRLLKFGVNVTFCTSFYAIRRIDTQTTHHGLTLAPIFDRHHNGQQPTLQQFFSDFATNGVCAVDEIIRSATATSQPFDHLVYTTVVPWATQVAAAHSLESTLLWCQPATLLDIYYYYFNGYQDLISCNNNPTFPINLPGLPPITTSDLPSILLSSCPKEQQFIVQILKDHIDAVKIAPRILVNTFDELELEPIRAIEKLVMLPVGPLMPLELLDGRGPSNNSFSCDLFEKPEEDYVKWLSTKPKLSVVYASFGSLSTLSIDQAEEMASGLLESGRPFLWVIREGDQLVKLSKIDELKKQGMIVSWCSQVEVLNHEAIGCFLTHCGWNSTIEALVAGVPTIAFAQWSDQVTNAKMIEDVWKTGVKVKRRERDGMVEGNEIKRCVEIVMQDREMRRNAEKWRELARKALNDGESSTLNLQAFLYDP

SEQ ID NO: 5359 - protein, 496 aa, Vitis vinifera
MGSKDDELHVMFLPYMAPGHMMPLVDMARLFAAHGVRITIITTTMNAFRFQNAIHRDIEAGRQIGLEILQFPSVEAGLPEGCENLISTPTPEMSMKLFQAIRMMKPRMETLLRNHRPDCIASDVLFHWTVDVAAELGIPRLSFSGSGYFNLCVSHCVERYQPHKDVSSETEIFLVPGLPDEIKLTRSQLPDLVKGRNEFSELFDRLKEAERKSFGTLMNSFYELEPAYADYYRNNIGIKAWHIGPVSLFNKDAADKAERGNKASLDEDSWLSWLDSKKPNSVLYVCLGSLTRLSKTQLTEIASALEDSGHAFIWVVGKVLNSSGEEDGSHEWWLPEGFQERAYQSGIGHIIRGWAPQVLILEHPAIGGFLTHCGWNSILEGVSSGLPMITWPIFAEQFYNEKLVTQVLKLGVGVGNEVWKVWATEEMPLMSREKIRRAVTMVMDQGIAADEMRRKASLLGELAKKAIEKGGSSYNQLKALIKEIRSFRQPPLCRNL

SEQ ID NO: 5360 - protein, 550 aa, Caenorhabditis briggsae
MTPNNIFSLLVLVAFTDSLKILVYSPAFAGSHTNFMARIADTLTESGHNVTFFVPIFDDNRSNQLGVKLTKNVIKMERSEEMKLDPVTMDNVTSSFWNINVNSKEGHSLFDPVHKLTVQSCRSLFSNAELLATLRSHEYDVGISEPMMTCSLALFRHLGIQKTILASSCPNFDVVMAAMGEPAETSYVPGKILTCYNHQIHGITITTYSFTIYSSVSGDRMDFADRLENYDMYHFMVKRYGQVFDDEAKVYRSFLGQDFPDWRELIPDASVHFTNSISYLDFPRPSIQKTIDIGGITVDVEQIESQKLSNEFNAILDKQEKTMFISFGSMAKSFEMPQNYKENLLEVFKSEPNVTFIWKYESNNVSFAEGLDNLELVKWAPQTTLLNDKRMSAFLSHGGLGSTIETVFFGKPTIMIPIFFDQFRNSHMLSRLGTSVTLLKTDLGNLDKLKSAFHKILHNDSFRKNAGHVADVVRNQPIKPKELVVKYTEFVGNHGPFHHMTPYSLKMPWFQRHGYDVLLYKSTFYLLPSFLFLASFRKFVFSRNEIPASR

SEQ ID NO: 5361 - protein, 488 aa, Unknown
  Description of Unknown: Oryza sativa Japonica Group sequence
MADAIGGGGRRRRLRVFFLPFFAKGHLIPMTDLACRMAAAGPEEMDATMVVTPGNAALIATAVTRAAARGHPVGVLCYPFPDVGMERGVECLGVAAAHDAWRVYRAVDLSQPIHEALLLEHRPDAIVADVPFWWATDIAAELGVPRLTFSPVGVFPQLAMNNLVTVRAEIIRAGDAAPPVPVPGMPGKEISIPASELPNFLLRDDQLSVSWDRIRASQLAGFGVAVNTFVDLEQTYCHEFSRVDARRAYFVGPVGMSSNTAARRGGDGNDECLRWLSTKPSRSVVYVSFGSWAYFSPRQVRELALGLEASNHPFLWVIRPEDSSGRWAPEGWEQRVAGRGMVVHGCAPQLAVLAHPSVGAFVSHCGWSSVLEAASAGVPVLAWPLVFEQFINERLVTEVVAFGARVRGGGRRSAREGEPETVPAEAVARAVAGIMARGGDGDRARARARVLAERARAAVGEGGSSWRDIHRLIDDLTEATASPEPQLQ

SEQ ID NO: 5362 - protein, 484 aa, Unknown
  Description of Unknown: Oryza sativa Japonica Group sequence
MDAGDAATTRARKPVVLYPSPGMGHLVSMIELGKVFAARGLAVTVVVVDPPYGNTGATGPFLAGVTAANPAMTFHRLPKVEVPPVASKHHESLTFEVTRLSNPGLRDFLAGASPVVLIIDFFCNAALDVADELGVPAYMFYTSGAEILAFFLYLPVLHAQTTANFGEMGEELVHAPGIPSFPATHSVLPLMERDDPAYAEFLKASADLCRTQGFLVNTFRSLEPRAVETIAAGSCAPPGVSTPPVYCIGPLIKSAEVGENRSEECLAWLDTQPNGSVVFLCFGSIGLFSAEQIKEVAAGLEASGQRFLWVVRSPPSDDPAKKFDKPPEPDLDALLPKGFLERTKGRGLVVKSWAPQRDVLAHAAVGGFVTHCGWNSVLESIVAGVPMLAWPLYAEQRMNRVFLEKEMRLAVAVEGYDDDVGEGTVKAEEVAAKVRWLMESDGGRALLERTLAAMRRAKAALRDGGESEVTLARLVESWREAASA

SEQ ID NO: 5363 - protein, 475 aa, Indigofera tinctoria
MEVTKHEEKTTMGMVAMLPSPGMGHLIPMIEFAKRLVLNHNLAVTFIIPTDGPPSKAQKTVLQSLPPAISHTFLPPVNLSDVPKNAMIETIISLTVLRSLPSIRDLFRSLAASALVVDLFGTDAFDVAKEFNVSPYIFFPSTAMVLSFFLHLPHLDQEVHSEYRELAEPVKIPGCVPVHGKDLLAPVQDRKNDAYKWVLHHTKRYREAEGIIENSFLELEPGPIKELLKEHSVKPPVYPVGPLVNVETGRAGNRSECLKWLDEQPHGSVLFVSFGSGGTLSSAQINELALGLEASEQRFLWVVRSPNDKVANASFFSADSHADPFDFLPKGFVERTKQRGLVVSSWAPQPQVLAHGSTGGFLTHCGWNSILESVVNGVPLIAWPLYAEQKMNAVMLTQDTKVALRAKDGDGGLVEREEIASVVKCLMEGEEGKKVRYRMKDLKEAAAKTLGENGASRNHISNLAQKWKNKATVTN

SEQ ID NO: 5364 - protein, 484 aa, Barbarea vulgaris
MKSELVFIPYPGIGHLRPTVEVAKLLVDREPRLSISVFILPFISGDEVGASDYISALSAASNDRLRYKVIFTGDQETAEPTKLTLHIENQVPKVRTAVAKLIDEYSKLLDSPKIVGFVLDMFCTSMIDVANEFELPSYMFFTSSAGILAVSFHVQVLYDEKKCNFSETMFEDSEAELILPSLTRPYPVKSLPYALFRTEMLIMHVNLARRFRELKGILVNTVDELEPHALKFLLSGITPPAYPVGPLLHLESNQDDESEDEKRSEIIMWLDEQPASSVVFLCFGSMGGFSEEQTREIAIALERSGHRFLWSLRRESPNIDKELPGEFTNLEEVLPEGFFDRTKGIGKVIGWAPQVAVLENPAIGGFVTHGGWNSVLESLWFGVPTAMWPLYAEQKFNAFVMVEELGLAVEIKKYWRGDLLLGRSAMEIVTADEIERGITCLMQQDSDVRKRVKEMKGKCHVALMDGGSSTLALDKFVEDVTKNI

SEQ ID NO: 5365 - protein, 481 aa, Oryza sativa
MAPAANGGAAAAHVLVVPFPAQGHLIPLLDLAGLLASRGLRLTVVCTPATAPLLAPLLAATHQGAVSALTLPFPSHPALPAGVENAKGSGPALFAKLIVAFAGLRGPLGTWARARADTPDRVVAVLSDFFCGWTQALADELGVLRVVFSSSAVYGTAVLHSMFRLMPKREDEHDDECPVSFPDIPGSPSYPWRQLSLLYRFYKAGDEVSEGVKNNFLSNMGSSCIVSNTFRQLEGRYLERPLADLGFMRLRAVGPLAPEPDASGNRGGETAVAASDLCAWLNQFADGAVVYVSFGSMAVLQPPHAAALAAALEWTGTAFVWAAGSHAAAALPEGFEERAAAGGRGKVIRGWTPQVPVLRHRAVGRFVTHCGWNSVLEAVAAGVAMLTWPMTADQFVNARLLVDEHRAAVPVSWGGIAVPPSADEVARVFEATSAAAAASEWSEVGARVKELAGEAAAATREGGSSWREVDELARELRELGG

SEQ ID NO: 5366 - protein, 469 aa, Ricinus communis
MKKPELVFVPIPGAGHLTSAVEAAKLLLDRDARLSISILILRRSSDSKVVSDLIDSLTATITSHRIQFINLPNEESESMGLDFIEKYKPHIREAVSKLATRSDFTLAGFVLDMFCMPVIDVANEFGVPSYVFFTSGAAFFGFMLHLRALHDEQEVDPTQFKNSDDELALPCFVNPLPARVLPSVLLEKESMPAFLEMSRRFREAKGIIVNTFMELESSAINSLSDGTIESPPVYPVGPILNLKGGDSVGSAESKEIMEWLDDQPPSSVVFLCFGSMGGFREDQAKEIAFALERCGQRFLWSLCQPLPMGKMTGYTDCQNLEGFLPEEFLDRTAGIGKVIGWAPQVAVLAHPAIGGFVSHCGWNSTLESIWYGVPIATWPMYAEQQFNAFQLVTELGLAVEITVDYRKDSDVIVKAADIERGVRCVMEQDSEIRMKVKEMSEKSRKVLMDGGSAFSSLNRLIEDAIDNMP

SEQ ID NO: 5367 - protein, 202 aa, Rosa chinensis
MVVGQFSIVDEADWILCNTFHELEPEVVDWMSKLWPLKTIGPTIPSMYLDNRLKEDKDYGGSLFKQNNDACMKWLNEQPKVSVVYVSFGSGAELGAEQMEELAWGLRSSKSNFLWVVRESEAGKIPKGFVEETSENGLVVSWCPQLEVLAHEAVGCFITHCGWNSTLEALSLGVPLLAMPQWTDQGTNAKYIMDVWKLDLKL

SEQ ID NO: 5368 - protein, 499 aa, Oryza sativa
MCDSPSSSSCSSLSLALAMGERMRRAAHAMLFPFPCSGHINPTLKLAELLHSRGVHVTFVNTEHNHERLLRRRGGGGALRGREGFRFEAVPDGLRDDERAAPDSTVRLYLSLRRSCGAPLVEVARRVASGGGVPPVTCVVLSGLVSFALDVAEELGVPAFVLWGTSACGFACTLRLRQLRQRGYTPLKDESYLTNGYLDTPIDWIAGVPTVRLGDVSSFVRTLDPTSFALRVEEDEANSCARAQGLILNTFDDLESDVLDALRDEFPRVYTVGPLAADRANGGLSLWEEDAACMAWLDAQPAGSVLYVSFGSLTVMSPEELAELAWGLADTRRPFLWVIRPGLIAGAGAGDHDVVTNALPDGFVAETKGRCFIAEWCAQEEVLRHRAVGGFLTHSGWNSTTESICAGVPMICWPGFADQYINSRYVRDEWGIGLRLDEELRREQVAAHVEKLMGGGGDRGKEMRRNAARWKAAAEAATAKGGSSYGGLDKLVEQLRLGQ

SEQ ID NO: 5369 - protein, 493 aa, Siraitia grosvenorii
MEATQRDGGAQSPTPHVVMLPSPGMGHLIPLLEFAKRLLFLHRFTVTFAIPSGDPPSKAQISILSSLPSGIDYVFLPPVNFHDLPKDTKAEVFIVLAVARSLPSFRDLFKSMVANTNLVALVVDQFGTDAFDVAREFNVSPYIFFPCAAMTLSFLLRLPEFDETVAEEYRELPEPIRLSGCAPIPGKDLADPFHDRENDAYKLFLHNAKRYALADGIFLNSFPELEPGAIKALLEEESRKPLVHPVGPLVQIDSSGSEEGAECLKWLEEQPHGSVLFVSFGSGGTLSSDQINELALGLEMSGHRFIWVVRSPSDEAANASFFSVHSQNDPLSFLPEGFLEGTRGRSVVVPSWAPQAQILSHSSTGGFLSHCGWNSTLESVVYGVPLIAWPLYAEQKMNAILLTEDIKVALRPKTNEKTGIVEKEEIAEAVKTLMEGEDGKKLRSKMKYLRNAAERVLEEDGSSSKALSQMVLKWKSKISGQKNCQTKFAFLES

SEQ ID NO: 5370 - protein, 470 aa, Solanum chilense
MGHLVAAIEIGKLLISRANWLSIVFFVIDLPIETRVHTYTNQSNQRLQFLHLSSPKTQTNHLSNRETLLVETFNNSKELVRNAIIQNFMTTSLVGVVVDMFSDKMIQVATELGLPSYVFFTSSAAFLGLMFYAQILKDEHNQDISDFKNSDTLLPVSTYIHPLPAKVLPNAMLDKIGRLHLPLSTARMLRKVKGIIINTFVEFELHSINTLDNDDGVPVLYPIGPIINLKQEPDESINSWLDEQQDSSVLFLCFGSYGSFDEEQLKEIAVALDRSGCRFLWSLRQPQGKGEIGASDDVARPEQVLPDGFLTRSMNRGKVIGWAPQVAVLSHRSIGGFITHCGWNSILESLWFGVPIATWPMYAEQQVNAFEMVVDLEIAVDIKMEYRSESPVLVTAEEIECAIRRLMFDSKEEKNGIRKKMEELKEKSRKTLLEGGSSYCFLESLINEFKDQSRVRKDTIPETNSTIKTS

SEQ ID NO: 5371 - protein, 479 aa, Unknown
  Description of Unknown: Fragaria x ananassa sequence
MKKASELIFIPIPGIGHIVSTVEIAKLLLCRDDNLFITILIMKFPFTADGSDVYIKSLAVDPSLKTQRIRFVNLPQEHFQGTGATGFFTFIDSHKSHVKDAVTRLMETKSETTRIAGFVIDMFCTGMIDLANEFGLPSYVFYTSGAADLGLMFHLQALRDEENKDCTEFKDSDAELVVSSFVNPLPAARVLPSVVFEKEGGNFFLNFAKRYRETKGILVNTFLELEPHAIQSLSSDGKILPVYPVGPILNVKSEGNQVSSEKSKQKSDILEWLDDQPPSSVVFLCFGSMGCFGEDQVKEIAHALEQGGIRFLWSLRQPSKEKIGFPSDYTDYKAVLPEGFLDRTTDLGKVIGWAPQLAILAHPAVGGFVSHCGWNSTLESIWYGVPIATWPFYAEQQVNAFELVKELKLAVEIDMGYRKDSGVIVSRENIEKGIKEVMEQESELRKRVKEMSQMSRKALEEDGSSYSSLGRFLDQIQTS

SEQ ID NO: 5372 - protein, 477 aa, Medicago truncatula
MSNSKTHILIFPYPAQGHMLPLLDLTHQLALQTTITTLTFTIIITPKNLPILNPLLSTHPNTIQTLILPFPSHPKIPQDAENIRHVGNTGNYPFINALSNLQSPIIHWFNTHPNPPVALISDFFLGWTHQLATRLNIPRLAFYSISSFLISVINCCWSNSNSSTQLLKKKNDEVVQFSDIPGTPEFKYEHLPSLILRYKESDPESEFVRDSFISNAASWGFILNTCKALDGPYLDHIRAEFGGNQRVFAVGPLSSIRVDANLDGGSDVLRWLDQLEEDGSVLYVCFGSQKLLKKEQMEALAFGLERSGTPFVWVVKEPSTAEQLEEGYGLVPEGFEDCVSGRGIVVRGWAPQMAILGHRIVGGFLSHCGWNSVLEAVVAGVGILGWPMEADQFVNARLLVEDMGVAVRVCEGADSVPNPDVLGRVVSGVMTGDSPQKRRAKLMREEVVGAVSKGGVSSKELDELIQVLKQLGVKEGS

SEQ ID NO: 5373 - protein, 488 aa, Cephalotus follicularis
MSNMEPHLLPPRVLLFPLPCQGNVNSMLNLAQLLSLAGLHVTFLNSDHNHDRLVRYTDIQARFTCYPGFQFKTITDGLPVEHPRNGESFMEMCYALNSVTRPLFRDMLVSGQFGLVNCIIADGIMGYTIDVADEVGIPIFHFRSISACCFWACFSIPQMIEAGEIPIKGNEAMDVLIRSVPGMETFLRSRDLPSFCRSSDVSNPSLQLIMTETRQSPRARALILNTFEDLEGPILSQIRTQCPTTYTIGPLHAHRKTRLAKHATNTLQRSSNSSSLWEVDRSCMTWLDQQPLQSVVYISFGSLAVLTRDQLIEFWYGVVNSKKNFLWVRRLDSTPGNKEGESEDIPVELVEGTKERGYMVGWAPQEEVLAHKAVGGFLTHSGWNSTLESIVAGVPMVCWPYFFDQQLNSRFVSEVWKLGLDMKDLCDRTIVEQMLNDLMVERRQEFVKSTAEMARLSRKSVSEGGSSYSNLDRLIKDIRLISMETPKC

SEQ ID NO: 5374 - protein, 296 aa, Helianthus annuus
MPGIRLKDIPPFVRVVHPGDEFMVGFSQRELKRAKSASAIIFNTFDELEDDILDTLSLMFPLCYGIGPVHLLETNNVDRSLDIIKSNLWIEDPKCLKWLDGKEPLSVVYVNFGSITVMTPQQLVEFCWGLAKSNYSFLWIIRPDLVIGDSAVLPPEFLAETSSRGLLASWCPQEQVLNHPSIGGFLTHSGWNSTIESISSGVPMICWPFFADQQPNCWWSCNKWMIAMEIDNNVKSDEVSKLVIELMSGERGNEMRKNAIAWKNKAKEAKEACTFPSGSSVVNLDKLIHLLQSSPK

SEQ ID NO: 5375 - protein, 259 aa, Citrus unshiu
MSLENSLKLLYPLNPISRYSSLILLMNKMATNRFVSSQICSLVNLPHRSTDSDEFLLPDFPEASTIQVNQLAYYLRVADGSDSISTVLQKVLPERTNADGILVNTIEELDKIGLEAKLEPAKEHGISAELCKNWLDTKSCISVLYVSFGSQNKIAVSQKMQLAMALDASGKNFIWIVRPPIGFDINSEFKANEWLPRGFEERVKGQGLVVHKWAPQVEILSHKSISAFLSHCGWNLICARSFVSWGADNWVAIGSRAVL

SEQ ID NO: 5376 - protein, 262 aa, Citrus unshiu
DRFLKAIDLSCKLVLIKTSRDIESKYLDYFSYITKKETIPVGPLVQEPVYTDNNDDTEIMDWLSRKEPSSVVYVSFGSEYFLSQEEMNEIASGLLLSEVSFIWVVRFHSEGKFTIEEALPQSFSKEIQGNNKGMVVQGWAPQAKILGHGSIGGFVSHCGWGSTVEGIMYGVPIIAVPMVLDQLFNAKMVADIGVGLEVPREEINQRVRKNDLARVIKQVVEQEEGQQIKRKAKELSESIKKKGDDEEINVVEKLLQLVKAPS

SEQ ID NO: 5377 - protein, 481 aa, Cleretum bellidiforme
MSKIELVLVPTPGMGHLLSAVELSKLIIRRENRISVLILILSFPFDSGLVNAYVDFQSRDPDNSGSLTFITLPPLSNIPDCTSSTFFTTVIELHKPNVKQVVEERVRSGSPKPAGFVIDMLCPAMMDVAEELEVPSYILFTSGANLLNVVFHFLSLADNGVDIATEVNDPDKEVDVPGFRNRVPCKVLPLPFLEKDFLVKRGRRFRRSNGILVNTSNELESYAIQTLLEQAKDNKIPPVYPVGPILELNSKSRCGTKEDEEVSIMRWLDEQPVNSVLFVCFGSMGTFDEDQVKEIANGLEQSGYCFLWSLRQPPPEGKATPSEEAFLDTLPEGFVERTSHKGKIIGWAPQVSILAHKAVGGFVSHCGWNSTLESLWFGVPMATWPISAEQQLNAFELVKEFGMAVEIRMDFWRDCRKNTQSFVVTSEEIENGVKKLMSMDEEMVEKVKKMSDKSRKTLEDGGSSHHSLGRFINDLLENAGF

SEQ ID NO: 5378 - protein, 472 aa, Jatropha curcas
MDSERAIKPHVILVPFPAQGHINPFMQLAKLLHSRGLYITFVNTEFNHSRLVRSKGQEAVKGLPDFRFETIPEGLPPSDKDATQDPAALCDSIRKNCLVPFLELLSKLNSSSQVPKVSCIISDGIMSFCIKAGEMLGIPAVQFWTASACGLMGYLQYGEFIKRGIIPFKDESFLTDGTLDTPIDWIPGMSNIRIKDIPSFVRTTNIEDTLFDYLKSESENCLKASAIIFNTFEEFEHEVLAAISAKFPHIYSIGPLTLLERRLPETELKSLRPSLWKEDSNCLEWLNKREPSSVVYVNYGCVTVMTEQHLKEFAWGIANSKYPFLWIIRPDVVMGNSATLPEDFLEEIEDRGYLASWCPQDQVLSHPSIGVFLTHCGWNSSMESVCGGVPVICWPFFGEQQTNCRFACTTWGIGLEVNGDVKSYEIEALLKEMMENDNGKKMKQKALEWKRKAGGSSNSDFERFMKDFLHFD

SEQ ID NO: 5379 - protein, 484 aa, Sorghum bicolor
MSSGKAQQRPHAVLIPQPAQGHVTPMLHLAKALHARGFRVTYVNSEYNHRRLLRSRGQDSLAGTDGFRFEAVPDGLPQSDNDDVTQDIAALCLSTTEHSAAPFRDLLARLNATPGSPPVSCVIADGVMSFAQRVAEEMGILALVFWTTSACGFMGYLHFAELIRRAYVPLKDESDLSNGYLDTAIDWIPGMPGIRLKDIPSFIRTTDPDDVMLNFDGGEAQNARKARGVILNTYDALEQDVVDALRREFPRVYTVGPLATFANAAAGGGLDAIGGNLWKEDTSCLRWLDTQRPGSVVYVNFGSITVMTAAQLAEFAWGLASCGSPFLWVIRPDLVSGENAMLPEGFVTDTKERGILASWCPQELVLSHPSVGLFLTHCGWNSTLESICAGVPMLCWPFFAEQPTNCRYVCDKWGIGMEIDSDVRRQEVARLVREAMDGERGKAMRLKSMVWKEKARQAVDEGGSSRKNMDRMVEFLLAGNDVPS

SEQ ID NO: 5380 - protein, 499 aa, Theobroma cacao
MNKFHVVFISAPGIGNFVPTVEFARHLNNHDPRFIVTILMIEIAERPIVNAYIQSCVATHTSINFINLPPVDPPSPDEYQTSLGYICLLIAKHKLHVKNAIEDLMSTESPSDSDMVDVRVAGLVVDMFCTSMIDVAKELGIPCYLYFTSPVSFLGFMLYFPTLDGIFTTEFVDSDSGLMVPKDSAAANTSELTIPGFANPLPHLMLPNRVLYRKQEGYFWFLHHARRYKETKGMVVNTFRELEPYAIDSVSNGNGDWPPIYPIGPVLDLVGPAQWHPERAQHDSIVQWLDNQPPSSVVFLCFGSMGSLSGAQLREIAVGLERSGFRFLWSIREPPKRELDLPGEYKNGEEIEMLPQGFVDRSRSAGIGLVCGWVPQAVILGHQAIGGFVSHCGWNSILESIWYGVPIATWPLYAEQQMNAFQLVKELELAVEIRLDYREGSDLVSPEELERALRRLMKGNDEVRRKMREMKQKSRAALMPNGSSYKSLASLIEELTAGT

SEQ ID NO: 5381 - protein, 472 aa, Unknown
  Description of Unknown: Oryza sativa Japonica Group sequence
MTTKTFVLFPSLGVGHLNPMVELAKHLRRRGLGVIVAVIDPPNNDAMSADAMARLAAGNPSVTFRILPAPASPDPGAHHVKRNLDTLRLANPVLREFLRSLPAVDALLLDMFCVDALDVAAELAIPAYFFFPSPASVLAVFSHLPYYYRNAPSLREMDKAALIRFPGIPPIRNVDMLATVKDKESETTKIRLYQFKRMMEGKGVLVNSFDWLEPKALKALAAGVCVPNEPKQRVYFIGPLVDARKKVGSGAERHACLAWLDAQPQRSVVFLCFGSQGAFPAAQLKELAHGLESSGHRFLWTVRSPPEEQSTSPEPDLERLLPAGFLERTKGRGMVVKNWVPQAEVVQHEAVGAFVTHCGWNSTLEAIMSALPMICWPLYAEQAMNKVIMVEEMKIAVSLDGYEEGGLVKAEEVEAKVRLVMEAEEGRKLRERLVETRDMALDAIKEAGSSEVAFDEFMRDLEKSSLENGVRS

SEQ ID NO: 5382 - protein, 479 aa, Medicago truncatula
MEYQQQSRTTPKQELPPLVAMFPTPGMGHLIPMVEFAKRLSKHNLPITFIIPNDGPPSKAQTTVLTSLPHGISHVFLPPITLSDLPPNTKPETLMTATTVRSLPSLHQTLLSLMTSHRLSALIVDLFGTDVFDMAAELDIPSYLYFPTNANNLSFAFYFPQLAQRVQGEFRDIPEPLNIPGCFAFHGKDLADPVQDRNDEAYKCFLHHVTRYKLAKGIIENSFLELEPEAITFLKKNEPPVYPVGPLVNEDSINNGSEFDVCFQWLDEQPRGSVIFVNFGSEGILTSAQTDEIAYGLEMSEQRFLWVLRCPKDKVENDSNFIANSNVDPFEFLPNGYIERTKGKGLVLPYWAPQAQVLSHISIGGFVSHCGWNSTLESVVNGVPLIAWPLYAEQKMNAVLLSENVKVAIRPKVGENGLVQREEIASVVKRLMVGEEEQKIRYRMKDLKEAAINALKENGSSTKQICELALKWKGVTIPN

SEQ ID NO: 5383 - protein, 499 aa, Dorcoceras hygrometricum
MATQSHKLHFILFPLMAPGHMIPMKDIAKLLAQRGVVVTMITTPLNAKRFSPTIDRATESGLEIHLVEIRFPSSEAGLPEGCENLDSLPSLDLASNFFVALGLLQKQVGDLFEELEPRPNCLISDMGLPWTTQIAEKFRIPRIVFHGTCCFSLLCSHNIVSSKILDSLSSDSEQFEVPNLPDSIRLRKFQVTGSTKRDSSAIKDVTDQIRAAEKTSFGVVVNSFQELEAAYVKEYSKAKGERVWCIGPVSLCNKNGLDLVDRGNKASINEQDCLKWLNSQEPGSAIYASLGSLSRLIAPQMIELALGLEESNRPFIWSLGGGDKTGELDRWILENGFEERVNGRGLIIRGWAPQVLILSHEAIGGFLTHAGWNSTLEGISAGVPMVTWPLFAEQFCNEKLVVEVLKIGVGIGVETPVKWGEEEKVGVLVRSDDVKKALELLMDGGENGEERRRKARELAEMAKKAINGGSSYGNMTSLIEEIMAKSNVDETSGQETLPV

SEQ ID NO: 5384 - protein, 473 aa, Vigna angularis
MEAEAVVAMVPSPGMGHLIPMIQFAKRLCRHHNLRINFLIPTNAPPSQAQTTILTSLPSLISHVFLPTVTLTDIPPNAKMETIMSVTVLRSLPYLRHALLSLSATHRVTALLLDFFGTDAFDLARELNVSPYVFFPSTAMVLSLALNVPRLDQDVHFRDFSKPVHLPGCLPVHRKDLGDAFEDRDDDAYKWILHHGKRYRLAEGFLENSFRDLEPDTIDLLLKDEPGRPPVYLVGPLVKEDDAGSEVNMVEQCLCLKWLDAQPHGSVILVCFGSGGSLSRDQMEELALGLEMSEQRFVWAVKSPNEEVANASYFREDTGVHLFDFLPQGFVERTKGRGLVVPSWIPQAQVLSHPSIGGFVTHCGWNSILESVVNGVPLVAWPLYAEQKMNAVLVTEGMKVAARVVIGENGLAERGEIARVVKMVLEGEEGKKLLHRMKQLKEAAATALRDGGSSSTQISELALKWKAQTKVYY

SEQ ID NO: 5385 - protein, 478 aa, Persicaria tinctoria
GSESPAAPPTTAPPPHVIIVPSAGMGHLIPLAEFAKRLLPRFTFTFAVPTSGPPSSSQRDFLSSLPASIDTSFLPEVDLSDAPSDAQIETLMSLMVVRSLPSLRDLIASYSASGRRVAALVVDLFATDAIDVALELGIRPFIFFPSTAMTLSFFLHLEKLDETVSCEFAELSDPVQIPGCIPVHGKDLIDPVQDRKNDAYKWLLHHSKRYKLAEGVIVNSFEGLEGGPIRELLHPEPGKPRVYPVGPLIQAGSCEKGAAARPECLKWLDQQPRGSVLFVNFGSGGVLSTEQQNELAGVLAHSQQRFLWVVRPPNDGIANATYFSVDGEIDPLKLLPEGFLEQTAGRGLVLPMWAPQIDVLSHESTGGFLTHCGWNSTLESVFHGVPLITWPLYAEQKMNAVMLTEGLRVGLRPSVGKDGIIRGAEIARVIGELMEGEEGKRIRSKMQELKRAASAVLSKDGSSTRALEEVAKIWESKV

SEQ ID NO: 5386 - protein, 490 aa, Brassica napus
MGSISGMEFESSPSPTPVHVMLVSFQGQGHVNPLLRLGKLIASKGALVTFVTTELWGKKMRQANKIVDGELKTVGSGSLRFEFFDEEWADDDDRRCDFLLYISHLEQVGKKEVSKLVRRYEEANEPVTCLINNPFIPWVCHVAEEFNIPCAVLWVQSCACLSAYYHYQNGTICFPTETEPDLDVELPCVPRLKHDEIPSFLHPSSRFAGFRQAILGQFENLSKSFCVLVDSFDALEQEVVDYMSNLCPIKTVGPLFKVAKTVTSEVSGDICKPADRCLEWLDSRPRSSVVYISFGTVAYLKQEQIEEIAHGVLKAGLSFLWVFRPPPHDLKVESHVLPQELKEECGRGNGKIVDWCPQEQVLAHPSVACFVTHCGWNSTMEALSLGVPVVCCPQWGDQVTDAVYLIDVFKTGVRLGRGATEERVVPREEVAEKLLEATVGEKAEELRKNALKWKAEAEAAVAPGGSSDKNFREFVEKLGVGASKVKENRH

SEQ ID NO: 5387 - protein, 482 aa, Unknown
  Description of Unknown: Oryza sativa Japonica Group sequence
IDHTSTRSDDSGEREIVGDGRRRRRRPGRGDVPLAGVRPHDPLPPAVQAPRGEGPRRLLPLHAAKPRQAPAGAGEPFRSSPPPAAADADTVEGLPEGAESTADVTPDKDGLVKKACDGLAAPFAAFLAGRAKRPDWIVVDFCHHWLPPIADEHCVPCAMFHIIPAAMNAMFGPRWANARYPRTAPEDFTVPPKWIPFPSTIAFRRREFGWIAGAFKPNASGLPDVERFWRTEERCRLIINSSCHELEPPQLFDFLTGLFRKPTVPAGILPPTTNLVTDDDDDDDRSEVLQWLDGQPPKSVIYVALGSEAPLSANDLHELALGLELAGVRFLWAIRSPTAGGVLPDGFEQRTRGRGVVWGRWVAQVRVLAHGAVGAFLTHCGWGSTIEGVALGQPLVMLPLVVDQGIIARAMAERGVGVEIARDESDGSFDRDAVAAAVRRVAVGGEREAFASNANRIKDVVGDQEREERYIDELVGYLRRYS

SEQ ID NO: 5388 - protein, 640 aa, Medicago truncatula
MNFRIVFLNCFDSIFGCLCQHFCQSDIAVVYSRMKWKNPVKLVPPLICFIRYTYQVWFECISFMSGFQSSTICAPTLLYFFRWISCRVDDPLVSSLRRLSVVGQDMSVEFASLIADRTAGVWFSGRIMNLQKLIITLLDNFCFIINLSTMEGVEVERPLKIHFIPYLASGHMIPLCDIATMFASRGQQVTIITTPSNAQSLTKSLSSAASFFLRFHTVDFPSQQVDLPEGIESMSSTTDSMTSWKIHRGAMLLHGSIEDFMEKDPPDCIISDSAYPWANDLAHKLQIPNLTFNGLSLFTVSLVESLQANNLLHSDTNSDLDSSSFVVPNFPHRITLCGKPPKVISKFLKMMLGTVLKSKALIINNFTELDGEECIQHYEKTTGHKVWHLGPTSLIRKTIQEKAERGKEGDVNMHECMSWLDSEKVNSVLYICFGSINYFSDKQLYEMACAIEASSHPFIWVVPEKKGKEDESEEEKEKWLPKGFEERNIRRMGLIIKGWAPQVKILSHPAVGGFMTHCGGNSIVESVSAGVPMITWPVHGDQFYNEKLVTQFRGIGVEVGATEWCKNGVAEREKLVSRDNIEKAVRRLMENGDEAKNMRLLAQEFGEKATQAIQEGGSSYNNLLALIEELKRLRDPKRHD

SEQ ID NO: 5389 - protein, 454 aa, Striga asiatica
MAFHSHVAVLAFPFGTHAAPLFALVRRMAASARGTLFSFFTSPTSNVGFFNGPDEHENICVRDVWDGTPENEVFTGSHSEAVGLFLKASPGNFEKAVEKAESESGLKMECLITDAFLWFGGDMAEERCVPWVAFWTAASCSLSAHVYTDEILKVAGSTEEKTEQEQRLTFIPGLENARLADLPPEIFLDVDNPSPLALTIGNMVRNLPKSSAIVLNSFDEIDPAITADLRRKFRHFLNVGPTTLLTSPNDTTADPTECLPWLDQFRDTPKSVVYVSFGTVAVPPEPELRALARALEALRAPFLWSLNDGAKNALPEGFVGRTAGGFGRIVPWAPQPRVLGHGSVGAFVTHCGWNSILESIAGRVPMVCRPFFGDQRLNGRMVEDTWRIGVGVPGGVFGEDGSTAEVLGRVLSDEGMRENVGRLREKALEAVGPDGSSSRNFEKLLEVIRSRERD

SEQ ID NO: 5390 - protein, 496 aa, Hordeum vulgare
MNFAGSGDGRSGSARAHFVLVPMMAQGHTIPMTDMARLLAEHGAQVSFITTPVNAARLEGFAADVKAAGLAVQLVELHFPAAEFGLPDGCENLDMIQSKNLFLNFVEACAALQEPLMAYLRQQQRSPPSCIISDVMHWWTGDIARELGIPRLTFIGFCGFSSLVRYIIFHNNVLEHATDENELITIPGFPTPLELMKAKLPGTLSVPGMEKIREKMFEEELRCDGEITNSFRELEALYVEFYEQIRKKKIWTVGPMCLCHRNSNTTAARGNKASMDETQCLQWLDSRKPGSVIFVSFGSLACTTPQQLVELGLGLEASQKPFIWVIKAGPKFPEVEEWLADGFEARVKDRGMILRGWAPQVMILWHQAIGGFVTHCGWNSTIEGICAGVPMITWPHFSEQFVNEKLVVDVLKIGVEVGVKGVTQWGSEKQEVMVTRDAVETAVNTLMGEGEAAEELRMRAKDCAIKARRAFDEEGSSYNNVRLLIQEMENKTNPCD

SEQ ID NO: 5391 - protein, 460 aa, Medicago truncatula
MEERKYSNMHVLMIPYPSQGHINPMLQFSKRLSTKGVKVTMVTTIFISKTMHLQSSSLPSSLQFDFISDGYDEGGFTQVGNISTYLSHMQAIGSKNLKELIQKHNVSDHPIDCVVYDPFLQWVLDVAKEFNIIGAAFFTQMCAVNYMYYYVYHGLLKLPISSMPISIPGLPLLELKDTPSFVYDPGFYPAYYEMVMNQYSNIHKADIILVNSFYKLEDQVVDSMSKLCPILTIGPTVPSFYLDKGVPNDKDNDLNLFQLDSSPINWLNSKPEGSAIYVSFGSMVCFSIEQMKEIALGLLGSGSNFLWVIPNMEKKNISKELVEEMSSSGKGLVVNWIPQLEVLSNKAIGCFLTHSGWNSTLEALCLGVPMVAIPQWTDQPLNAKYVEDVWKVGMRVKVNENGIVTKEEIESCIMKVMENDIGREMKINAKKWRELAIEAVSHSGTSDNNINEFVNKLKRS

SEQ ID NO: 5392 - protein, 209 aa, Ricinus communis
MGITGLYHACRYKETKGIVVNTFQALEEYAINSVSASGLPPVYPVGPVLDLAGPIQWHPNRDQHHRILKWLDDQPKSSVRWLERTGFRFLWSIKSAYRLLYLPGEYADAKEVTILAHQAIGGFVSHRGWKSILESLWHGVPIATWPLYAEQMNASQLEGERGIKCLMESDSEVRKRVKEMSQKSRMAATENGSSHASLTSLIDKLAAGI

SEQ ID NO: 5393 - protein, 459 aa, Zea mays
MAASCGGRVVVFPFPFQGHFNPVMRLARALHARGVGITVFHTAGARAPDPADYPADYRFVPVPVEVAPELMASEDIAAIVTALNAACEAPFRDRLSALLSAADGEAGEAGGRVRCVLTDVSWDAVLSAARGLGVPALGVMTASAATFRVYMAYRTLVDKGYLPVREERKDDAVAELPPYRVKDLLRHETCDLEEFADLLGRVIAAARLSSGLIFHTFPFIEAGTLGEIRDDMSVPVYAVAPLNKLVPAATASLHGEVQADRGCLRWLDAQRARSVLYVSFGSMAAMDPHEFVELAWGLADAGRPFVWVVRPNLIRGFESGALPDGVEDRVRGRGVVVSWAPQEEVLAHPAVGGFFTHCGWNSTVEAVSEGVPMICHPRHGDQYGNARYVCHVWKVGTEVAGDQLERGEIKAAIDRLMGGSEEGEGIRKRMNELKIAADKGIDESAGSDLTNLVHLINSY

SEQ ID NO: 5394 - protein, 472 aa, Cucumis sativus
MASKQFPSHVFLVCYPGQGHINPTLRLAKKLAVEGLLVTLCTAAHFRETLQKAGSIRGGDQLTPVGNGFIRFEFFEDGIIEINPKDMSLDRFIAQLELSGRLSLVDLIKKQTAENRPVSFMVLNPFFPWTYDVAEELQIPYAVLWVQSCAVFSIYYHYFHKSVPFPTEIDPTVDVQLPILPRLKNDEIPSFLHPKKTYGILGKAMLSQFGKLSLAFCVLIDTFEELEKEIINYMSKIIPLKPIGPLFLISQKLETEVSLDCLKAEDCMDWLNSKPPQSVVYVSFGSVVFLKQEQIDEIAYGLCNSGFSFLWVLKPPSEFFGKQRHSLPEEVAEKIGERGKIVQWSSQERVLSHESVGCFVTHCGWNSSVEAVANGVPVVAFPQWGDQVTNAKFLVEEYGVGVSLSRGAEVNELITRDEIERCLSDVMTGGSTGDNVFRQNALKWKKMAAAAVADGGSSARNFQDFVDNIRQK

SEQ ID NO: 5395 - protein, 216 aa, Citrus unshiu
MYLDKQLEDDKDYGFSMFKQNNESCIKWLNDQAKGSVVYVSFGSMATLKIEEMEELAWGLKASDKESEQSKLPENFSDETSQKGLVVNWCPQLGVLAHEATGCFLTHCGWNSTLEALSLGVPMVAMPQWADQSTNSKYIMDVWKMGLKAPADEKGIVRREAIAHCISEILEGERGKEIKQNAGKWRNFAEEAVAKGGSSDKNIDEFVANLVCSKCL

SEQ ID NO: 5396 - protein, 463 aa, Panicum hallii
MADGSEQSVHVLLLPYPSQGHINPILQFGKRLAARRGVRCTLATTRFALSQSQPATGDAVRIAAISDGCDRSGFSEAGGVDAYLSRLESAGSETLDALLRSEAEQGRPVRVLVYDAVLPWAPRVARRRGAATAAFFTQPCAVDVAYAHAFAGRIRPPLADEETVADELHGLPAGLRPGDLPSFLAEPTRDHPAYLDLLVNQFDGLDTADHVLVNSFHELQPQESDYMASTWRAKTVGPTVPSAYLDNRLPDDTSYGFHLYTPLTATTKAWLDGRPPRSVVYTSFGSVSAPGALQMTEVAEGLYNCGKPFLWVVRASETAKIPESFAGRAKERGLIVTWSPQLEVLAHPAVGCFVTHCGWNSTTEALSAGVPMVAMPQWSDQPMNAKYIEDLWRVGVRVRPDEEGVVRKEEVERCVREVMDGEKSTEYRRNAAGWKEKAKRAVSEGGSSDNNIVEFLGKLGLEV

SEQ ID NO: 5397 - protein, 492 aa, Citrus unshiu
MDLKEEKEYGDHVLMVSLATQSHINPLLRLGKRLVSKGLSVTVATPEIAQHQLLKSFTSSKINDCVSDDIPCLYFSDGFDLDYNRKSDLDHYMETIEKAGPGNLSKLIKNHYHDKHKKLSCIINNPFVPWVVDVAAELGIPCAMLWIQPCSLFSIYYRFYNKLNPFPTSENPNSSVELPGLQTLHTHDLPSFVLPSNPFGSFSRILNDLFQNLNKQYKWVLANSFFELEKEATESMSQLCPIRPVGPLVPPSLLGQDEKLDVGVERWKPEDCCLEWLNKQSNSSVVYISFGSLTQLSANQMEVIATALKNIKLPFLWIVKQSESASSDGEGTLPLWFLEETKNRGLVVSWCPQTKVLAHPALACFVTHCGWSSLLETIVAGVPVIAYPQWSDQPTNAKLVADVFKIGLRLRPSEDGFVGNEELEKCVEEIINGPKSEYYKKNAVELKHAARQAVAGGGSSDQNIQLFADEILGNYSEGGARCGEKLASSMIG

SEQ ID NO: 5398 - protein, 478 aa, Brassica napus
MNSEVSEPIHICFFPFMAQGHMIPTLDMAKLFSSRGAKSTIITTPINSKIFEKQTEAFKNQNPDLEIGIKIFHFPCVQLGLPEGCENVDFINSYQKPNAGDLSLKFLFATKYMKQQLESFIETTKPSCLVADMFFTEKFGVPRLVFHGTSFFSLCCSYNMRIHKPHKKVSTRSTPFVIPGLPGNIVMTLQQANVSNDETPRGKFMKEVRESESVSFGVLVNSFYKLESTYADFYRGFVAKRAWHIGPLSLCNVDLAEKAGRGKKANVDEQECLRWLESKATGSVVYMSFGSGTSFTNEQLLEIAAGLEGSGQNFIWVVRKNENQGENEEWLPEGFEERTKGKGLIIRGWAPQVLILDHKAVGGFVTHCGWNSVMEGIAAGLPMVTWPMGAEQFYNEKLLTMVLKTGVNVGATELVKRGKLISREEVEKAVREVIVGEEAEERRKRAKKLGEMAKAAVEEGGSSYNDLNKFMEEVNGRK

SEQ ID NO: 5399 - protein, 459 aa, Arabidopsis thaliana
MAKPSQPTRDSHVAVLVFPFGTHAAPLLAVTCRLATAAPSTVFSFFSTARSNSSLLSSDIPTNIRVHNVDDGVPEGFVLTGNPQHAVELFLEAAPEIFRREIKAAETEVGRKFKCILTDAFLWLAAETAAAEMKASWVAYYGGGATSLTAHLYTDAIRENVGVKEVGERMEETIGFISGMEKIRVKDTQEGVVFGNLDSVFSKTLHQMGLALPRATAVFINSFEELDPTFTNDFRSEFKRYLNIGPLALLSSPSQTSTLVHDPHGCLAWIEKRSTASVAYIAFGRVATPPPVELVAIAQGLESSKVPFVWSLQEMKMTHLPEGFLDRTREQGMVVPWAPQVELLNHEAMGVFVSHGGWNSVLESVSAGVPMICRPIFGDHAINARSVEAVWEIGVTISSGVFTKDGFEESLDRVLVQDDGKKMKVNAKKLEELAQEAVSTKGSSFENFGGLLDEVVNFG

SEQ ID NO: 5400 - protein, 479 aa, Centella asiatica
MSQLHAFFFPMLAHGHMIPTLDIAKLFASRGVHATIITTPLNAPVFTKAVEKASRSGLQMSLKIIKFPKVPGLPEGCESADQITNPQLFPNFFTATMLLEEQLEQVLEEFRPDCLVADMFFPWATDVAAKFGIPRLVFHGTSFFTLCAAEQVRLNKPHENLLNDWDPFVVPNLPHEIKMTRSQLPPSERDGVQTEFTKMLSRAKESELKSYGVIVNSFYELEPDYADHYRNVLKRKAWNIGPVSLCNREVEEKAQRGKKAAIDQDECLKWLDSKNPKSVIYVCFGSVCSFPPSQLHEIALGLEASGQDFIWVVRKGKNDEEEEEEKRIPEGFEERMEGKGLFIRGWAPQVLILEHEAVGGFVTHCGWNSILESICAGVPMVTWPAFADQFYNEKLVTEILEIGIGVGCREWYMAGRGNSDVKMEEVEMAVKGIMVGEEAEERRNRAKALKEMAREAVEEGGSSYLDLDALIKDLSSHHS

SEQ ID NO: 5401 - protein, 477 aa, Pueraria montana
MQQEETIVLFPSAGIGHVVSMVELAKLLQTHNYSITILLTTGFLDHPSIQTYIHRISTSHPSISFHRLPHIDPTTTPTTVSFITKGFNFNKRNAPNVATTLTQISKSTTIKAFIIDLFCTTAMEPASSLGIPVYYFFTSGAAVLALYSYFPKLHEETNVSFKDMVGVELHVPGNAPLKAVNMPEPILEREDPAYWDMLEFCTHLPEARGIIVNSFAELEPVAVKAVADGACFPNPEHAPTVYHIGPLIAEPQQSDAATDSKQCLSWLDEQPSRSVVYLCFGSRGSFSVSQLREIANGLEKSGHRFLWVVKRPTQDEGTKQIHDVTAGEFDLSSVLPSGFIERTKDRGLVVRSWAPQVEVLSRDSVGAFVSHCGWNSVLEGVVAGVPMIAWPLYAEQHVNRHVMVGEMKVAVAVEQREKDGFVSGEEVEKRVRELMESKEVRETSFKLKQLALAAVEESGSSTKALANLVETWTGIGI

SEQ ID NO: 5402 - protein, 479 aa, Ricinus communis
MAHILVFPFPSSGHIIPLLDLTQSLLSRGLIITVAITTNNLPLLNPLLSSTQQLQHLLLPSPSINPSATAPSKNRLFSILRFMRETHYPILLNWFQSHTSPPVAIISDFFLGWTYHLASQLGLPRIVFSPSGAFAFSVGASTWSDQPQNDNPENHDFVVSFPNIPNSPSYPWWQISHLYRMPKDSDWEFYRDSNLANMASWGVIFNSFTELERVYIDHMKNEFGNVRVWAVGPALPSDDDLMGPAANRGGTSSVPCHDVLTWLDSHHKDHSVVYVAFGSRAMLTCEQMNELAAGLEKSGVDFILCVRQQGDYGILPDGFEDRVAGRGFIIKGWAPQMAILRHRAIGAFLTHCGWNSVLEGISAGVVMLTWPMGADQFTNAQLLVGELEVGMRVGEATQKIPESGELARILSESVEENRRERVRAKKLKEAARSAVKGGSSEADLDRLIKRLNELKLENGGGLMISSNGVKIEKYDTHIS

SEQ ID NO: 5403 - protein, 478 aa, Vitis vinifera
MGSATPLHVVVFPFMAQGHTLPMLDLSKLLACRGLKVTIITTPANFPGIHSKVSKNPEISISVIPFPRVEGPLEGVENTVDLPSEDLRAPFIEVIKKLKEPFEEILRGMFEAGCPPIGVISDFFLGWTLDSCNSFGIPRIVTYGMSALSQAILIISGFHTPYILASLPEDPVQFPELPTPFQVTRADFLHLKHDPRGSLMSSIIQEFTEADLKSWGLLVNSFEDIEREHIAALESLYSTEAKAWCVGPLLLCNPIKEKEEDANEPQAGNQTSDPCIEWLNKQIGYETVLYISFGSEAHVSDEQLDEIALGLEMAMHPFIWVVKSRNWVAPEGWEERVKERGLIVRGWVEQCRILAHPKTGGFLSHCGWNSVLEGLSMGVPLLAWPMAAEQPFNAKIVADWLGAGIRILELSECSQTIGSEIICDKIKELMEGEKGRKARARAQEVKRMARQAMKKGGSSDRNLNELIESLARRRKHIT

SEQ ID NO: 5404 - protein, 485 aa, Unknown
  Description of Unknown: Oryza sativa Japonica Group sequence
METATSKPHFVLVPWIGSISHILPMTDIGCLLASHGAPVTIITTPVNSPLVQSRVDRATPHGAGITVTTIPFPAAEAGLPEGCERLDLIPSPAMVPGFFRASRGFGEAVARHCRRQDARPRRRPSCIIAGMCHTWALGVARELGVPCYVFHGFGAFALLCIEYLFKQRRHEALPSADELVDIPVLPPFEFKVLGRQLPPHFVPSTSMGSGWMQELREFDMSVSGVVVNIFEDLEHGSAALLAASAGKKVLAVGPVSLPHQPILDPRAASDDARRCMAWLDAKEARSVVYVSFGSAGRMPAAQLMQLGMALVSCPWPTLWVFNGADTLPGDVRDWLRENTDADGVAHAHSKCLVVRGWAPQVAILDHPAVGGFMTHCGWGSTLESVAAGMPMVTWPFFAEQFINERLIVDVLGIGVSVGVTRPTENVLTAGKLGGAEAKVEIGADQVKKALARLMDEGEDMRRKVHELKEKARAALEEDNDMKAIG

SEQ ID NO: 5405 - protein, 218 aa, Trifolium pratense
MKKAEVVIIPSPGVGHLVSTLEFAKLLINRDNRLRITVLVIKFPHTTETDVYTKSLPISDSLNVINLPDCSLPPTSKPGPAMAFTLLEAQKQNVKKVVSNLTTGEQHGHLAAFVVDMFCTTMIDIAKEFSVPAFVFFTSGVAFLGLCLYIHNMFERDNVDSTHFLQRTELAIPSFANLVPTKSLPGAVLRKEFESYFMTYAKGLKNADGIIVNSFEEL

SEQ ID NO: 5406 - protein, 454 aa, Nicotiana tomentosiformis
MKKHHFLIISLPAQGHINPTLQLAKILARAGARCTFVTSVHGFRKMNNLPSIDGLFYASISDGHDDGRPKEMYFGDYLNDFKRVGSENLKNLLHKFTDDGYPVTCLVYTILFTWVAEVARECHAQSAFLAIQCATAFAIYYNLFTTNNGIYSSTTEIEPSFPIKLPELPLISRDDIPTFLLQSDSASSFMIPVMREHIKILESDSNPRVLINTFDALEEKSLKILEKIGVCSIGPLIPSAFCDGNDVNDKSFGCELFDKSENYSQWLDLKAEGSVVYVSFGSLAVLKEEQKEEILKGLLESERPFLWVIRSSNEDDKIKNENYGLNGKGMIVPWCSQMEILFHKSIGCFVSHCGWNSTLESIALGVPLIGYPQFSDQVTNIKMVEEVWGTGVRARAEEGIVKREELKRCLEILMGNGEKGNEIRRNVKKYGDLAMEAVRGGSSHYNLNKFLDSF

SEQ ID NO: 5407 - protein, 468 aa, Morus notabilis
MGNKNIEPPMHVLLVSFPAQGHINPMLRLGKRLLSKGLLVTFTTTTNMAKDIQKYPNDNPEDKTTPFIGFDFFDDGIPDDDSRRSDFDFYFSRLEKAGKESIPQLIKKLNDNGRPVSCLVNNPFIPWACDVAEDLKIPWATLWVQSSAVFAVYYHFFHQTVPFPSEAEPDIDVQLTSMPALKRDEIPSFLIAGNPYEVFGKTILEQFKNLSKSFCVLADTFEELEQDIIRALSGFCMVRPIGPLFKGPKDIAVTRGSECLEWLDSKPPSTVVYISFGTVAYLKQEQVDEMAHGVLNSGMSFLWVMRPPKKESGLKPHVLPEGFLETIGDRGKFVEWSPQERVLAHPSVTCFLTHCGWNSSVEALTLGVPVVCFPQWGDQVTNAKFLVDVFGVGVRLGRGEAENRVVPRDEVERCLVEATVGEKAAEMKRNAVRWKKAAEEAVEKGGLSDRNLDEFVEEIRSRSVASSN

SEQ ID NO: 5408 - protein, 471 aa, Vigna angularis
MKDSIVLYSALGRGHLVSMVELGKFILSHHPSLSINILFLTPPPNQDTPTSPTAFTCAATAKYITSVTAATPSITFHRIPQISLPTVLPPLALNFELCRATTHHLRRILNSISLSSNLKVVVLDFMNHSAARVTHTLQIPTYFYYTSGASTLAILLQQIILHENYTKSIKDLNMDVLIPGLPKIHTDDFPDTVQDRTSEAYKVFTEIAMCMRDSDGVIVNTSEAMERRAVKAFNEGLMEGTTPPVFCIGPVISSAPCRGDDDGCLSWLDSQPSQSVVFLSFGSMGRFSRAQLREIAIGLEKSGQRFLWVVRSEFEDGDSGEPTSLEELLPEGFLQRTKGTGMVVRDWAPQAAILSHDSVGGFVTHCGWNSVLESVCEGVPMVAWPLYAEQKLNKVILVEEMKVGVAVKGDKDGLVSSTELSNRVKELMDSDRGKEIRQNIFKMKISATEAVGEGGSSIIALNRLVELWKEH

SEQ ID NO: 5409 - protein, 472 aa, Panax ginseng
MKSELIFLPVPAFGHLVGMVEMAKLFISRHENLSVTVLISKFFIDTGIDNYNKSLLAKPTPRLTIINLPEIDPQKYLLKPRCAIFPSLIENQKTHVRDVMSRMTQSESTRIVGLLADILFVDIFDIADEFNVPTYVYSPAGTGFLGLAFHLQTLNDDKKQDVTEFRNSDTELLVPSFANPVPAEFSPSIFLEKDGRHDVLLSLYRRCREAKGIIVNTFEELEPYAINSLRMDSMIPPIYPVGPILNLNGEGQNSDEAAVILGWLDDQPPSSVVFLCFGSFGSFPENQVKEIAMGLERSGHRFLWSLRPCISEGETTLQLKYSNLELPAGFLDRTSCVRKVIGWAPQMAVLAHEAVGGFVSHCGWNSVLESVWYGMPVATWPMYGEQQLNAFEMVKELGLAVEIEVDYRNEYNKSDFIVKADEIETKIKKLMMDGKNSKIRKKVKEMKEKSRVAMSENGSSYTSLAKLFEEIM

SEQ ID NO: 5410 - protein, 470 aa, Arabidopsis thaliana
MDQPHALLVASPGLGHLIPILELGNRLSSVLNIHVTILAVTSGSSSPTETEAIHAAAARTICQITEIPSVDVDNLVEPDATIFTKMVVKMRAMKPAVRDAVKLMKRKPTVMIVDFLGTELMSVADDVGMTAKYVYVPTHAWFLAVMVYLPVLDTVVEGEYVDIKEPLKIPGCKPVGPKELMETMLDRSGQQYKECVRAGLEVPMSDGVLVNTWEELQGNTLAALREDEELSRVMKVPVYPIGPIVRTNQHVDKPNSIFEWLDEQRERSVVFVCLGSGGTLTFEQTVELALGLELSGQRFVWVLRRPASYLGAISSDDEQVSASLPEGFLDRTRGVGIVVTQWAPQVEILSHRSIGGFLSHCGWSSALESLTKGVPIIAWPLYAEQWMNATLLTEEIGVAVRTSELPSERVIGREEVASLVRKIMAEEDEEGQKIRAKAEEVRVSSERAWSKDGSSYNSLFEWAKRCYLVP

SEQ ID NO: 5411 - protein, 514 aa, Cephalotus follicularis
MHAIEFQPRLLFSYILINQTTYVDQPKTMRKFELLFISIPGVGHLVPIVEFSRRLTNHDRRLSATILVTTLNDAPILDAYIQSRTSTTSDIKFLRLPPLDPLSPDQYQTSSAYISIFIDKHKPHVKHAITSLMMSTESDSVAVAGFFVDMFCTAMIDVANELGIPCYLYFPSPASYLGFTLHLPTLDTQLATEFVDSETGLIVPRNPQTELNVPSFVNPLPPLVLPTRVLRRKEDGYFWFLYHARRYIETKGIVVNTFRELEPHAIGSVSISGRGVPPVYPVGPVLDLDGPAQWHPYRDRQESIMRWLDDQPPSSVVFLCFGSKGSVDGAQVKEIALGLDRAGFRFLWSLRKPAKGETDLPGEYTNLEEVLPNGFLVRTEGIGLVCGWVPQVTILAHEAIGGFVSHCGWNSTLESLWYGVPIATWPLHSEQQLNAFQLVKELGLGVEIRLDYREGSDLVSAEELQRSIKQLMDGDNELRRKFKEMKEKSRLAVMENGSSYQSLTTLIEELTTHI

SEQ ID NO: 5412 - protein, 201 aa, Cephalotus follicularis
MDSDKLQPIAVCHVVAMPYPGRCHVNPMMNFCKLLVSRKNDILITFVVTEEWLGYIGSDPKPGEKQIAEQCCHLKVLCHSSVGGFWTHCGWNSTLEAVYAGVPMLTFPLFLDQGPNSKQIVECWKIGRRVSAELGPENLVTRKQIAEQVRRFMDLESNEGKEMRRRARELHNVCRQGIAEDGSSTTNLDAFIRGISPGHGG

SEQ ID NO: 5413 - protein, 475 aa, Morus notabilis
MAKPRFLLVVFPAHGHVNPALQLARRLVLIGCEVTFVTTVRAHRRMITKGGGTDDNNDNNFTPPNGMSFTQFSDGYDDGFGPKAIDFTVYSLELRSRGSQALIDLVDSSKNEGRPYTCMIYTFIMPWVADVAAKLGIPVALFCVQTATVFDLCYYYFHGYGDLIRDKMVNDISCSLGFPGLPLDFAVRDLPSFLDASDSKLGSLVQLFQEQFDVIGQESQPKILVNTFDALEPEALRALCDNYKLNLIGIGPSINPVELRNSDDKNYKISKWLNSKPKGSVIYVSFGSIAVLTKPQMEEIAKGLLDFGRPFLWVIRENDNKNKDERGGGEEEEKVSFKEELEKVGKIVPWCCQVEVLSNNALGCFVTHCGWNSTLESLVCGVPVVAFPQSVDQLTNAKLIEDFWKTGVKVKANEEGIVEGQEIKRCLESVMGGEEMRRNAQKWRDLAWEASKDGGSSDTNLKAFVSDVIGLKTIS

SEQ ID NO: 5414 - protein, 482 aa, Unknown
  Description of Unknown: Oryza sativa Japonica Group sequence
MGSHGDDGGGGGAHVLLLPYPSQGHVHPMLQFAKRLAFHGMRPTLAVTRYILATCASPDAAAAGAVRFATISDGCDAGGFGECCDDDGGGGVTAYLSRLESAGAATLDKLLRDEASDSGGRRPVRVLVYDAFLPWGRPVAARHGAAAVAFFTQPCAVNVVYGHVWCGRLRVPVEAGDGEDGGGGAVALPGLPALSPEGLPWFIKVGPGPYPAYFDLVMKQFDGLELADDVLVNSFYELEPEEAAYMASAWRAKTIGPTVPAAYLGDGRMPGDTKYGFHLFELTTAPCVAWLGAHPPRSVVFASFGSLSDLDPAEMREVALALLDAGAPFLWVVRSSESHKLPAGYAAAAAAANGMVVSWCPQLEVLAHPAVGCFLTHCGWNSTAEALVAGVPMVALPQWTDQPMNAEYVEAVWGAGVRVRPAAAAGLAARAEVARGIEEVMRGERSGEYRRNAAAWMEKARAASREGGSSDRNIAEFVAMYG

SEQ ID NO: 5415 - protein, 469 aa, Ricinus communis
MKKPELVFVPIPGAGHLTSAVEAAKLLLDRDARLSISILILRRSSDGKVVSDLIDSLTATTTTRRIQFINLPVEDTESMGLNFIEKYKPHIREAVSKLASRSDFTLAGFVLDMFCMPVMDVANEFGVPSYVFFTSGAAFLSFMLHIQALHDEQDMDPTQFKNSDDELALPCFINPLPARILPSVVLEKEWISLFLGMARRFKEAKGIVVNTFMELESSALNSLSDGTIRSPPVYPVGPILNVKGGDSVKSDGSKIIMEWLDNQPPSSVVFLCFGSMGGFREDQAKEIAFALEGSGQRFLWSLRQPSPTGKMTGSTDYQNLERSLPEGFLDRTAGIGMVIGWAPQVAVLAHPAIGGFVSHCGWNSTLESIWYGVPIATWPMYAEQQFNAFQLVKELGLAVEITVDYRKDSDVIVKAADIERGIRCVMEHDSEIRMKVKDMSEKSRKVLMDGGSSFSSLNRLIEDIVDNMP

SEQ ID NO: 5416 - protein, 465 aa, Fragaria vesca
MAPVSNQVGGHVAVLAFPFSTHAAPLLNIVCRLAAAAPSTLFSFFNTKQSNSSILAGNTSVLRYSNVSVCEVADGVPEGYVFVGKPQEDIELFMKAAPDNFRRCLEASVAESGREVSCLVTDAFFWFGAHMADDMGGVPWVPFWTAGPASLSAHVHTDLIRNTTGGGGHDEKETITVIAGMSKVRPQDLPEGIIFGNLESLFSRMLHQMGQMLPLATAVFINSFEELDPVITNDLKSKFKRFLNVGPLDLLEPPASAATTTPQTAEAVTGDGCLSWLDKQKAASVVYVSFGSVTRPSPEELMALAEALEASRVPFLWSLRDNLKNPQLDEFLRKGKLNGMVVPWAPQPQVLAHGSVGAFVTHCGWNSVLESVAGGVPLICRPFFGDQKLNARMVEDVWKIGLRLEGGVFTKNGMLKSLDMLLSQDEGTKMRNKINTLKQLAQQAVEPKGSSTRNFESLLEMTTTN

SEQ ID NO: 5417 - protein, 486 aa, Medicago truncatula
MTDGICSYITNHSIPMAKTIHIAVIPSPGFSHLVPIVEFSKRLVTNHPNFHVTCIIPSLGSPPDSSKSYLETIPPNINSIFLPPINKQDLPQGVYPAILIQQTVTLSLPSIHQALKSLNSKAPLVAIIADIFAQETLDFAKEFNSLFYLYFPSSAFVLSLVLHIPNLDEEVSCEYKDLKEPIKLQGCLPINGIDLPTPTKDRSNEAYKMLLQRAKNMHLVDGILFNSFLELESSATKALEQKGYGKIGFFPVGPITQIGSSNNDVVGDEHECLKWLKNQPQNSVLYVSFGSGGTLSQTQINELAFGLELSGQRFIWVVRAPSDSVSAAYLESTNEDPLKFLPIGFLERTKEKGFILASWAPQVEILKHSSVGGFLSHCGWNSVLESMQEGVPIVAWPLFAEQAMNAVLLSDGLKVAIRLKFEDDEIVEKDEIANVIKCLMEGEEGKRMRERMKSLKDYAANALKDGGSSIQTLSHLASQWENFGGT

SEQ ID NO: 5418 - protein, 469 aa, Barbarea vulgaris
MTNLEDDDNGTKLHVAMFPWLAFGHMVPYLELSKLMVQKGHTVSFISTPRNIDRLLPRLPENLSSAINFVKLPFSGGNKLPDDGEATTDVPFDLIPYFKIAFDGLQIPVTKFLESSKPDWILHDFAPYWLPPISRRLGIKTGFFSAFTGASLGIIKPPGFEEYRTSPEDLLTPPKWVPFETPVSYRLFECRFIFNGFLVEPIEGNVSDVHRFGGVIDGCDVIAIRSCYEYEAEWLRLIQDLHRKPVIPVGVLPPKLEEKFEDTDTWLSIKTWLDTHNKTSVVYVAFGSEVKLSQTELNEIAFGLELSGLPFFWVLKTQRGPWDTEPVKLPDGFEERTADRGMVWRGNWVEQLRILSHDSIGLLLTHPGWGTIIEAIRFAKPMVMLVFLYDQGLNARVVEEKEIGYMIPRDESEGFFSRESVAKSLKLVMEEDEGKVYRENVKDMKKVFGDMDRQDRYVDSFLDYLVTHR

SEQ ID NO: 5419 - protein, 469 aa, Clitoria ternatea
MALQHFLIVTFPAQGHINPALQLAKKLIAMGAQVTLPITLYVYNRIANKTTIPGLSLLPFSDGGYNTAGGGANYKLYVSELRRRGSEFVSNLILSSAKEGQPFTCLVYTLLLPCAADVARSFNLPFALLWIEPAAVLDILYYYFHDYRDYINQKTQKSSSCSISLPGLPFSLSSCDIPSFLLVWKTSVFSFVLESFQEQIQQLDLETNPTVLVNTFEALEPEALRAVDKLNMIPIGPLIPSAFLDGKDHTDSCFGGDLFQVSNDYVEWLDSRPEKSVVYVAFGSYFELSKRQTEEIARALLDCGCQFLWVIREKKDSQVDGTKSEEEMSFREELGKKGKMVTWCSQMEVLSHPSLGCFLSHSGWNSTMESLVSGVPIVAFPQWTDQKTNAKLIEDVWKIGVRVDDHVNEDGVVEAEKIKRCLEVVMGCGKKGEELRKNAKKWKALARDASKKGGSSEKNLRVFLDAVAQ

SEQ ID NO: 5420 - protein, 287 aa, Unknown
  Description of Unknown: Oryza sativa Japonica Group sequence
ECTNDVPSDKFELLWKAFDALAPPFAEFLGAACVGTRALPAGGDVHEKAACPPRPSAAVARRRTPPHRRDGRRRHHAVAGRAAARFSGVRRAGERGAVRVELVHELALRLELAGTRFLLALRKPCGVDDSDVLPLGFLEQTHGHGHVAMGWVPQTTILAHAAVGAFLTHCGRNSLVEGLLFGKPLIMLPIVGDQGPNAWSMEGNMVGLQVRRDENDGSFDRHGVTAAVRAVMVEEETRSVFVTNALKMQEIVADRELHERYIDGFIQQLIFHVADGNSDTAAPDPSS

SEQ ID NO: 5421 - protein, 270 aa, Vigna unguiculata
MPVMDSADLPWGGVAKIFFSHIVKEMKNLEFGEWWLCNTTSDLEPGAVTISPRFLPIGPLMESDTNKSSFWEEDTTCLTWLDQQQPQSVVYVSFGSLATLEPNQFKELALGLDLLKRPFLWVVRPSSDKNKVNNAYPDEFHGGKGKIVKWAPQKKILNHPAIACFISHCGWNSTLESLCSGIPFLCWPFFSDQFFNRSYICDVWKVGLRLEKDENGVIVKGEIRKKVDQVLEDGDIKARSLKLKELLVVDNSVKGGQSSKNLEKFINWAK

SEQ ID NO: 5422 - protein, 522 aa, Spodoptera litura
MEKLKYFLFCVLISLCSCNAYKILAVFPVPSPSHGILGDNMVKHLLNAGHEVTYITPFASRQKSNPKLNIVDVTDHHSFFNPDVLDITQIMTGAVNFNDHDVVFAMMVHIATMTLGHENVQKLMRDPQQKFDVIIGEYMFADLYSTFPAVFQCPYIWFSTVEPHWMVVNLVHSPMNPAYNGDYMYASIPPFNFMQRVQELWRLLFGLYRHNNEYYKREEAVYLKHIVPILKEQGKPVPDYNVLKYNASLLLGNSQVAIGNAVPLPPSYKHIGGYHIDDEVKPLPENLKKILDNSKNGVIYFSMGSNLKSKDLPDELKKGLLEVFGGLKQTVLWKFEENLPNQPKNVHIVQWAPQQSLLAHPNLKLFVTHGGLLSLTEAVHFGVPVIAIPVFADQFLNANQIQHKGIGEKLDLSYNLHKDLKVALDKVLADLPKYTAKIKEISVAYHDSPMKPKEALNFWVEHVVRTRGAPHLRSVALQVPLYQQAYLDLLAVILAATVVILLLVKKMLCYLKSQESIKQKKN

SEQ ID NO: 5423 - protein, 479 aa, Medicago truncatula
MCSLGTTKNVPHVVCVPYPAQGHINPMLNIAKLLHFKGGFHVTFVNTEYNHKRHLKARGPDSLNGLPTFRFETIPDGLPESNVDSTQDIPSLCESTRKTCLPHFKNLLSKLNDALDTPPVTCIVSDGVMSFTLDAAQELNIPQVLFWTTSACGFMCYAQYRQLMEKGLTPLKDWSDMTNGYLETPIDWVPGIKEIRLKDLPSFIRTTDPNDPMIEFMSRECQRAQKASAIILNTFDALEHDVLEAFSSIFPPIYSIGPLNLLLKDVTNEELNSIGSNLWKEDSKCLKWLNNKEPNTVVYVNFGSVTVMTKEQMIEFAWGLSNSKKPFLWVIRPDLVAGENAVLPLEFLEETKDRGLLSSWCLQGEVLAHSAIGGFLTHSGWNSTLESVCAGVPMICWPFFAEQQTNCRFCCNEWEIGLEIEDAKRDKIESLVKELLDGEKGKEMKAKALQWKKLAHNAASGPHGSSFMNLENLFRDVLL

SEQ ID NO: 5424 - protein, 337 aa, Oryza sativa
SPATVVLIPFCVPGHLTPMLEVGKRMLRVGFCGNADDGRGAMSLTVLLAQLPEFVRAPDHEETIRREAAGASEHSGFDVRFHCLPAEELPDFRGGEDFMSRFMQQHASHAREAIAGLESRVAAVVLDWFCTTLLDVTRDLGLPGYVFFTSAASMLSLLLRLPALDKEVAVDFEEMGGAVDLPGLPPVPAALLPTPVMKKGCNYEWLVYHGSRFMEAAGIIVNTVAELEPAVLEAIADGRCVPGRRVPAIYTVGPVLSFKTPPEKPHECVRWLDAQPRASVVFLCFGSMGSFAPPQVLEIAAGLERSGHRFLWVLRGQPAAGMPYPTDAVVDELLPEG

SEQ ID NO: 5425 - protein, 278 aa, Cephalotus follicularis
MLHHAKRYKLAEGIMVNSFPELEAGAIKALQEKEPGKPPVYPIGPLVKMGSSGNTDDSDCLKWLDNQPHSSVLFVSFGSGGTLSSDQISELALGLEMSEQRFLWVVRSPNDKVANATFFSVESGHRDPSDFLPKGFLERTKGRGMVVPSWAPQAQVLSHGSTGGFLTHCGWNSTLESVVNGVPLIAWPLYAEQKMNAVMLTEDIKVALRPNASESGLIGRVEITRVVKALMEGEEGKMVRYRMKDLKDAATKVLSEDGSSTKALSELAHKWSRNQKSC

SEQ ID NO: 5426 - protein, 395 aa, Citrus unshiu
MSLYVPFTRATKLMQPHFERALESLPHVSFMVSDGFLWWTLDSANKFGFPRFVFYGMNNYVMCVSSSVGANRSLSGVQSDDELVTPPEFPWIKITKKDFDPPITDPEPKGPQFELFIDQIVSTSNSYGMIVNSFYELEPLFADHCNRVVKPKSWCVGPLCLAELSPKNEEPKNELSKPAWIRWLDRKLDEGSSVMYVAFGSQAEISAQQLKEIATGLEQSKVNFLWVIRKAESELGDGFEERVKGRGLVVRDWVNQKEILWHESVQGFLSHCGWNSALESICAGVPILAWPIMADQPLNARMVTEEIKVALRVETCDGSVRGFVKWQGLEKTVRELMGGEKGEKARTKVKELSEIARKAMEEEKGSSWRCLDMLLDETCKYEQQLHDDKNNYEGR

SEQ ID NO: 5427 - protein, 743 aa, Unknown
  Description of Unknown: Oryza sativa Japonica Group sequence
MADSDGSVHVLLLSYPAQGHVNPLLQFGKRLAAHRRVRCTLAVTRSLLNSCCRAPPSPGGGGGVHVATYSDGCDARGYDELGDEGAYLSRLESAGSATLDELLRGESGEGRPVRAVVYDAFLPWAAPVARRHGASCAAFFTQACAVNVAYAHAWAGRVELPLPTSAPAPPLPGVPPELEPADFPTFLTAPAAGRSAYLDLLLRQCQGLEVADHVLVNSFHELQPKEAEYMAATWGAKTVGPTVPSAYLDGRLPGDASYGFDLHTPMAAESKAWLDERAASSVVYVSFGSLATPSAVQMAELAHGLRDSGRFFLWVVRSSETGKLPDGFAGETAAKNTTGLIVPWCPQLEVLAHGAVGCFVTHCGWNSTVEAVSAGVPMVAVAQWSDQPTNARYVEEAWRVGVRARADGEGVVRKEEVARCVAGVMDGETGMEFRTNAARWSAMARAAMSQGEKDLKQCLGIGSAQKNIDLPVAVRKNSAGKKDDLAVKAITKSGAETKMGVVMGTWKSEEPFAAAAALQASEKQEPHQSPIHLNQVEFSIGSGLGHNYKSVRKIRCYGTAVGTGTARYQNPGRWIWPDLTAGRVWYRAVPILSLCSTTRRTEVEGQKRNFACNNRIGRDGRAARTLEALGFLIDRRRRLLEVNSAVAAAASGKDDIDAATVAGNDKFAAAVACFNVAAATVAGKDDIDAAAAGKEDIDAAATGNDEFATAAAYFNTAAARKDEFVAAAAACFNACRNPPLAAT

SEQ ID NO: 5428 - protein, 470 aa, Rosa chinensis
MAGMKQSIVLYPASPGSHHMVSIVELGKLISQRHPNLSITVLLDTSSPLAKSSYINHLLSSNSDPDQARISFFTLPALNLPQPDAQTRPERVHQLRLQTVPSVLQALKTISLTSKVLAFITSLWHHPYDPEIPTYYYFTSCASVLALFLYFPTVHDQTPESFKDRNDDVVEYPGLPALRGSQMPDPILDRNEAEYDFFLYFASYLPKAKGIITNTFQELEPRAIKAIKEGVCVPNHQTPPLYHIGPLISDSENRSIQGGSPMPTNCSTLWLDKQPSRSVVFLCFGSRGTFSEEQFKELAIGLERSKLRFLWVVKSQLDLEVLMPQGFLERTKDRGLVVTSWAPQVAILSHESVGGFVTHCGWNSITEAVTYGVPMVAWPLYAEQEVNSVVLVEEMKLAIPIFEVPSKSKQGSVSADEVEKKVLRLMDMESDEGKSLRERCQAVKAMGLAAWRNGGSSFTSFSELVSSWMH

SEQ ID NO: 5429 - protein, 477 aa, Cephalotus follicularis
MKRAELIFIPTPGIGHLVSTLEFSKRLIERDDRISITVLVMKFPIATFVDAYTKSLTASQPRIQVIDLPLVDPPPPTLVQKSRHRYLCSFIESCIPNVKNVIKNIVTSSDSSSGSVQVAGLVLDFFCVSMIDVANEFGLPSYMFLTSNAGFLDLMLYLPTRHDQISFEFEKTDPEILLPGFANPVPPCVLPDGLFNKEGGYSTYIKLAQRFKDVKGIIVNTFIELETYTVNSFSHAQIPHVYPVGPVLELKGQPHPDTNQAEYDKIMEWLDDQSQSSVVFLCFGIMGSFEVPQVREIALGLEQSGYRFLWSMRVPPTKAEASVTSPYTSYEDMLPEGFLERIKGRGKTCGWAPQVKVLAHKAIAGFISHCGWNSILESLWHGVPIVTWPIYGEQQLNAFMMVKEFGLALKFRLDYRRDGQLVTGDDIERAVRCLMDGDEELRKKVRDMSEMGRKALVDGGSSFNSIGQLIEDMIGRS

SEQ ID NO: 5430 - protein, 291 aa, Helianthus annuus
MIQLSTSMPLMDPANFVWACMGDPDPVANQIIFDYLFLEGKDAAEAADHIICNSSMELEPGAFTLFPKMLPIGPLLATNNATRQVGHLWKEDSTCLTWLNQQPVCSVIYVAFGSITIFDQLQFEELALGLEDTKMPFLWVVRPGPSGNMDYVYPSGYLDRIGSRGKILSWAPQQEVLNHPSVACFMSHCGWNSTMEGVSNGVPFVCWPYFADQFFNKTYICDIWKTGVGLNKDETGIVTRGEIKSKVEQLVNNDIHKANALNLKEKLTDCLREGNSSNKNLNKFIDWLKEG

SEQ ID NO: 5431 - protein, 482 aa, Vigna angularis
MAGAHVVMFPCPFQGHVQPMLKLAELLALHHLHVTFINTHSIHNRLTRYGDIQSLSASYPTLHFNTIADCYSHGNHTGSGDTSGDIILSTTLHAKPLLRNILLAQSPEIPKVTCIIQDGILGSLSNDLASELGIRITIIHFRTSSPCCFWPYFWLPNLFKTNELPIRGDEDMDRIITNMPGMENLLRCRDLPSFCRPGAKGNMSIDWVSFQTQQSLAADALILNTFEELDRLVLSQIRLHFPKVYTLGPLHHHLNVRKAETNGANDAPSFRSSFFEVDRSCMAWLDAQAQGSVLYVSFGTSTIVTREELMEFWHGLVNSKKRFLWVMRPDLVVGRENDDRIPEEVEEGTKERGLMVEWAPQEEVLAHKAIGGFLTHSGWNSTLESLVAGVPMICWPYFADQQVNSRFVSEVWKVGLDMKDVCDRDVVEKMVNDLMVHRRDEFLKSAQAMAMLAHQSVSPGGSSHSSMQDLIHYIKSVSKENN

SEQ ID NO: 5432 - protein, 483 aa, Medicago truncatula
MVLPANINDVPHFVLFPLIAQGHIIPMIDIAKLLAQRGVIVTIFTTPKNASRFTSVLSRAVSSGLQIKIVTLNFPTKQAGLPEGCENFDMVDSIDMRMNLFHAITLLQKPAEELFDALTPKPSCIISDFFIPWTIQIAENHKIPRISFHGFSCFCLHCMLKIQTSKILERVDSESEYFTVPGIPDQIQVTKEQIPGILKGELKEFGEKMHDAEMKSYGEIINTFEELEKAYVKDYKKEKNGKVWFVGPVSLCNKDGLDKAQRGIIASISEHHCLKWLDLHQPKSVVYACLGSLCNLIPSQLMELALALEATNRPFIWVIREGNKSSEELEKWISEERNKGRGLIIRGWAPQVLILSHPSIGGFLTHCGWNSTLEGISAGLPLVTWPLFADQFLNEKLVTQVLRIGVSLGVEVPMRLGVEESLGVLVKKEGIKEAICMVMDEGEESKERRERASKLSEMAKRAVEKGGSSHLNINLLIQDIMEQ

SEQ ID NO: 5433 - protein, 473 aa, Amborella trichopoda
MGAISYWSPSQDKAMLSQQSDLLAASNASLLVSLATNKTVGQQMHDASAAGPVGPISFETFSDGLGMPDNNQHDLDKFMAQLNCAGPEGLAALINDLQARGRPVHYVVSNPFMPFVVDVAEGFGIPCAMLWIQSCAVYAVYYRSLYRLGEFPTPERPNIDISLRGLPVLKTNELPSFLVPFAPYQCLADAILCHIRKINKVKWVLANSFHALETEAIRSMSELTPIMPVGPLVPSKLLGKSTASEMQGDLWKPEDDCLNWLSTQPREFVIYVAFGSVVSLPPKQIEELAWGLASSGRPFLWVGKPVASTSKFLLPDGFLDATAGRGKVVKWCPQVEVLTHPAVACFVTHCGWNSTLETIAAGTPILAFAHWGDQVTNAKFLVDVFGVGVRLERDAEGVVRRDEVCRCIEEIREGPRASKMRENAMKLKEAAREALEEGGSSYKNLRVFVENLMSLALEVQAIRVRLPEDQSPD

SEQ ID NO: 5434 - protein, 460 aa, Medicago truncatula
MKDTIVLYPALGSGHLMSMIELGKLIVTHHPSFFITILILTPPNKNTLSPQEQYIASVSSTFPSINFHYIPLISPPTTLPPPPLLTLELSHQSNNYVHNILQSISKTTNLKGVILDFLTYNASKVTTKLEIPTYFYFTSGAIVLALFLHYPTIHQNATKPIKDLHTPLRIPGLPKNISTDDYPDEAEFFLESAKTMRQCDGVIVNTFDAIEGKANKALNEGLYIPDGTTPSIFCIGPLITASYGEDENECLSWLESQSSQSVVLLSFGSMGRFSKAQLNEIALGLEISEQRFLWVVRSELDLEEQSLDELLPEGFLERTKQKGMVARNWAPQGAILKHDSIGGFVTHCGWNSVLEAICEGVPMVAWPLYAEQRLNKVILVDEMKVALELKDSKDGFVSGTELGDRIKELMDSDKGKEIRKIIFKMKISAKEAREEGGSSLVALNNLAQLWKQKKQPSMAN

SEQ ID NO: 5435 - protein, 483 aa, Dianthus caryophyllus
MVAEPHRLHIVMFPFLAHGHMIPTLDIARLFAARNVEVSIITTPVNAPIFTKAIETGNPLINVELFKFPAKEAGLPEGCENAEIVIRQPELIPQFFKATHLFQQQLEEYLDRVRPDCLVADMFYPWATDSATKFNLPRLVFHGISCFALCAQESVSRYEPYRNVSSDDEPFALPGLPHEIKLIRSQISPDSRGDKENSSKTTTELINDSEVESFGVIMNSFYELEPEYAEFYAKDMGRKAWHIGPVSLCNRSNDQKALRGKRASIDDHECLAWLDSKEPNSVVYVCFGSTSVSIAPQLREIAMALEQSGKNFIWAVRDGGNGKNEEWLPLGFEERTKGKGLIIRGWAPQVLILDHKAVGAFVTHCGWNSTLEGISAGVPMVTWPLFAEQFFNEKLVTNVLRTGVSIGVKKWNRTPSVEDLITREAIEAAIREIMEGEKAEEMRLRAKKLKEAARNAVEEGGSSYNHLSTLIDELRKYQTQKRN

SEQ ID NO: 5436 - protein, 467 aa, Vigna angularis
MKDTIVLYPNNGRGHLVSMVELGKLILSHHPSLSITILILTPSPNATFTLACNSNAQYIAAVSATIPAITFHSVPMAQLPLDNPSLPPHLISLELSRHSTQNVALALQSLVKASNIKALVMDFLNFSNPKILTENLTTNIPIFFYYTSAASSLVVLFHFPTTLPKQVKDQQFQLHFPGLPAISTDVFPNETFDPLSYTNQIFRRIAEAMKRSSGIIINTSEAIEEKAIAVLNDNRMLPPLFFVGPVISAPYGEEDKGCLSWLESQPSQSVVLLCFGSMGWFSRRQLMEMAIGLEKSEQRFLWVVRTELEGGDSLEEKPSLDELLPEGFMDRTKEKGLVVRDWAPQREILSHDSVGGFVTHCGWNSVLEAVCEGVPMVAWPLYSEQKLNRVFMVQEMKVALALKEEKDGLVSGSEFGERLKELMESDTGKEIRQRVFKMKLSAAEELGEGGTSRVALDRLAMLCKRVM

SEQ ID NO: 5437 - protein, 476 aa, Sesamum indicum
METASAAPSPSHIAVLPSPGMGHLIPIVEFAKKLLHHHRISTTLIMPTDGPLSNAQNTLFSTLPPGIDYILLPTLNFDDLPPDVKIETRISLTVTRSLPSLRDAVKSLLERTPLAALVVDLFGTDGFEVALEFKIPPYIFFPSTAMALSLFLYLPKLDETVSCEYREVAEKLLIPGCTPIDGRDLLDPLQDRKNDAYKWVLHHTKRYRMAEGIILNSFKELEPGAIEALQEKEDRKPVVYPIGPLIQTGPKPEVDESCVCLKWLDEQPRGSVLYVSFGSGGTLSHDEMVELALGLEMSEQRFLWVARCPNDTTANATYFNIQSSNDPLAYLPDGFLERTKGRGLVVPTWAPQAHILGHESTGAFLTHCGWNSILESVVNGVPMIAWPLYAEQRMNALMLHEDVRVALRPKAGENGFVGRDEIAKTVKGLVEGEEGKEIRSRMRDLKDAAAKVLSVNGSSTKILAELAGRWKSNTCI

SEQ ID NO: 5438 - protein, 461 aa, Eucalyptus grandis
MNHQHFLIISFRGQGHLNPTIQLAKRLVWAGAQVTYANAVDGRNVRTIKTPISMEGLSHTSFSVTDDDAGEPSSYEDRISEIKRVGSRNLRELIVSLSEKDRPVTFLIYTVLLPWAADVARDLGVPSAFLSIQSAAVFAIYHHYFNSRSGFYQSSKNEPPTTISLPGLPPLTPEDLPSFLLPTDPNFPIVPTFQEHILTLEKETNPCVLLNTFDALEEDLIKAGMENMKLFAIGPLIPLAYLDNKDRPLDNSFGCDLFDCSTDYLQWLDSKPASSVIYVSFGSLAVLKKNQMEELCQGLRESGQPFLWVIRPSNTSEQEEIDTMIKGRIDGDSGLIVPWCLQVEVLNHKSIGCHVTHCGWNSTLESLTAGVPMVACPQFSDQLTNAKLIQDVWGVGVKARADGEGVVGREEMKRCLDLVMGPTHEEGMRESASKWKALARRAVKESGSSDDNLRLFMAGLK

SEQ ID NO: 5439 - protein, 449 aa, Helianthus annuus
MGHAGQLVARHMVKTFDHITATVLVIKLPGDEIGTDYTNSFTDHIQINFIHFPPMDLHLFQQCPTLGFRVDAVINHHKPIIRDLVASASTGPGPMGALIVDMFCTTIIDVAKEFNLPAYVFFTSNAAFLGTMFHFQTLQDELGQDISELSHSPTELQVPSYANPVPPSVVPNVLLDRDQWSKRFLCYARKYREANGIIVNTFQELEHHALRWYDGNTPPVYTVGPLIKPKKPTPDHEVLQWLKGQPESSVLLLCFGSRGWFGVDQVRGIAVAIERSGCRFIWSLRRASPEELNGFPDEYADYNEVLPDGFLERTAEKGKVVGWVPQAEVLVDMATGGFCVALWVELVTGEYLVRVPVATWPIYAEQQLDAFQMVKDLGLAVEISLDYNQMNKDQQLVSAETIEKGIREVMDRNSAVRAKVKEMSAKSRMAMEEGGSSFESLRRLVDDIM

SEQ ID NO: 5440 - protein, 467 aa, Elaeis guineensis
MEDPIQQHILVATYAGQGHINPALRLATQLARTIPGARVTFSTTVYGHRRMFPSAASDGEVSDGRLSYLPFSDGYDDGFKDLIPKFDQYMIQAKLNGSRNLSNLLGDLTARGRRVTCLIYTILLPWAADVAREHGIRSFLHWIQPAAVFAIYYHYFHGYEGVVASHREDPLFEVEFPGLPPLRMRDLPSFFAISADDPFHSVLLMLREEFETLDREKTESTKPWILVNTFDALEADALAAVDAMHLLPVGPLLPSPEETISEGDMFQLDGKRYMEWLDSKPEKSVVYVSFGSLSVIRKQQLEELSNGLEECGRPYLWMVRKDNRGEGVELEKGENGMVVEWCSQVQVLSHPSIGCFVTHCGWNSTLESLACGVPIVGAPQMSDQAMNARLAEDAWGTGVRAEANNEGVLEGTELRRCLEVVMGEGEKGAEIRRKAKKWRDRVREAVASGGSSDRNLRAFVEEIGKGS

SEQ ID NO: 5441 - protein, 357 aa, Citrus unshiu
MPYPLQGHIKPMMSLAELLGSANFQVTFVNINHNHDLLLRNTDITSFCNRFPNFQFKSIPSGLPANVIRSGLTAKDVFDAMKAVSKPAFRDLLISLEELQIPLLALRTHNASYSWIYFHLPKLIEDGLIPFPDENMDKPIAGIPGFENFLRNRDLPGTCRVKTSDDDYLLQFFIEETFAMTRASALVLNTFEIEAPIVSLLGFHFTKIYAIGPLHKLQKSRMKDINSPSVSSSGILQKEDTSCMTWLNSQPPKSVLYVSFGSLVGLTREQMSELWHGLVNNGQSFLLVVRPDLILGEPGAGETPLAQNEGTEERNRFIVSWALQEEVLAHPAVGGFLTHGGWNLTLEGIAAGVPMIC

SEQ ID NO: 5442 - protein, 486 aa, Populus trichocarpa
MGSLGHQLHIFFFPFLAHGHMIPTVDMAKLFASRGVKTTIITTPLNAPLFSKTIQKTKDLGFDIDIQTIKFPAAEAGLPEGCENTDAFITTNENAGEMTKKFFIATTFLQEPFEKVLQERHPDCVVADMFFPWATDAAAKFGIPRLVFHGTSNFALSAGESVRLYEPHKKVSSDYEPFVVPNLPGDIKLTRKQLPDFIRENVQNDFTKLVKASKESELRSFGVIFNSFYELEPAYADYYRKVLGRRAWNVGPVSLCNRDIEDKSGRGKEASIDQHECLKWLDSKKPNSVVYICFGSMASFPASQLKEIATGLEASGQQFIWVVRRNKNSEEDKEDWLPEGFEERMEDKGLIIRGWAPQVLILDHEAIGAFVTHCGWNSTLEGITAGKPMITWPVSAEQFYNEKLVTDVLKTGVGVGVKEWVRVRGDHVKSEAVEKAITQIMVGEEGEEKRSRAIKLGEMARKAVEEGGSSCSDFNALIEELRSYRP

SEQ ID NO: 5443 - protein, 468 aa, Populus euphratica
MAVQPHFLLLTYPAQGHINPALQFAKGLTRIGVLVTLVTSLSAGRRMSKTLFPDGVSFVTFSDGYDDGFKPEDDRDHFTSELKRRGSQTLNELIVDSAKEGKPVTCLVYTMLLQWAAEVARAQHLPAALLWIQPATVFDIYYYYFNGYGDIFNNCKDTSYAIELPGLPPFASRDLPSFVLPSNTYTFAIQMFQEQLEQLSQETNPKVLVNSFDALELGAMSATEKFNLIGIGPLIPSAFLDGKDPLDKSFGGDIFQGSEDYTEWLDSKTKSSVVYVSFGSFLVLSKQQIEEIARGLVDSGLPFLWVIRDEQKKNEEKEEEEDHPSACREAILERQGMIVPWCCQVEVLSHPSIGCFVTHCGWNSTLESLVSEVPVVAFPHWTDQGTNAKLIADVWKTGVRVAANEEGIVKGDEIKRCLDLVMAHGKMGEDIRKNAKKWKDLARDAVKEGGSSDKNLKAFVQEVGQGCF

SEQ ID NO: 5444 - protein, 385 aa, Cephalotus follicularis
MMHMLAQLHDPIVNWFKNHPSPPVAIISDMFLGWTHDLACKLGIQRIVFSPSGAMALSTMYYLWRYMPIPNDPNDPNATVSLSTMPNSPTYPWWQISPLYRGFVEEGPNMEFVKDGFLGNISSWGLVINSFTDLEGLYLDHLMKELGHERVWAVGPLLPTPDNDSSGLIERGGSSAVSVDDILYWLDTCEELKVVYVCFGSQAVLTNDQMKELALGLETSGVHFIWSIKEPTKGQVEGQYGMFPSGFEERVAGRGLVIKGWAPQVLILRHRAVGAFLTHCGWNSTLEGLVSGVRFLAWPMGADQFVDTALLVDELRVAIRVCEGAKTVPNSHKLAIALAESVSDNGVDERERAMGLRGAALEAIKEGGSSVKALDGLVKRLTELG

SEQ ID NO: 5445 - protein, 400 aa, Medicago truncatula
MPSTIETTLLNKPSISRSIEQFKIHFNNIDIQTIKFPCVEGGLPYELLLQQKPHCIVADMFFPRATDSAAKVGIPTIVFHATGNINMTRLQLPNIFTKIDAPKLMESEVRSYGVIINSFYELDGVYADYYREFIGKKEWHIGLFSVYNRDMDTSYRGKEPSINKHKCLKWLDTKDINLVVYVCFGSTNHFLNSQLKEISMGLKASWKDLVLVVKKKREDREKGLPEFEKIMKGKGLIIRGWPLQLLIFQHKAIGAFVTHCGWNLTLESVAAGVPMITWPIAFEEFYNEKLVTEVLKIGVPVGDKKVSGYHSVAILLTRIVIIREDEDIAQRLLHDYHVTTASDEISLISKLTYVFLRQHSEIILDNPSFSAGKLDYLEIMEEEDIGQHLLMTCYNRTSGK

SEQ ID NO: 5446 - protein, 483 aa, Solanum chilense
MTSGKKIELIFIPSPGIGHLVSTVEMAKLLITREKNMSITVLIIQSPHDNKLPSYIQSLTNFSSSLKFIHLPQDDTVLKLLKSNPFTSYIPAHKPAVRDVVAEIIKTQSNVTLAGIVIDLFCTSMIEVANEFELPTYVFYTCGAAPLGLQFHIQSLTDDFGRDITNYKDEPEAELSIPTYFNPFPAKCLPSVALDKEGGSAMFLDLTRRFRETKGIMINTFLELDSHAINFLSQDKNIPPVYPVGPVLNLNNVQGDNLSLSDQNMMKWLDDQPTSSVVFLCFGSGGSFTIEQVKEISYALENSGCRFLWTLRQPPQKDATLPGDYENFEEVLPEGFLQRTQGIGKVIGWAPQLAILSHKAVGGFVSHCGWNSTLESTYFGVPMATWPMYAEQQANAFQLVKDLEMAVEIKMDYRKEPTGKMGQKVIVKAEEIEKAIRELMDPENKIRMKVKEMKEKSREATMEGGSSYTSIGSFIQSIMENTP

SEQ ID NO: 5447 - protein, 470 aa, Brachypodium distachyon
MESVNTSPHSSDHEGGGGGGAHVLLVPLPAQGHMNPMLQFGRRLAYHGLRPTLAATRYVLSTGPPPGAPFRVAAFSDGFDAGGMASCADPVEYCRKFEAVGSSTLAQAIESETAAGRAPTVLVYDPHMAWVPRVARAAGVPVAAFMSQSCAVDLVYGEAWAGRAPLPMADGSALKRRGIVSIDLAAEDLSPFVVSPEIYPKYLDVSIRQFEALDDADDVFVNSFRDLEPLEAEYMEKRWRAKTVGPTLPSFFLGDDRLPSNKAYGVNFFSATAPCMAWLDRQPARSVVLASYGTVYNLESMELDELGNGLCDSGKPFLWVVRSSEAEKLSEQLLGRCKEKGLIVPWCPQLDVLAHNAIGCFLTHCGWNSTTEAIVAGVPMVAMPRSADQPTTAKYVESAWGIGVRVRADEKGLVKRAEVEGCIKKVMDGEMKDEFRGNAAEWMRKAKEAMQEGGSSDKNIAEFAAKYLER

SEQ ID NO: 5448 - protein, 316 aa, Arabis alpina
MKTNSFPNLEDLDQTVQLPALPLLEVRDLPSFMLPSFGSHFNTLMAEFMDSMKDMKWVLVNSFYELESEIVDSMTDLKPMIPIGPLVSPFLLGANEDETLDGKNLDLWKSDEYCMEWLDKQARSSVVYISFGSLFKSSENQVQSIATALKNRGVSFLWVIRPKESGENVDVLQGMIKEGQGVVIEWGPQERILSHEAISCFVTHCGWNSTMEAVVTGVPVVAYPSWIDQLMDARLLVDVFGIGVRMMNDEGDGELKVTEVERCIQAVTEGPTAADMRKRATELKHAARLAMAPGGSSARNRDSFISDITTITWLRT

SEQ ID NO: 5449 - protein, 472 aa, Clitoria ternatea
MSGHHFILVLFPAQGHINPAFQLAKRLIISFGARVTISTTLRMHRRLTNKPSLPSLSFLPFSDGFDDTAATANQSSLYASELKRRGSQFLTNLILSHAQEGHPFTCLLYTPLLPWAAEVARGFHLPTAILWTQPATVLDILYHYFHGYRDYINDKTKEDPSCSIELPGLPRVLMLTPRDLPSFLLNSNPSLDPLIVSMFEEQFNDLDVETKPRILVNTFEALETQALRAVDKFSMIPIGPLIPSAFLDGKDPSDTSFGGDMLHFSNGYVEWLDSMAEMSVVYVSFGSFCVLSKIQMEELARALLDSGRPFLWVIREKEKKVGETEEEEEELRCREELEQRGKIVKWCSQVEVLSHPSLGCFVTHCGWNSTLESLVSGIPMVAFPQWTDQKTNAKLVEDVWKTGVRVDHHVNEEGIVEGEEIKRCLEVVMGSGEKGEELRMNAKKWKDLVKETVKEGGSLEKNMKTFLDSVGS

SEQ ID NO: 5450 - protein, 462 aa, Arabidopsis thaliana
MGEEAIVLYPAPPIGHLVSMVELGKTILSKNPSLSIHIILVPPPYQPESTATYISSVSSSFPSITFHHLPAVTPYSSSSTSRHHHESLLLEILCFSNPSVHRTLFSLSRNFNVRAMIIDFFCTAVLDITADFTFPVYFFYTSGAACLAFSFYLPTIDETTPGKNLKDIPTVHIPGVPPMKGSDMPKAVLERDDEVYDVFIMFGKQLSKSSGIIINTFDALENRAIKAITEELCFRNIYPIGPLIVNGRIEDRNDNKAVSCLNWLDSQPEKSVVFLCFGSLGLFSKEQVIEIAVGLEKSGQRFLWVVRNPPELEKTELDLKSLLPEGFLSRTEDKGMVVKSWAPQVPVLNHKAVGGFVTHCGWNSILEAVCAGVPMVAWPLYAEQRFNRVMIVDEIKIAISMNESETGFVSSTEVEKRVQEIIGECPVRERTMAMKNAAELALTETGSSHTALTTLLQSWSPK

SEQ ID NO: 5451 - protein, 508 aa, Cicer arietinum
MQNATCKDYIINHLIHFYINKKNFIKLFTKLSMGNENNDLHIILFPFLANGHIIPCIDLARLFFSRGLKVTIITTHLNVPLISRTIGKSKINIKTIQFPSPQHTGLPEGCENSESALAPDKFIKFMKATILLREPLEHVLQQEQPNCLVSDMFFPWSTDSAAKFNIPRIVFHGLGFFPLCVLACIRQYKPQEKVSSYTEPFLVPNLPGEITLTKMQLPQVPQHDKVFAQLLEESNESELKSYGVIANSFYELEPVYADHYRNELGRKAWHLGPVSLCNRETEEKACRGRESSIDEHECLKWLQSKQPNSVVYVCFGSMTVFGDAQLKEIAMGLEASEVPFIWVVKKGAKSEGEKSEWLPEGFEERIKGKGLIIRGWAPQVMILDHECVGGFVTHCGWNSTLEGVCGGCSMVTWPMYGEQFYNAKFLSDVVKIGVGVGVQTWIGMGGGEVVKKDVIEKAVKRIMVGDEAEEMRNRAKEFGNMAKRAVEVGGSSYNDFNSLIQDLRSRAH

SEQ ID NO: 5452 - protein, 577 aa, Citrus unshiu
MVQGEPHILILPFPAQGHMRPMLKHVADDDMDREINSVPGVEAILRRRDLPSPCRSKEIDVPILQFFVNETLAVTRVIARSTIENMCLNSHKKLRFRALSMEQTRVPHVVLLPYPAYGHIKPMLTLAELFSHAGFRVTFVNTEQYHDRLLGNNDVTGFYKRFPNFRFTSIPDGLPPDNPRFGIYIKDWFCSDKPVSKLAFLQLLMSPGLLPTCIISDSIMSFTIDVAEELNIPIITFRPYSAHCFWSDFHFSKLAEEGELPVTNENFDKPVKCIPGLENFFRNRDLPSICRDGGPNDPILQTFIRDTSATTRTSALVINTFNEIEGPIISKLGSRLTKIYTVGPLHALLKSRIQEDSAESSPPESNNCVLSKEDRSCMTWLDSQPSRSVLYVSFGSFIKLGREQILEFWHGMVNSGKRFLWVIRSDLFDGEPGVGPVPVELDQGTKERGCIVSWAPQEEVLAHQAIGGFLTHSGWNSTLESLVAGVPMICWPQIGDQQVNSRCVSEIWKIGLDMKDTCDRSTIENLVRDLMDNKRDKIMESTVQIAKMARDAVKEGGSSYRNLDKLIEDIRSMAFKA

SEQ ID NO: 5453 - protein, 438 aa, Genlisea aurea
MTAADKPTLFFIPFPVFSHFVAAVKTAELLLERDNRLQINVLVLKFVVKNEIADFIKKKSTNQKPAVRDAVAGALNGRESNIPAGIVVDMFCTTMADVAEEFGIPSYVYFTCGAANLGMMFHAQSLVDDLGGDLSEFEDPGRFVAVPGYKNPFPTSVTPALILDKERRDYFLEMMRRFRRAKGILVNSFLELEDYAIKTLSEDTKLPPVYPVGPVLQDSGEEIRLDFKELMDWLDGQPDSSVVFLCFGTRGGGAFDDAQVKEIAAGIERSGRRFIWSLRKQSPHGPNFFPSDYETFDEILPAGFPNGSGKVIGWAPQAAVLAHRAVGGFVSHCGWNSILESVWFGVPVAVWPLSAEQQANAFQLVREFETAVEIKMDYRAGGGEKVPAEKIEGAIRELMDLNNPIRLNAKELKEKSRTTLLPNQSSSNFLAKFARDFI

SEQ ID NO: 5454 - protein, 495 aa, Panax notoginseng
MEERKEKMIVIFPYMAQGHIIPFLSLALQIEKKGYQITFVNTPLNIKNLKQSLPLNSSIRLLEIPFNSSDHRLPPETENTDSIPFSLTLTLLEASVSLKPAFRNLISDLVRGGAPPLAVIADIFFGWTAEVAHEFGIFHTIFSSTGGFGMACYYSVWMNLPHNYTDSVEFTLPDFPEAGLIHRTQLSANVLAADGTDPSSKIIQLLLSSWVDSDGILFNTIEEIDKIGLYYFRRKLSLPVWPIGPILLSVDSRARSNKVCGISSESCINWLDSKPQNSVLYISFGSQHTISASQMMQLAKALDSIDINFIWVVRPPLGFDMNLEFDAVEWLPEGFLKRIEEQNRGLIIVKWAPQVEILLHKAVAAFLSHCGWNSVLESISAGVPLIGWPMGAEQFYNVKYLEEEVGVCMEVARGTNFEVRNEDIVKKIGIVMGENGKGKEIREKACEVKKMIENGGRDEEGYKGSSVRAMEEFLNVAAFFGKEKKVRGQKCRMNT

SEQ ID NO: 5455 - protein, 474 aa, Cephalotus follicularis
MKDVVVLYPSPGIGHIISMVELGKLILHHYHHQFSITILLTTGFRDTHSITSYIDNVSQSHPSITFRHFPSISVDTTPTRSPAAIAFEFVHLNAPNALHSLGEISKTSTIRAFVIDLFCSDALPVAKQLNIPTFYFYTSGAAALAAFLHFPKLHQLFTQSYKDLATTILQFPAGVPPLRAIHMPEPLLDRNDPAYQDFVHFCSSLPLSDGIIVNTFHDLEPIPIKALEEGACLPDKPTPPIYCIGPLIAEARDEGTHDCLSWLDKQPKRSVVFLCFGSRGTFSPAQVKEIAKGLERSGYRFLWVVKTPPSNEKRKGIDERDMKDVDLDALLPAGFLVRVKDRGMVVKSWAPQVQVLSRDSVGLFVTHCGWNSVLESVVAGVPMVGWPLYAEQHLNRNILVEDMKMAVAVEQREEDGLVNGDELERRVREMMESEKGRELRQRVLLMKERAMVALGESGSSTRDLAQLVQLWNHA

SEQ ID NO: 5456 - protein, 390 aa, Cephalotus follicularis
MFRQIMQKEEEDDRITCIIYDSLMYFAQDVADSFKLPGISVRTSAAAMLLVMAVFRRPDEQGNISYQAFAVNSPSVLPIKKTCVQKKTNVVYVDAVDYMPEDKTPVLQSLKLKNIFESMPQSARDAMLEYRAALTDSLKRSSAIIVNTMDFLEQEILTNIQKLFSAPIFTIGPFHKLAPTISSTSIFQEDATCISWLNKQVPKSVIYVSFGSMASMNENELHETAWGLANSEQPFLWVIRPGLVQGVDWLKLLPEGFKERIGERGCIVKWAPQKEVLAHVAVGGFWSHCGWNSTLESICEGIPMLCRPFFGDQPLNVRYVCDVWKVGLELESELDRGKIEIAVRRLMVDTEGEDIRQRAMEFKKKTDHCLGESGSSLDCLNELTEKILSV

SEQ ID NO: 5457 - protein, 470 aa, Phoenix dactylifera
MEHRPQHFLIVAYPAQGHINPALHLARRLASTTGAHVTFSTAISAHRRMFPALSKPDEEVEDGLLSYIPFSNGYDNGFKAGTGTENAQDFVSKFKLVGSRTLSTIIANLAARDRPVTCMIHTMLFMSWAADVAYDHGVPPVVYWIQPAAVFAIYYHYFHGFEELITSHSQDPLFTVNFPGLPPFRIRDLPTFTITNSDDPYYVILLDFRETFDMLDRKQRSSKPRIMMNTFEALEADAIKAVGNVELITLGPLVPSLPLLGMDSKDKDLFKPDDKGYMEWLDSKPERSVVYVSFGSIAVMKKQQLEEVLRGLRESGRAYLWVVRKDGREEGVELEDEENGMVVEWCSQVKVLSHPSVGCFVTHCGWNSTLESLVCGVPTVGVPQWSDQGTNAKLVETWGTGVRTEVDKEGMLEGRELRRCLEVVMGEGERGVEIRKRAEIWKNKAQEAIREGGSSDVNLRAFLEQIASNN

SEQ ID NO: 5458 - protein, 470 aa, Amborella trichopoda
MEMGSETKHVMLVCYAAQGHINPVLQFAGRLASRGISITVATAAIGRQRILKDGDKATAFEADGNIKFEFFSDGSDPLMPIKDLDDCLGRLEREGPESLAGLVEDLRVQGRKVTYMVTTPFTPWVIDLAKGLGVPCSLLWIQCCAVYGYYYRVLHRNRAEMEVPLTFPGLPHLKPEDFPTLASPSSTYNRFPLLLTQLYEKLGDVKMVLGNSFNELEPEEIWFAEGLHLMKLVGPLIPQALLGCPTAPRLRKDMWVAPSNCLSWLDSKPEGSVVYVSLGSVSVLPPKQTEEMAWGLKISRRAFIWVVKPPENSSETGLPEGFLEGVEGQGIVVPWCPQVEVLSHPSLACFLTHCGWNSTLETVAAGVPVIAFPQWTDQPTNAMFLVDVLRVGVRLKVDLVTRDEVERCIAEVTDGEKATEMKKAAARCKEMARASVAKCGSSERNMQAFVDDIMDNGPIHEPKPGNGVLC

SEQ ID NO: 5459 - protein, 474 aa, Medicago truncatula
MDIQPKKKSLPHVLIFPCPAQGHVNPMLKLAELLAIQNIYITFLNTKYIHNRLIQFNDDIQALLECYPKLQFKTISDFHSEEKHPGFGEKVGDVILSLSLYGKPLLKDIIVSEKISCIILDGIFGDLATDLAAEFGIQLIHFRTISACCFWAYLSVPKLLECNELPIKGDEDMDRIIRNVPGMENLLRCRDLPSFRKMDDSDTILDKAALLTQQSLKGNALILNTFENLESPALSQIRLHAPKLYTIGPLHHHLNTTKKTSSSSSSSSKSNFFEVDRTCMTWLESQPLKSVVYVSFGSITPMKGEEIIEIWHGLLNSKKPFLWVIRPNMVQEKGLLKELEEGTTKEKGMIVGWVPQEEVLSHKAIGAFLTHSGWNSTLESVVCGVPMICWPYFADQQINSRFVSDVWKLGLDMKDVCDRKVVENMVNDVMVNRKEEFVRSAMDIAKLASKSVSPGGSSYNNFQDLIQYIRSTSP

SEQ ID NO: 5460 - protein, 456 aa, Unknown
  Description of Unknown: Crocosmia x crocosmiiflora sequence
MDSASRQHVALIAFPFASHPGNLFAFARALAAAAPDITFSFLTTTFAAATLPPAPPAANLRLCHVADGVPEGGLPPGTTIHGRIGMFLRATPGNFRDGVRAAEEEVGVKVSCVVSDAFLWMTADVAEEIGAQWLPLWTCAPAALLAHVSTDQLRERFGVEKQATAGWADELVDFIPGLSCLRIRDIPDEIVTNWHSDLSILLHRMGNQLTSATAVALNTFDGLDTTIDAALASLFKKTLPIGPLNLLSSPPPLQPGDEKCLSWLDGQEDATVAYVSFGTMVLMPTQSDVSEIAQGLESSGVRFLWSLREEARAGLLPPGFLERTAGRGLVVPWAPQVRVLGHRAVGAFVTHCGWNAVMESVTSGVPMACLPSFADQKTNARMVSAAWGIGEALRGEKVTKEEVVRSMEIVMMGEEGRRMRERIGNLREKAAEAVGPGGSSSENFKSVLEMVRGTAN

SEQ ID NO: 5461 - protein, 857 aa, Citrus unshiu
MYRNSMNCSRWCNSGESGRIFLCEIATEEEGLRRLFWAPAPTVVQAVPISQSFSCRLRAGLSVVTGPVSQAGMASGICQLHIFFFPFLAHGHMIPTVDMAKLFTTRGVKASVITTPANAPHLSRSIQKASELGIELDVKIIKFPSAEAGLPEGWENLDAITNEVNRELIVKFYMATTKLQKPLEQLLQEHKPDCLVADMFFPWATDAAAKFGIPRLVFHGTSFFSLCAIKCLALYEPHKKVSSDSEPFVMPNLPGEIKLTRNQLPDPAKQDMGDNDFSRFMKASDDSDLRSYGVVALGRRAWHIGPVSLCNRNFEDKALRGKQASVDEQECLKWLNSKQPNSVVYICFGSVANFTSAQLMEIAMGLEASGQNFIWVVRKNKNNGGEEEKEDWLPEGFEKRMEGKGLIIRGWAPQVLILDHEAVGGFVTHCGWNSILEGVTAGVPLVTWPVYAEQFYNEKIVNEVLKIGIGVGIQKWCRIVGDFVKREAIVKVVNEIMMGDRAEEMRSRAKAFGEMAKRAVENGGSSSSNLNSLIEDLRLTTGLSMVECPFSVFAEQFFNETWVTRLLKIGEVGMAGEIRKLHIIFFPLMAHGHMIPLVDMAKLFGSRGVKTTVITTPANATLFSKAIPRANELGIEIDIKTIKFPSVEVGLPEGSENLNEMTSQPDMPVNLQEHKPNCLVADMLFPWATDAAAKFGIPRLVFHGTSFLSLCATACLMLYEPHKKVSSVSEPFVIPNLPGDIRLTRNQLPDTMKQDDETDFSRLFKAAVESELKSYGVVVNSFYELEPAYAVHYRKVLGRRAWHIGVLKLAEIKATQFCCLPMLWKPSQLHFCSANGDCNGASSFGAKFHLDCEEKQE

SEQ ID NO: 5462 - protein, 540 aa, Oryza sativa
MTRDKAESSLKLWTPTTHTDTRCYLAIGEPVCSSCSGRDAAVAPAGTMGDGGGGGLDVVVFPWLAFGHMIPYLELSKRLAARGHDVTFVSTPRNVSRLPPVPAGLSARLRFVSLPMPPVDGLPEGAESTADVPPGNDELIKKACDGLAAPFAAFMADLVAAGGRKPDWIIIDFAYHWLPPIAAEHNVPCAVFLIVQAAAIAFLGPRWANAAHPRAPLDFTAPPRWFPPPSAMAYRRNEARWVVGAFRPNASGVSDIERMWRTIESCRFTIYRSCDEVEPGVLALLIDLFRRPAVPAGILLTPPPDLAAADDDDVDGGSSADRAETLRWLDEQPTKSVIYVALGSEAPVTAKNLQELALGLELAGVRFLWALRKPAAGTLSHASAADADELLPDGFEERTRGRGVVWTGWVPQVEVLAHAAVGAFLTHCGWGSTIESLVFGHPLVMLPFVVDQGLVARAMAERGVGVEVAREDDDEGSFGRHDVAAAVRRVMVEDERKVFGENARKMKEAVGDQRRQEQYFDELVERLHTGGGEINDEKYC

SEQ ID NO: 5463 - protein, 435 aa, Arabidopsis thaliana
MTTTTTKKPHVLVIPFPQSGHMVPHLDLTHQILLRGATVTVLVTPKNSSYLDALRSLHSPEHFKTLILPFPSHPCIPSGVESLQQLPLEAIVHMFDALSRLHDPLVDFLSRQPPSDLPDAILGSSFLSPWINKVADAFSIKSISFLPINAHSISVMWAQEDRSFFNDLETATTESYGLVINSFYDLEPEFVETVKTRFLNHHRIWTVGPLLPFKAGVDRGGQSSIPPAKVSAWLDSCPEDNSVVYVGFGSQIRLTAEQTAALAAALEKSSVRFIWAVRDAAKKVNSSDNSVEEDVIPAGFEERVKEKGLVIRGWAPQTMILEHRAVGSYLTHLGWGSVLEGMVGGVMLLAWPMQADHFFNTTLIVDKLRAAVRVGENRDSVPDSDKLARILAESAREDLPERVTLMKLREKAMEAIKEGGSSYKNLDELVAEMCL

SEQ ID NO: 5464 - protein, 418 aa, Cephalotus follicularis
MHTLGKAGPINLSNLITDHYHNHHKKLSCIINNSFVPWVADVASKHGIPCAMLWIQPCSLYAIYYRFYNKLNPFPTLTNPNMNVELPGMPLLLTEDLPSFVLPSNPFDSFTELLSFGFQNMRAYKWVLGNSFFELEKDAIESMAEICPIRPVGPLVPPSLLGEDQNLDVGFEMWKTDDSCIDWLNNQPASSIIFVSFGSIVVLSAKQMEAIATALKNSNRSFIWVVKRPEFPSPNREGELPQGFIEETKSQGLIVSWSPQTKVLAHPALACFITHCGWNSMLETMTAGVPVIAYPQWTDQPTNAKLVTDVFSIGLRLRPNQDGIITSEEVERCVKEIFDGPKSEELKKKAAEWKAAAREAVGSGGSSDRNIQLLVDEIVGVSEISSSVERVVHECLGSDSGVHEVDDQLVIGVDSLAN

SEQ ID NO: 5465 - protein, 253 aa, Cephalotus follicularis
MKGICLKDMPSFIRTTDKDDLIIDIILDVTERAKRASAIILNTFNSMEHQFLSALSSMLPPIYSIGPLQLLLNEVPDTDLKHFGSNLWKEEPECLEWLGSMDANSVVYVNFGSITVMTPDQLVEFAWGLANSKQTFLWIISPDLVSGDSAILPPEFFADTKDRALLASWCPQEKVLNHLAIGGFLTHSGWNSTIESVCGGVPMICCPFFAEQQTNCRYCCTKCGIGMEINNDVKRDEVESLARELTEGDKGKE

SEQ ID NO: 5466 - protein, 428 aa, Unknown
  Description of Unknown: Oryza sativa Japonica Group sequence
MGEEAAAATVTAAAAAAASGGAPHLLLICFPGQGHVNPMLRLAKRIAAKGLVVTFSSTSAIGAKLVESSGVSVGGDGVPLGGGRIRFEFLEDGFDGSDLDELMRHLGTAGPAAFAELLARQEAAGRPVACVVGNPFIPWAVDVAAAAGILSAVLWVQSCAVFSLYYHRVHGLVEFPPEDDLDARLTLPGLPAMSVADVPSFLLPSNPYMSLTEAIQQQIRTIDKATWVFVNSFTELERDVVDALRGVATSPPPPPLIPVGPLIELEGDAAVRGDMIRAADDCVGWLDEHPPRSVVYASLGSVVVLSAGEVAEMAHGLASTGRPFLWVVRPDSRALLPEGFLDAVAGRGMVVPWSPQEQVLVHPAVACFLTHCGWNSTLETVAAGVPVVAFPQWGDQCTDAMFLVDELGMGVRHVEAFVEEVKARAAKA

SEQ ID NO: 5467 - protein, 480 aa, Vigna angularis
METPKLTHVVLVSSPGLGHLIPVIELAKRFVLLHNFKVTVIAVTSQTSPAEAQILNSLLTPSLCHLIDIPSPDISALISQNDAVFTRLCVVMSEAKLAIRSILSEITPRPSAVIVDAFSTETIPITRELDILGYVYCASHAWMLALVLYSPVLDELVEGQYVDQTEPIKIPGCKPVRPENLVDPMLDRNDRQYTEYLKIGKGIVQSDGVLVNTWEELQREELEALREGGSLSEALNMKIPVYAVGPLVREPELETNSSIESLVTWLDQQPTQSVVYVSFGSGGTVSSEQMKELAWGLELSEQRFVWVVRSPIEGVADAAYFTTGSSGIDEVAKHLPEGFVSRTREVGLLVPDWAQQVTILSHRSIGGFLSHCGWGSTLESITNGVPLIAWPLYAEQKINAALLAEELGVAVGPRVLPTKKVVRREEIAEMVREVIEGVESVKGNHVRERVKEVQQSAMKALSKGGSSLVALSHLVNIISG

SEQ ID NO: 5468 - protein, 458 aa, Polygala tenuifolia
MEGVEANKTHCIVLAYPAQGHLNPMVQFSKRLIQKGVRVTLVTTHFYCKNLRKENYNSISIEGITDGFDEGGAMQSAEDWETYLNKFWQVGPASLAELLEKFASSGSPAGCLVYDSFMPWALDVAKKYELVGAVFLTQSCAVNNVYYHVHEGLLKTPISEHTISLPGLPELAVKDLPSFVYSPDSYPVLSKLIVDIFSSIGKADWVLCNTFYELEEEAVKFLSKVWPLRPIGPAIPSMYLDQRHQDDTEYGLSILNQNTEVCLKWLGERPKRSVVYVSFGSLASLNDEQMKEIAYGLKDSESDFLWIVREPDEAKLPKHFAQTLQKGLVMRWCPQLQVLAHDAVGCFFTHCGWNSTLEAISLGVPMIAMPQWTDQTTNSKFIMDVWRVGVKVQLDERGIAKREAIKQTIKEVMEGERGKDIRENSIKWKALSQSTFNEGGSSEKNIDDFVSTLMFSPK

SEQ ID NO: 5469 - protein, 272 aa, Medicago truncatula
MTKLIRDFVIVFLDKANQGLIEYVVDWTMKIWPKFRPIGPSIPSMFLDNRHKDDEDYGVAQFKYNEKCMEWLNDKPKGSVVYVSFGSMVSLDEEQIQELAYGLRDSGSYFLWVVRASEENKLPKDFEKESKKSLVVTWCSQLKVLAHEAIGCFVTHCGWNSTLEALSLGVPTIAIPQWSDQRTNAKFIADVWKMGIRAPIDEKQIVRQDKFKDCILEIMKGEKGKEIKSNATQWKTLAVGAFEEHGSSQKNIIEFVTSLINVGPLTREGSIQ

SEQ ID NO: 5470 - protein, 467 aa, Arabidopsis thaliana
MRNVELIFIPTPTVGHLVPFLEFARRLIEQDDRIRITILLMKLQGQSHLDTYVKSIASSQPFVRFIDVPELEEKPTLGSTQSVEAYVYDVIERNIPLVRNIVMDILTSLALDGVKVKGLVVDFFCLPMIDVAKDISLPFYVFLTTNSGFLAMMQYLADRHSRDTSVFVRNSEEMLSIPGFVNPVPANVLPSALFVEDGYDAYVKLAILFTKANGILVNSSFDIEPYSVNHFLQEQNYPSVYAVGPIFDLKAQPHPEQDLTRRDELMKWLDDQPEASVVFLCFGSMARLRGSLVKEIAHGLELCQYRFLWSLRKEEVTKDDLPEGFLDRVDGRGMICGWSPQVEILAHKAVGGFVSHCGWNSIVESLWFGVPIVTWPMYAEQQLNAFLMVKELKLAVELKLDYRVHSDEIVNANEIETAIRYVMDTDNNVVRKRVMDISQMIQRATKNGGSSFAAIEKFIYDVIGIKP

SEQ ID NO: 5471 - protein, 479 aa, Zostera marina
MDKAEGRHLVFISIPIVGHLIPMVAFAKLLTPRFQITILTMNPPLPNWAAPSAAYLASLRSENNNNTDHDLSRIRFLQLPSVDFQVDHTNHAFTTMSRFIDAHKFNVKEAISDLQQTPNVHVYAVVTDFVTSMIDVANELRIPAYVYFPSSAACLSIMLYPPSQSQLTDDMVDVVGISPVPADAMPGLITDPDGYDTFTYHGRRFNKAQGIIVNTFKELEPAVADALSAKSVLGDATSDDGHYVDVLPPVYTVGPVISIPTETSQHECIRWLDDQPPLSVVYLCFGSMGWFETKQVRQLAHGLERSQHRFLWVLRCPSNEDGSRGDTDLERIGLPDEFLKRTRSRGLVWGSWVPQMDILLHSSVGGFVTHCGWNSCLEAVWAGVPMLAWPLYAEQKFNKCEMVEDMGVALPIISKDGEGVMDAEEVEKGVRCLMGESEEGIKVRIRVTKMKDESRKAVQTRSGSSYHALELWIQNILSF

SEQ ID NO: 5472 - protein, 496 aa, Oryza sativa
MATPAPALVLLPEWGSGHLMSMLESCKRVLLAGAGGGKEFSITLLVMRPPTDEAGSEVEAHVRREAASGLDIRFHRLPAVDPPADAAGVEEFIARYIHLHAPHVRDAVAGMGRPVAALVLDMFAAPMVDVARDLGVPSYVFMSSTGAMLALMLHLPVLHDRVAVEFHEVDGEVDVPGLPPLPPASMPCPVVDKKSPNYTWFVRLGDRFMDATGIIANTADELEPGPLAAIADGRCVPGRAAPPVYPIGPVLSLGGNDKRDSSEPPHECIAWLDGQPPASVVFLCFGSMGWFEAAQVVEITAALERSGHRFLWVLRGPPPAAESGTGAPDGSEHPTDANLDELLPEGFLERTKGRGMVWPTWAPQKEILAHPAIGGFVTHGGWNSVLESLWHGVPMAPWPLYAEQHLNAFELVRDMGVAVPLGVDRERDNFVEAAELERAVRSLMDDASEEGKKAREKAAEMKAVCRSAVAAGGGSSHAALQRLSEALHQGAALPKK

SEQ ID NO: 5473 - protein, 487 aa, Unknown
  Description of Unknown: Oryza sativa Japonica Group sequence
MPAMEEEAVANEAHHFLVVTYPAQGHINPARHLARRLARAAPGARVTISTAVSACRKMFGDAAAAGAGGELVDEGGVRYAPYSDGYDDGFDRAVHDSASYMTQVRVVGARTLAAVIEGFRAAGRPVTRVVYTLLLTWVADVARDHGVPVALYWIQPAAVLAAYFHYFRGTGGVDRDIAAAAAARDRMAPVRVPGLPPLRLRDLPSFLAIADDDDPYAFVLDAFRDIVAVLSRGDRPTVLANTFDAMEPEAVASLRQHGVDVVPVGPVLSFLDAAKSGGGGGAITTTTSNDLFKQNDTGYLEWLDARPAGSVVYISFGSLSTMSRRQIAEVSRGMAASGRPFLWVLRKDNRGEADDVAIDGGVVVEWCDQVRVLGHPAVGCFVTHCGWNSTLEAVASGVPAVCVPQWTDQGTNAWLVAERLGAGVRAAVSEVDGVLEAGELRRCIDAATSEAVRASAAAWREKARAAVADGGSSEKNLQAYVGKIRAN

SEQ ID NO: 5474 - protein, 359 aa, Arabis alpina
MSFTLDPAEELGVPEVLFWTLSACGFMAYLHFYRLVEMGLSPLKDESCWTKEYLDTVIDCVPSMKNMKLKDIPSFIRATNHDNIMLNFSLRETERAKRASAIILNTFDDLEHDILRSMQSILPPVYSIGPLHLLANREIAEDSKIGKMGSNLWKEETECLDWLDTKPRNSVVYVNFGSTTVVTAKQLVEFAWGLAGCGKEFLWVIRPDLIAGEEAIVPPEFLVETANRRMLASWCPQEKVLSHPAMGGFITHSGWNSTLESLSSGVPMICWPFFAEQQTNCKFTCDEWEVGMEIGGDVKREEVEAVVRELMGGNKGKKMREKAEEWCRLAEEATKHKVGSSVVNFETFVNKALLGQRSE

SEQ ID NO: 5475 - protein, 505 aa, Unknown
  Description of Unknown: Oryza sativa Japonica Group sequence
NTFGLTAAPSVRPSARRRRRHTAMSSCEARRAHAVLIPQPAQGHVTPMLHLAKALHARGFFVTYVNSEYNHRRLLRSSGPGALAGAAGFRFEAVPDGMPESGNDDVTQDIAALCVSTTRHSAEPFRELLVRLNSTPGTPPVSCVIADGVMSFAQRVAEEMGILALVFWTTSACGFMGYLHFAELIRRGYVPLKDESDLTNGYLDTPIDWIPGMRGIRLKDVPSFIRTTDPDDVMLNFDGGEAQNARKARGLILNTYDALEQDVVDALRREFPRVYTVGPLPAFAKAAAGEVGAIGGNLWKEDTGCLRWLDAQQPGSVVYVNFGSITVMSPAHLAEFAWGLACCGRPFLWVIRPDLVSGEKAMLPEEFVGETKERGVLASWCPQELVLSHPSVGLFLTHCGWNSTLESICAGVPMICWPFFAEQPTNCRYVCDKWGVGMEIDSNVSRTEVARLVREAMEGERGKAMRVNAMVWKEKAKEATEEGGSSSRNLDRLIEFLHSSGSDAR

SEQ ID NO: 5476 - protein, 487 aa, Catharanthus roseus
MGSLSSSDYSKKPHAVCIPYPAQGHINPMLKLAKLLHYKGFHITFVNTEFNHKRLLKSRGSDSLKGLHSFQFKTIPDGLPPSDVDATQDIPSLCESTTTHCLVPFKQLLQKLNDTSSSEVPPVSCVVSDAVMSFTISAAQELDIPEVLFWTPSACGVLGYMHYAQLIDKGLTPLKDASYFSNGFLDQVLDWIPGMEGIRLRDLPTFLRTTNPDEYMIKFILQETERSKKASAIVLNTFQELESEVIDSLSTLLPPIYPIGPLQILQNQVDDESLKVLGSNLWKEEPECLEWLDTKDPNSVVYVNFGSITVMTNDQLIEFAWGLANSKQNFLWIIRPDLISGESSILGEEFVEETKERGLIASWCHQEQVINHPAIGGFLTHNGWNSTIESISSGVPMICWPFFAEQQTNCRFCCNKWGIGMEINSDVKRDEVESLVKELMVGEKGKEMKKKALEWKNIAEVTTTKPDGSSYSNLEKLIKVLKSKPSH

SEQ ID NO: 5477 - protein, 356 aa, Oryza sativa
REGTPAVSSNQLDDKDGREEEQVVRGLGILPAQLELSTKELPWLVGDSATQRSRFAFWLQTLRRARGFRSVLVNSFPGEAVTGTAAAEDDDGPQRQAACPRVLPVGPLLVLAGCNVERAKGAGDDGGVAATNINNHPQPCSKNPSMWQADSTCIRWLDAQPAASVVYVSFGSWVGPIGHDKIRELALGLEATGRPFLWAIKDDPSWRAGLPAGYAGSVAGRGKLVDWAPQDDVLGHAAVGCYLTHCGWNSTVEAIQHGVRMLCCPVSGDQFINCAYITRVWEVGLKLGSVRRDVVRDCIERIMGGAEGTRLQEKMDALRQRAVTAEARCLAQGNLRSFVNEIKRDHPLLTQIYNIL

SEQ ID NO: 5478 - protein, 332 aa, Unknown
  Description of Unknown: Fragaria x ananassa sequence
YYFNGYKDLIKNNTGADNNDPSFALELPGLPLLFKRRDLPSFILASSPIIHRLVIQMFEDQFEDLGKLSKPIILVNTFDALEPEALKAIDKYNLIGVGPLMPSAFLDDKNSSDKSFGCDIFQKAKESCYMEWLNSKPEQSVVYVSFGSISVLSKNQMEELAKGLLDCGRPFLWVIRENQKKGEGKEEKEEEEELSCRAELEELGMIVPWCSQVEVLSNPSLGCFVTHCGWNSTLESLVCGVPVVAFPQWSDQGTNAKLIEDSWKTGVRVEPNEEGIVVGEEIKRCLDLVMESDKMRRNAKKWKDLAREAVSEGGSFHKNLKAFLEEIEERLR

SEQ ID NO: 5479 - protein, 461 aa, Populus euphratica
MENKHFLLIALPAQGHLNPMFQLGKCLIHAGAGRVTFATTAHGLTQVEAFPSLENLHYASFSDGFDDGIKPTNDPHRIRAELKRVGSQTLTELLLSLSKEGNPVSYLIYTLLLPWAADVARDMSIPSAFLCILSTTAFALCYCFFKERDGVYDSNDNGPPSSIEMPGLPLFTSKDMPSFLLPNDPHASILIPLFQHHIQALEKDSNPCVLLNTSDCLEEEAIRRISNLNPIPIGPLVSYAFLDENNSTDSSCGIDLFEKSTEYSQWLNSKPKGSVVYVSFGSLAVLQKNQMEKILLGLTGTCRPFLWVVRPSAGSDDREFEEKIRDKVNEEEGLIVPWCSQMEVLAHESIGCFMMHCGWNSTLESLATGVPVVGFPQFSDQTTNAKMVEEVWRTGVRARVNDDGTLEAEEIERCLEMVMGGGQRGEEIRRNAKKWKGLTLEAVMEGGSSYNNLNAFLEKIE

SEQ ID NO: 5480 - protein, 470 aa, Medicago truncatula
MSYFANNNKKPHAVLIAYPVQGHINPLFKLAKLLYLKGFHITFGHTEYNHKRLLKSRGPKAFDGFTDFNFETIPDGLTPMEGDGDVSQDIPSLSDSIRKNFYHPFCELLAKLHDSATAGLVPPVTCLVSDCYMSFTIQAAEEHALPIVFFSPASASTFLSVLHFHTLFEKGLIPLKDKSYLTNGYLDTEVDCVPGLKNFRLKDLPDFIRITEPNDVMVEFLIEAAERFHKSSAIIFNTYNELETDAMNALYSMFPSLYTVGPLPSLLNQTPHNHLASLGSNLWKEDIKCLECITVMTRDQLLEFAWGLADSKKPFLWIIRPDLVMGGSFILSSEFENEISGRGLIAGWCPQEEVLNHPAIGGFLTHCGWNSTTESICAGVSMLCWPFFADQPTNCRYICNSWEIGIEINTNVKREEVSNLINELMSGDKGKKMRQKAMELKEKADETTSPGGCSYNNLDKVIKEVMLKQY

SEQ ID NO: 5481 - protein, 467 aa, Medicago truncatula
MKDTIVLYPALGSGHLMPMVELGKLISTHHPSFSITILILTPPNKNTNTNKGTLSPQEQYIANVSTTFPSINFHYIPPISFPTTLPQLLCTLEVCQHSNNHVENILHSISKTTNLKAVILDFFTYSASQVTKKVEIPTYFYYTSGAIFVATFLHFPIVYENATKPIKDLHMPLQIPGLPKSLSTDDYPDGFNDSISENKVLQDMLDSMKTTRECDGIIVNTFDGIEGRAIKALNEGLFIPDGIPSIFCTGPLIASSYGEDENGCLSWLESQPIQSVVLLSFGSMGRFSKAQLNEIALGLEKSEQRFLWVIRSELDLEEQSLDELLPEGFLERTKERGMVVRNWAPQGAILKHDSIGGFVTHCGWNSVLEAVCEGVPMVAWPLYAEQRLNKVILVEEMKVALELKDSKDGFVSGTELGDQIKELMDSDKGKEIRQIIFKMKISAKEAREEGGSSLVALNKLAQLWKQN

SEQ ID NO: 5482 - protein, 468 aa, Panicum hallii
MVSSDHQSLHILLLPFPVQGHINPLFQFGKRLASHKGVRCTLAATRFVASSTKPAPGSSSVHVAVFSDGCDGGGPDELGGPGGPYFERLESAGSETLDALLVSEAEEHGRPVHVVVYDAFLPWAQGVARRRGAACAAFLTQTCAVNALYTHAWAGRVPFRPAKEELAGLRGLPAQLEPGDLPSFLVDRSCPRSFREVVLNQFQGLDTAEAVLVNSFHELEPQESEYLASTWGAKTVGPTVPSAYLDNRLPDDVSYGIQLHTPMTAESKAWLDGHPARSVVYVSFGSMVALAADQLAELAQGLRASGKPFLWVVRATETAKLPESFRGRARAARGLVVPWCPQLDVLAHPSVGCFVTHCGWNSAVEAIAAGVPMVVVPQWSDQPMNAMCVEDVWHVGVQARPETEATAVVGRGEVERCVRTVMEGETGAGFRRSALDWSRKAKKAVSEGGSSDINILEFISKFRSLQVN

SEQ ID NO: 5483 - protein, 491 aa, Tripterygium wilfordii
MQEDKFTYSHTHREVSMAAIVLYPTTGMGHLISMVELGKLILTHHPSFTVNILLPTAPYATGSTAQYISAVSTTNPSIIFHHLPPVSLPLDPASYSCVEALTFDLIRLNNPNVHTAIQSISQTSTVHALILDFFCNAALDVATELDVPAYFFLTSGASFLALFCHFPTIDRSTNKNFKDLETTVNLPYLPPIPLSHMPEPMLEKDTTEYAGFIDCSVGLSKSTGIIVNTFSTLEPKAVKALADGVCNPDGPTPPVFCIGPLIVTNRQIGNEGDDKVLGSECLTWLDKQPSQSIVFLCFGSLGLLSKEQLREIAIGLEKSGQRFLWVVRNPPSEDKKQRFLTQPDPDLNSLFSDGFLDRTKERGLVVKRWAPQVAVLNHEAVGGFVTHCGWNSVLESVCAGIPMVAWPLYAEQKFNKALLVEELKLALPMNESETGFVSATEVEKRVRELMESEEGNSLRERVTAKRNEAMKAMEEGGSSRVALAKLVEQWK

SEQ ID NO: 5484 - protein, 350 aa, Helianthus annuus
MINQTGSSRVVGFVVDVFCTGMIDVANEFNLPTYVFFTSSSAFLGFNLYIETLCVDHNQDHVIELSNSKGEIVVPSFVNPVPKKAFPADYWTQEGLDFVICSIRDLRKAKGIMVNTFLELETHVMKSFTDTNFPPVYPVGPVLNLDVVVKKAHDMDVIRWLDGSSEGDSTRIRTKWSSFCVVPTLSPHLAQSFEDPKVLLPDGFLERTVGIGKVIGWAPQVSLLAHEAVGGFVTHCGWNSILESLWFGVPMTAWPVYAEQQLNAFEMVVELRLAVDLKLDYKMDLFNPNVNTTIVTTEEVERGIRRVMEDNKVRAKVKEMSKLSRATLVEGGSSYASVGYLVQEIMSNII

SEQ ID NO: 5485 - protein, 473 aa, Genlisea aurea
ELVFIPSPGRGHLQAALQLATFLVEADSRLSVTVLVITPFSAPKSPLQSPATHSRIRFVDVAPSDFSPSLDMAKSPVFAMQSFISSHRDSVRAEVKKLREDSGSNGKLAGFVVDMFCNSMIDVADEFSVPAYVFFTSGAAFLGFMFHMQGLLEHKKQDLMAFKNSTEIIDAPSYKHPFPANLLPALTFEKPDGTIFYNIAAAYRRAKGILVNTFLELETHAINSLSDGEKFPQVYPIGPLIYMENDEKNPKYSEIMNWLDEQPDSSVVFLCFGSMGWFDGDQVKEIAAGLERSGHRFLWTLRKPPAPGTVANPGDYENFDEILPDGFLRRTAGIGKVIGWAPQVAVLSHRAVGGFVSHCGWNSILESLWFGVPIAAWPMYAEQQPNAFLLVKDLGVAVEMKMDYVKNSVYGGGNVSSMIVSADVIASGIRELMDSGNHVREEVRVMKEKSRAALSENGSSSRYFRSFVDSLVD

SEQ ID NO: 5486 - protein, 476 aa, Centella asiatica
MKTNYRQPHVVILPFPAQGHIKPMFMLGKLLCNTGINVTLVNTDQNHNILSSSIDKSSFYHLYPGFRFMALGVGPPEENIRRRGKAEIMKWIISTCHPKFNELMIEENKGDGKITCVIADGYMSFAIDVAKEFDIPVISFRTYNATCTWLYFHLEELLQSGEIPVQDRDMDQQVTCIPGLENIVRRRDLPEFCRHESGNSILQFYMDQTSKMKQASALILNTFEELESPIVSNLRSIFQKVYTIGPLQGLLESRMAQNSRWSDVSDASLRPQDQTCISWLDNQAPKSVIYISFGSLVVLTRDQLMEFWHGLVNSGLPFLWVIRPGLIMSDTQTPPERSDWPNKRGFIVDWAPQEEVLAHRAIGGFLSHGGWNSTLESIWAGKSMICWPQFADQQVNSRCVEEMWRIGLDMKDTCDKSTVEKMVKDLMDSTNEQIQKSTARFASMAHNSVSKGGSSYRNIEKLIADIKVGCFNKPNT

SEQ ID NO: 5487 - protein, 221 aa, Panicum miliaceum
MEENRIPQLIQDGVIDEKGWPKRQETLQFAPGMPPLHTSRLAWNNAGAPEGQPAVFQLVTRNNEAKDLAEVIVGNSFRDAEPAAFKLYPDILPIGPLVADLQLKKPVLAHGAVACFVSHCGWNSTLEGVRNGVPFLCWPYFTDQFQNESYICNVWRTGLAVAPGADGVVTKEELSGKVERVLGDDGIRERVGALRDAARRSIAEGGSSHQNLMKFVELLKK

SEQ ID NO: 5488 - protein, 474 aa, Rhodiola rosea
MGSDSRPLRVFFFPFMAHGHLIPMVDIARLFSSQGVHSTIITTPLNANYISKTTSLSIKTIPFPAAEVGLPDGCENIDMLPSPDLFFKFFQAANLLQAPFENLLELERPDCLISDIFFPWSVDSAEKFNIPRLVFHGTSFFAMCAMESLKTHKPYKSVSTDSEPFLIPNLPDEIKMTKSQFTVDAWEDTEKGLGKLLADARASGLRSFGMIVNSFHELEPAYADYYKNVLNMKAWCVGPVSVCNRNVEEKIARGKKSAIDDHECLKWLEGKQPDSVVYVCFGSSASFPDEQLRDIALGLEESGVNFIWVIRRSSESGSKDYLPEGFEDRVKDRGIVIRGWAPQVLILDHPSVGGFVTHCGWNSALEGISAGLPMVTWPLFAEQFFNQKLIKDVLKVGVEVGVQKWSRNGEDRVTKEKVEKAVRAVMVGEEAEERRGRARQLGKLAKKAVAKDGSSYIDLHNLLDELKLRRETLS

SEQ ID NO: 5489 - protein, 486 aa, Ricinus communis
MPSMGQDQLHIFFFPFMAHGHIIPTIDMAKLFASRGVKSTVITTPLNAKTISKTIQRTKNSGFDIDIRILEFPAEAGLPEGCENMDVIISHQDGKDLVMKFFRAIARLQQPLENLLGECKPDCLVADMFFPWTTDAAAKFGIPRLVFHGINFFSLCTGECIKLYEPHKKVSSDSEPFVIPYLPGEIKYTRKQLPDFLRQQEENDFLKMVKAVKESELKSYGVIVNSFYELESVYADFYRKELGRRAWHIGPLSLCNSGIEDKTQRGREATIDEHECTKWLDSKKPNSIIYICFGSLANFTASQLMELAVGLEASGQQFIWVVRRNKKSQEEDDEEWLPKGFEERMEGKGMIIRGWAPQVLILDHEAIGGFVTHCGWNSTLEGITAGKPMVTWPISAEQFYNEKLVTEILKIGTGVGVKEWVKFHGDHVTSEAVEKAINRIMTGEEAEEMRSRAKKLAEMAGHAVEEGGSSYSDLNALVEELRPRRG

SEQ ID NO: 5490 - protein, 516 aa, Aedes aegypti
MIGKIGFPLLLLALAISSNNKGVESAKILCIFPSPGRSHVLVGQTLLKGLAARGHEVTMVSPFKLSKPVPNYREIYVPADDTVSKMTKSFLEKPQNMFKSMPTLMRSVTETANKTINDPQFLAIKNEQFDVVITGLFVADFILGFGPHFNAPTIALWSAGQTKFTSDLVGNPRALEAVPHIMLGSQGAMGFFGRMKNLLIGTVENLITIYMTHSQQKFYDWNFPADKYPSYKDVRKNVSLVLLNTHFSSSGPRPYIQNIIEVGGLQIKTKPDPLPKDIQEWLDGAEHGVIYFCLGSNLKSSDLPPEKLQIFLRVLGKQKQRVLFKWETDSIPNQPKNFLTKKWLPQDDVLAHKNVVLFIAHGGLGGMAEARFHAVPVLGIPIFAEQSHNVNGVEREGWGKQVDYATLTEESFETPLKEILTNPQYRQKVQELSELYRDRPQSAIDLACYWVEYVIRYKGAPHMHYQGADLNFFQEQMLDVVAALLVGAYVVFKVLKLLIKSIAKRICGGRKKQKTY

SEQ ID NO: 5491 - protein, 462 aa, Brachypodium distachyon
MDSINTTAQRSIGGGGGHVLLLPFPGMQGHANPMLQLGRRLAYHGLRPTLVVTRYVFSTTATTDGCPFPVAAISDGFDAGGIASCPDTAEYLRRMESVGSETLSRLISDEARAGRPVRVLVYDSHLPWARRAAKRAGVAAAAFLTQLCAVDVIYGEAWAGRVALPLTDGSALRGVLSVELGPDDVPPFVAAPEWYPAFTESALGQFDGLEEADDVLVNSFRDLEPKEADYMELVWRTKTVGPTLPSFYLDDNRLPLNKTYGFNLFSSIALCMEWLDKQVPCSVVLASYGTVANLNSTQLEELGYGLCNSRQPFLWVLRSDEAEKLPKDLRDKCNTKGLIVPFCPQLEVLAHKATGCFLTHCGWNSTIEAIVTGVPMVAIPQWADQPTTAKYVESAWGIGRRACPDRECLVTREKIERCVKEVICGEKEYTRNAAKWMQKAKEAMQQGGSSDKNISDFVAKYL

SEQ ID NO: 5492 - protein, 474 aa, Ipomoea triloba
MDTSQRSIRVLMFPWLAHGHICPFLVLAQALSKRNFYIYICSTPVNLSSIKKRISEKDAISIKLVELQLPSLPNLPPHYHTTNGLPPHLMPTLKKALDMAKPGFLNLVHTLKPDLVVYDFLQPWVPAMAAAQGIPAVLFLSTGTAAFSYILYNIGRGYPAEEYPFPEVYLRDHEFITNKRLFEAAEQTDGGVSDGERIDGCLDGSSSIILLKTFRQLEGKYIDHLSNMVKKRCVPVGPLVRSPAPDGENPEIKEWLDMKPRCSTVFVSFGTEYFLTEEEMEEVALGLELSKVNFLWVIRFPAAEAGEKPRAIEDALPEGYLERVGERGKLVEGWAPQGMILEHSSIGGFVSHCGWSSVMEALKFGVPIIAMPMHLDQPLNARVVTAAGIGEEVVRDGEGKVEREEVARVVRKVVAEKSGQRLRRRAREFSEKIMSERGEEEIDEAVQELTALCQTTTFRQDSAELNCIRFSLGG

SEQ ID NO: 5493 - protein, 483 aa, Manihot esculenta
MGSLASEIPPHAVLVPYPAQGHVNPLMQLGKLLHSRGFYITFVNTEHNHRRLIRSRGQEFIDGLPDFKFEAIPDGLPYTDRDATQHVPSLSDSTRKHCLAPFIDLIAKLKASPDVPPITCIISDGVMAFAIDAARHFGIPEIQFWTTSACGFMAYLHHIELVRRGIVPFKDESFLHDGTLDQPVDFIPGMPNMKLRDMPSFIRVTDVNDIMFDFMGSEAHKSLKADAIILNTYDELEQEVLDAIAARYSKNIYTVGPFILLEKGIPEIKSKAFRSSLWKEDLSCIEWLDKREPDSVVYVNYGCVTTITNEQLNEFAWGLANSKHPFLWIVRPDVVMGESAVLPEEFYEAIKDRGLLVSWVPQDRVLQHPAVGVFLSHCGWNSTIECISGGKPMICWPFFAEQQTNCKYACDVWKTGVELSTNLKREELVSIIKEMMETEIGRERRRRAVEWRKKAEEATSVGGVSYNNFDRFIKEAILQHKTK

SEQ ID NO: 5494 - protein, 593 aa, Helianthus annuus
METHDSTLRSTTSRRIILFPLPFQGHINPMLQLANILHTRGFKITIIHAEYNSPNPSNYPQFTFKPIKDRFSAIADQLPTNPDTTYYLKYLNESCVDPFRDCLAGLLAEERVACVITDAGFYFAQAVADDLKICRIVLRTSSLGGLLACKVLPFFSKKASFYLTKEANMLHTRGFNITVIHAEYNSPNPSNYPHFTFIPIKDRFSEIADQLPTNPDASYFLNYLNKSCEQPFRDCLAGLLAEPGEERFACVITDAAFYFTQAVADDLKLPRIVLRTSCIGCVITYDALPFYSKKACFKLTKQDPDYEASVPEYPLLKFKDIAKITINPQGTGDFATNMLSQMRASSGIIWNTFKELEESDLETLSRDFPVPSFTLGPFHKYFPASSSSLIEQDRTILSWLDKQPPKSVVYVSFGSVAHITESEFQEVAHGLVNTGLPFLWVVRPGIVIGSEWLEALPEKFLERMGERGRIVKWSPQQEVLAHPATGCFWTHNGWNSTLESICEGVPMICSPCFVDQPINARYVSDVWKIGVMLEDGFERVGIEMAIKRVMMDKEGEEMCERVTSLKEKVNLSLAEGGSSCRSLNNLVDYISSL

SEQ ID NO: 5495 - protein, 458 aa, Solanum lycopersicum
MKHHHFIIISLTIQGHINPTLQLAKNLSRAGVRCTFVTTVNGFSKLNNLPSIDGLFYASISDGNDDGTAKMDFSDYMKQLKRVGSENLKKLIDRYAGDGHPVTCLVYTFIWPWVAEVAREINLPSAFLVIQSATAFAIYHHLFSINNNGVYSSTNEINLSFPIKLPELPLLFRDDIPSFLLQNDPYSSFMIPVMREHIQNLEHDTNPRVLINTFNKLEEKSLKIIDKIGIYSIGPLIPSAFLDGIELEDKSFGCDLFEKSETYCQWLDSKLEGSVVYVAFGSIATVKEEQKEEVLQGLLESEMPFLWVIRSSKEDDKKKNDEIYGLNGKGMIVPWCSQMEVLFHKSIGCFVSHCGWNSTLESTIAGVPLIGVPQLADQFTNIKMVEEVWGTGVRARVEEEGGIVKREELKRCLGVLMGDGEKGNEIRRNVKKYRDLAMEAVKVGGSSHNNLNKFLESL

SEQ ID NO: 5496 - protein, 480 aa, Helianthus annuus
MGSNLEKKPHALCIPAPLQGHINPMLKLAKILHSKGFLITFVNTEFNHQRLLRSQGLEALHGLPSFRFETIPDGLPPPENTNATQEIPSLAKSVEETCLGPFKSLVTKVNASYAPVTCIVSDLLMGFTLAAAEELGIPEILLWTSGTGSLICYNQFTNLLEKELMPLKDPSYLVNGYLDTVVDCIPTMPGIRLKDFPPFIRIIYPGDEYMVRFLCLQVERAKRASAIIFNTFDALEHDVLDSLSSMYPPCYGIGPLHLLEKNIADKSLASFKSNLWKEEPECLKWLDSQAPSSVIYVNFGSIAVMTPQQLVEFCWGLAKSNYSFLWIIRPDLVIGDNAMLPPEFVTETSDRGMLVGWCPQEEVLNHPSIGGFLTHSGWNSTLESISSGVPMICWPFFADQQTNCWWSCNKWGVATEIDNNVKSDEVSKLVVELMKGEKGREIRKNVIDLKNKAQEACIAPSGSSMTNLEKVVQLMHTFSK

SEQ ID NO: 5497 - protein, 470 aa, Cephalotus follicularis
MASNSMDTSHHVVLFPFMSKGHTIPILGLARLLLLRPGITVTVFTTPANSPFISKSLTDTTASIIELPFPQNIPEIPPGVESTDKLPSISFHVPFTRATKLMQADFERALEAVPRVSFMVSDGFLWWTLDSANKFGFPRFVFYGMCGYANCVFKAVFENRLMIGPKSDDELITVPPFPWIKVTRNDFEPPFNDPEPKGPFFELFMDQIISTENSYGQIVNSFYELEPTYVDHWNSGGEHKKWCVGPLNLAEPPGLEPGRHQKPTWIQWLDQKWSQGSSVLYVAFGSQAEISGEQQKEIAKGLEESNVNFLWVIRRKEAELGEGYEERVGERGIVVMEWVDQNEILKHQSVKGFLSHCGWNSVLESICAGVPILAWPMMAEQHVNARMVVEELKIGLRVETCNGSVRGFVKWQGLEKMVRELMEGEMGKEARKKVKEFAEMAKAAFEEGSGSSRRTLDMLIDEICNATKMS

SEQ ID NO: 5498 - protein, 459 aa, Nelumbo nucifera
MGERPNHFLLVTLPMQGHINPTLQFAKRLLRTGAQVTFAISFSAYRRLMKSSTPIHGLTFAPFSDGFDDGYRVFFDEPSEFKLRASQALADLILAASKEHRPVTCLIYTLLLSWAADVANNLGVASALLWIQSAAVFDIYYHYFNGFRELIANSEDDPLSSIELPGLPRLTSQDVPSFLLPSNFLPLAVPGFQEQFQSFERETKIQVLINTFDAMEPEALGAIDKINMIGIGPLIPSAFLDDEDPSDKSFGGDLFHGSGDYIEWLNSKPDSSVVYVSFGSLAVLQTEEIANGLLESGRPFLWVIRLNRNETGEETMLGRWEELKERGLIVPWCTQVEVLSHSSVGCFVTHCGWNSTLESLVAGVPVVTLPQISDQTTNSRLIEDVWRTGVRTKVKTEEGIVESGEIKRCLDLVMGSESGNEMTRNVKKWKEMSKEAVKDGGSSDKNLKRFLEEIVMTGI

SEQ ID NO: 5499 - protein, 492 aa, Zea mays
MATAAVPASRTGSGGVVRRRRRRVLMFPLPFQGHLNPMLQLAGALHARGGLDITVFHATFNAPDPARHPPGYRFVPVGDGVPSADLVPSGVDADIPGALLRINRRLREPFRDCLRQALALPEDDGDEGGAPPACLVVDSNLRGMQLVAEELGVPTLVLRTGAAACLVAYLAFPALCDKGLLPPTSKDKSQLDIPLDGLTPLRLRDMVFSPTTTHANMTECLKCLVDATRSCSGVIFNTFRDLEDSDLQRIANGVVGVPIYPVGPLHKISPCTEDSLLAPDRACLEWLDKQEADSVLYVSFGSLARVDGKELLEIAWGLADSKMPFLWVLRHGLLVNSSSSDDDDDQDKVRRLLLPGGFEEATRGRGVVVPWVPQQEVLRHRAVGGFWTHSGWNSTLESVCEGVPMMCRPQFADQMINTRYVQEVWRVGFELDGDQLERRKIAGAVTKLLCTEEGRRMRQRARDLRDKAIECVQEEGASKSAIQLLIDRIASF

SEQ ID NO: 5500 - protein, 482 aa, Medicago truncatula
MEPSRPHVVCVPLPAQGHINPMLKLAKLLHHSGFFITFVHTQFNFDRLLQSSGQNSLKGLPDFRFETISDGLPPENQRGIMDLPDLCSAMPIGGLISFRNLIAKFVSSENEDVPPVTCIVSDGVMNFTLKVAQEFNIPEFMLYTPSGCGMLGYINFDELQKRGYFPLKDEKNVCDGYLETEVDWIPAMRGVKLKDLPTFFRTTNSNDTMFNYNRESVNNAMNAKGVILNTFQELEQEVLDAIKMKYPHLYPIGPLSMLHKKNSNSSSNNQLDSIDFNLWKEDVNCMNWLDKKDKGSVVYVNFGSLVIMTTKQLREFAWGLANSKYNFLWVIRPNLVDCGDEVISNDEFMKEIENRGLILGWSPQEKVLSHSCIGGFLTHCGWNSTLESICEGVPLACWPFFAEQQTNCFYACNRWGVGIEIESDVNREQVEGLVKELMKGEKGKEMRNKCLELKRKAEAATSIGGSSYNNYNSLVLKLKFEK

SEQ ID NO: 5501 - protein, 517 aa, Bicyclus anynana
MRLNYAYLQKMIKKALWLVVVILTLCEISAYKYLVVSPIPSKSHSILGDALVEYLADAGHEVTYITAFTPEKVSPRVTIIDTSDHIRNFPIDATFNLKSFMDGTVTTNNFMTFAPLMLEISRATLGNSNVRKLLADENQRFDAVIAEWMYNEVYVGFAGVFNCPLIWFSSIEPHWMVMQLIDEIPNPAYSTDMLTADSIPPLTFRQRVVELYTQIVGRLAQTFWLSGLERDVYNEYFVPFIRDRYNTVPPFEELRYNASLMLCNSHLSMNTPIRLPANVITIGGYHIKPNIKPLPEDLQTLMDNSKDGVIYFSMGSNLRSKHFPDEVKQSLLKMFGKLKQIVLWKFEEDLPNRPNNVHIVQWAPQQSILAHKNCILFITHGGLLSTTETVHFGVPIIGIPVFADQFVNVGRAVKKGFAQRVDLSYSLAADIEKAIRNVLDNPSYTTRVKELSAIYHDRTVPPATELVHWAEQVVKTKGARHLRSPAFMMPWYQKMYLDLILVLLVVLLVLKYVFIYI

SEQ ID NO: 5502 - protein, 367 aa, Medicago truncatula
MIFLCFSLISRLSHNLCQHRNHKHLLKSRGPKAFDGFTDFTFETIPDGLTPTEDSSNDDLIPPVSCLVSDIELFLLVHPHFCVLCSFVHLLIKVSYPSKMSYLTNGYLVTKVDWIPADDMVHEANAIVFNTYNELESDVVKALSIKIPSIYAIGPLSSFLNQNPQKHLASLGSNLWKEDMKCLESKEQGSVVYVNFGSTMLVIGGSVILSSEFVNGTSDRGQIASWCPQEQVLNHPSVGRFLTHCGWNSTLESICARVPMLCWPFFSEQPTYCRYICNKLEIGIEIDTNVKREEVEKLMNELMVGQKGKKMRQKAVELKKKKAEKDTRPGDSSYMNLDKVIKDVLEIILQKHTSLHYTISFLLHRLI

SEQ ID NO: 5503 - protein, 473 aa, Rhodiola sachalinensis
MAGSGTGAPHIALLPSPGMGHLIPMAEFAKRLVHHHNFTVTFIIPTDGPPSAAYRQVLASLPTSISHIFLPPVDLSDVVPSHPRIETLISLTVVRSLPSLHNTIASLLASKNLAALFVDLFGTDAFDPAIDLGVSPYIFFPSTAMTLSLILHMPELDRSVTCEYRHMTDLVRIPGCIPIRGSDLFDPVQDRTDEAYKRIVHHAKRYPMAEGIIENSFMELEPGALKYLQSVEPGRPPVYAVRPLIKMDYEVDSSGSKIIEWLDGQPIGSVLFISFGSGGTLSFDQMTELAHGLESSQQRFLWVVRSPSLIPNSAYFSAQSQNDPLAYLPDGFLNRTSDRGLVVPNWAPQAQILSHGSTGGFMSHCGWNSILESVVYGVPIIAWPLYAEQKTNSIIVVEDVKVAVRPAGVGEGLVKRLEVATAVKALMEGEEGKKVRNRMRDLKDAAARAICVDGASTKAIAELAKKWRSSVKH

SEQ ID NO: 5504 - protein, 317 aa, Theobroma cacao
MDQEQQPQAYPHVLIFPLPAQGHVNSMLKLAEVFALAGLQYPRFKFETIPDGLREDHPRLGDCFMELFEGMELRTKPILREMLVKINPPVDCIVGDGVLGLVLDVADELGIPIFQFRTISASCIWAYFAIPDMIEAGELPIRVFGKWTGVACHGLMSNQRNLLFRPDFMPEKGSIPVELVEGTKERGYMVGWAPQEEVLAHCAIGGFLTHSGWNSTLESLVAGVPMICWPYFADQQLNSRFVSEVWKLGLDMKDVCDRRVVEKMVNDLIVDKREEFVKSSAEIAKLAKACVNVGGSSYCNLDRLIEDIRSMNRNCSK

SEQ ID NO: 5505 - protein, 470 aa, Medicago truncatula
MTFQPDKNNPHPHTLVIPFPAQGHMIPLLDLTHKLASTITNLTITILTTPKNQSLLTPLLNSHPSTIHPLILPFPSHPSIPHGIENAKDLPNSFDTFILAVSKLHDPLLNWFHSHHSPPQYIISDMFCGWTQHLASQLNIRRLVFSPSGAFAFSTMCFNWKHLPSRVNPNDENEVVLYHNIPNSPKYPWWQVSPIFRSYIPGDTDSEKLKDLFLCNSQSYGIIVNTFAEFEKPYLDYLKTELGHDRVWAVGPLLPVDESSTMALQRGGSSSVSVNDVVSWLDQREDKKLVYVCFGSQTILNKDQTVAIASGLLKSGVHFIWSIKETKNENEGLDFEDAFLGRGLVIRGWAPQVMILRHRAVGAFLTHCGWNSVLESVVAGVPLIAWPMTADQFVDATLLVDELKVGKKVCEGGNSVPDSDELGRVLAEAIGGSGEEISRSLKLKQAAFDAVREGGSSDKDLQCLMEQLVL

SEQ ID NO: 5506 - protein, 474 aa, Oryza sativa
MAIPTLVLLPTWGTGHLMSLLDAGKRLLGCRGGGGLSLTVLVMQPPRKEYASAVAATVRREEASGLDIRFRHLPAVEPPTGCAGVEEFVSRFVQLHADHVRAAVSGLDCPVAGLVIDFFCTTLLDVARELAVPAYVYFTSNAACLALLLRLPALEGEVTVEFEEMDGEVDIPGLPPVPPSSLPMPVMDKKNPNYTWFVYHGRRFMEANGIIVNTVREIERSVLAAIADGRVTPGVRAPVIHPVGPVISFTPPSDDPPHECVRWLDAQPPASVVFLCFGSMGSLAPPQVLEVAHGLERSGHRFLWVLRGAPAAGGSMNPTDADLDELLPEGFLERTTGRALVWPTWAPQKEILAHAAVGGFVTHGGWNSTLESLWFGVPMVPWPLYAEQHLNAFTLVAAMGVAVAMKVDRKRNNFVEASEVERAVRSLMGGSEEGRKAREKAAEMKAVCRKAVEEGGSSDMAVHKLYEELSTQTA

SEQ ID NO: 5507 - protein, 471 aa, Vigna angularis
MEKAARLVFIPGPGVGHLVSTIQFANLLLERHHHIWITLLVIKLPSDTTTAAYTHSLNSHRLQLVNLPETPSDAQAIPITLIELQKPNVKEAVSNLSPTPPLAAFVVDMFCTSMIDVAKEFHVPSLVFFTSGLAFLGLILHLHTLKEEENAEFTEPDAEWVIPSFAKPVPIRNFPSVVLWKEWEEFFVAFGRGLKKADGFVVNSFEELESHAAHSFLDGPQLIFAVGPILNPKPKLHPDAPADNADIFDWLDNQPPSSVVFMCFGSMGSFGEDQVREIARALENSGARFLWSLRKPPPKGSRFIPPSDYAPSELPSILPAGFLDRTAGIGKVIGWAPQAQILAHRATGGFVSHCGWNSTLESIHFGVPIATWPLYAEQQTNAFLLVRELEIALEISLDYRAESKNETPSVLSAEQIENGIRNLVEIDDEKRKRVVEASENSRKTLLEGGCSYSSFGRLIDYVMNQGINSPC

SEQ ID NO: 5508 - protein, 468 aa, Citrus unshiu
MSPGHQIDMARIFASRGVKATILTTPLNISRFESSINRDDYHHHNPIKLLLLNFPSTAANLPPNCENLDAIPSRDLSYNFSKAIMMLQPQADDLVRQCQPDAIISDMNFPWTAEIARKYGIPRLVFRGTCCFSLSLSVAAAQHKPNVNVSSDTETFLVPGLPRPVYITQSQMPDQFFGNTDLQEFFEKFIKAERNSYGVVANTFFEIEPDYVKHYEKVTGKVVYPVGPPRGNEGDRGSVDEDYCVSWLDSRESNSVLYVCFGSLCEFAESQLLEIALGLESSNICFIWVIKSDAFLLLDKDFEERVKDRGLIIKGWAPQVLILNHPAVGGFMTHCGWNSVLESVSSGAPMITWPLFAEQFYNGNFVLTHWKIGVGVGVESGLAWGEEEKIGVLVRRDRVEKVVYQFMINGGEEVEGMRKRARKLSELAKIAVSKGGSSYVNVGLLIDDLLNQKVERLSKKKESVDQFV

SEQ ID NO: 5509 - protein, 474 aa, Unknown
  Description of Unknown: Oryza sativa Japonica Group sequence
MAMVEKTVLLYPCPAVGHLNPMVQLAEALVRRGVSVTLAVADPPDKGAVLAGAIARIAAVCPSIGVRLLPIPSCEGKTYSHPVMWIVDALRLANPVLRELLRSFPAAVDALVVDMFCIDALDVAAELAVPAYMFYPSAASDLAIYLQVPHVARSAPSSFKDMADTVLSFSGVPTIRALDMPDTMQDRESDVGTTRIHHCSRMAEARGILVNSFDWLETRALKAIRGGLCLPSGRSVPAIYCVGPLVDGGKLKENDARHECLEWLDRQPKQSVVFLCFGSRGTFSVSQLSEMARGIENSGHRFLWAVRSNLGEVDLEALFPEGFLERTQGRGFVVKNWAPQSAVLQHGAVGAFVTHCGWNSSLEAIMSGVPMICWPLYAEQRLNKAHLVEEMKLGVLVEGYDGELVKADELETKVRLVMESEEGKRLRERSAMAKEMAADAVKDGGSSDMAFAEFLNNLGTNNVKSGPRDTPVHD

SEQ ID NO: 5510 - protein, 480 aa, Arabidopsis thaliana
MKTAELIFVPLPETGHLLSTIEFGKRLLNLDRRISMITILSMNLPYAPHADASLASLTASEPGIRIISLPEIHDPPPIKLLDTSSETYILDFIHKNIPCLRKTIQDLVSSSSSSGGGSSHVAGLILDFFCVGLIDIGREVNLPSYIFMTSNFGFLGVLQYLPERQRLTPSEFDESSGEEELHIPAFVNRVPAKVLPPGVFDKLSYGSLVKIGERLHEAKGILVNSFTQVEPYAAEHFSQGRDYPHVYPVGPVLNLTGRTNPGLASAQYKEMMKWLDEQPDSSVLFLCFGSMGVFPAPQITEIAHALELIGCRFIWAIRTNMAGDGDPQEPLPEGFVDRTMGRGIVCSWAPQVDILAHKATGGFVSHCGWNSVQESLWYGVPIATWPMYAEQQLNAFEMVKELGLAVEIRLDYVADGDRVTLEIVSADEIATAVRSLMDSDNPVRKKVIEKSSVARKAVGDGGSSTVATCNFIKDILGDHF

SEQ ID NO: 5511 - protein, 465 aa, Unknown
  Description of Unknown: Oryza sativa Japonica Group sequence
MMTETVVVNAGLGVGHLAPMVELANLFPRHGLAVTVVLIEPPAKPPSFAAAVSRSMASNPRITFHVMPSPSCHSNVPELIRAMNAPLREYLRSSVPSARAVVFDMFCACALDVAAELGLPAYFFQCGGASHLAVGLHLPHVQAEINASFGEIGDEPLLFPSVPPFKPSDLPKAALDRNDEMYRWILGVFERLPESRGILVNTFQWLETKALRALGDGACVVGRPTPPVCCVGPLVSRSGEDKKHGCLSWLDAQPEKSVVFLCFGSMGSFPKEQLAEIAIGLERSGQRFLWVVRRPHAGEASLSGLLAGCHGTHGELDIDELMPEGFLERTKGRGLAAGSWAPQADVLRHRATGAFVTHCGWNSVLEGIAAGVPLLCWPLYAEQRLNKVFIMEEVGVGAVMAGYDGEVVRAEEVEAKVRWMLESNEASPIRERVALAKERAEEATRKSGSSHQSFVKFLIDFGVTK

SEQ ID NO: 5512 - protein, 473 aa, Fragaria vesca
MTQHRFLLVTFPAQGHINPSLQFVKRLIRTTDADMTFVTALSAHRRIANGSSMPRGLTFAPFSDGYDDGFKPGDIDIHHYMSELRRRGSQAITDIVMSSANEGRPYTCIVYTILLSWVAKVASELQLPAALVWIQPATVFDIYFYYFNGYKNLIRNSAMTNNCDPCHGVQLPGLPLSLKSRDLPSFMVDSNSNPYDFALPLFEEQFEQLGKESKPTILVNTFDALEPEALKAIEKYNLIGIGPLIPSFFLDGKDPSDESFGGDLFDKSKDSAYLAWLNSKPKESVVYVSFGSISVLSKIQMEEIAKGLLISGRPFLWVIRENQKNGEKEEDKVSCREELEELGMIVPWCSQVEVLSNPSLGCFVTHCGWNSTLESLVSGVPVVAFPQWTDQGTNAKLIEDTWKTGVRVEPNEEGVVVGEEIKRCLDLVMESDKMRMNAKKWKDLAREAVSEGGSSGKNMKVFLDQIGDGSFLA

SEQ ID NO: 5513 - protein, 463 aa, Unknown
  Description of Unknown: Oryza sativa Japonica Group sequence
MAIGTVESVAVVAVPFPAQGHLNQLMHLSLLLASRGLDVHYAAPPAHLRQARLRLHGWDPDALRSIRFHDLDVPAYESPPPDPTAPPFPSHLMPMLESFAVAARVPLAALLERLSASYRRVVVVYDRLNSFAAAQAARLPNGEAFGLQCVAMSYNIGWLDPEHRLVREHGLQFHPVEACMTKEFVELISRAEQDEENAASSGILMNTSRALEAEFIDEIATHPMFKELKLFAAGPLNPLLDATARTPGQTRHECMDWLDKQPLASVLYVSFGTTSSLRGDQVAELAAALKGSKQRFIWVLRDADRANIFADSGESRHAELLSRFTAETEGVGLVITGWAPQLEILAHGATAAFMSHCGWNSTMESLSYGKPILAWPMHSDQPWDAELVCKYLKAGLLVRPWEKHSEVVPAEAIQEVIEEAMLPEKGMTIRRRAKELGEAVRASVADGGSSRKGLDDFVGYITR

SEQ ID NO: 5514 - protein, 464 aa, Arabis alpina
MTPPHFLLVTFPAQGHVNPSLRFARRLIRTTGARVTFVTCQSVFNCSMIPNQSNLKNLSFLTFSDGFDDGGMSNVEDRQKRSLNLKTNGDKTLTDFIEANRYSDSPVTCVVYTILLNWAPKVARRFQLPSALLWIQPALVFDIYYNHFTENNTSFEFPNLPSLAIRDLPSFLTPSNTNKDAYGSFQEMIELLKEEANPKILVNTFDSLEPEALTAYPNIKMVAIGPLLPTEIFLESTKSVKDVSREQSRYSLWLDSKTESSVIYVSFGTMVELSKKQIEELARALIDGKRPFLWVITDKSNREAKTEGEDETEIEKIDGLRHELEEVGMIVSWCSQVEVLRHRSVGCFVTHCGWNSTLESLVLGVPVVAFPMWSDQPTNAKLLEEQWKTGVRVRENEKGLVERGEIRRCLEAVMEEKAVELRENAEKWKRLAAEAVGEGGSSDKNMEAFVEEICGNSVQWKRGG

SEQ ID NO: 5515 - protein, 452 aa, Helianthus annuus
MEKPSHIAIIPIPGMGHLIPLIEFSKKLLAQHNLSATFIIPNEGPLSNSQYEFLDSLPDAINYTLLPPVNFDDLPQDTKIETRLCLLATRSATALHATISSMMADKKIVALFVDLLAADAFDVADKFGVPRYLFFAASAMCLSLCLYLPKLDQMVSCEYRDVPDPIQIPGCIPVHGRDLLGSLQDRNNEAYKRVLHIAKRYVMADGIVQPGMPPVYPVGPLIQSGSVESSKGVNESSCLKWLDGQPCGSVLYICFGSAGTLSSEQVTELAMGLELSEQRFIWVVRPPHDKGADGTYLNSQGHDGTFDFLPKTFLERTKNRGLVVPNWAPQARILSHSSTGGFLTHCGWNSILETIVHGVPVIVWPLYADQKMNAIMLTEGLQVGMRAKLNENGIVDRLEIARVVNGLLQGDEGKAIRIRTHKLKEAALSVLSKDGCSTKTLDQLASKLKNKI

SEQ ID NO: 5516 - protein, 475 aa, Brachypodium distachyon
MASHAEPAQGEAAGAGAGGGHVLLLPYPSQGHVHPMLQFAKRLAHHGMRPTLAVTRHILATCTPDAALASAVRVAAVSDGCDAGGFGECNDVDDYLSLLEAAGSETLGELLRAEAAGGRPVVAVVYDAFLPWARGVAAAHGAAAAAFFTQPCAVNVAYGHVWGRKVSVPVEAGAKVVGLPGLPALQPEGLPWFLKVGPGPYPGYFEMVMSQFKGLELADDVLVNSFYELEPEEAAYMASAWGAKTIGPTVPASYVGDDRLPSDTKYGFHLFDLTAAPCIEWLSTHPARSVVFASFGSLSNLDPAEMREVAQGLLDAGRPFLWVVRCSEAHKLPAGYSEACGSRGGLVVSWCPQLEVLAHRAVGCFLTHCGWNSTAEALVAGVPMVALPQWTDQPMNAEYVEAVWRVGVRVRPAAEDGLARSGEIVRGIEEVMEGEKSGEYRRNAAAWVEKARAASREGGSSDRNIAEFVAKYSSK

SEQ ID NO: 5517 - protein, 460 aa, Ricinus communis
MGHPHILVVTFPSQGHINPGLQLAKRLVTLGLKVTFATTISTHRRMSRTDDSNGLLSFATFSDGHDDGYNLLGGDFAHCLSELTHYGQQTFPKIILRSAKDGHPVTCIIYSLLVSWVAKVARDFHLPSIFLWNQPATVLDVYYHYFHGYEGDIEKSINSPTISVNLPGLPPLRSSDLPSFFSPKSNTKLHGFALPALKEHFHILDAETNPRILVNTFDELEHEALNSIKKYNLIGVGPLIPSAFLDEKDPSDTSFGADLVQGSNSYTEWLDSKPKSSVIYISFGSIAMLSEKQMEETAKALIDIDRPFLWVMRENDIGVKHRKELQQKGIIVDWCCQVEVLSHPSVGCFVTHCGWNSTMESFVSGVPVVALPQWSDQGTNAKLVTDVWMTGIRMVPNERGIFEGEQLKKGVQLVMGEREKAKEMRKNARKWKDLARDAVKEGGTSDKNLKTFLDEIIEGC

SEQ ID NO: 5518 - protein, 469 aa, Medicago truncatula
MDTIRDEEKALHIVMFPWLAFGHMIPYLELAKLIAQKGHKVSYVSTPRNIQRLPKLPPNVAPLIKFVNLPLPKVDNLPENAEATTDIPYDVVPYLKNAFDKLEKPFTHFLETSNAGWIFHDFANFWIAPTASQLGIKCAFFSIFTAPTMGFLGPVSVILGDEPGRTKPEDFTVAPPWVPFQTTVAYRYFEIIKTADILSDKILGTSDLHRYGLSIQNSDFILIRGCTEFEPEWFQVIQNIHQKTVLPAGQLPNTEFDSGHENDSWPRIKEWLDKQPHGTVVYVAFGSEAKPSQEEVNEIALGLEKSNLPFFWVLKVRRGPTDKVVLQLPEGFEERTKGRGVVCTDWVPQMKILGHMAVGGFLTHAGWTSVVEAVQHEKPLVLLTYLSDQGINARVLEEKKMGYSVPRDERDGSFTSDSVAHSIRLIVVEEEGMIYRENIKNMKDLFVNIERQDKYVNNLLSHLTSLLKH

SEQ ID NO: 5519 - protein, 482 aa, Indigofera suffruticosa
MAKKRAQVVFIPSPGAGHFGSTVEFAKLLSNRDEGISITVLVMKSPFDHSTSANSCTESLSSFERIKVTHLPEVQVTADQFNPGSFMTELLELQKPNVTQVVSNLTASASAPPLAAFVVDMFCTTMIDVAEQHFKVPSLVFYTSGLAFLGLILHLHTIRERDNIYFGDSEADVAIPSFVNPVPPKSLPSIVVNKEWNPFFLRYGGGLKRANGLIVNSFEELESHAVRSFSSTSEFHHLPVYPVGPILNFNGGDDADNNNNNEEIIKWLDDQPPSSVVFLCFGSMGSFDEDQVREIAIALDNSGARFLWSLRKPPPKDTMGKPSDYAPSELPAILPDGFLDRTAGIGRIIGWAPQTQILAHPSTGGFVSHCGWNSTLESIYFGVPIAAWPLYAEQQTNAFELVCELKVAVEIALDYRVEFKGGRNMLLSADKIERGIRSVLEKDGEFRNKVKEMSEKSRKTLLPGGCSYSYLGRLVDYLMDQV

SEQ ID NO: 5520 - protein, 490 aa, Polygala tenuifolia
MDQTASSAKPHVLILPFCAQGHIKPMFKLGQLLCHAGLRISFVNSEHNHQNLLRQIDLLAFQAQYPEFSFLSIPDGLAVDHPRSGLTSGDLFLPPARSVMTQHLNELITGFIGRNTKPACIIADGVMCFAIHVAREFEIPSITFRTYSATCTWAYFHFKTLTQEGLVPLPEGVDMDNPVTCIQGLENLLRNRDLPIMCRYKVAARAVEFFIEETSIMAQASALLLNTFDELEAPLISKLRSIFNKIYTIGPIHSLYKSYIKSNLPQSNGLSNTSGSLVQEERSCMTWLESKPPKSVLYVSFGSVVELKQNQLLEFWHGLVNSEKFFLWVIRSDLISGEKDAGQNVPAELKEGTMDRGCIVSWAPQEEVLAHPAVGGFMTHSGWNSTLEGIAAGVPMICWPLISDQQVNSRCVSDIWKTGLDMKDKCDKVIIEQMVRDLMENKKDEIRISAEEKGRLAQESVEKGGSSYNNFEKLIEDIRSMALARAHESS

SEQ ID NO: 5521 - protein, 499 aa, Theobroma cacao
MLTTLYINPTEAGFVHIHQRIHIAISGTQRDSSAFFPKMPNQENSVAVVMVPFPAQGHLNQLLHLSRIVLSYGIPVHYVATPTHNRQAKIRAHGWDPVATANFHFHDCQVPPFLSPPPDPSSAIKFPSHLQPCFDACWHLCQPVTELLRMLSSQARKVIVIHDSMMGSVVQEVGSIANAESYTFHTVSAFSLFFYVWESIGKPEVNAEMPDEGDVPSLEGCFTKDFLEFIALQFQYLRDNAGIIYNTSKVIEGPYLELLGGIMRGKQHWALGPFNPVRIPGKNSSASRHFCLEWLDKQATNSVLYVSFGTTTAMDDEQIKELAIGLRKSNQKFIWVLRDADKGDVFNGEVRRPELPQGYEDSVKDTGLVVRDWAPQLEILAHPATGGFVSHCGWNSCMESITMGVPIGAWPMHSDQPRNAVLITKLLKVGIAVKDWERRDGTVTAPIVEDAVKRLMASKEGDEMRKRAAEVGGAVRQSVAEGEVSQKERDSFIAHITRK

SEQ ID NO: 5522 - protein, 479 aa, Sorghum bicolor
MAGDDGRAPTPTGRRVVMFPFPFGSHITQMLQLGELLRARGLGVTVLHTDFNAPDPACHRDLTFVSIRETLPADVVASPDMVEQMIRLNAACEAPFQAALAEELLAARGGTTTVVACVVVDRQWYRMLGAATRVAVPALALCADGAATFLSMLATPRLVADGYLPIKEERLDEAVPGLEPLRVRDLIRVDGSDDETVLRFITLDAEAVRASSSGVVLNTFEGIEGAELAKVRRELSGRPAFAVGPLHLQAPPAPAAGRGQFQHAPDRSCLAWLDARPPRSVLYVSMGSVARVDRAVFEETAWALAASGVPFLWVLRRGSVVRGGGGAAGVDAEEEEVPPPVPEELRETVRHRGKIVAWAPQREVLAHPAVGGFWTHCGWNSMVEAIAEGVPMLVQPFFAEQIVNARYVTHQWGVGFEVGKPLERTAMARMIRRLVVGELGPQGPRERARLLMGQAKECVAEGGAASLALDGLVEYISSL

SEQ ID NO: 5523 - protein, 497 aa, Oryza sativa
MATMDEQQPLHILFLPFLVPGHLIPIADMAALFAARGVRCTILTTPVNAAVVRPAVDRANDDALRGDAGGAPAIDIAVVPFPDVGLPPGVESGTALASEEDRGKFVHAIQRLREPFDRFMAEHHPDAVVADGFFTWSVDAAAEHGVPRLVFLGTGVFARSCQESMVRHNPVEACPDDDPDAAVSLPGLPHRVEMRRSQMIDPKKRPDHWAYFKMMNDADQRSYGEVFNSFHELETDYVEHYRTALGRRAWLVGPAAFASKDVAARGAAELSPDADGCLRWLDAKPHGSVAYVSFGTLSSFSPAEMRELARGLDLSGMNFVWVINGAADDTDASGQWMPEGFPELISPHGDRGLTIRGWAPQMLILNHPAVGGFVTHCGWNSTLEAVSAGVPMVTWPRYADQFFNEKLIVEVLKVGVSVGSKDFASNLENHQVIGGEVIAGAVRRVMGDGEEGAEAIRKKAAELGVKARGALEKGGSSHDDVGRLMDALMARRTSVDV

SEQ ID NO: 5524 - protein, 456 aa, Citrus unshiu
MEREIFVVTGYGQGHLQPCMELWKNFSSRNYHTTLVIPSILVSAIPPSFTQYPRTRTTQITSSSRPMPPSDPLSQQAAKDLEANLASRSENPDFPAPLCAIVDFQVGWTKAIFWKFNIPVVSLFTFGACAAAMEWAAWKLDATDIKPGETRLIPGLPEEMALTYSDVRRKSSVPSRGGRGGPPKPGDKPPWVPEIEGSIALMFNTCDDVDGLFIKYMADQIGIPAWGVGPLLPEQHWKSTSSLVRHCEITEQKRQSSCSEEEVIQWLDSKPRGSVLYVAFGSEVGPTREEYRELAGALEESPGPFIWVVQPGSEEYMPHDLDNRVSNRGLIIHAWAPQALILNHISTGGFLSHCGWNSTMEAIVHGVPFLAWPIRGDQYFNAKLVVNYIKVGLRVTDDLSETVKKGDIAEGIERLMSDEEMKTRAAILQVKFEQGFPASSVAALNAFSDFISRKVT

SEQ ID NO: 5525 - protein, 480 aa, Ziziphus jujuba
MVQPRFLIVVYPAQGHINPGLQFAKRLIHIGAEVTFVTTISAYRRMNKAASIPSGLSFAPYSDGYDDGFKYGVHDADHFLSELSRCGKQAISDLVVSAAKEGRPFCCVVYSILLPWAPEAAHELQVPSALLWIQPTTVFHIYYYYFHGYDNAITNNGAFNDGPSWSIELPGLPLKLKRRDLPSFMDAGNAYTFAIPLFKDQFEKLELGNNRKVLVNTFDALEPEALKAIGINFDLIGIGPLIPSAFLDGKDPSDTSFGGDLLQHPKDYYIEWLSSKPKGSVIYVSFGSMSVLAKPQMEEVGRALLEMGRPFLWVIREKPDSNNGEDKKEEDQLSCREELEKLGKIVPWCSQLDVLSNSSCGCFVTHCGWNSTLESIACGVPMIGYPQWSDQGTNAKLIEDVWKIGLRVNKNKDGIVESDEFKRCLEVVMGDGDKGEEMRRNAKKLKDLARESAKEGGSSDKNLKEFVDEINQKERAGPQV

SEQ ID NO: 5526 - protein, 442 aa, Cephalotus follicularis
MELCGHLSPQNYHTIHVFSSNLSSAIASFFTQNPLHKIAQISPSPRPMPGSDPLSQQSAHDFEAYLITHARVPDLPSPLCAIIDFQMGWTKGVFFFWKFNIPVIGLFTLGVCTAAMEWNAWKVLAGDLKSGETLPVRGLPEEMSLTHSDFLRKPFGPQRGSGQSKTDPKRGGRGPPKLGDRPPWVPKIQGSIALMFNTSDYIDGPFIEHMADQMGMSAWVVVPLLSQQYWNSSAKLIRNCEITEDKQCQSNFTEDEITQWLDSKPRGSILYVDFGSKVGPMMELASARRVRWALRLGHTTGVGGLDKRMGDGGLVIYGWEPQLLILSHKSAGGFLSHCEWNSTMEAIGRGIPFLSWPIRVDQYFNAKLVVSYHKVGYRVAHDLSLLITKDDILMGVQRLIGDIEMKRRAEVLYAKFEHGFLASYVAALDAFENFTSQNQMVV

SEQ ID NO: 5527 - protein, 486 aa, Dianthus caryophyllus
MGAEPKRLHIVFFPFLAHGHMIPTLDVARLFAARNVEATIITTRVNAPRFTSAVDTGNRIGNNQTVKLELLRFPTHEAGVPEGCENAEIAMRIPGMMPRFFKGTQLLREQLEQYLSRVKPNCLVADMFYPWATESANKYDIPRLVFHGTSYFSLCAQEIVRVHEPYKMVLCNNEKFTIPLIPHDIKLLRSQMCPDLISDEDNDFRKRMDLVKKSEVESYGVIVNSFYELEPDYAEVYTKELGRKAWHVGPVSLCNRSVLEKGRRGNQASIDEHECLTWLDSKKLASVVYISFGSMSSSITPQLHEIATALENSGCNFIWVVRSGESENHDESFPPGFEQRTKEKGLIIRGWAPQVLILDHEAVGAFMTHCGWNSTLEGITAGVPMITWPHAAEQFYNEKLVTEILKSGVSVGAKIWSRMPSVEDLIGREAIEIAIREVMDGEKAETMRLKAKWLKEMARKAVEEGGSSYTQLSALIEDLKNYHTQK

SEQ ID NO: 5528 - protein, 273 aa, Helianthus annuus
MLSSSPKEHKFVMEFIKDHVDALKIFSRILVNTFDELEIDPIRAIEKVVMLPVGPLVPSEFFEGRGPPNSSFSCDLFEKPMEDYIKWLNTKPKSSVVYVSFGSMATLSIEHVEEMASGLVESAPPFLWVIRDSGQVGKLSKIEELKKQGMIVSWCSQVEVLNHQAIGCFLMHGGWNSTMEALATGVPTVVFSQWSDQATNAKMIEDVWKTGVKVKRREEDGMVEGKEIKRCVEMVMEDEEVRRNAKKWRELARQAINNEGSSAINLKAFLDDA

SEQ ID NO: 5529 - protein, 438 aa, Helianthus annuus
MPVGRKILIVSYAGAGHINPSLTFADRLRKMGVDVTISTSFFVLKNIKDKETTPHGLTFAPFSDGHDNGIQPTTTLQQFISDFATNGARSVGETITSAVAAGQPFDHLVYTSGIPWAAKVAQAHKLKSSLLWCQPATVLNIHYYYFNGYENLIADNMNNASFPIELPGLPSLTTADLPSFYSPSRPKEHDFLMQVLEDHVDALKTAPRVLVTSFNELEIESITASEQLEFLPIGPLIRSDGKENDECIRWLDTKLEASVVYVAFGSQAILSMEQVEEIAIGLVTSSRPFLWVIRDSEQARRVSKTAQLQTQGMIVEWCSQVAVLNHRSIGCFVTHGGWNSTIEALVAGVPTVVFPQWADQPTNAKMIEDVWKTGVRVTRRGDGVVDGKEIDRCLQKVMTGDDGGEMRRNARKWRDLATEALENGGSSTVNLQAFVNDV

SEQ ID NO: 5530 - protein, 416 aa, Genlisea aurea
FYITFVNTHFNHRRLIQSHGIQALSGLPDFRFASIPDGLPPSDANATQDVPSLCKSTTTTCLEPFCELIHELNKEKKVDCIVSDGVMSFTLKAAERFRLPEVLFWTTSACGLLGYMCYQRLIDEGITPLKDVGQLSNGFLDTVIDWVPGVKGGGLRLKDFPTFIRTTDPDDIMLNFVIQETEALKRASGILLNTFDALEEDVIAALQQILPPIYTVGPLNLSLHRIPDGPVKSIGSSLWKEESECLKWLDNKNPATVLYVNFGSITVATPEQLTEFAWGLANSGSPFLWVIRPDIVFGESAMLPEAFLQATKDRGILASWISQEEVLGHAAIGGFLTHSGWNSTIESISSGVPMICWPFFAEQQTNCRFSCVEWGVGLEIDSDVKREDVEKLVRELMEGEKGKRIKEAAAKWRNEA

SEQ ID NO: 5531 - protein, 478 aa, Unknown
  Description of Unknown: Fragaria x ananassa sequence
MEKPAELVLIPSPGIGHLVSTLEIAKLLVSRDDKLFITVLIMHFPAVSKGTDAYVQSLADSSSPISQRINFINLPHTNMDHTEGSVRNSLVGFVESQQPHVKDAVANLRDSKTTRLAGFVVDMFCTTMINVANQLGVPSYVFFTSGAATLGLLFHLQELRDQYNKDCTEFKDSDAELIIPSFFNPLPAKVLPGRMLVKDSAEPFLNVIKRFRETKGILVNTFTDLESHALHALSSDAEIPPVYPVGPLLNLNSNESRVDSDEVKKKNDILKWLDDQPPLSVVFLCFGSMGSFDESQVREIANALEHAGHRFLWSLRRSPPTGKVAFPSDYDDHTGVLPEGFLDRTGGIGKVIGWAPQVAVLAHPSVGGFVSHCGWNSTLESLWHGVPVATWPLYAEQQLNAFQPVKELELAVEIDMSYRSKSPVLVSAKEIERGIREVMELDSSDIRKRVKEMSEKGKKALMDGGSSYTSLGHFIDQI

SEQ ID NO: 5532 - protein, 250 aa, Genlisea aurea
YTRGPGEDYPFPAIKLADDDKFDPRAIHGKSFSGVENEFFGGVFKFSTGVVILKSYGDIEAKHIQYLSELCGRKVLPAGPLVSESDYDNQSSEIVDWLDGKTPGSTVYVSFGSEYSISGEETRQLAKGLELSGVNFLWLYRSQSETSIEELLPEGFSERTGERGMVATKWAPQTVLMTHPSIAAFVSHCGWGTLTECLYFGIPIIAMRLKLTDWPVNAALMVESGAGVTMDRKGGIYTAEEIAKSISGAV

SEQ ID NO: 5533 - protein, 461 aa, Ricinus communis
MAQGHSIPLIDMAKLFASRGQKVSIITTPVNAPDISKSIQRSRVLGHKIDIVIIKFPCVEAGLPEGCEHLELVTSPEMVSVFFQATTILAQPLEHLLKKYCPDCLVSDTFFPWSNKVASKFGIPRIVFSGTCFFSSCASQCMYLYQPCKNVSSDTDVFVIPNLPREIKLTRNQLPEFVKEETSFSDYYRKVKEAEAKSYGVLVNSFYELEPTYADHYRNVLGIKAWHIGPISLCNSNNQDMLNRGKEASIDENECLEWLNSKKPNSVVYICFGSLANFVSSQLLEIAMGLEDSGQQFIWVVKKSKSNEEDWLPDGFEERMKEKGLIIRGWAPQVMILEHKAVGGFVTHCGWNSTLEAVSAGVPMVTWPVSAEQFYNEKLITEVLRIGVAVGAQKWLKLEGDGVKKEAINKAVTQVMVGGKEAEEMRCRAEKLGEMAKKAVAEGGSSHSDFNTLIEGLRSKN

SEQ ID NO: 5534 - protein, 313 aa, Medicago truncatula
MTTSFNLYFPALHEQVSCEYKDHTDLIQFPGCLPICSQDLPPEFFHDRSSVRYSFFLLHSKNLSLAHGFLVNSFSKMEASTGRALQEEHNKTTKLVYMWLENQTPNSVLYVCFGSGGTFSQQQTNELALGLELSGQKFLWVLREPSKSKDVDYKIASIGNDDNDLLKYLPHGFLERTKEQGLVVPLWAPQTKILSHNSTGGFLTHCGWNSTLESIVSGVPMVTWPLFGDQRMNAILIVEGLKVGLKIKFNENDIAEREEIAKVVKDLMLGEERSEIRQRIEELKDEAACALAGDGSFTRALFEFGTRVENFSL

SEQ ID NO: 5535 - protein, 468 aa, Ricinus communis
MESLCSEQTYHVVLFPFMAKGHTIPILDLARLFLHRQIAVTIFTTPANLPFIAESLADTNVSIVELSFPSNVPEIPTGIESTDMLPSMLLWPSFVFSTKLMQPNFERALENLPPVNFMVSDGFLWWTLESANKFGFPRFVFFGMSNYAMCVEKAVYENKLLFGPESEEELITVTPFPWIKITRSDFDPSFSNPESKGLFFELAKLVFTAASSSFGYIMNSFYELEQVFVDYWNNHSERQLTWCIGPLCLAERPRLQRVDNNKPTWIQWLDQKLEQGQPVLYVAFGTQTEISLEQLQEISIGLEVSKVNFLWVTRDKGINLEGFEERVKGRGMIVREWVEQREILMHKSVQGFLSHCGWNSVLESMCEGVPILAWPMIAEQPLNARMVVEEIQIGLRVETCDGSVRGFVKSEGLRKTVKELMEGDVGKKTRKKVKEVAKMAKEAMKDNTGSSWRSRDLLIQNCNCKVSL

SEQ ID NO: 5536 - protein, 241 aa, Ricinus communis
MARSAGIISITFEALEERALKAVREGHCTPGEPVPPLYCILPGGGIESTIKEQHACLSWLDAQPSRSVVYMNFGSVGKVSANQLKETAIGLEKRGVRFLWVVRNPIAEVLNHDSVGGFATHCRWISVLESLSAGVPMLAWPLYAEQRLNMAALVEMKLPLSIKQSYDGYVSATELEERVNELMNSEKGKAIGERAMVMKEAAAEVTKDGGSSRIAIAQLVESFKLKQIQNMLNLHHKLLSK

SEQ ID NO: 5537 - protein, 494 aa, Centella asiatica
MASNIQQLHFVLVPLMSQSHIIPLTDFGKLLAQRGVVVTMITTPLNAVRCKPIIDGAQNANLNIQLASLHFPTREVGLPEGVENLDELSMKSLKTLGINFFQANEMLREPLEKLLAEMVPRPSCIISTDALPWTNEVAWKFKIPRYSFNTISCFSLVLFHKLKISRVHESVTSDSESFVVPGLPDKIELKRSQLPEWVKRTSNDNNSHVMDKLKATEHLPRGVLVNTFEEMEPRYVEEFKKQEKLVFCVGSVSLCNTDQSDMSSRGNKASVEEDSCLKWLDSMKPCSVIYVCFGSLSNIPYPQLIELGLGLEASNRPFIWIIRKGDYSPRLEKWLEEYRFEEKVKGRGLIIRGWAPQVLILSHPSVGGFFTHCGWNSILEAVCEGMPMITWPMFAEQFYNERFVVDVVKIGVPVGVEEALTSVEDEEKFELLVTSSQVKEAIDELMDGEDAGERRKRARELGEKAKKAIEDGGSSYLYITNLIEDVRQQNSSRF

SEQ ID NO: 5538 - protein, 458 aa, Centella asiatica
MVTNSKDNNALRILMFPWLGHGHISPYLELAKKLSRKDSKIYFCSTPINLKPIKNKILDYNSIELIEFPLPSSQELPPHYHTTTGLPPHLLPALKDAFEMASPQLSNILDTITPDLLIYDIYQPWVPKLASSYKIPAVHFQTTGATAISYFYRLSMNLKTAFPSTIIHLKDIELVRMLETGGGDESDPENEQDRDRVFDSILGSVEILLIKSSREIEGKYIDCLSDFIKKKIVSVGPLVQEFVGNDQENDDVITWLSKKEPFSTVYVSFGTESFLSKKDLEELAHGLELSGVNFIWALKFPEAEKITKVEEALPQGFLERVGEKGLVLGGWVPQAKILNHSSIGGFVSHCGWSSVIESLSFGVPIIAMPLQNDQPLNARLVVEVGVGLEVEKDDKLEFGREEVARVVKEVVVEEKSRETFGKRVKELSEVLKVKADEDVDNAIKELKRLCENNLRKVE

SEQ ID NO: 5539 - protein, 448 aa, Rhodamnia argentea
MATTRRTIRVLMLPWLAHGHIGPFLELAKKLSKRNFHIFLCSSPINLTSIEIPHEYGSTIELVELNVPSLPGLPPQYHTTRGLPPHLMPKLKTALDMAGPCLSKIITECRPNFLIFDHLLPWAPEVARSHGIPSVDFSGVAAGTTSYALHSIKRLGDEYPFKAMSLQDHWTMKFRNQFEQASENGMSDTERFMRCIHQSSGLIFLKTFRELEGKYIDYLSDLLGKKVVPVGPLVQDPVQEDGNPIIEWLDQKERSSAIFVSFGTEYFLSEKEREEIACGLELSNVNFIWVVKFPAEEHIKLEETLPKGFLGRVRDRGLVIEGWAPQATILAHPSVVGFVSHCGWSSVMESMTFGVPIIAMPMHLDQPLNARVVEDVGVGLEVTRNESGELEREEIAKVIRGVVVEEGGERVRNRVKEVSIGIRNKGDEEIDQVEDAIVKLCGIALGSC

SEQ ID NO: 5540 - protein, 523 aa, Citrus unshiu
MMQLAMALEASGKNFIWVVRPPIGFDINSEFKANKWLPRGFEERIKCSGQGLVVHKWAPQVEILSHRSVSAFLSHCGWNSVLEALSHGVPIIGWPLAAEQFYNSKLLEEEMGVCVEIARGMSCEVLKEDLSAKIELVMNETEKGTDLRNKANEVKMLQSLLQTLVNTPLNLKRLKSSLPQNSSIHLLEIPFNSIEHDLPPCTENTDSIPHHLFPRFLQASASLEPHFKKLISELVNEQNGQKPLCIITDSFLGWCKETAQEYGIFHAIFIGGGGFGFACFYSLWVNLPHRKTDADKFLLPDFPEASTLHVTQMSLSLRAADGSDSLSVLSKELFLQWKDADGILASGKNFIWVVRPPIGFDINSEFKAKEWLPQGFEEKIKGSGQGLVVHKWAPQVEILSHRTISAFLTLSHGVPIIGWPLAGEQFYNSKLLEEEIGVCVEVARGLTCEVLKEDLSAKIELAMNETEKGTDLRNKAKEVKVIIKNAVRNEDNFKGPSVKAMDQFLNAALIMRQMEKGASKNEV

SEQ ID NO: 5541 - protein, 477 aa, Rosa chinensis
MEKPAELVFIPSPGIGHLVSTLEIAKFLLSRDDQLLITVLIMKFPAVSKGTDAYVESFADSSSPISQRIKFINLPQVNTDHTEGSVRNSLIGFVESQQPHVKDAITKLSESQTRLAGFVVDMFCTAMIDVADQFGVPSYVFFTSSAAALGLMLHVQALRDQEGKDCTEFKDSDAELLIPSFVNPLPAAKVLPGRLFVKEGAESFLNIIKRFRDTKGILVNTFADLESHALHALSSDAVIPPVYPVGPLLNLNTNESSVDSDEAKQKSDILKWLDDQPPLSVVFLCFGSMGSFGEDQVKEIAHALEQAGHRFLWSLRRPPPTGKIAFPSDYDDHTGVLPKGFLDRTVGIGKVIGWAPQVAVLAHPSVGGFVSHCGWNSTLESLWHGVPVATWPLYAEQQLNAFQLVEELELAVEIDMSYRSESPVLVSAKEIERGIREVMKRDNDIRNRVKEMSEKGKKALMDGGSSYSSVGQFIDQI

SEQ ID NO: 5542 - protein, 479 aa, Vitis vinifera
MDQGSISPHVLIFPFPIQGNINSMLKLAELLCLADIQVTFLNCHYPHRRLLSYSNIQARFSRYPGFRFETISDGLPMEHPRTAEQFLDIVDGVKTTTAPLFMEMMISWCRSASDTRSPLTCIIADGLMSFAIDVANEVGLPVIIFRPISACSFWAYFSLPQLIEAGEVPFRGGDMDRLVASVPGMEGFLRRRHLPSSGRVNDVAYPGLQHLMKIFRQAQRAHSLVINTFDDLEGPVLSQIRDHYPRTYAIGPLHAHLKSKLASETSTSQSSNSFRKEDKSCIPWLDRQPPKSVIYVSFGSLAIITKDELGEFWHGLVNSGNRFLWVIRPDALVGKDEERQTPAELLEGTKDRGYVVGWAPQEEVLKHPAVGGFLTHGGWNSTLESIVEGLPMICWPYFADQQINSRFVSHVWKLGMDMKDSCDRVTVEKMVRDLMVEKRDEFMKAADTLATLAKKCVGDGGSSSCNLNSLIEDIRLLST

SEQ ID NO: 5543 - protein, 481 aa, Medicago truncatula
MSSEDTEIKPEIHVLLVAFSAQGHINPLLRLGKSLLTKGLNVTLATTELVYHRVFKSTTTDTDTVPTSYSTNGINVLFFSDGFDISQGHKSPDEYMELIAKFGPISLTNLINNNFINNPSKKLACIINNPFVPWVANVAYELNIPCACLWIQPCTLYSIYYRFYNELNQFPTLENPEIDVELPGLPLLKPQDLPSFILPSNPIKTMSDVLAEMFQDMKKLKWVLANSFYELEKDVIDSMAEIFPITPVGPLVPPSLLGQDQKQDVGIEMWTPQDSCMEWLNQKLPSSVIYISFGSLIFLSEKQMQSIASALKNSNKYFLWVMKSNDIGAEKVQLSEKFLEETKEKGLVVTWCPQTKVLVHPAIACFLTHCGWNSTLEAITAGVPMIGYPQWTDQPTNATLVSDVFRMGIRLKQDNDGFVESDEVERAIEEIVGGERSEVFKKNALELKHAAREAVADGGSSDRNIQRFVDEILVTAIDSNN

SEQ ID NO: 5544 - protein, 443 aa, Oryza brachyantha
  MOD_RES (114)..(117): Any amino acid
MAAAAAPRCSPMLLLAAALHARGLAVTVVHAETRVPDRRSLPAGCELVTVPDGIPPELAASNDIPSFVFALNRNCAAPFRDLLAAALREDDDGRRVACVVVADVDWFAPPPPAXXXXALMTSSAARFRVYMAYRRLSEMGYLPVQESNMDKPVDELPPLLVRDLHARMDTARHVAYADLLDHIVAGVRQSSGLILNTFDAIERADVEHIRRDTSIPVFPVGPLHAISPVAAPQQSGALPEEDRSCLAWLDTQLPGSVLFVSFGTLVSIDADELMELAWGLAGSNRPFLWVVRPRLVRGRDSVELPGELLQEIRGRGVIVRWVPQEEVLSHPAIGAFVTHCGWNSTLESISKGVPIICKPCGSDQLGTARYVCDMWKVGVRVEIKDKVTREGIQVAIERLMDGKEGEMVRDRIIEMSDVVSKCTMKGGSSELAMNDLVDFIESS

SEQ ID NO: 5545 - protein, 361 aa, Medicago truncatula
MRHIRCQNVTIITTPSNAQILGKSIPLNQHLRIHTVPFPSQEVGLPDGVESLSAATDFNNMVKIFQATTLLRPPIQHFVEQHPPDCIVTDFLFPWVDELANKLQIPRLSFNGFSLFAICAMESVKAHSLYGYASFVIPGLPHSIVMNATPPKQMSEILGERLEMVFKSQGILVNNFVELDVVPEKKGKENESQEEKEKWLPKGFEERVIAKKKGLIIKGWAPQVMILSHTVVGAFMTHCGWNSTVEAVSAGVPMITWPMHGEQFYNEKLITQVRGIGGEVGAVEWCLVGIGEKEKLVGRDGIEKVVKRLMDNSYVAEIIRRHAREFGDKAKCAAQEGGSSHRNLTVLINDLKSLRDNKLLV

SEQ ID NO: 5546 - protein, 359 aa, Vigna angularis
MSFTVDAAQELGVPEVLFWTTSACGFMCYVQYEQFIQKGITPLKDSSDVTNGYLESTIDWIPGIKEIRLKDIPSFIRTTDSNDLMLDFVQGECKRARRASAILLNTFDTLEHDVLEAFSSILPPVYSIGPLNLLVKSVDDKKLNAIESNLWKEETECMEWLGTKEPNSVVYVNFGSIAVMTPEQLVEFAWGLGNSNKSFLWVIRPDLVAGENAVLPQEFVKETKNRGLLSSWCSQEEVLNHPAIGGFLTHSGWNSTLESLCAGVPMICWPFFAEQQTNCRFCCKEWGVGLEIEDVKRDKIESLVKELMGGEKGKEMKEKALQWKELAKSAASGPYGTSFLNLDNMIRQVLLDKNVINQF

SEQ ID NO: 5547 - protein, 455 aa, Hordeum vulgare
MAPPPPHIAVVAFPFSSHAAVLFSFARALAAAAPAGTSLSFLTTADNAAQLRKAGALPGNLRFVEVPDGVPPGETSCLSPPRRMDLFMAAAEAGGVRVGLEAACASAGGARVSCVVGDAFVWTADAASAAGAPWVAVWTAASCALLAHLRTDALRRDVGDQAASRADELLVAHAGLGGYRVRDLPDGVVSGDFNYVISLLVHRQAQRLPKAATAVALNTFPGLDPPDLIAALAAELPNCLPLGPYHLLPGAEPTADTNEAPADPHGCLAWLDRRPARSVAYVSFGTNATARPDELQELAAGLEASGAPFLWSLRGVVAAAPRGFLERAPGLVVPWAPQVGVLRHAAVGAFVTHAGWASVMEGVSSGVPMACRPFFGDQTMNARSVASVWGFGTAFDGPMTRGAVANAVATLLRGEDGERMRAKAQELQAMVGKAFEPDGGCRKNFDEFVEIVCRV

SEQ ID NO: 5548 - protein, 492 aa, Sorghum bicolor
MPAMVEEEVVIRGAAAAPEPEPHFLVVTFPAMGHINPARHLARRLLRATGARVTVSTSVFALRKMFPGAAAETEPEGHRDASGVWYVPYSDGYDDGFDKAVHDATHYMDQIKLEGSRTLGNVLDRLRDAGRPVTLVVYTLLLSWVADVARAHAVPAALYWIQPATVLAAYLHFFRATDGVDAAIAAAGGDPWATVRFPGLPPLRVRDLPSFIVSTSENDPYAFVVDAFRQLIELLDGEDSPSVLANTFDAMEPEGVASLRDHGVDVVPVGPVLSFLDDDDDDDAAAGGGNDLFSQDGKGYLDWLDAQAPGSVVYISFGSLSVMSERQIEEVARGMSESGRPFLWVLREDNRSSEGAAPLGGERGMVVGWCDQVRVLSHPAVGCFVTHCGWNSTLESMACGVPVVCVPQWTDQGTNAWLVERIGTGVRAAVSDKDGVLEADELRRCLDFATSEMVRAKAAVWREKARAAASEGGSSERNLKAFVAKQIAGGNN

SEQ ID NO: 5549 - protein, 529 aa, Solanum chilense
MASCAINSCCLLVFTHLTLTSTNQASSNEPLQISLNILFKQQKMDRLNKKTELVFIPVPGMGHLVPTLEMAKVLIARDEHLVITVLVIKLPSDNKLSSYIESVSTNPNYNSQMKFIELPQDESILQSITNTTFITFLSSHKPQVRNSVIEILYSGSNRLAALVIDMMCTAMIDVANEFGLPTYVFYTSGAAMLGLQLHLQSLRDDFNEDVTDYEDDPEAELSVTTYGNPFPAKCLPSIAFDKDGGSTMYLDLSKRLREAKAILVNTFSEFESHAVKSLSLDEKIPLVYPVGPLLNLDNNQVNNQESSQHQTIINWLDDQPDSSVVYLCFGSLGSFTEEQIKEIAYALEKSGCRFLWSLMKPLAKDTIFPAAYDNPEDVLPEGFLQRTEAIGKVIGWAPQVAILSHDAVGGFVSHCGWNSTLESIWFGVPLATWPIYSEQQANAFQLVKDLEIAVEIKMDYRKDLRGTESNVIVKAEEIEKAIKQLMEPENEIRLKVKGMKEKSRLVFKEGGSSYNSVGHFIEQVMDITN

SEQ ID NO: 5550 - protein, 522 aa, Papilio polytes
MRLASFSTFLIINELCSAYKILLVFPVPGRSHAILGEGYVRHLLNDGHEVTYITPIMMKMEHPRLRQIDISSDFKLMPPDELFDTKNILMNTWNVKNIEFMLFVTTEFVNGTLGHPNVQRLINDTSEQFDAVIVEWLYSELYAGFASVFECPLIWSSSLDPHWLVLDLIDEVPNPAYNPQHLADVVTPLDFWNRAQELWHVIHTKYFKWRLRHRENRIYNNAFASSVALRGRDLPPFNEVRYNGSLMLGNSHLSAGTSISLPPNYIPIGGYHITDNIDPLPSNLQQVADNARNGFIYFSMGSMLKSSRIPDIIKKGLLDVFSKLKQTVIWKFEEDLLDRPKNVHIVSWAPQWSILAHPNCKLFITHGGLLSILETLHFGVPIIGVPMFGDQHMNINRVVEKGFGMRVDLNDDVVVNMEIAIKEILDNPRYTQKVKEYSFVYHDRATSPGKELTHWVSHVIRTKGALHLRSQANMLPWYQKLYLDLAIVMFLIFYLSVKIVFKIFRGILLMSIKCAASKQKVN

SEQ ID NO: 5551 - protein, 468 aa, Helianthus annuus
MKNHEGGDTTVESTRPAATPRRIILFPLPVQGHIGPMLQLASILHTQGFKIIIIHPESYSPNHSDYPHFTFKPIVDGFSEIGKHIPEKPDPSFFITYLNEHCADSFTDCLAGLLAEPGEPPVACLITDAEYYFTQEVADSLKVPRVVNWACNIVVLLVYNDLSYFYEKGYFNLTMKDSEYEEPVPKYPSLKVKDVIQTSRNPNGMVRFVTKVMKQVKASSGIIWNSFKEPEEDLMQTLSHDFPIPRFTLGPLQTYLPPSTSNNMFEQDRTFFSWLDAQPPMSVIYVSFGSVASISESEFQEVAYGLANIDFPFLWVVRPGVVKGSDWLESLPEKFLEEVGGRGRIVKWCPQKEVLAHEAIGCFWTHNGWNSTLESVCEGVPMICSPCDVGQPLVARYVCDVWKIGILLEDGLQREGIKRAVKRLMIDKEGEEIRERINRLKEEVKISFDEGESSHRSLKSLVDYISSF

SEQ ID NO: 5552 - protein, 498 aa, Vigna angularis
MELPKQEARVAPAPPIVAMLPSPGMGHLIPMIEFAKRVVRYHNLSVTFVIPTDGPPSKTQIAVLQALPDSISHTFLPQVTLSDLPPDAKIETVMSYVVLRSLPSLRQAFHSLSATHTLAALVVDLFSTDAFDVAAEFNASPYVFFPSTATALSLLFHLPTLDREVHCEYRDLPEPVKIPGCIPLHGRELLDPVQDRKDEAYKWVLHHAKRYREAEGIIENSFTELEPGAWSELQKEQPGRPPVYAVGPLVRMETSSVESECLRWLDEQPCGSVLFVSFGSGGTLSTAQINELAHGLEASEQRFLWVVKSPNDKIANAAYFSAETAADPFHFLPEGFVERTKGRGFVVPSWAPQPQVLAHPSTAGFLTHCGWNSILESVVSGVPFIAWPLFAEQRMNAFMLTQEVRVALRPKVADNGLVERQEISSVVKSLMEGEEGKKLRYRTKDLKDAAAMALAENGSSTNHISHLALLWANKTTVTPPPPKIKLNPSSSSSSSSIQ

SEQ ID NO: 5553 - protein, 484 aa, Oryza sativa
MASAERSKKLRVLLMPFFATSHIGPCTDLAVRLAAARPDVVEPTLAVTPANVSVVRSALRLHGSAASTVVSIATYPFPEAAGLPPGVENLSTAGDERWRVDAAAFDEAMTWPAQEALIKDQSPDVLITDFHFSWNVGIAEELAMPCVQLNVIGLFSTLAVYLAAAVVNDSDSEELTVAGFPGPELRIPRSELPDFLTAHRNLDLVDNMRKLVQVNTRCHGFAVNSFLFLDKPYCEKFMCNGFAKRGYYVGPLCLPQPPAVASVGEPTCISWLDSKPNRSVVYICFGTFAPVSEEQLHELALGLEASGKPFLWAVRAADGWAPPAGWEERVGDRGLLVRDWVPQTAILAHSATAAFLTHCGWNSVLEGVTAGVPLLTWPLVFEQFITERLVMDVLRIGERVWDGARSVRYKEAALVPAAAVARAVARFLEPGGAGDAARIRAQDFAAEAHAAVAEGGSSYGDLRRLIDDLVEARADAGESALQPL

SEQ ID NO: 5554 - protein, 225 aa, Helianthus annuus
MSWILPIGPLLASNRLAKQTGYFWKEDPTCLTWLDQQPAHSVIYVAFGSFTLMDRNQFHELAIGLELTNRPFLWVVRADMVDEMNNNYLTGYMNRIHERGRIVGWAPQQLVLNHPSVACFVSHCGWNSVLEGVSSGLPFMCWPYFADQFINQGYVSDVWKTGLEFGKDESGIISRYEIKNKVEQLLEDKECKVRAAELKEKVKIAVRRGGHSDINLNSFIDWIQE

SEQ ID NO: 5555 - protein, 479 aa, Helianthus annuus
MGSNAELGKPHAICIPFPAQGHVNPMMKFAKLLHLKGFHISFVNTHFNHKRLLRSQGPSSLDGLPDFRFYSIPDGLPPSDADATQSIPDLFHSIPKHCVEPFCELITRLNGASDVPRVSCIVSDGAMTFTLKAAEKFGLPEVFFWTTSACGLLGYLRCRDLMQKGYTPLKDMSYVTNGYLETILDWIPGMNNIRLRDFPSFIRTTDINDILLNYLVTEAEALTRGSVVVLNTFDALEKDTVNLLTASMPRIFTVGPLNLMQQHVQDERVKQLGSSLWKEDVTCIHWLDTKDPGSVVFVNYGSITVLTKEQLIEFAWGLANSKKDFLWITRPDIVCGNEAVMPPEFLVETKGRGLIISWCPQEQVLKHPAIGVFLTHCGWNSTLESISSGVPLLCWPFFAEQQTNCRYSCVEWGIGMEIDTNVKREKVEAQVREMIEGEKGKLMKAKALELRRKAEEGVTIDGLSYLNFDKFITDVLSKI

SEQ ID NO: 5556 - protein, 498 aa, Barbarea vulgaris
MASEKSHLFDPSLHFVIFPFMAQGHMIPMIDIARLLAQRGAKITIVTNPHNAARFYNVLSRSIESGLPINLEHVKLPYQEAGLSEGQENIDSLDSMELMVPFIKAVNLLEEPVMKLMEEIKPRPSCLISDLLLPYTSKITKKFNIPKIVFHGMGCFCLLCMHVLRRNIEILKNLKSDKDYFLVPSFPDRVEFTKPQVPVETNASGDWKEFLDEMVEAEDTSYGVIVNTFQELEPAYIKDYKEAKAGKVWSIGPVSLCNKIGADKAERGNKAAIEQDECLKWLDSKEEGSVLYVCLGSICNLPLAQLKELGLGLEESQRPFIWVTRGWEKYDELYEWMLESGFEERTKDRGLLIRGWAPQVLILSHPSVGGFLTHCGWNSTLEGITSGVPLLTWPLFGDQFCNQKLVMQVLKVGVSTGVEEIMKWGEEEKIGVLVDKEGVKKAVEELMGESDDAKERRKRVKELGKLAHKAVEEGGSSHCNITLFLQDICQLQSVKYFK

SEQ ID NO: 5557 - protein, 649 aa, Drosophila pseudoobscura
MRLLQLLMALSLLCGAISCANILAVLPSVWKSHYLFGRRLLQELVASPRNHSITLISPHALEAGGVDAELPNIREIRIEGLKENWVGMGMSFEPEQMRSQSVMERFTRLIYAGTTNVDLLLSDQQVRKLLTSGEQFDLLIVDLFLSDALLGLAYYYGIPTVAISPTGANSWLNNMFGNPQSSSLDPSNFLPFTERMNTQQRIVNSLMSTFERLTYNFFHLISQQTVYSKHFEMLVQELPLYRDLTKNLSLALINSHPGLNYPRAYLPNMVEVGGLHLTARTDLRPLPNHLLSFMESAAGGCIYMSLGADVQTAQLPSEKLAIFMDVFGHLKEFHFVLKWENEDFVSSLELPENVMIANWWPQQAILSHTLVKLFISSCGQLSVWESIMGETPILAIPILAEQEVMAKRLQLNGVSLTVNYDAIAYDALLHGIRQLTLNTSYADSLVKLRKRLGGPSPSSLAVGQIELILDSGGADFLKSHANTLTYWRLEGLDVLVIITIGFVGILTIPFLVISCILRKSYYSEAGQDQQPPYRSTLKVVGRVHSYGDPGGTPAEPLRRTRSAQSLSARSSSSSFSSNTTPPTTASTTPLDMTPPPPAVVQLLGHVPSPLQLYVNQQQQQQQQQQIYSNSDLSNRQQASQDDITERRFS

SEQ ID NO: 5558 - protein, 481 aa, Unknown
  Description of Unknown: Oryza sativa Japonica Group sequence
MASVDGATRRGGGDGSIRRRRVLVFPLPFQGHINPMLQLAGALHGRRGGGGGELSVTVLHTRFNAIDPSRYPELAFAEVPDGIPPDVAANGNIVDIIVALNVAMDGGESSPSFRDVLASVVAADDEGRKPRASCLIIDGNLMAAQKTAAELGLPTLVLRTGSAACLGCYLAYPALLQKGYLPPKESQLYEPVEELPPLRVRDLYYTSNANQELVRKVLGWIAETARNSNGVVINTFDELEPAELERIRRELDGDGVAIVLAVGPLHKLSPMNAGGSLHLCPDRSCIEWLDTQATGSVLYVSFGSLASLDSNEFLEVAWGLESSGQPFLWVVRPDLVKGLDKPSLPDGFERAVEGRGKVIKWAPQQEVLAHHAVGGFWTHNGWNSTLESVSEGVPMICKPQFADQMLNTRYLEAVWAVGFELVGKLERGEIKKAIKRLMVEKEGAEIRERAKELKKKMDQCLESSGSSQIAINRLVNYIISL

SEQ ID NO: 5559 - protein, 473 aa, Medicago truncatula
MEKTIHIAVVPGVGYSHLVSILQFSKRLVQLHPNFHVTCFIPSLGSLPTDSKTILQTLPSNISCTFLPPVNSNDLPQGIALVLQLQLTLTHSLPSIHQALKSLTLKTPFVALVVDISAMDALDFAKEFNLLSYVYYPASATSLSSYFYLLKLDKETSCEYRDLPGPIQIPGSVPIHGRDLFELAQDRSSQSYKYLLQGVEKLRLFDGILINSFIEIENGPIEALTDEGSENLLVYAVGPIIQTLTTSGDDANKFECLAWLDKQRPCSVLYVSFGSGGTLSQEQINELALGLELSNHKFLWVVRSPSNTANAAYLSASDVDPLQFLPSGFLERTKEQGMVIPSWAPQIQILRHSSVGGFLTHCGWNSMLESVLHGVPLITWPLFAEQRTNAVLLSEGLKVGLRPKINQNGIVEKVQIAELIKCLMEGEEGGKLRKNMKELKESANSAHKDDGSATKTLSQLVLKWRNFGIEKQV

SEQ ID NO: 5560 - protein, 486 aa, Unknown
  Description of Unknown: Oryza sativa Japonica Group sequence
MGSNSRLHAVLIPYPAQGHVTPLLHLAKVLHSRGFHVTFVNSEYNHHRLLRSRGTGALAGLDDFRFETIPDGLPPPSESDNDDVTQDIPTVCTSFLTHGPAAFGALLARLNSEPGTPPVSCVIPDGVMSFAQRVASDMGILAPAFWTTSACGFMGYLHYAELIDRGYVPLKDESYLTNGYLDTVLDWVPGMPGIRLRDMPSFIRTTDRDEFMLNFDSGEAQNARHAQGLILNTFDAVEHDVVDALRRIFPRVYTVGPLLTFAGAAAARRPEVGAIGGNLWKEDASCLRWLDAQQPGSVVYVNFGSITVMSPAHLAEFAWGLARCGRPFLWVIRPDLVASEKAMLPEEFVSETKERGIFLSWCPQEQVLEHPATGLFLTHSGWNSTLESISAGVPMICWPFFAEQMTNCRYACTKWDIGLEIDTDVKREEVARLVQEAMDGEKSKDMRAKAMAWKEKAVAATEEGGTSSAGIDRLVEFLLARGDHAS

SEQ ID NO: 5561 - protein, 473 aa, Unknown
  Description of Unknown: Pyrus x bretschneideri sequence
MESQTPLPHIFLVCFPAQGHINPMLRLGKRLASKGMLVSFSTTENYGKEMRKANDGISDQPTPVGNGFIRFEFFDDGLAEDDPKFSRLDEYMPLLELVGKELVTQTIKRHANEGRPVSCLVNNPFIPWVCDVATELGIPRATLWIQSCALFSAYYHYHNKTVPFPTEAEPIIDIQLPGMPVLKHDEIPSFLLPSDPFQVLGRAILGQFKKLSKSLYVLMDTFQELEPEIIEHMSQVCIVKPVGPLFKNPKAPKTSIGGDLMKADDCFEWLNSKPPTSVVYISFGTIVYLKQEQVDEIAHGLLSSGVSFLWVMKPPGKAFGWEKHVLPDGILEKVGDKGKVVQWSPQEQVLAHPSVACFLTHCGWNSSVEALTSGVPLVTFPQWGDQVTNSKFLVDVFGVGLRLCRGRAENRLITRDEVEKCLLEATVGEKANELKQNALKWKKAAEEAVAEGGSSDRSLEDFIDEISKITYVA

SEQ ID NO: 5562 - protein, 480 aa, Ricinus communis
MAFDSNNHQLHILLFPLMAQGHMLPLLDIARLFASRGVKITIVTTPGNAPRLNRSFQTTQDSSTQISFKIIKFPAKEAGLPEGLENLDSVSDKETHSKFFDALSLLREPLEQVLQELHPQGLVSDIFFPWTAEVASKYGIPRLIFYGTSFFSMCCLENLEEHQLYKKVSSDTEKFILPGFPDPIKFSRLQLPDTLTVDQPNVFTKLLASAKEAEKRSFGMIVNSFYELESGYVDYYRNVLGRRAWHIGPVSLCNRNLEEKSQRGKEASISEHECIKWLDSKKPNSVLYVCFGTVAKFSDPQLLEIALGLEASGQNFIWVVRSEKNEEEKWLPDGYEKRIEGEGLIIRGWAPQILILEHEAVGGFVTHCGWNSTLEGVSAGLPMVTWPIFADQFFNEKLITDVLGIGVSVGAEKWVRLVGDFVESGKIEKAVKEVMVGEKAVKIRSRAKKVGEMATRAIEVGGSSYNDLGALIQELKSYHS

SEQ ID NO: 5563 - protein, 236 aa, Citrus unshiu
MAKSCPVLTIGPTIPSFYLDSRIQNDNGYDLNLFTLDKSICINWLNKKPERSVVYVAFGSMGCLANKQVEELAWGLKKSSFYFLWVIRDTEEKYKLPKGFVDEIGDKGLIVNWSPQIEVLSNKALGCFLTHAGWNSTIEALSLEVPMVAMPQWTDQPMDAKFIEDVSKVGVRVGVDGDGIVRRDDIESCIREVMEGKSGREMKINAKKWRDLAIEAVSEGGTSDKNIDEFISKFTT

SEQ ID NO: 5564 - protein, 489 aa, Citrus unshiu
MKEKAELVFIPSPSVGHLVSVIVFAKRLLLLDRDNAAGSNNSFSITVLVMQEHTATASDNDAHIKSLAGAGATADVSIRFIGVPKMNPPPLDYFKSPEKFITEYVDSHKDCIKEAIIEHVLNNNVKIAGLVLDFFCSSMIDTANELGVPSYAFFTSGAGFLGFVLHLPTRGGEEFEESEADSADIFTYANPVPYRVLPSLCFNKHGGFSAFENFGRRFKETKGIIVNTFEELESHAVEYLMKCDGVPPVYNVGPMIDLHGDIHARPRGGGTQRDEIIRWLDDQPASSVVFLCFGSMGSFGEEQIKEIASGLEKSGVRFLWSLRKTPPKDRPEMPGEYTCVEDILPRGFQERSKGRGMICGWAPQKEVLAHSAIGGFVSHCGWNSILESVWFGVPIVTWPIYAEQQINAFQMVRDLGLAVELRLDYRRGTENHVMADELARAVGCVMDGDSEVRKRVKEVSEKARLALRDGGSSYAATGRLIEDLFGSVS

SEQ ID NO: 5565 - protein, 471 aa, Pueraria montana
MKDSIVLYSALGRGHLVSMVELGKLILSHHPSLSITILFLTPPPNQDTPTSPTAFTCDATAKYIAAVTAATPSITFHRIPQISIPTVLPPMALTFELCRATGHHLRRILTSISQTSNLKAIVLDFMNYSAARVTNTLQIPTYFYYTSGASTLAVLFQQIIIHQNNTKSIKDLNMHLLIPGLPKIHTDDMPEQVQDRENEGYEVFIDIATCMRDSDGVIVNTFEAMEGRVMEAFNEGLMEGPTPPLFCIGPVISSAPCRVDDDGCLSWLDSQPSHSVVFLSFGSMGRFSRTQLREIAIGLEKSEQRFLWVVRSEFEEGDSVEPPSLDELLPEGFLERTKGKGMVLRDWAPQAAILSHDSVGGFVTHCGWNSVLEAVCEGVPMVAWPLYAEQKLNKVILVEEMKVGLAVKQNKDGLVSSTELGDRVRELMDSDRGKEIRQKIFKMKMSANEAMAKGGSSIMALNRLVEVWREH

SEQ ID NO: 5566 - protein, 478 aa, Trifolium pratense
MKKVEVVFIPSPGVGHLVSTLEFAKLLINRDNRLRITVLVIKFPHTTEVDVYTKSLPITDSLHVINLPECSIPPNIPPSSLMNVLLEAQKPNVKQAVSNIATGAENGVLSAFVVDMFCTNMIDIAKEFSVPGLIFFTSGVASLGLILHGHTLFERDNVDSTQLLQQTELTIPSFANLFPINSLPGFMLRKEWESFFMNYAGGLKKADGIIVNSFEELESHAVHSFSSHPDLPDFPIYPVGPLLNPEPKTKGTDDSSNIIKWLDDQPPSSVVFICFGSRGSLDEDQVKEMALAIENSGASFIWSLRKPPPKGTMISPSDYPLSDLNSLLPEGFLDRTADIGKVIGWAPQAQILAHPATGGFVSHCGWNSTLESIYFGVPVATWPLAAEQQSNAFELVVELKMGVEIALDYRVEVGGGANYLLTADKIERGIRSVLDKNGEVRNNVKEMSEKSRNTLLEGGSSYAYLGRLIDYIINQVSN

SEQ ID NO: 5567 - protein, 467 aa, Eucalyptus perriniana
MAPLNYLVVAFPAQGLINPALQIAKRLLHAGAHVTFATAGSAYRRMAKSDPPEGLSFASFSDGSDEGLKPGIDFNQYMVDVERLGSETLRDLVVTSLNEGRKFACIFYTTIIPWVAQVAHSLQIPSTLIWTQPATLLDIYYYYFNGYGDIIRNLGKDDPSALLHLPGLPPLTPPDIPSFFTPDNQYAFTLPLMQMQFELFKEEKYPRVLVNTFDALEPGPLKAIGNVTMFGIGPLIPSAFLDGQDPLDKSFGGDLFQGSKGYIQWLDTKPKGSVIYVSFGSISVLSKAQKEEMARGLLGTGHPFLWVIRKDKDEEGEGEQDHLSCMEELEQKGMIVPWCSQVEVLSHASVGCFVTHSGWNSTFESLACGVPMVAFPQWNDQLTNAMLVENEWKVGVRVNVNEGGVVEGDEIKRCLELVVGDGEQGEEIRRNAKKWKHLAREAAKEGGSSDRNLKAFLEEIQIEANGH

SEQ ID NO: 5568 - protein, 417 aa, Citrus unshiu
GPNKNSLSSLLPHFEFCSFSDDGFSETYQPSKVADDIPALLLSLNAKCVVPFRDCLANKLMSNSQESKDSFACLITDAAWFIAHSVANDFRLPTIVLLTDSIAASLSYAAFPILREKGYLPIQDFQLEAPVIEFPPLRVKDIPLLKTQDSNNADKFLSIRDNQIMASSGIIWNSFEDLEQVELTTVHQQYYLSIPVFPIGPFHKYFPAYSSSLLSQDQSSISWLDRQAPRSVIYVSFGSIAAINEIEFLEIAWGLANSRVPFLWVVRPGLGRGAEWLEPLPKGFLEMVDGRGYIVKWAPQQQVLAHPAVGCFWTHSGWNSTMESICEGIPMICQPYFADQMVNSRYVSHVWRVGLHLEGKLEREEIERAIRRVMVEADGQGMRERAMYLKEKVDICLQRGGSSYQSLGRLTDHILSL

SEQ ID NO: 5569 - protein, 442 aa, Citrus unshiu
MGGRQAHVLAVANPAQGHVGPLMKLSLLIADQGIKSLGNCVIRKWQNTRLDFVSIPDGVDPQDGREERIQLSESMQRVMPSHLENLIMKINSSEDDRMATCFIAHATIAWAIDTAKKMGVKMAMFWPSAVAAFAFSLIDAKITDHNGVPLKSGMIKISPKLPAMSTDEFMWSVPGDPIRRKILFGYISCAKKTLKICNWLLGSSFYELEPLACDSIPNVLPIGPLLWINRPGKAAASLWPEDSTCLKWLDKQPSQSVIYVAFGSIAIFSRCQFEEVALGLELAGRPFLWVVRPNLLDGSVIKHPDGFLERVPNQGMIIEWAPQEQVLAHRAVACFLSHCGWNSTIEGLSSAVPFLCWPYFADQFLISSYICDFWKVGLGLKQEANGNISRHEIKRNLDQLLSDSGIRENGLQIKEMAGKSLIERESSRKNFEIFIYQLKCMI

SEQ ID NO: 5570 - protein, 485 aa, Eucalyptus grandis
MGSESHQLHIFFFPFMAPGHMIPMIDMAKMFAMRGCKSTLIATPHDEPTFLRSIAKPKDLGFDINVVTVTLPLKDVGLPEDCGSLSKITTMEMRMTFVRAVMMLDRQIELLIEKLAPDCLISDIFLPWTTEIAAKFGIPRLVFHGTSAFSMAGIECVRLYQPHKKVSCDSEPFIIPNFPGEITLCKMQMQDLVREENELAKFFNAVKDSEKTSFGVVMNSFYELEPAYADHYRTFLGIRSWFVGPLSLCNKETEDKAHRGNEASIDQHECLKWLDSKQPNSVIYICFGSTTNFNAAQLHEIAVGLEASGQQFIWVVKKDPNAEEGKEEWLPDGHESRIRNKDLIIRGWAPQALILDHEATGGFVTHCGWNSILEAVAAGVPMVTWPVAAEQFYNEKLVTQVLKIGVDIGVKQGVISFGDSVKSERVEEAVKRVLVGEEAEEMRRRAKALAEMARGAVEEGGSSWSDLGALIQELKSHRLAHTKKI

SEQ ID NO: 5571 - protein, 292 aa, Rosa chinensis
MPEPMLDRNDPAYLDMVYFCSHLALSDGIIANTFEELETPAAIKAISEGRCVPDAPTPPVYYIGPLIDEEKASGSAHSEEECLLWLDKQPSRSVVYLCFGSMGSFSEAQVREIASGLERSGQRFLWVVKKPPVDNTKQSHGVDDFSLEALLPEGFVERTKDRGLVVKSWAPQVLVLKKVAVGGFVTHCGWNSVLESVIAGVPMVAWPLYAEQHLNRSVLVNDMKMAIDVEQRKEDGFVTGDEVERRVRELMESEKGRELRERSLKIGEMALGAVGELGSSRRALANFVNAIE

SEQ ID NO: 5572 - protein, 308 aa, Helianthus annuus
MSYVTSGYLETSLDWIPGMNNIRLRDFPSFIRITDINDFLLNYLMNEVEALPRASAVVLNTFDALEHDSVKPLNALNPRIFTLGPLHLMEQHLQDEGVKQLGSNLWKEDVSCIHWLDTKDDGSVVFVNFGSIAVMTKEQLIEFGWGLANSKKDFLWITRPDIVGGNEAVMPPEFLDEIKGRGMITSWCPQEQVLNHPAIGGFLTHSGWNSTLESISSGVPVLCWPFCGEQPTNCRYSCMEWGIGMEIDTNVKRKEVEAQVRELIDGAKGEMLKAKALDLQKKAKEAVIFGGSSYVNFNKLVTEVLWKN

SEQ ID NO: 5573 - protein, 487 aa, Jatropha curcas
MGSMDQNQLHIFFFPFMAHGHTIPTVDMAKLFAFRGHKTTIITTPSNEPLISKTIQRTKDLGFVINIQILKFPSVEVGLPEGCENIDFVLSLVENGTEMMNKFCLAIGKLQEPLEKLLQECNPNCLVADMFFPWATDAAAKFGIPRLVFQGTSFFSLCAGESIRLYQPHKKVSTDSASFVIPDLPGEIKITRKQFPIIFREEVQNDFTKIVKESNESELKSFGVVVNSFYELEQAYADHYRNVLGRKAWHIGPVSICNRGMEDKAQRGKEASIDEQECLKWLNSKKPNSVIYIRFGSITNFTDSQLKEIAIALETAGQKFIWVVRRNKNSEGHEEEWLPEGFEKKMEGKGLIIRGWAPQVLILEHDAVGGFVTHCGWNSTLEGVSAGKPMVTWPVGAEQFYNEKLVTEVLKIGIGVGAKEWDWLHGDYVKSEAIEKAIRRVMEGEEAEEMRSRARKLGEMARQAVEDGGSSYSDFNALVQESRYYGP

SEQ ID NO: 5574 - protein, 459 aa, Arabis alpina
MELHGALVASPGMGHAVPILELGKHLLNHHGFDRVTVFLVTDNVSRSKSLIGKVLTEEDPKFVIRFIQLDVSGQDITGLLLTKLAEMMRNALPKIRSAVMTLEPRPSVFVVDLLGTEALAVAKELEIMKKHVLVTTSAWFLALTVYMASLDKETLYKNLRSIGALLIPGCSPVKFDRVQNPSNYVRELAESQRIGAEVITADGVFVNTWHGLEPVTIRAFLDLENLGQVMRGVPVYPVGPLVRPAEPGLKHEVLDWLDLQPKESVVYVSFGSGGALTAEQMIELAYGLELTGQRFIWVVRPPAEDDPSASMFDKTKNQTEPLDFLPDGFLDRTKDIGLVVQTWAPQEEILAHKSTGGFVTHCGWNSVLESIVNGVPMIGWPLYSEQKMNALLISEELKIAVRVNVGDGIVKKEEIVEMVKRVMDEEEGKEMRKNVKELKKTSEEALKNTHIPSTYFTQN

SEQ ID NO: 5575 - protein, 466 aa, Vigna angularis
MTTFEVVFIATPALGNLVPLVEFANLLTKHDPRFSATVLTIFMPQRPLINTYVQSRASSPANLRILHLPTVDPPPPDQYQSSIAFLSLHIQNHKHHVKNALLSLLPSDSNSPVRLAAVFVDMFCGSLIDVAAELSVPCYLFFASSASFLGFTLHLPRPDSLDSESEFSIPSFKNPVPKSVLPSFVLDANDASPWFSYHARRYRETKGIVVNTLGELEPHALPSLHDDSLLPRVYPIGPVVDLAGSAGWDPNPVQYKRIMEWLDRQPAASVVLLCFGSMGSMKADQVEQIAIGLERAGVRFIWALREPPKAQLEDPRDYLNEVDVLPDGFLKRTAGIGLVCGWVPQAKVLGHEAVGGFVSHCGWNSILESLWHGVVVATWPVYAEQHLNAFQMIRELGLAVEISVDYRVGGDLVRAEAVEKGVRSLIEGSDELRRKVKEMSEKCKSALVEKGPSYNNLVSLIQELTS

SEQ ID NO: 5576 - protein, 484 aa, Medicago truncatula
MKMEYTKAPLKILLVSYPAQGHINPMLRLGKCLASKGSSVIFITTEKAGKELRTVNNITEKLVIPVGNGSLTFQFFDDGLSDDDPIRTSQTTYLPHLELVGKQFLSQMIKNESNTPISCIINNPFLPWVCDVAVENEIPSALLWVQSSAVFAAYYNYFHKLVRFPSVEEPYIDVQLSSVVLKYNEIPDFVQGFSTFSILGTIIMEQIKNLSKVFCVLVDTYEELEHDFIDYVSKNSVKIRPIGPLFKNPQIKNASNICGDFVKSDDECIIEWLNSKPPSSVVYISFGTVVHLPQEQINEIGYGLMNSQVSFLWVLKAKPPPDFTHVGFKPHFLPDRFFEETSGRGKVVKWCPQEQVLAHPSVACFVTHCGWNSSMEALTLGVPMLTFPAWGDQVTNAKFLVDVFGVGIRLGCGQAENKLVCRDEVKKCLSEAMAGPKAEELKQNAIKWKKAAEAAVAIGGSSDQHLDAFMEDIKARFKRYNTLS

SEQ ID NO: 5577 - protein, 476 aa, Catharanthus roseus
MAMKTAELVFVPSPGIGHLLSTVELAKILVNQDHRLSITLLIMKFPFETKIAKYTKSFYESPIPRLKFIEIKEDQPSSSERYKSTFFYDFIDSHKGKVRDVLSEISISEKSQLSGVIVDMFCTSMIDVANEFGVPSYVYYTSGAAMLGLVLHFQHLRDDLNEDIIEYKDKDTDFTVPTYINPLHSKVLPSVLFDNEEGSKLFLDQAKRYRETKGIIINTFLELESHSVTALSEDPNIPPVYTAGPILNLKSEASQESELILKWLNLQPESSVVFLCFGSYGSFSAEQVKEIAIALENSGHRFLWSLRRPPPEGKMEPPSEYENLEEILPEGFLKRTAETGKIIGWAPQIEVLSHSAVGGFVSHCGWNSTLESVWCGVPMATWPIYAEQQLNAFEMVKDLEMAVEIKIDYRREVWTTNSEILGADLIEERIRCLMDPENKIRSKVKEMQRKSSSTLKEGGSSWSSIRRFIDSVVTKN

SEQ ID NO: 5578 - protein, 465 aa, Eucalyptus grandis
MAPPHFLLIAFPSRGAINPALQLAERLTHAGSRVTFFTTVSAHRRMIEPVCLDGVTFATFSDGYDNGYELGDDVDHFMAELKRRGSEALRGLIEYSSGRGLRFTCALHTMFRWADEVARSFQIQSVLVWIQPATVFGIYYHYFNGYEDVIKSVTSQSCDTTSLIRLPGLPPLTDRDLPSFFNPDNKYAFGLPHMQSQFKQLKEGGKPNMVLLNTFDMLELEVLRAIGTLNLVGIGPLVPFRFLNAQDRNSSDESSRGDHFQSSKEYVQWLNTKKEASVIYVAFGSIAKFSKAQKLEIAHGLLETGRPFLWVVRKTVGDDDELIYKEELDKRGMIIPWCSQMEVLSHRSIGCFFTHCGWNSTLESLACGIPMVAFPQFTDQMTNSKLVEDVWKVGVRVSEINEDGIIVKGGEIKKCLELVMGSGETGDGIRRNARKWKNLAMEASKEGGSSDKNLRAFVEEFSKVD

SEQ ID NO: 5579 - protein, 980 aa, Citrus unshiu
MQRLEYQTHGDVVALLASPGMGHLIPVLELGKRFATQNDFQVTIFVVATDTSTVQSQLRNLPNPHLFNIVSLPPVDISALLDADASIVIKIIFMMRESLPALRSSISTLKPRPTALFADLFGTEAFQIADEFEMLKYVYIASNAWFLAATIYFPTIDKRLQEEHYGRKQPLMIPGCRSVRFQDTLEAFTDPKDQLFDEYLRIGLEMVTADGILVNTWEDLEPTTLASLRDGISKLPPIYPIGPVVRSMGSSHMSENSSLLEWLDMQPTESVIYVSFGGGGTLSANQMVEVAWGLELSQQRFIWVVRPPMDNDVSGSFFKVGDGSSDGTPDYLPDGFLTRNAKMGLVVPDWAPQVEILGHASVGGFLSHCGWNSTLESIVNGVPLIVWPLYAEQKMNATMLAEELGVAVRPNEMPTENLVKREEIEMMVRRILVLVDKEGQALRSRVKELKHSAKKASTKGGSSYNALSQVAKQCEMSLQGLMAKCLTMEIRKPRVALLASPGMGHLIPVLELGKRLVIQNNHHATIFVVANDTSSEQLSKLVNSPDYDILDIVLLPCIDISGIVCTDASLVTQIAVMMHESIPALRSTISAMKYRPTALIVDLFGTEAMAVADEFEMLKYMFIASNAWFVAVTIYAPALDKKVLQEEHVNQKKPLKIPGCSAVRFEDTLEAFLDPYGPMYDGFLQVGMDMSKADGILVNTWEDLESKTLAALRDFNMLRRVAKAPVYPVGPLARSVASSPVSGSHVVLDWLDKQPHESVIYVSFGSGGTLSSKQTMELAWGLEQSKQRFIWVVRPPLDHDVFDSYLTAGSGALNTAEGALDYHYLPEGFLIRTRDVGLVVPMWAPQPEILAHPSVGGFLTHCGWNSTMESIVNGVPMIVWPLYAEQKMNATMLTEELRVAIRSKEVPSEKSVVGRGEIEMMVRRIVAEKQGHAIRNRVKELKHSAQKALINGGSSYNSLSKIAHECENSLQFTQEKAEGA

SEQ ID NO: 5580 - protein, 495 aa, Ricinus communis
MEEAIVLYPTPAIGHLISMVELGKLILSCRPSCSIHILILAAPYEAGSTAPFIAKVSATIPQIKFHHLPIITLPSTPTTHHETLTFEVIRLSNINVHQTLLSISETSTISAFIMDFFCAASLSVPTELSIPGYFFFTSGASCLALLLYFPTIHQNTTKSFKDLNTFLDVPGAPLVLASDLPKPTLDRNDKAYECFLDCAKCFYKSSGIIVNTFELLEPKAVKAISDGRCIPNATTPPVYCIGPLIVTNNKRGDNNTSNGAPQCLTWLDSQPSKSVVFLCFGSLGLFSKEQLREIAIGLERSGQRFLWVVRNPPSNIQSLAISAQPEPDLDSLLPDGFLDRTKGRGFVMKSWAPQLAVLNHDSVGGFVTHCGWNSVLESVCAGVPLIAWPLYAEQRFNKVLLVEEIKIALPMNESENGFITALEVEKRVNELMESEAANTVREQTIAMQKASKAAVTEVGSSHAALSKLIDSWKGKKIYCGPCKMCQWLSDSICIA

SEQ ID NO: 5581 - protein, 487 aa, Arabidopsis thaliana
MESHVVHNAQKPHVVCVPYPAQGHINPMLKVAKLLYAKGFHVTFVNTLYNHNRLLRSRGPNALDGFPSFRFESIPDGLPETDGDRTQHTPTVCMSIEKNCLAPFKEILRRINDKDDVPPVSCIVSDGVMSFTLDAAEELGVPEVIFWTNSACGFMTILHFYLFIEKGLSPFKDESYMSKEHLDTVIDWIPSMKNLRLKDIPSYIRTTNPDNIMLNFLIREVERSKRASAIILNTFDELEHDVIQSMQSILPPVYSIGPLHLLVKEEINEASEIGQMGLNLWREEMECLDWLDTKTPNSVLFVNFGCITVMSAKQLEEFAWGLAASRKEFLWVIRPNLVVGEAMVVLPQEFLAETIDRRMLASWCPQEKVLSHPAIGGFLTHCGWNSTLESLAGGVPMICWPCFSEQPTNCKFCCDEWGVGIEIGKDVKREEVETVVRELMDGEKGKKLREKAEEWRRLAEEATRYKHGSSVMNLETLIHKVFLENLR

SEQ ID NO: 5582 - protein, 480 aa, Arabidopsis thaliana
MAEANTPHIAIMPSPGMGHLIPFVELAKRLVQHDCFTVTMIISGETSPSKAQRSVLNSLPSSIASVFLPPADLSDVPSTARIETRAMLTMTRSNPALRELFGSLSTKKSLPAVLVVDMFGADAFDVAVDFHVSPYIFYASNANVLSFFLHLPKLDKTVSCEFRYLTEPLKIPGCVPITGKDFLDTVQDRNDDAYKLLLHNTKRYKEAKGILVNSFVDLESNAIKALQEPAPDKPTVYPIGPLVNTSSSNVNLEDKFGCLSWLDNQPFGSVLYISFGSGGTLTCEQFNELAIGLAESGKRFIWVIRSPSEIVSSSYFNPHSETDPFSFLPIGFLDRTKEKGLVVPSWAPQVQILAHPSTCGFLTHCGWNSTLESIVNGVPLIAWPLFAEQKMNTLLLVEDVGAALRIHAGEDGIVRREEVVRVVKALMEGEEGKAIGNKVKELKEGVVRVLGDDGLSSKSFGEVLLKWKTHQRDINQETSH

SEQ ID NO: 5583 - protein, 400 aa, Rhodiola sachalinensis
RSNPPVSCIVSDGVMSFTLDAAKELGVPEVIFWTTSACGFLGYSLYDRLRKQGFTPLEDSRQLTNGYLETVVDWPPSADGIRLKDFPTFLRTTDPDDLMFEFVTSESTRAQRATAIVLNTFEPLESEVLSALQAHYTPPVYCIGPLHLMATDTALDGLGSNLWKEDRHCIKWLNSRPDNSVVYVNFGSITIMTGDQMLEFAWGLADSARSFLWVIRPDLVSGKTAVLPPEFLTATEGRGLMVDWCPQEEVLAHSAVGGFLTHSGWNSTMEALTSGMPVIAFPQWGDQVTDAKYLVDEFKIGVRMCRGEAENRVVTREEVRKCLLEATTGEKAAEMKANAAKWKKAATEAFVEGGSSDRNLQTFVDDVRMKSVEITKKNLAFGLPAAKTEGQRGVDTAVKA

SEQ ID NO: 5584 - protein, 503 aa, Vigna angularis
MATSKPHAILLTSPGMGHIIPMVELGKRLLTHHSFHVTIFVVTTDSATTTSQILQQTSNLSSLNIVHVPPIDSNKLPPNAPLEVRINFTMLESLPFLRSSLTSINNFPPPSALIVDLFGLQALPMARDLGMLTYVYFATSAWFSAVTVYFSDTDNKIMERHAENREPLLIPGCAPLRFEDTLESFLSPGGAMYEGYHAAAKEIVAADGILMNTWQDLEPSATKALTEDGILGRFTKGEVYAVGPLVRSVEKKPKGGKKDGVLQWLDEQQAESVVYVSFGSGGTMSGNQMREVALGLELSQKRFVWVVRPPCEGDASGAFFDVASGGDAAMSYLPEGFLKRTEGVGVVVPMWAPQAEILEHPATGGFVTHCGWNSVLESVENGVPMVAWPLYAEQKMNAFMLSEELGVAVRVAEEGGGVVGREQVAEVVRRVMVDKEGFGMRKKVKELKLSGEKALSMFGSSHHSLAEMRKECEVHMQSSDTKLPPACHLRSTTTDVFNHVVYS

SEQ ID NO: 5585 - protein, 1367 aa, Citrus unshiu
MNLSTGYILSLYLIRKLNMGSKVPQLHVFFFPFMAHGHMIPIVDMAKLFASRGVKASVITTPANGPYVSKSVERANEMGIELDVKTIKFPSVEAGLPEGCENLDAITNEVNKELIVKFVGATTKLQEPLEQLLRDHKPDCLVADIFFPWATDAAAKFGIPRLVFHGTSFFSLCASNCLALYEPHKNVSSDSEPFVMPHFPGEIKLTRNQLPDFVKQDMGDNDFSRLLKAIDDSDLRSYGVAVNSFYELEPAYADHYRKALGRRAWHIGPVSLCNRNFEDKALWGKQASIDEQECLRWLNSKQPNSVVYICFGSIANFTSAQLMEIATGLEASRRNFIWVVRRNKNDGGEEEKEAWLPEGFEKRMKGKGLIIRGWAPQVLILDHEAVGGFVTHCGWNSTIEAVTAGVPLVTWPVSAEQFYNEKMVNEVLKIGVGVGIQKWCRIVGDFVKREKIEKAVNEIMVGDRAEEMRSRAKTLGKMAKRAVENGGSSYCDLSALIEENCSRWCNSGESGRIFLCEIATEEEGLRRLFWAPAPTVVQAVPISQSFSCRLRAGLSVVTGPVSQAGMASGICQLHIFFFPFLAHGHMIPTVDMAKLFTTRGVKASVITTPANAPHLSRSIQKASELGIELDVKIIKFPSAEAGLPEGWENLDAITNEVNRELIVKFYMATTKLQKPLEQLLQEHKPDCLVADMFFPWATDAAAKFGIPRLVFHGTSFFSLCAIKCLALYEPHKKVSSDSEPFVMPNLPGEIKLTRNQLPDPAKQDMGDNDFSRFMKASDDSDLRSYGVVVNSFYELEHAYADHYRKALGRRAWHIGPVSLCNRNFEDKALRGKQASVDEQECLKWLNSKQPNSVVYICFGSVANFTSAQLMEIAMGLEASGQNFIWVVRKNKNNGGEEEKEDWLPEGFEKRMEGKGLIIRGWAPQVLILDHEAVGGFVTHCGWNSILEGVTAGVPLVTWPVYAEQFYNEKIVNEVLKIGIGVGIQKWCRIVGDFVKREAIVKVVNEIMMGDRAEEMRSRAKAFGEMAKRAVENGGSSSSNLNSLIEDLRLTTGLSMVECPFSVFAEQFFNETWVTRLLKIGEVGMAGEIRKLHIIFFPLMAHGHMIPLVDMAKLFGSRGVKTTVITTPANATLFSKAIPRANELGIEIDIKTIKFPSVEVGLPEGSENLNEMTSQPDMPVNLQEHKPNCLVADMLFPWATDAAAKFGIPRLVFHGTSFLSLCATACLMLYEPHKKVSSVSEPFVIPNLPGDIRLTRNQLPDTMKQDDETDFSRLFKAAVESELKSYGVVVNSFYELEPAYAVHYRKVLGRRAWHIGVLKLAEIKATQFCCLPMLWKPSQLHFCSANGDCNGASSFGAKFHLDCEEKQE

SEQ ID NO: 5586 - protein, 461 aa, Erythranthe guttata
MKSHHFLIISFPIQGHINPILQLAKNLARLGAKVTFATTDRILHRLQDSLPTLHRLSYASFSDGQHHEEEQEKSTKSTAGYMAEMKRAGSENLIRILQESLDGPEPVTCLVYSLLLPWAAAVARDMQIPSAFLFIQCATAFAIYHRFSKPHNEIVDPVDIIQDLPLFSSSDLPTFLLPDNPMYSFMKPMMIEHMQELEKDPKPLVLLNTFEELEQDAIESLKTKNINVITIGPLIPSAFSDGNDSTDKSFGGDLFISKKEDYFKWLDTKPENSVVYVAFGSLVVMNKDQKIEFLHGLVESKRPFLWVIRSSSSSSDSVDENETKKMIDNSDIGENGMIVEWCAQMGVLSHKSIGCFVTHCGWNSTLEGLICGVPFICCPHFADQPTNAKLVEEVWGTGVRARANGEVLIEREEFKKCLDVVMGEGDRGKEMRRNALKWRGLALEAVKEKGSSYINLKRVLE

SEQ ID NO: 5587 - protein, 497 aa, Persicaria tinctoria
MKKAHLVFIPSPGVGHLVSAVEFSRRLLARDARLSITILAMTSPFPTSTSLPQTTSTPSTDSNSPGEPHYIFLPQADLPPKEVLENSMEEYISKFAASHSHHVRTALLTLQESSLDRVRFHLVVDMFCTSLIDVGKDLGIPSYLFLTSGAAFLSLLLHLPERFLRTGVPRFDESEPEIAISGFQNPVPSSALPEFAFNTSGYTALMSHANKLEETNGLIINTFAELEPFAIKSLREVYDELAAGTESEIKIQRFRPPLFTVGPVLDLKGQARRPGDASQESKIMKWLDTQPEASVVFLCFGSVGAFSEEQAKEIANGLTQSGQRFLWSLRKKTTTGAKRPMEYTDAELKGVLPKEFWGAVEGGRGLVCGWAPQAEILAHKAIGSFVSHCGWNSTLESVWFGKPIVAWPLYAEQPSNAFELVNELGLAAAWLGYGGKPGDLVTADEVERAVRSVMDSDNPVRSRAKEMSEASKSALLNGGSSFDSIGCLMRKIIGDEL

SEQ ID NO: 5588 - protein, 241 aa, Punica granatum
MSKVYPLMTVGPTIPSIYLDKRVENDSNYGLDLFDLDSSNITSWLETHSPRSVVFVSFGSMATLSTEQTEELAWGLHDSGHPFLWVVRASENSKISEKFKLAITAERALLVQWSHQLEVLSSDRIGCFFSHCGWNSTIEALSMGIPMVAMPQWTDQPTDAKLVEDVWVVGVRVRVGEDGIVKREEIEHCVREVMESERGKVMAVNATKWKDLAVEAVSEEGTSDNNINDFVSKILLKRKSI

SEQ ID NO: 5589 - protein, 229 aa, Ricinus communis
MTSISASSGLIQRSKALSCMFALAACHIITKQLIELALGLEASMRSYIWVVKEGDYTAELDKWLVEEQFEETVKDIGLVVRGWAPQVPILSHPAIGGFLTHCGWNSTLEGISSGLPMITWPMFAEQLFNEKLIVQVLKIGVRIGVEIPMKWGEEEKLGVMVNKDEIKKAIDQLMDEGSEGEDRRRRAKELGEMAKKTVEEGGSSYLNMTLIIQHVIEEVTNGNQSNYTI

SEQ ID NO: 5590 - protein, 480 aa, Zostera marina
MAVCQENRHRLHIFFLPFLAPGHMIPMVDMARRFTEHGVKSTIVTTPLNVLRIQPSIDHFNNSSENNWPIEILQIKFPSSYFEPGENVSSFQSPSITGELLASMNSLRQPFEELLEKHRPDAIVSDALHVWSPDSADMFGIPRLVFHGCGTFPILVSTKLMDHIPLDDGDDEKKFVVPGLHHRIEMRVSELPGYVLKRNIWTDDMVRGYRRSYGVVMNTFTDLEKDYIRDDVATSPSSWEVGPLSLCNRDKTDMILRGDVIADGFSATCMDWMDSMKPKSVLYVCFGSCGKFTIPQLKEILSGLDASGYPYIWVVKSVGGTHLSEWLPEEERRSKKGLILTGWAPQVLILNHNSIGGFMSHCGWNSCLESITAGVPMVTWPLFGDQFFNMKFIVDVVKVGVEVGDMVCSEIAEERRVMTRWQIEKAIRRVMDGGDEAVAMRKRVSTLRSLSLKAVEEGGSSFNNTRRLINELMKLKHDKA

SEQ ID NO: 5591 - protein, 501 aa, Sorghum bicolor
MSAASLPTGQEPEPQPHAVCVPFPTQGHITPMLKLAKILHARGFRVTFVNTEYNHRRLVRSRGAAVAGLTASSSSFRFATIPDGLPESDADATQDPATISYATKHNCPPHLRSLLAGLDGVTCVVADNLMSFAVDAARDMGVPCALFWTASACGYMGYRNFRLLIDMGIIPFQDEEQLTNGFMDMPVDWAPGMSKHTRLKDLPTFLRTTDPNDVLLNFQLQEVERSEYASAVVVNTFDELEQPALDAMRAVIPAVYTIGPLVSVTEQVVVVRRDPRLDAVSCSLWREDQSCLAWLDARKHRPRSVVYVNFGSITVMTGQEMAEFAAGMASSGHDFLWIVRPDAVKGDTSSSAAALPPGFLEATPKGRGLLASWCDQEAVLRHEAVGLFLTHSGWNSTLESLAAGVPMLCWPFFAEQQTNCRYKCVEWGVAMEVGGDVRREAVEARIREAMGGDKGKEMARRAAEWKEAAAGSAARSLANLDRLINDVLLSPARLGGSLKMA

SEQ ID NO: 5592 - protein, 287 aa, Panicum miliaceum
MPVSELPPYRVRDLVVLGGDDRGGVRELLARAVTAVKVSSGLILNTFDALERRELEGLRRDLAVPVFDIGPLHKFSPAGDSSLLRQDRSCLEWLDARPPSSVLYVSFGSLACMSQRDLVETAWGIAGSGVPFLWVVRPGMVRGSAHQELPEGFEAATRGHGMVVAWAPQEEVLRHRGVGGFWTHNGWNSTMESVCEGVPMLCRPYFGDQMGNARYVEHVWKVGFEVGGELERGAVEAAIRRLMMTGKDGAEMRARAGELKKAAEECTGKGGSSCLAIDKLVTHMMSL

SEQ ID NO: 5593 - protein, 483 aa, Ricinus communis
MASQNQQLQFVFLPHLAQGHMIPMVDMARLLAQHGVTVTIITTPFNAARYETMINRASESGVRIQLLQVPFPSKEVGLPQGCESMDTLPSRDLFKNLLIGITMLQVPVEQLFSKLQPPPSCIISDKNVAWSHQTALKFKIPRLVFDGTSCFSLLCTHNILATKIHESVSDSEPFVVPGLPHQIVLTKGQLPNAVLMNDSGDIRHEIRESEKAAYGVVVNTFEELEPAYISEFQKARGCKVWCVGPVSLCNKETLDKAERGNKASIDENQCLKWLDLRAQGSVLYACLGSLSRLTGAQLIELGLGLEASNRPFIWVIRGGNGTEEFEKWISEKDYETRLRGRGILIRGWAPQVLILSHPAIGGFLTHCGWNSTLEGLCAGIPMITWPLFAEQFYNERFIVQILKIGVRLGSEFSVKLSEEKKSWEEVKRAIDQLMDEAEEGEERRKRAEELGKMARKAIEEGGSSHLNMISLIEDIKKQVISNS

SEQ ID NO: 5594 - protein, 513 aa, Medicago truncatula
MDLYKPTHIVLLSSPGLGHLMPIIELAKRFQIHHNFKLTILAITSQTSHTESHILKSATNPSLYNIIQIPSPNISSLLPVSATVCTRIFLTMRHSIPSIKSALTNLTLPPSALIVDIFGTEALPLALELNIPRFIYVASHAWFLSLYVYSPVLDKQIQGPYIEQKEPLKIPGCKSVQPNDLVDPMLDRYNLEYKEYLTVAKNFSKSDAILVNTWDELQHRELKALNDGDGELSSLLKVPVFAVGPLVRQAESEIGQASESVIQWLDKQPKESVVYVSFGSGGTLSNEQMNELAFGLELSEQRFVWVVRACASTTEAVDAAFFTTGSGGDGFGDELDDQIGKHLPEGFVERIKNKNVGLFLHEWAPQVTILKHPSIGGFVSHCGWGSVLESLTNGVPIIAWPLYAEQRMNAALLVEELGVAVRTVVSPGKNVVEREEIASLVRKVILVDQNGKRNHVRERVKEVRVSAEKALLQGGSSYNALSHVAKIINKQDFVCVSKNMDTDGDDIKDRKNQ

SEQ ID NO: 5595 - protein, 486 aa, Medicago truncatula
MGYSEAPINILLVSYPAQGHINPMLRLGKCLASKGSSVIFITTEKAGRELRTVNNIIDKSVIPVGNGSLAFEFFEDGLSDDDPIRASLTTYLPHLELVGKKFLSQMIKNHAADESNTLISCIINNPFLPWVSDVAAELEIPSALLWIQSGAVFAAYYNYFHKLVRFPSNAEPYIDVQLSSLVLKYNEIPDFLHCFSKYPFLGSLLLEQIKNLSKVFCVLVDTYEELEHDFINYISKYSVLIRPIGPLFQNPKTKTASNICGDLVKSDDDCIIEWLNSRPQSSVVYISFGTIVHLPQEQVNEIAYGLLDSQVSFLWILKVKPSLNAKHVGFKPHCLPDGFLEETSGKGKVAKWCPQEQVLAHPSVACFMTHCGWNSSMEALTLGVPMLTFPAWGDQVTNAKFLVDVFEVGVRLGYSQAENRLVCRDEVKKCLLEAMAGPKAEMLKQNTIKWKKAAEAAVAVGGSSDRHIDAFMEDIKTRFKRCNKLS

SEQ ID NO: 5596 - protein, 482 aa, Vinca minor
MGSEEKNFPPHVLIFPLPIQGHVNSMLRLAELLCLAKLDITFVVSDFSHNRLIKHTNVASRFARYPGFQFQTISDGLPDDHPRAGEKVMDILPSTKNVTGPLFKRMMIENNCFASSTRRPTTCIIADGVLSFAGDFAEENGVPLIYFRTVSACAFWACFSMPELIESGDIPIKGNGMDLLVKGVAGMETFLRRRDLPGFCRVNDMSEPKLQIIKTETRQTTRAQAAILNTFEDLEGPILSQIRKHIPRLFTIGPSHSHLNSRLETQNIKTSISSGSFWEEDRSCVDWLDSQPPRSVLYVSFGSITVVTRAQLLEFWHGLVNSGHRFLWVMRPDSIMGKDGENRVPHELEEGTKERGYMVGWAPQEEVLNHSAIGGFFTHCGWNSTLESIVAGVPMICWPYFADQMINSRFVSEIWKIGLDMKDSCDREIIVKMVRELMEVKKDEFMERADEMAKLARKAVSEGGSSYSNLDALVEYIRSLII

SEQ ID NO: 5597 - protein, 497 aa, Vitis vinifera
MQMQMQFETQVRFDHPLHRPNRSISTSSSSPTMTQPHFIVITYPAQGHINPSLQLAKRLIRVGAHVTFVTSTYASERMAKTPTMDGLKFVTFPDGCDSGLKQSDALQGFMSELERLGSQALTDLLIASANEGRPVACIIYGILIPWVAEVAHSLHIPSALFWSQPVSVFNIYYYYFCGYGELIRKKVRDSSPSIELPGLPLLSSRDIPCFLLPSNANEYNFVLSAFEKHLEMLHRDTNPTVLINTFDALEPEALRAVSKFKSIGVGPLFPTAFLGGKDPSDTSFGGDLFRRSKDYIEWLNSKPESSVIYVSFGSLAVLSKQQSEEIARGLLDSGRPFLWVIRAKEKGEEEKEEDKLSCYAELEQQGMIVPWCSQVEVLSNPSLGCFVTHCGWNSTLESLASGVPVVAFPQWTDQSTNAKLAEDVWKTGVRVTVNQEGIVESDEIKRCLELVMGDGEEAKEMRRNAKKWKGLAREAVMEGGSSDKNLKNFMDEVIQGY

SEQ ID NO: 5598 - protein, 349 aa, Arabidopsis thaliana
MEESKTPHVAIIPSPGMGHLIPLVEFAKRLVHLHGLTVTFVIAGEGPPSKAQRTVLDSLPSSISSVFLPPVDLTDLSSSTRIESRISLTVTRSNPELRKVFDSFVEGGRLPTALVVDLFGTDAFDVAVEFHVPPYIFYPTTANVLSFFLHLPKLDETVSCEFRELTEPLMLPGCVPVAGKDFLDPAQDRKDDAYKWLLHNTKRYKEAEGILVNTFFELEPNAIKALQEPGLDKPPVYPVGPLVNIGKQEAKQTEESECLKWLDNQPLGSVLYVSFGSGGTLTCEQLNELALGLADSEQRFLWVIRSPSGIANSSYFDSHSQTDPLTFLPPGFLERTKKRVRAKWQPLNI

SEQ ID NO: 5599 - protein, 481 aa, Eustoma exaltatum
  MOD_RES (92)..(92): Any amino acid
  MOD_RES (102)..(102): Any amino acid
MGQLHIFFFPFLAQGHMLPTIDMAKLFSSRGVKATLITTPYHNPMFTKAIESTRNLGFDISVRLIKFPYAEAGLPEGIESTDQITSDDLRPXFLKGCNLLQXPLEQLLQEFHPHALVADVFFYWANDSAAKFGIPRLLFHGSSSFAMSATDSVRRHKPYQNLSSDSDIFVVPDLPHEIKLSRGQISVEQREGIENEMTKLWEKVIDSERKSYGVVVNSFYELEPDYVNYYKNVMGKKAWHVGPLLLCKKEDEDVSQRGKESAINTHECLKWLDSKNPNSIVYICFGSMSNFTVAQLNEIALGLELSGQEFIWVVRKCADEEDSAKWFHKDLKTRIQGKGLIIKGWPPQLMILGHEAVGGFVTHCGWNSTLEGVCAGVPMVTWPMFAEQFYNEKLVTDVLRTGVGVGSKQWGRVNKETVKREAIKKAICHVMIGEEAVEMRSKAKELKKMAKMAVEEGGSSSNDLIALFEELKAYHDGRKQD

SEQ ID NO: 5600 - protein, 471 aa, Arabis alpina
MDKPHALLVASPGLGHLIPVLELGNRLSSVLNVHINVLAVTSGSSSQTETEAIRAAAASGACKITELPSVDVNHLVEPDATVATKIFVTMRAMKPAAREAVKSMSRKPTVMIVDFFGTGLMSLADEVGMTGKYVYVPSHAWFLAVMVYLPVLDKVVEGEYVDIKEPMKIPGCKPVGPKELMETMLDRSDRQYRECLQGGEEIPTSDGVLVNTWEELQGNTLAALRQDGKLSRVMKVPVYAIGPIVRTNGSVKKPDSIFQWLDQQPERSVVYVCLGSGGTLSLEQTMELACGLELSGQRFLWVLRRPTSYLGASSGDDDDQVCAGLPDGFLDRTSGVGLVVTQWAPQVEILSHGSIGGFLSHCGWSSVLESLTKGVPIVAWPLYAEQWMNATLLTEEIGVAVRTSELPAKEVIGQEEVAVLVRKIVVEEDEEGRKIRAKAEEVKVSSERAWTQGGSSHSSLFEWAKRCHLVS

SEQ ID NO: 5601 - protein, 665 aa, Vitis vinifera
MLHHHFLLITYPAQGHINPTLQFAKRLIRMGMEVTLVTGVSALSRMAKAPSSAGLTFTTFPDGYAEWDKARADFSHQLSEIKRSGSQALTDIILRSAEQGRPVTCLVHTLLLPWVTGVARRLHVPSALLWIQTATVLDIYYYYFNYYGDVVRKNSNNPSCSIELPGLPLLTCGDLPSFLLTGDDLTSFLCSSTLDSISFSTFQEQVEVLTQETNPKVLVNTFNELEAEALRSVDKLKLIGIGPLIPSAFLDAKDPSDTSFGADIFHGSTDCIQWLNSKPKSSVIYVSFGTLCDLPKPQMEEIARALLDSGRPFLWVLRSQGSGNVKDKDQEEEKWSCREELEEKGMIVPWCSQLEVLSHPSLGCFVTHCGWNSTLEGLACGVPIVAFPQWSDQRTNAKLITEMWKTGVRALVNEEGIVESDEMKRCLEIVMEDGERAREMRRNAEKWKDLAREAVKEGGSSDRNLKAFVDEVVAERVEEMRRNANKPKDLEKETVKEGGISDKNLIVFVDEVPEGRGEETVRNAEKCKDLARQVVNQGGSSDKDHKAFVEEADGERVEELRSNTEKWKDLAAEAVNEAGYSDKNLGALVDKVAEEKVEEMRNGEKWKDLTREGMKDGAVSDKNLKALLDEVAAGRLEQFSMNGGFSHKNLKAFMDDIAAGEEQYN

SEQ ID NO: 5602 - protein, 488 aa, Cephalotus follicularis
MSNMEPPHPLPPHVLIFPLPCQGHVNSMLNLAQLLSLAGLHVTFLNSDHNHDLLVRYTDIQARFACYPGFRFTTIPDGLPLEHPRNGESFMELFDAVKSITMPLFREMLVSGQFGLVNCIIADGIMGYTIDIANELGIPIFHFRTISACSFWAYFSIPQLIEAGEIPIKGNEDMDALVKSVPGMETFLRSRDLPSFCRCSDVFNPGLQLVMNETRQSPRARGLILNTFENLEGPILSQIRTQCPTTYTIGPLHAHLKSRLAKHATNTLQRSSNSSSLWEVDRSCMTWLDQQSSQSVVYISFGSIAVLTREQVIEFWYGVVNSKKNFLWVRRPDSIAGNKEGESEDIPVELVEGTKERGYMVGWAPQEEVLAHKAVGGFLTHSGWNSTLESIVAGVPMVCWPYFADQQVNSRFVSEAWKLGVDMKDLCDRKIVEQMLNDLMVERRTEFVKSTAEMAGMSRRSVNEGGSSYSNFDRLIEDIRLMSMETPI

SEQ ID NO: 5603 - protein, 504 aa, Brachypodium distachyon
MGSEAGETLAAPHAVLVPYPAQGHVTPMMKMAKLLHARGFHVTFVNTEFNHRRLLRSRGPAALDGVVPGFRFAAIADGLPFSDADATQDVPQLCQSTMTTCLPRLLSLLATLNDTPSSGVPPVTCLVVDGVMSFAYDAAREIGVPCAALWTASACGFLGYRHYRQLIEQGLVPFKDESQLTDNAFLDAVVPGIRGMCDGMRLRDFPSFLRTTDREDIMLNFFVHEGERLSLPDAVMVNTFDELERKVLDEMREFVLPAPLYTVGPLLLHAHHAVPEGSTPLDALGTNLWKEQDGLLDWLDGHAPSTVVYANYGSITVMTNEQLLEFAWGLAGSGYPFIWNIRPDLVKGDAAVLPPEFLEAVRGRAMLTTWCAQEKVLAHGAVGAFLTHSGWNSTLDGICGGVPMLSWPFFAEQQTNCRYKCTEWGNGMEIGGEVRREALAGMIRQLMEGDEGRGIRRRAAEWKESALRATLPGGSAMANLDTVVRDVLLAKFSGRDGGNYYAKN

SEQ ID NO: 5604 - protein, 486 aa, Anthurium amnicola
MAANIPPRTPDAPHVLCVSFTGQGHLNPFLRFARRVAAKGADVTFSTVEDAGHRIRKSSNSAVADGEFTTVGSGRLRFEFFSDGWEVGDPRRLDIQLYLPQLREVGSREVAALIRLQGELGRPVSSVVNNPFIPWVLDVAAGMGIPCGMLWVQSCAVFSVYYHYYHSLADFPDEARPEQIVPLPGVPPLQPHELPSFLLPTNPYLFLTDSILAQFENLHKARWVFANTFMELERDAITGIPNLFRPVIPVGPLVDAPFTGEGEHVHGDLWKAADCMGWLDAQEPCSVVYASVGSVVVLQRDQVVEMAEGLKAGGRPFLWVVRDDARWMLPEGFEEDTAGKGVVVGWSPQERVLAHPSTACFLTHCGWNSTIECLASGVPAIAFPQWGDQVTDAKFLVEVYGVGVHLRSKAPRLASGKGPSFTRADLERCIEEVTRGPRAESMRAMAARWKEATRSAVAEGSSSDTNILAFMEEISPGEPPWLPLPP

SEQ ID NO: 5605 - protein, 471 aa, Unknown
  Description of Unknown: Oryza sativa Japonica Group sequence
MESKPSRNVVLYAAMGAGHLLPMVELAKLFLTRGLDVTIAVPATPGSGTTGSPTIAGIAASNPSITFHHLPPPPSCADPDPNPLLLMLDVLRRSVPSLASLLRSIPSVAALVLDIFCAEAVDAAAALHVPAYIYFTSAAGAFAASLGLMHHYSTTTTNLRDMGKALLRFPGVPPIPASDMPSLVQDREGRFYKARVKLYARAMEASGVLLNTYEWLEARAMGALREGACSPDRPTPPVYCVGPLVASGEEEGGGVRHACLAWLDAQPARSVVFLCFGSMGSFSAAQLKEIARGLESSGHRFLWVVRSPRQDPANLLEHLPEPDLAALLPEGFLERTADKGMVVKSWAPQAKVLRHAATAAFVTHCGWNSTLEGITAGVPLLCWPLYAEQRMNKVFIVEEMKVGVVIDGYDEEMVSAEEVEAKVRLVMESEEGGKLLERLAVARAKAVEALAEEGPSRVAFDEFIDRLVTSE

SEQ ID NO: 5606 - protein, 475 aa, Linum usitatissimum
MERKSSEECHVILLPYPGQGHINPMTEFARRLVSRGIRATLVTTVFISNSLKLGPTIGHVHHDVISDGFDDSGRYGKGRTLPEYLEKAKEVGSRSLSELIEKYKSAPFGQPVDCVVYEPFLPWALDVAKEHGLYAAPFFTQPCAVDYVYYNVWAGSLGLPVDGWPVEIPGLPVMEAADAPSFLVDPVSSKDFLGLLVNQFSNAERADCFLINTFYELEKEVVDTFSKICPILPIGPTIPSNYLTTKPSMTENGKYGLDLFEHDESIPIKWLSNKPLSSVIYVAFGSRASLTHTQMEELALGLKQTAHYFLWVVRETEQAKLPKQFLKSSGNDNKGLVVKWSPQLKILANKAIGCFLTHCGWNSTIEALSLGVPMVAMPIWSDQPANASFVEKVWKVGVRVRVSEKNGVVGRDEIERCIREVMDGTGMAMKKNATKWREAVVKAVGKGGSSFRNIDDFVAKITTHKKTFETRMLIG

SEQ ID NO: 5607 - protein, 457 aa, Ricinus communis
MEKAANASKAHAVILPYPSQGHINPMLQFAKRLVSKGVKATLANTKAINKSMHSDPSCLIDIETISDGFDEGGSAQAKSTEVYLSTLKVVGAKSLANVIKRFKDSDCPVTAIIYDGFLPWALDVAKQFGILAVAFLTQACAVNNAYYHVQRGLLRVPGSSPTVSLPGLPLLQVSELPSFISDYVSYPGFRNLLVDQFRNIDGADWVLCNTFYRLEEEVVDWMAKKWRLRTVGPTLPSKYLDKRLEYDKDYGINLFKPDSGTCLNWLKTKPSRSVVYVSFGSVAELGTEQMEELALGLKGSNCYFLWVVRTSGWSKLPENFIEETYGKGLAVSWCPQLEVLANEAIGCFVTHCGFNSVLEALSLGVPIVAMPQWADQPTNAKYVEDVWKVGIRARPNEKGIVRRETVELCIREVMEGQKGKEIKENANKWKNLAKEAIDESGTSDKNIDELVAKISSS

SEQ ID NO: 5608 - protein, 301 aa, Unknown
  Description of Unknown: Oryza sativa Japonica Group sequence
MPASHFIDNRPEEPPESEVYKAVMDLVRRYTNKCSNGFLVNTVDSLEARVVNTLRHARRQGGRALPPFYCVGPLVNKAGERGERPERHECLAWLDRQPDRTVVFLCFGSTGIGNHSTEQLREIAVGLEKSGHRFLWVVRAPVVSDDPDRPDLDALLPAGFLERTSGQGAVVKQWAPQVDVLHHRATGAFVTHCGWNSVLEGITAGVPMLCWPLHSEQKMNKVLMVEEMGIAVEMVGWQQGLVTAEEVEAKVRLVMESEAGVELRARVTAHKEAAAVAWTDVGSSRAAFTEFLSNADSRQTS

SEQ ID NO: 5609 - protein, 444 aa, Gardenia jasminoides
MFPWLAYGHISPYLELAKRLTDRGFAIYICSTPINLGFIKKRITGKYSVTIKLVELHLPDTPELPPHYHTTNGLPPHLMATLKRALNGAKPELSNILKTLKPDFVIYDATQTWTAALTVAHNIPAVKFLTSSVSMLAYFCHLFMKPGIEFPFPAIYLSDFEQAKARTAAQDARADAEENDPAAERPNRDCDSIFLVKSSRAIEGKYIDYLFDLMKLKMLPVGMLVEEPVKDDQGDNSNELIQWLGTKSQRSTVLVSFGTEYFLTKEEMEEIAHGLELSEVNFIWVVRFAMGQKIRPDEALPEGFLERVGDRGRIVEGWAPQSEVLAHPSTGGFICHCGWNSVVESIEFGVPVIAMPMHLDQPLNARLVVEIGAGMEVVRDETGKFDRKEIARAIKDAMVEKTGENTRAKMLDVKGRVELKEKQELDEVAELLTQLVTETTQSSN

SEQ ID NO: 5610 - protein, 477 aa, Trifolium pratense
MKKAEVVFIPFPGPSHLISTLEFAKLLINRDNRLHITVLLMKFPNSRGTDAYTKSLSTSDSISFINLPECSLPPNTNPRDAFGALFEAQKPNVRQAVSDLTNGEQYGHLAAFVVDMFCTTMIDIAKEISVPTLVFFTSGVASLGLNLHLHTLRVRDNVDPTQLQQLKELVIPTFANPVPSYSLPGSVLSKEWEPFFLNYVGGLKKADGIIVNSFEELESHAIKSFSSHSELAGLPIIYPVGPILTPEPETKGVVESNDIIKWLDDQPPSSVVFLCFGTRGSFDEDQVKEIAHAIENSGARFVWSLRKPLPKGVMAAPSEYYSLSDLSLVLPEGFLDRTTGIGRVIGWAPQTQILAHPATGGFVSHCGWNSTLESVYFGVPIATWPIFAEQQANAFELVVELKMAVEIVLDYRVDLFQGPNYLLTADKIEKGIRSVLDNDEVRKNVKKMSENSRKTLLENESSHTYLGRLTDYIINQI

SEQ ID NO: 5611 - protein, 489 aa, Arabidopsis thaliana
MGSQIIHNSQKPHVVCVPYPAQGHINPMMRVAKLLHARGFYVTFVNTVYNHNRFLRSRGSNALDGLPSFRFESIADGLPETDMDATQDITALCESTMKNCLAPFRELLQRINAGDNVPPVSCIVSDGCMSFTLDVAEELGVPEVLFWTTSGCAFLAYLHFYLFIEKGLCPLKDESYLTKEYLEDTVIDFIPTMKNVKLKDIPSFIRTTNPDDVMISFALRETERAKRASAIILNTFDDLEHDVVHAMQSILPPVYSVGPLHLLANREIEEGSEIGMMSSNLWKEEMECLDWLDTKTQNSVIYINFGSITVLSVKQLVEFAWGLAGSGKEFLWVIRPDLVAGEEAMVPPDFLMETKDRSMLASWCPQEKVLSHPAIGGFLTHCGWNSILESLSCGVPMVCWPFFADQQMNCKFCCDEWDVGIEIGGDVKREEVEAVVRELMDGEKGKKMREKAVEWQRLAEKATEHKLGSSVMNFETVVSKFLLGQKSQD

SEQ ID NO: 5612 - protein, 427 aa, Helianthus annuus
MENQPKTTVRRHRRIIMFPFPFQGHINPMFQLANLLYSEGFSITILHTNFNAPKVSNYSHFTFKSILDDCPENERYSKASWADFAQNFIYKQDDAFWHFTQKVADSLNLPRLVLRTSSLYCTIVYSSIPLLDDRGYFTLDESHLEEQVVELPLLKVKDVIGIKSIKDPYAELICDMVKETKASSGIIWNSFKELEETELKRVSDDFLVPHFLIPFPKYFTASSSSLLEQDRTIFPWLDQQLPKSVVYVSFGSLSQVEEKEFLEIAHGLVYSKQPFLWVVRHGFVKSSTWHESLPEGFPGERGRVVEWAPQQDVLANEATGVFWIHSGWNSTLESICEGVPMICSSFWGDQPLDARYMSEVSRVGVYLENGLQREEIASAIRRLMVDEEGKEIRERARVLKRKADVSVTKGGSSNESVKTLIDYISSL

SEQ ID NO: 5613 - protein, 485 aa, Cicer arietinum
MDLLADGTKKKPHALLIPFPIQGHINPFLKLAKILHNKGFYITFVNTEFNHKRLFKSIGPNALNGFQDFQFETIPDGLPHTNMDATQSIPSLCDSTRKYSLAPFCNLISKLNDSNCAPPVSCIISDGIMSFTVKASQQFGLPNVLFWTHSACGFMSFKECKNLMDRGLIPLKDASYLTNGHLDTIIDWIPGVKNITLRDLPGIYHTIDPNDLLLNFVVEQIEVASKASAIILPTFDALESDVLNALSTMFPKLYSIGPLEFFLDQISDNRFESFHCNLWKEEFECLKWLDSQEPNSVLYVNFGSVIVMRYNQLVELAWGLANSKKKFLWVIRPDLVEGETLLVPQEIVEEVKDRALMVSWCPQEKVLKHKAVAGFLSHCGWNSTIESIINGVPMICCPFFNDQILNCKYICSEWNFGMKMDSENVTRDEVEKLVVELMDGEKGKEMKNKAIEWKKMAEEATNINGSSSLNLDKLVSEVLLFKSLG

SEQ ID NO: 5614 - protein, 470 aa, Citrus sinensis
MEQEQHQQHQPHFLLVTFPAQGHINPALQLARRLIRIGTRVTFATTIFAYRRMANSPTPEDGLSFASFSDGYDDGFNSKQIDPRRYVSEFKRRSSEALTELITGSENQGAQPFTCLVYSLLLPWTAEVARAYHLPSALLWIQPALVFDVYYYYFYGYGDLIEEKVNDLIELPGLPPLTGCDLPSFMDPRKSNDAYSFILPYFKEQMEAIVEETDPKILVNTFDALEAETLRAIDKFNMIAIGPLVASALLDGKELYGGDLCKNSSKEYYMEWLSSKPKSSVIYVAFGTICVLEKRQVEEIARGLLDSGHPFLWVIREHENKDKDKGEDDVVMKYKEELNEKGMIVPWCSQVEVLSHEAVGCFVTHCGWNSSLESLVCGVPVVAFPQWTDQGTNAKIIVDFCKTGVRVKANEEGILESDEIKRCLELVMGEGDEFRGNSLKWKDLAREAAKQGGSSYKNLKAFVDDFSTSK

SEQ ID NO: 5615 - protein, 491 aa, Unknown
  Description of Unknown: Oryza sativa Japonica Group sequence
MSASDCSLSSQSRSPIPCSEMSPKKLAVIYPPPGMISHLVSTVELGKLLAAQGLDITIVLGGHDEKEAAATATTSFLAEAAAANPELSFHRLPQPTLQCDVPADDYVSRIFEFARSSGPDLRDFLRSTSPAVLIIDFFCYSALNIGAELGIPTYFFLTTCIASVAFMLYLPVVQGENTLSFRDLGGDLVHAPGIPPIPADHLPRSQFDRDSMSSNHFLALSEQVCNAHGVMVNSCRSLERRAADAVVAGLCTFPGRRTPPLHCIGPLIKPREDDSAERHECLAWLDAQPKDSVLFLCFGSMGVFSVEQIKQVAVGLETSGHRFLWVVRRPPGFEHVTGPDLEALIFPEGFLRRTKGRGLVVMSWAPQREVLEHGAVGGFVTHCGWNSVLEAVTAGVPMLAWPLYAEQRMNKVFLVEEMRLAVAVEGYDKGVVTAEEIQEKARWIMDSDGGRELRERTLAAMREVKEALSDKGEFKIALLQLTSQWKNYNNS

SEQ ID NO: 5616 - protein, 477 aa, Scutellaria barbata
MGQLHIILVPMIAHGHMIPLLDMAKLFSSRGVQTTIIATPAFADPVRKAREAGHDIGLTITSFPPEGSSLPDNILSLDQVTNDMIAEFFRALELLQQPVEEIMKELKPDCLVSDMFLPWTTDSAAKFGIPRLIFHGTCCFSRCCAIEMGLQKPFKNVSSDSEPFVIPNLPHELSFVRTQVPDFELQEDVNENPFTKMMKQMRESEARSYGDVINSFQELESEYADHYKNILGMKAWHIGPLLLCNKRGEEKASQRGKKSVIDEDECLAWLNSKKPNSVVYMCFGSMATFTPAQLHETAVGLESSGQDFIWVVRNAGENEDWLPQGFEERIKGRGLMIRGWAPQVMILNHPSVGAFVTHCGWNSTLEGICAGLPMVTWPVSAEQFYNEKLVTEVLKTGVSVGNKKWHKVGDGVGSEAVKAAVVQVMVGDGAAEMRSRAKHYKEMAGKAIEEGGSSYNALNALIEELSAYVPPMKLAIN

SEQ ID NO: 5617 - protein, 478 aa, Cephalotus follicularis
MGSTILSERPHAVCIPFPAQGHVNPMLKLAKLLHHKGFHITFLNPEFNRRQLLKSRGANSLNGLSSFRFETIPDYLRPTDVDAARDLPSFCESTRKTGLAPFRELLSKLNDTSSSDVPPVTCIIADGGMTFTLDAAEELGIPEVLFWTTSACGFLAYVHVRTLIEKDVSYLTDGYLDNVIDFLPGMKGIRLKDMPSFIRTTDKDDPMIDIILDEIERAKRASAIILNTFNSMEHQFLSALPSMLPPIYSIGPLQLLLNQVPDTDLKRFGSNLWKEEPECLEWLGSMDPNSVVYVNFGSSTVMTLDQLVEFAWGLANSEQTFLWIIRPDLVFGDSAILPPEFLADTKDRALLASWCPQEQVLNHPAIRGFLTHSGWNSTIESVCGGVPMLCWPFFAEQQTNCRYCCTEWGIGMEINNDVNRDEVESLVRELMEGDKGKEMKQKAMEWKKMAEESTACPNGSSYKNLEMMINQVLLSIRN

SEQ ID NO: 5618 - protein, 476 aa, Linum usitatissimum
MTMTVAVTTVPHILIFPFPAQGHLIPILDFTHYLALRRQLQITILVTPKNLPLLQHLLSRHPSIQPLTLPFPDSPGIPPGVENTKDLPPSSTKSAHVSFMNALSGLRSPLLNWFQTTPSPPSVIISDMFLGWTHHLASDLGIPRIVFSPSAAFALSVIYHLWRNMPQLPENPSESITFPDLPNSPNWIKSQLSPIYRSYVPGDPQSELVKDGFLADIDSWGIAFNSFAGLESKYLEYLKIELGHDRVWAVGPLLSPPSESVASRGGTSSVSVPHLEAWLDTCPDDKVVYVCFGSEAVLTEDQSNKLASGLEKSGVQFVWRVKDVEGGRPSIPEGFEDRVAGRGVVIRGWAPQVMILSHRAVGAFLTHCGWNSVLEGIVAGVPMLAWPMGADQFIDATLLVEELKMAVRVCEGKESVPDSEVVASKLSELMEEDREERKLAKELSLAAKEAVSEGGSSVKDMESLVEQLVQLYSSSD

SEQ ID NO: 5619 - protein, 339 aa, Salvia splendens
MAKITQAYRNFDLKRAAFLPGAAALLALTTSAEKLVVDGVIDTDGTPLQSDPIRLSPSMPEMNPNHFAWVCLPDLAGRRAIFQSIVENNKSAKLAQYLICNSSSALEPAALDFLHNCRPIGPLLATRRLAKQAGHFWPENPTCLSWLDHHPPRSVVYVAFGSFTLLDPAQFRELALGLELTGLPFLCVVRSDITCHVSEAYPAGFEDRVRSRGKIVDWAPQQEVLAHPAVACFVTHCGWNSSVESVSSGVPVVCWPYFADQFLNETYIVDHWGVGVRLEKGGNGIIGREEIKGKVEMVLGDGGYKERVMELQEKTLASSVVGGSSHKNLCDFVDWIKED

SEQ ID NO: 5620 - protein, 486 aa, Helianthus annuus
MANNTFAELVFIPAPAVGHIMSTIEMAKLLLNRDQTLSVTLLIINPPYSVLPLTTYIESLAKNAIERMRFIKLPQDQSPPKLDSNAPFVMSFYEFINSHCKYVRNILEDAINQTSSRSRVVGLVVDILCTGMIDVANEYNLPTYVYFTSNAAFLGFKLHFETLFVDQKQDLIELANSEGEIVIPSFVNPVPMKVFPEVYRKQEGLDFLISAIGRMRKAKGILINTFLELETHAINSFSGTNFPPVYPVGPILNLDGVGEKPDDTDVFRWLQSQPPSSVVLLCFGSTGGFDEAQAKEIARGLEQSGHRFVWSMRRLPPPEQSLKVLPDDFDDPRGVLPDGFLERTSGIGKVIGWAPQVSLLAHEAVGGFVSHCGWNSMLESLWFGVPTATLPMLWEQQMNAFEMVVELGLAVDLKLDYKINVLNSEGDVVIVTAEEIERGIRRLMENKEVRTKVKEMSKMSRETVAKGGSSYSSVGYFLKEIMSNVI

SEQ ID NO: 5621 - protein, 400 aa, Unknown
  Description of Unknown: Oryza sativa Japonica Group sequence
MAAFVTFTDAVSLLRPQFEAAVAAMWPLASFIVADAFLYWVNESAAVLGVPKMSFFGISAFAQVMRELRNRHGLCAVMEPGDVDDDGYPATLAVPEFPHIRVTLEDLMATFGEPSAVRMMMELDGKLGKAIEESHGLIINTFHGLEAPYIKFWNEHVGPRAWPIGPLCLAQSASATADARPSWMEWLDEKAAAGRPVLYIALGTLAAIPEVQLKEVADGLERADVNFIWAVRPKNIDLGLGFEERIKDRGLVVREWVDQLEILQHESVRGFLSHSGWNSVLESVTTGVPLAVWPMIADQPFNARFLVDELNIAIRVSPIDRTMRGLVPSEEISKVVKELMDGEAGAEATKRVVELSALAKEAMDEGGLSWIAVKEMITELCAMKNDVHEKEEANYCKQDI

SEQ ID NO: 5622 - protein, 480 aa, Ricinus communis
MASEFDHHQLHILLFPLMAQGHMLPLLDIARLFASRGVKTTIITTPGNAASFTKITQDLSIQINLKIIKFPSKEAGLPEGLENLDLVSDKQTHSKFFKALSLLQDPLEKVVQELLPHGLVSDIFFPWTTEVATKCGIPRLIFLGTGFFPMCCFANIEEQQPHKNVSSDTELFILPGFPDPIRFTRLQLPDFMTGEQQTVLAELLGSAKEAEKRSFGILVNSFYELEPGYVDYYKNVLGRRAWHIGPVSLCNRTLKDKAQRGKETSISEHECMKWLDTKKPNSVIYVCFGSVTKFSDSQLHEIAIGLEASGQDFIWVVRTNNEEKWLPDEYEKRMEGKGMIIRGWAPQVLILDHEAVGGFVTHCGWNSILEGVSAGLPMVTWPICGDQFFNEKLITDVLRIGVGVGAKKWVTLVGDYIESTKIKEAVREVMMGEKAREIRRRATKFGEMARSAIEEGASSFNDLGALIQELKSYHTRIQVS

SEQ ID NO: 5623 - protein, 481 aa, Cucumis sativus
MEEAKQREEQQEFESSTPHVVMMVSPGMGHLIPLVEFAKRLVLLHRFTVTFVIPSGGPPPKAQISLLSSLPSAIDHVFLPPVSLNDLPPQTKGETIIVLTVTRSLPSLRDQFKSMLTQRNPVAFVVDQFCTIAIDLAREFNVPPYVYLPCSATTLSLVLHMPELDKSVVGEYTDLTEPIKLPACSPFPAKALPDPFLDRKDDSYKYFLESMSRFGLADGIFVNSFPELEPDPINALKLEESGYPPIYPVGPIVKMDSSGSEEEIECLKWLDEQPHGSVLFVSFGSGGTLSSIQNNELAMGLEMSGQKFIWVVRSPHDKEANASFFSVHSQNDPLKFLPEGFVERNKGRGLLLPSWAPQAQILSHGSTGGFLSHCGWNSTLESLVNGVPMIAWPLYAEQRLNAVILIEEIKVALKVKMNEESGIIEKEEIAKVVKSLFESEEGKKVREKMEELRVAGERVVGEGGSSSRTVLEVVQKWRNRN

SEQ ID NO: 5624 - protein, 494 aa, Unknown
  Description of Unknown: Oryza sativa Japonica Group sequence
MAAAGHDVQLPHVAIFPFMARGHTVPMTHLACLLRRRGLATVTFFSTPGNAPFVRGQLDDDVAVVELPFPDHVVARGAAECVEALDSLFPLPAFVEAVSALRPGLEVSLAAARPRVGLLVADAFLHWAHASAAALGVPTVAFLGGNMFATIMRDVILRDNPAAALLSGGGGAEAATFAVPEFPHVHLTLADIPVPFNRPSPEGPIMELNAKLWKAIAGSNGLIVNTFDAMEGRYVEHWNRDHRAGPRAWPIGPLCLAHGGTGTGTGAVEPSWMKWLDEKAAAGRAVLYVALGTAMAIPDAQLREVAGGLEAAAAAGVYFLWAVRPSDADLGAGFEERVEGRGMVVREWVDQWRILQHGCVRGFLSHCGWNSAVEGVAAGVPLAAWPMGAEQPLNAMLVVDELRVGVRVPVPTAMATGGHGVVGSEVIARVARELMMMAGEGKGGGGGEEARNVAALASKAREAVAEGGSSWKALEEMVATLCRPVEGDTPKPTK

SEQ ID NO: 5625 - protein, 246 aa, Citrus unshiu
MGKTLPKATVVAINSYEELDPIVVETLKSRFRKFLNVGPSTLTSPPPVSDPHGCLPWLNEHENASVIYISFGSMITPPRAEVIALAEALEAIGFPFLWSFRGNAEEQLPKGFLERTKSYGKVVPWAPQLKILEHSSVCVFVTHCGWNSTIEGITGGVPMVCRPVFADQALNQRIIETAWGIGVGVEGEKFTKDETVNALKQVLSSEEGKRMRENVGALKKLAFKAVESDGSSTKNFKALVEVVNRT

SEQ ID NO: 5626 - protein, 441 aa, Citrus unshiu
MARKLHVVMLPWSAFGHLMPFFQLSIALAKSGVKVSFISTPKNIQRLPKPAPESEVAALINFVEFPLPASAALDDKLLLPEGAEATVDIPSENIQYLKIAYDLLQHPFKQFVAQQSVDWIIVDVMSHWAGKIAQEYQVPLLLFSAYSAAAFQFIANPECLVGDGQKRVRPSAESLTSVPEWVDFPSSVALRTFDAIGMHHGFYGMNASGITDAHRTAEILHSCQAMAIRSCPEFEGEYLNLLEKLTGKPVIPVGLLTPEPNSAKGRDHQISMIFQWLDEQKPRSVVFVGFGSECKLSKDQVYEIAYGLELSGLPFLWALRKPEWATDDVDALPLGFADTIRGKGIVSIGWAPQLEILAHPSIGTSLFHAGWGSVIETLQFGHSLVVLPLIIDQPLNARLLVDKDLAVQVERKDDGSFTRDGVSQGSETGHGVLWGFFCERR

SEQ ID NO: 5627 - protein, 436 aa, Helianthus annuus
MAQTQPHFLLITYPAQGHLNPALQFAKQLTRLGVKLTFPTTVNAYHRMGKAGKIPESLNYVLFSDGYDDGFNPDTDDATHLLAQFREKGNECLKDTILFSAKNGTPVTCLVYTLLIPWAAEVARDCNVPPALLWIQPASVFRVYYYYFKGYDKLIGENCNEPSWSIELPGLPLLKSRDLPSLCLPSNASDPVGLERDGWQGKHGGCWLIPSAFLDGKDMSDQSFGGDLIEASHEYLEWMNTKPKGSIVYISFGTLIVWSKKQKEAMAHGLLESKRPFLWVIKDKDREEEEDEISYMHELKKLGLELIIPWCNQLEVLAHPSLGCFVTHCGWNSTLESMACGVPLLAVPKRSDQTTNAKLIEDLWGAGVRVTTNEEGVVEGEEMKRSIEMVMGGHERGEIVRVNVMKWMGLAREAMKEGGSSYMNLMAFIEEVGSCT

SEQ ID NO: 5628 - protein, 216 aa, Cephalotus follicularis
KVYEYFLETAIQMPKSAGIMVNTVETLEQRALKAILHGESTSGDPAAPIYCIGPLIVASEGSGKDKHECLNWLDKQPSRRVLFLSFGSLGKFSTEQLKEMALGLERSRVRFLWAVRNPPQEDDPLRKLEAAGVGEPSLEYLLPEGFIDRTKDQGLVAKDWVPQVPVLSHDSVGGFVTNCGWNSAMECLREGVPMLAWPSYAVQSINKLVSPNEFEN

SEQ ID NO: 5629 - protein, 434 aa, Rhodamnia argentea
MSPERGAFTSILMLPWLAHGHISPFLELSKRFADRNIHIYFCSTPVNLASVKPKLAGTKYFSKIKLVELHLPSLPELPPRNHTTKTLPPHLMPTLKKAFDTSSPGFAGILRLLVSDLVVYDFLQPWAPAIGTSLGIPAVEFLCTSATMCAFVNHANMKPGVEFPYPGIYLHDHEFDKFTNLLECSANGIKDRERVFQCFERSLDMIIIKGIREIEGKYIDYLSFLLDKRVVPVGPLVEDTMFEDGEKSKILDWLDNREEKSTVFVSFGSEYFLSKQEMTEIAHGLEASKVNFVWVVRFHDGERDAEANSRCHLPEGFLKRVAGRGLVLQGWAPQAAILQHSSIGGFVSHCGWSSVMESIRFGVPIIAMPMHLDQPMNARVAEEVGVGTEVKRDETEHPESGGGEEHQECDGRQGGGESEAESEGDERYHKKERR

SEQ ID NO: 5630 - protein, 475 aa, Trifolium pratense
MKKAEVVFIPSPGVGHLVSTLEFAKLLINRDNRLRITVLVIKFPHTTETDVYTKSLPKSDSLNVINLPECSLPPNSSPGPAMNALLEAQKLNVKEAVSNLTTREQHGHLAAFIVDMFCTNMIDVAKEFSVPAFVFFTSGVAFLGLNLHIHNLFERDNVDSTQLLQLTELAIPSFANLVPTKSLPSAVLRKEYESFFIGYAKGLKNADGIIVNSFEELESHAVHSFSSHPDLVGLPIYPVGPILNPEPKTKDADDIINWLDDQPPSSVVFICFGSRGSFDEDQVKEIALAVENSGAHFVWSLRKPPPKGTMIPPTDYLLSELVLVLPEGFLDRTVEIGRVIGWAPQAQILAHPAAGGFVSHCGWNSTLESIYFGVPVATWPLFAEQQTNAFELVTELKTAVEIALDYRVELFGGPNYLLTADKIEGGIRNVLEKDGEVRKKVKEMSEKSRKTLLEGGSSYNYLGHLIDNIMNQISN

SEQ ID NO: 5631 - protein, 774 aa, Helianthus annuus
MDCNTKPHAVLIPFPAQGHVIPFMNLAKLLHSHGFHITFVNTEFNHRRLVRAKGPESVKGLPDFWFKTIPDGMPHSDQDATQDVPMLCDMIKKTCLGPFKELLCRLNSSDGVPPVSCVIGDGVMTFAIKAAMDLGIPEVQFWTFPACALMCFLHYREFIKRGIVPFKDDNYLTDGTLEKSIDWIPAMSNLRYKDIPSFIRTTDPNDIMFNIAMDEAENNLSSPAIIMNTFDALEHKVIEAIASKFDYPNIYTIGPLPLLARYVPDDSPIQSLNSSLWMSDSSCLKWLDQKEEGSVIYVNYGSITTMTDQHFIEFAWGLARSMQPFLWVVRPNVTMGNSAVLPGELLEEIKDRGMLVSWCAQEKVLAHRSVGAFLSHCGWNSTTESILEGVPLICWPFFSDQLTNCRFACTEWGIGMEINHDVKRNEVEVVVKEMMQGEKGKEMRRNAREWKRKAKEATEIGDDNYLTDGTLEKSIDWIPAMSNLRYKDIPSFIRTTDPNDIMFNIAMDEAENNLSLPAIIMNTFDALEHKVIEAIASKFNYPNIYTIGPLPLLARYVPDDSPVQSLNSSLWMSDSSCLKWLDQKEEGSVIYVNYGSITTMTDQHFVEFAWGLARSMQPFLWVVRPDVTMGNSAVLPGELLEEIKDRGMLVSWCAQEKVLAHRSVGAFLSHCGWNSTTESILEGVPLICWPFFSDQLTNCRFACTEWGIGMEINHDVKRNEVEVVVREMMQGEKGKEMRRNAREWKRKAKEATEIGGLSYNNFQRFIKEALHYHT

SEQ ID NO: 5632 - protein, 496 aa, Unknown
  Description of Unknown: Oryza sativa Japonica Group sequence
MAVGEGEQQPLHILFFPFIAHGHLIPVADMAALFAARGVRCTILTTPVNAAVIRSAVDRANDASRGTGSPEISITLFPFPDVGLPPGVESVPGISSKAEQEKIAEAFLRFREPFDRFLAEHHTDAVVVDSFFHWSSDAAADHGVPRLAFLGSSLFARACSDSMLRHNPVEASPDDPDAVVSLPDLPHRVELRRSQMMDPREREGEWAFLQLVNAADQRSFGELFNSFREMEPDYVEHYHTKLGRRAWLLGPVALAAGKGMAERQDTDTDSGRLSPDEERCLRWLDGKAAGSVVYISFGTIARLLAAELTEIARALQLSGKNFLWIITREDTDASEWMPEGFADLMARGERGLVVRGWAPQVLVLNHPAVGGFVTHCGWNSVLEAVSAGVPMVAWPRYTDQFYNEKLIVEMLKVGVGVGAREFASFIDHRSQVIAGEVIAEAIGRVMGEGEEGEAMRKKVKELREKARSAVKEGGSSYDDAGRLLDELMARRSSGTS

SEQ ID NO: 5633 - protein, 310 aa, Cephalotus follicularis
MYTDLIRQHYANVEGNDSGDKTFEFIPGLSKIHIDDLPDRILPKSGSNFEESPFHSMLSKLKHILPQSATVVMNYYQELYTVPLLDDLKSKFPGLLNVGYMTLSMPPPPLLPSNLDATGCLSWLDGQKDMSVAYISFGTLAILPPNETLELGEALEASGVPFLWALKDDFKDHLPNGFLERTSMQGKVVPWAPQTQVLAHSSIGVHVTHFGANSVNESIANGLPMIGRPCLGDNHINGRIAEEIHGIGLRVEVLTKSGVIKSLELVLVHEQGKEMRKNVQSLKEIVLKAAGPTGSATKDFQTLVENISIL

SEQ ID NO: 5634 - protein, 456 aa, Eucalyptus grandis
MAPPHFLLVALSTRSAMNPALQLAERLARVGSRVTFLSTVCAHRCMIDPVCPEGVTFTTFSDGYDDGYVPGDDLERYRAEMKRRGSEALRDLIEHSSGQGLSFTCVLHTIVPWVHDVARSLQIKSVLVWIQPATVFDIYYHYFSGYEDVIKSVTSQRCDTTSLIRLPGVPPLTNRNIPSFLHVENKYAFALPEIQSLLENLKEGENPKVVLVNTFDALELEALRAIGTLNLVGIGPLVPLSFLDSDQSSRGDRFLGSEDYVKWLNAKEEASVIYVAFGSIAMLSKAQKREMARGLLETGRPFLWVMGKGDGDDDELIYKEEIDKRGVIVPWCSQIEVLSHPSIGCFLTHCGWNSTIESLVCGIPMVAFPQWADQMTNAKLVEDVWKVGVRVSEIDQEGIIVEAGEIKKCLELVMGGGERGDEIRRNAKKWKDLVMEASKDGGSSDKNLKAFVEEIA

SEQ ID NO: 5635 - protein, 221 aa, Citrus unshiu
MLLCLKSLDLWEPGSVIYACLGSICGLATWQLLELGLGLEASSQPFIWVIRGGERSQGLEKWIQEEGLEERTKGRGFIIRGWAPQVLLLSHRAIGGFLTHCGWNSTLEGVSAGVPLVTCPLFADPFYNDKLAVQVLGIGVSVGIEAAVTWGLEDKSGLVIKREKVKEAIEKLMDRGKQGDERRKRARQLGEIANCATGVGGSSHRNMEMLIKFVIQRTRGQ

SEQ ID NO: 5636 - protein, 460 aa, Syzygium oleosum
MDNMQRPIKVLMLPWLAHGHISPFLEPAKGLSRRNFHIYLCSTPVNLSSIKPKISEKYSSSIGLIELHLPSLPNLPPHYHTTKGLPPHLMNTLKVAFDMASPSFSSIIKSLGPDLLIHDFLQPWAVEAAQSHSVPSVVFFSAGAGALSFMFHVIMNTGSKFPFEAIHLHDYERTKLIKLIDDSAGRLSNKDRALQSVERSLNFILLKTFRELEGKYMGYLSSLLGKIVEPVGPLAEDPINVEDGDSIIEWLDKREKSSTIFVSFGTEYFLTEKEREEIAYGLELSNVYFIWVIRFPVGESTELEEALPEEFFERVRDRGLVIDGWAPQGKILGHPSIGGFVSHCGWSSIMESMKSGVPIIAMAMQLDQPLNARMVKEVGVGLEVKRNKSGELERLEIVKVIKDVVVEKDGDSVRKKAKEMSDGIRKKGEGELDEVADALVQLCVGHKEQYVSKRSHVIGI

SEQ ID NO: 5637 - protein, 468 aa, Helianthus annuus
MAAIDDHKQLHVAMFPWLAFGHIIPFLELSKFIAQKGHKVSFLSTTRNIQRLPTLPSHLSPLIYLVKLTLPHVQELPHNAEATMDLRTGETHEYLKKAFDGLQPEVTRFLEEESPDWIIYDFAPYWLPSIAAGLGISKAFLSMPNAWFIAFRGPSMDLINNTDGRTTAEDFMTPPKWVTFPSKLYYRKHEAKWMVDRLSVNASGVSDAYRSGMVLKGSDCLFIRHSYEFEPQWLTLLEELHHIPVVPVGLMPPETPTNVGDETWVTIKKWLDGQQKGHVVYVALGSEVMLSKSELAELAVGLELSGLPFFWALRKPVGSTELSLPDGFSERTSDRGVVWKSWAPQLKILRHESVGGFLTHCGWSSIVEGLMFSHPLIMLPFVVEQGLNARILVDKQVGIEIPRNEEDGSFTKESVARSVRSVVVEDEGKIYKANAMKLSQIFGDTELEQNYINNFIDYLEKKRRVVSM

SEQ ID NO: 5638 - protein, 453 aa, Jatropha curcas
MAKAKQGQRCGRVVLVPCPFQGHISPMLQLATILHSKGFSISIVHTKFNSPKTSSHPEFDFRPIQEGLSSYEIASLNLVDIILVLNEKCKIPFQECLLQMIMQQNSDDEISCIIYDDLMYFSESVAYHLNIPSIVLRTSSAATVISRLAILQLSSEGYVPFPDAVSNDPIPEISTLRYKDLPIFKLGPRENFYQLMANACDIKTSCAVIWNTIDCLEESLLTKLQKTQFPIPIFTIGPMHKFAPAFSCSLLKEDTSCITWLDKQDPNSVLYISLGSVASTDETELAEMAWGLANSKQRFLWVIRPGSVSGSEWIEFLPKGFLETVGEKGCIVKWAPQREVLAHPAVGGFWSHCGWNSALESISEGVPMICRPCFGDQMVTARYVSHVWRIGLILENKIERKEIESAVRRLMMDEEGEEMRKKAEELKEKVEGCFKKGGSSYNSLNKLVEFMSA

SEQ ID NO: 5639 - protein, 496 aa, Cucumis melo
MPAVSETPCHVFLVTFPGQGHMNPTIRLGKKLASKGLYITISTTSEFGLSLKNAGSIGDQPSPVGSGFIDFEFWDDGWELDDPRRRDLDLYMPQLQITGKPALTQMLKSRAGENRPVSCLIGNPFVPWVCDVANDIGIPCSVLWVQSCSVFSIYYHYSRKSVDFPSESDPYCDVQLPSLPLLKYDEIPSFLHPHGQYKVIGRSILQQFRNVSIPFCILMDTFEELERDIIKHMSTICPIKPIGPLFKTLKFSDDNKKADLSGDFLKADDCFEWLDSKAPNSVIYISFGSIVHLSQKQIEEMAHALVNSGFSFLWVMKPLSKDMADCLGLKQHVLPDGFLEKAGERGKIVKWSPQQKVLSHPSIACFVTHCGWNSSVEALSSGVPLLVLPQWGDQVTNAKFLVEEYGVGIRLGRGESEKRLVERDEFEQHLRDAIVGVKAKELRENALKWKIAAEKAAADGGPSESNIQELVEEIRKKWSTQMSDIHNLVVNNVDGA

SEQ ID NO: 5640 - protein, 491 aa, Zostera marina
MDASNSAHFVMIPLVAIGTMNPMLDLASALALRGSVVTFVTTPVNAKRMESGIDHCTKTELPIQFAVIHFPCSQAGLPEGGENVDLIPSMSYKSNFLQAITLLKEPIMELLLKSQSPKPSCFITGSFFGSDVWVNELARFFGASWLIFDGPGVFSTLCYTLLEKCDTFPKNPAEPFHILIPFMLQGMPHDVTITRSQLPPNLTYRSQDYKIKEKNMEYFDGIIINSFTELEMEYAQVYEAVTGKNLWMIGPLSLHSNNEPSSDVSYTWNRGNKSEIDEQQCINWLDYHKPRSVIYACFGSREKLSLLQLVELGFGLKNSNHPFVWVVRQKEDENIDLWLSEFEGEMATESEDKKAQGLVIRGWAPQLHILSHPSIGGFLTHCGWNSIIEGISAGIPMITWPYCAEQFLNEKLVVEVLEIGVSVGVKHQKYFGILVENSTVTNAVKRLMNESEEAKIRRTKVKKLSIMAKMAMDEGGSSHTNLMKLNKYAAL

SEQ ID NO: 5641 - protein, 484 aa, Citrus clementina
MCTQTQVCTQMPKNKHMEQQQQPHFLLLTFPIQGHINPSLQFARRLTRIGTRVTFAIAISAYRRIANNPTPEDGLSFASFSDGYDDGFNSKQNDRTHYMSEFKRRSSEALAELITTSQNEGGQPFTCLVYPQLLPWAAEVARAYHLPSALLWLQPALVFDVYYYYFYGYGDLIEGKVNDLIELPGLPPLTGRDLPSFLDPRNSNDAYSFVLPSFKEQMEAIVEETNPRILVNTFDALEAETLKAIDKFNMIAIGPLVASALLDGKEQYGGDLCQNSSIEYYMEWLSSKPKSSVIYVAFGTICVLEKRQVEEIARGLLDSGHPFLWVSRESDNKDKDKDKGEDDVMMKYKEELNEKGMIVPWCSQVEVLSHEAVGCFVTHCGWSSSLESLVYGVPVVAFPQWTDQGTNAKIIVDFCKTGVRVKANEEGIVESDEINRCLELVMGEGDDFRRNSLKWKDLARDAVKQGGSSHKNLKAFVDDFSTSK

SEQ ID NO: 5642 - protein, 510 aa, Citrus unshiu
MKKFRVVLICTPEMGNLVPLVEFAHQLTNRDRRFCATVLIMTVPERPIVNAYVKSRDALATTTDANTINFVYLPSVDPPSPDQYKSTLGYLSLFIERHKPHVKNEITKLMETESDSEDSDRVAGLFIDMFCTSMIDVANQLGIPCYLYFASPASFLGFMLHFPNIDAQLANEFVESNTDFFVPKDSTTELVIPSFANPLPPSVLPSTVLKRKRDGYVWYLRHATRYMETEGIVVNTFQELEPYAIESNSVNGMPPVYPIGPVLDLNGPAQWHPDRVHHESIMKWLDDQPPSSVVFLCFGSMGSFVGPQLREIAIGLQRVGFRFLWSIREPSKSKIYLPGEYTNLKVKEMLPEGFLNRTAGVGLVCGWVPQVTILSHQAIGGFVSHCGWNSVLESLWYGVPIATWPLYAEQQMNAFELVKELRLAVEIRLDYRDGRGSDLVSAEEIERGLRRLMDGDDEVRKKVKEMREKSRTAVMEEGSSNKSLGSLIKKIVADVRNFEAQSKLINSTFQ

SEQ ID NO: 5643 - protein, 481 aa, Citrus unshiu
MDSKSSPVEMFFFPYVGGGHQIPMVDIARIFAAHGAKSTIITSPKHALSFQKSINRNQQSGLPITIKTLHLPDDIEIPDTDMSATPRTDTSMLQEPLKSLLVDSRPDCIVHDMFHHWSADVINSMNIPRIVFNGNCCFSRCILENVRKYKPHEKVSSDYEPFVVPGLPDKIELTSSQLPVCARQQEAGSVHKMFAKQEEKSFGIVVNSFYDLEPAYVEYFKQDLGNDKAWFVGPVSLCNRNIEDKAERGQKTSIDEGKILSFLDSKETNSVLYISFGSLARLSPEQLLEIAYGLEASNHSFIWVVGKIFQSPGTRKENGIEENWLPSGFEERMRESKRGLIIRGWAPQLLILEHTAVGGFMTHCGWNSTLESVSAGVPMVTWPITAEQFSNEKLISDVLKIGVKVGSVNWVSWSTEPSAAVGRDKVEVAVKRLMGAGEEAAEMRRRAGELGEKAKNAVEEGGSSFIDAEALLQELKSLSRI

SEQ ID NO: 5644 - protein, 404 aa, Branchiostoma floridae
MPFFDSHWFGLAKIGQALAGKGHTVTVVVPVGVAKERHAERPDFHFETFEDQGTGARLKEIQDRYFTVAGTMSLYQTFKLNIPGSVYITKHCDVLLGNRDLANRLKKPQYDVVIFDPIFPCGAILSALIDLSVPLIAIFRGDPYFLGERATGVPLPSSYVPFFTSDFTDQMTFAERVQNVFLSTLAPMVSGWLARKTYDGLVRKYLGEGHTIQSVTERTDLWLHRTDNVLDFLRPSMPNIVQIGGVNVQAVASLPKELEAFVQSSSKHGVIVVSFGSMYRTLSPEKTEIFAAAFARLRQKVLWRYTGEKPAGLGNNTKLMAWLPQNDLLGHRKTRAFVTHAGYNGLCEALYHGVPVVCLPLYGDQPANAARVVARGLGVKLDFGTVTADKLYQAVIHVLTNNRY

SEQ ID NO: 5645 - protein, 483 aa, Medicago truncatula
MELSKQEPLSKPPPMVVMLPSPGMGHLIPMIEFAKRIIILNQNLQITFFIPTEGPPSKAQKTVLQSLPKFISHTFLPPVSFSDLPPNSGIETIISLTVLRSLPSLRQNFNTLSETHTITAVVVDLFGTDAFDVAREFNVPKYVFYPSTAMALSLFLYLPRLDEEVHCEFRELTEPVKIPGCIPIHGKYLLDPLQDRKNDAYQSVFRNAKRYREADGLIENSFLELEPGPIKELLKEEPGKPKFYPVGPLVKREVEVGQIGPNSESLKWLDNQPHGSVLFVSFGSGGTLSSKQIVELALGLEMSEQRFLWVVRSPNDKVANASYFSAETDSDPFDFLPNGFLERTKGRGLVVSSWAPQPQVLAHGSTGGFLTHCGWNSVLESVVNGVPLVVWPLYAEQKMNAVMLTEDVKVGLRPNVGENGLVERLEIASVVKCLMEGEEGKKLRYQMKDLKEAASKTLGENGTSTNHISNLALKWTNKSTVIN

SEQ ID NO: 5646 - protein, 469 aa, Medicago truncatula
MNKKTYIAMVPSPGLSHLIPQVEFAKQLLQQHNEFIVTFIIPTLCPLTPSMQQVLNTLPPNIEFIVLPQVKHLPEINLEPATQMKLIVKHSIPFLQEEVKSLISKTNLVSLIFGLFSTDAHEVAKQFNLSSYLFYASGALSLSFFLTLPNLDDSVSSEAEFLESAYETVNIPGCVIPFHIKDIPEIILCERSNVNYKIFLEVCQKLTLVDGFIISTFTDLEPDVIRVLQEKEKPCVYPVGPIIRNESNCEDNINSMCLRWLENQPPNSVLYVCFGSGGTVSHEQLNELAFGLELSGKKFLWVVRVPSKDVNSAYFVGAKDDPLEYLPNGFLERNKENGLVVPSWAPQVEILGHGSIGGFLSHCGWGSTLETVVNGVPVIAWPLFAEQRMNARLLTDVLKVAVRPKVDDESGIVKREEVAKCVKRIMEGDESLEIQKRIKELSDGAAVATSEHGSSRKALSSLALKLHNF

SEQ ID NO: 5647 - protein, 477 aa, Unknown
  Description of Unknown: Pyrus x bretschneideri sequence
MNNTKHHFLLISCPAQGHVNPTLQLAKLLIQTGGGTRVTYATTVRALTQIKSFPSLQGLSFATFSDGFDDGVIPTHDPDLFMSEFKRVGSRTLTALIQKLSASSDGGDGEPVTFLIYAVLLPWAAQVAADLGIPSAFFCIQSTTSFALCHHYLTYFHKCHSVPSSITIDGLPPFAPQELPSYLLPSSPHATIVPTFQEHIQALEQVNVKPYPNFVLLNTFAALEETAMEAIRSQMKNANVVPVAVGPLVSSSSDAGFRCDLFDKSRDDDYLQWLDGKPDCSVVYVSFGSMVVLKRDQIEEMINELVDSGLQFLWVIRASENGDDRSMTMMIEERLKSKEQGLVVPWCSQVEVLGHRSVGCFVTHCGWNSTLESLVAGVPTVCCPQFSDQNTNAKLVEEVWGTGVRAKSNHEGVTEGGEIKRCLEIVMRGEEIKRNCQKWKGLANEALNADNYNLRHFIAGLECNKTPPILWAGAPGR

SEQ ID NO: 5648 - protein, 473 aa, Daucus carota
MSPVYQDSKKDLVHILLVSFIGQGHVNPLLRLGNLLASSGFLVTFSSCSEVGNSMRKANNNIDELVPVGDGMIRFEFFDDGLPESDPRRHDLDFYMPHLELHGKEAVTGIVKKHEKEGRPVSCIINNPFIPWVSDIAEALSIRNAVLWVQSCACFSAYYHYHNKLSQFPSESEPEIDVQLPSMPLLKHDEIPSFLHPSTPYPALRRTILAQFKNLSKPFCVLVETFQELESEVIDYMSKLCPIKAIGPLFKNPKSQLSNIQGDCLKPVDDCIDFLNSKSPSSVVYISFGSVISMNQKQTNELAQGLLNSGVSFLWVFRPPLPGFDVAVLPEKFLEAAGDKGKVVQWCSQKQVLASPAVACFLTHCGWNSTLEALTTGVPVITYPAWGDQVTNAKFLVDVLKVGVRLSRGNQSKKNVISRDDIEKSLREATIGENAAEIKRNALKWKEAAEDAVAEGGSSDRNLKEFVDKLMMN

SEQ ID NO: 5649 - protein, 475 aa, Barbarea vulgaris
MRNTELIFIPTPTVGHLVPFVEFARRLIDQDDRIRITILLMKLQGQSHLETYVKSIASSQPFVRFIDVPELEEKPTFAARQAVEAYFYDVMERNIPLVRDIIMAILSSPALDGVVVKGVVADFFCLPMIDVAKDVSLPFYVFLTTNSGFLSMMQYLADRHKKDTSIFVRNSEEMLSIPGFVNPVPVKVLPSALVFEDGYDAFVKLAILFSKAKGIIVNTSFDIEPYSVNRFHHQRNYPSVYDVGPLFNPKAHPHPDQDLTRRDELMKWLDDQPEASVVFLCFGSMGRLTSPLVKEIANGLELCQYRFLWSLRPEEEVANDELLPEGFLDRVSGRGMICGWSPQVEILAHKAVGGFVSHCGWNSIVESLWFGVPIVTWPMYAEQQLNAFLMVKELKLAVELKLDYMAHSDELVSAKEIDTAIRCVMNKDDNVARKRVMDISQMAQKATVNGGSSYSAIEKFIQDVIGIKPYPNFYP

SEQ ID NO: 5650 - protein, 475 aa, Hordeum vulgare
METTVTAVSGTTSSSVGHGAGGGAARVLLLPSPGAQGHTNPMLQLGRRLAYHGLRPTLVATRYVLSTTPAPGAPFDVAAISDGFDAGGMALCPDPAEYFSRLEAVGSETLRELLLSEARAGRPVRVLVYDAHLAWARRVAQASGVAAAAFFSQPCSVDVVYGELWAGRLALPATDGRALLARGVLGVELGLEDMPPFAAVPESQPAFLQVSVGQFEGLDYADDVLVNSFRDIEPKEVEYMELTWRAKMVGPTLPSYYLGDGRLPSNKSYGLDLFNSEVECMDWLEKQMNSSVVLVSYGTVSNYDATQLEELGNGLCNSSKPFLWVVRSNEEHKLSEELKEKCGKIGLIVSWCPQLEVLAHRAIGCFVTHCGWNSTLEALVNGVPFVGIPHWADQPTIAKYVESAWGMGVRARKNKNGCLKKEEVERCIREVMDGERKDEYKKNAMNWMQKAKEAMQEGGSSDKHVAEFATKYSSI

SEQ ID NO: 5651 - protein, 483 aa, Arachis duranensis
MVNQNRRHHRFLLAIYPAQSHINPALQLAKRLISMGAHVTLLITLHVYRRMANKPSIPGLSLLTFSDGYDAGFSVFSGGDDDYRLYSSELKQRGSDFIAHLIASRAMEGEPFTCLIYTLLVPWAHEVARAFQLPTALLWIQAATVMSIVHPYFHGCETYITDKIKSKDEPFTIPGLPLLLSSCDVPTFLLVSTTNPLSFIFPLSEEQFRVLHKETNPTVLVNTFEALEPEALGALDGINMIPIGPLIPSAFLDGSDPRDTSFGGDILHASNDYVKWLDSQEESSVVYVSFGSYHELPKKQTEEIARALLGCEHPFLWVVRENLIKVEGRKEEEDLSYMEELKMKGKIVKWCSQVQVLSHASLGCFVTHCGWNSTMETLISGVPVVAFPQWSDQNTNAKLMEDVWKIGVRVNPNVINEEGIVEAEEIRRCLDIVMGSGEKAKEVRKNAERWKMLSREAAKEGGPSDTNLRDFVNGVGQFMHVDG

SEQ ID NO: 5652 - protein, 309 aa, Arabidopsis thaliana
MADESSLDTKINWIPSMKNLGLKDIPSFIRATNTEDIMLNFFVHEADRAKRASAIILNTFDSLEHDVVRSIQSIIPQVYTIGPLHLFVNRDIDEESDIGQIGTNMWREEMECLDWLDTKSPNSVVYVNFGSITVMSAKQLVEFAWGLAATKKDFLWVIRPDLVAGDVPMLPPDFLIETANRRMLASWCPQEKVLSHPAVGGFLTHSGWNSTLESLSGGVPMVCWPFFAEQQTNCKYCCDEWEVGMEIGGDVRREEVEELVRELMDGDKGKKMRQKAEEWQRLAEEATKPIYGSSELNFQMVVDKVLLGE

SEQ ID NO: 5653 - protein, 285 aa, Genlisea aurea
LSSGMKLRTHEARAIHRRRNMKGPIGINLAQRLLISADQCDAMAFKSCNEMESKYLDFLSKKYKKAVLPAGPVLPEAAKLGKDDEKWSEWLDEYEAKSVIYCAFGSEARLEPIQFQELILGLELTGKPYLFAAKPPTGAETVEEGIPEGGLSGRGVVHGGWVPQQLILSHPNTGCFITHCGWGSLFEGILSECQLVLMPLLSDQPINARMIGGELGIGIEVEKGDEDGICRRESVRRAVDLAMDFAAGGIGDKIRANHTRWRQRMTKQGLEDSYIDDLLINLRAL

SEQ ID NO: 5654 - protein, 1420 aa, Citrus unshiu
MDQRKGRRLVLFPLPLQGHISPMLQLANILHSQGFTITIIHTSFNSPNPSSHPHLTFHFIQENLSESEASTDDLVAFVSLLNTKCLVPFRDCLAKLLADVEEEPIACLISDAMLPFTQAVADSLKLPRIVLRTGGASSFVVFAAFPLLKERGYFPIQDSKGQEPVVELPPLKIKDLPVINTRDPETLYEIVNGMVDGAKVSSGIIWNTFEDLEESALATLRQQFSIPIFPIGPFHVCIPASPSSLLTQDQSCIAWLDKQAPKSVIYVSFGSIAAVSEAEFLEIAWGLANCKLPFLWVVRPGLTRGSDCLEPLPSGFMEMVDGRGHLVKWAPQQEVLAHPAVGAFWTHNGWNSTLESICEGIPMICMPCFTDQKVNARYVSDVWKVGLQLENGLKREEIEKTIRRVMVEKQGEEIRSRIFRLKEKANHSWKQGRSSFESINSLVHINLTSNKVGTLKSKREADSMERQKESNVQQKKGRRVILFPLPLQGHINPMLQLASILYSKGFSITIIHTNFNSPNPSNYPHFSFNSISESLWESEVSTENAISLLTVLNDKCVVPFQDCLAKLISNGDQEEPVTCLITDAIWHFAQTVADTLRLPRIVLRTSSISSFLAFSAFQILLEKGYLAEQDSQLEKPVTELPPLRVKDIPIIVTHDTRNFHQLISAVVSKTKACSGLIWNSFEDLEQTELTRLHKDFPIPMFPIGPFHKYCLASSSSLLSQDQSCISWLDKQAAKSVMYVSFGSIVVVNVTEFLEIAWGLANSRVPFLWVVRPGLVPGVEWLEPLPKGFLEMLDGRGHIVKWAPQQEVLAHPAVGGFWTHNGWNSTLESICEGVPMICQPCFGDQLVNARYVSHVWRVGLHLERKFERREIETAIRRVTVEAEGQEMRERIMHLKEKLELSLLEAGSSYQSLERLDSSAAPLNIKLDAGAGKSVNKMEQVPRPGPKYACYPPHVLIWPLPALGHVNSMLKLAELLSHAGIKITFLNSEHYHERLVRHSSDVFSRYMNLPGFQFKTITDGLPKDHPQTVDNFHELLNSLASVTPPLLKDMLTDAKSPVHCIISDGLMSFAIDVAKQVGIPIIYFRTVSACAFWAYFCIPEIIDAGELPIKGNEDMDRLIKHVPGMEKFLRCRDLPSFCRAEDPMDMNLQLVVSETRSSVRADGLVLNTFEDLEGPVLSQIRAHCPKIYTIGPLNAHLKARIPENTHSSNSLWEVDRSCIAWLDNQPSKSVIFVSFGSVAVMQRDQLIEFWYGLVNSHKRFLWVIRPDLISGKDGENQIPKELDKATKERGYIAGWVPQEEVLGHKAVGGFLTHCGWNSTLESIVARMPMICWPSFADQQINSRFVDEVWKLGLDMKDLCDRKIVEKMVNELLVERRAAFMKSADRMANLAIKSVNEGGSSFFYRKFVNHDKTYYYKNLPQQN

SEQ ID NO: 5655 - protein, 479 aa, Arabidopsis thaliana
MASHAVTSGQKPHVVCIPFPAQGHINPMLKVAKLLYARGFHVTFVNTNYNHNRLIRSRGPNSLDGLPSFRFESIPDGLPEENKDVMQDVPTLCESTMKNCLAPFKELLRRINTTKDVPPVSCIVSDGVMSFTLDAAEELGVPDVLFWTPSACGFLAYLHFYRFIEKGLSPIKDESSLDTKINWIPSMKNLGLKDIPSFIRATNTEDIMLNFFVHEADRAKRASAIILNTFDSLEHDVVRSIQSIIPQVYTIGPLHLFVNRDIDEESDIGQIGTNMWREEMECLDWLDTKSPNSVVYVNFGSITVMSAKQLVEFAWGLAATKKDFLWVIRPDLVAGDVPMLPPDFLIETANRRMLASWCPQEKVLSHPAVGGFLTHSGWNSTLESLSGGVPMVCWPFFAEQQTNCKYCCDEWEVGMEIGGDVRREEVEELVRELMDGDKGKKMRQKAEEWQRLAEEATKPIYGSSELNFQMVVDKVLLGE

SEQ ID NO: 5656 - protein, 481 aa, Malus domestica
MGDVIVLYAAPGIGHIVSMVELGKLIVHRYGPHKFSITILYTCGSVVDITSIPAYIRRISHSHPSISFLQFPRVTNKITRNISGAAIMFDFIRQNDPHVRRALQEISKSAAVRAFIIDLFCTSALPIGKEFNIPTYYFYTSGAAALAAFLYFPKIDEQTTESFKDLRETVFEFPGWKSPLKAIHMVEPVLDRNDPAYSDMIYFCSQLPKSNGIIVNTFEELEPPSVLQAIAGGLCVPDGPTPPVYYVGPLIEEEKELSKDADAAEKEDCLSWLDKQPSRSVLFLCFGSMGSFPAAQLKEIANGLEASGQRFLWVVKKPPVEEKSKQVHGVDDFDLKGVLPEGFLERTADRGMVVKSWAPQVVVLKKESVGGFVTHCGWNSVLEAVVAGVPMIAWPLYAEQHMNRNVLVTDMEIAIGVEQRDEEGGFVSGEEVERRVRELMESEGGRALRERCKKLGEMASAALGETGSSTRNMVNFVSSIT

SEQ ID NO: 5657 - protein, 468 aa, Vigna angularis
MTNNAELIFIPSPGIGHLTSSLEFAQLLINRDNHLSVTILCIKIPLTPFADSYIKSALASQPQIKLIDLPLGELPPQELIFKSPEHYICTFIESLKPHVKATLENILSSYPRSESQPVVRLVLDFFCLSMIDVGNELGIPSYMFMTSNVAFSAFILSLLNRGIEDVFNVSEPDLLIRGFPDSVPLSVFPDAAFNKDGGYAAYYKLAQRFLDTEGIIVNSFSDLEKYAIDALSDGQSQVPPIYTVGPLIDLKGQPNPNLDQAQHDKILKWLDEQPPSSVVFLCFGSMGRFAPSQTREIAVALQGSGVRFLWAMNSPPTADNVDRTLPDGFLEWMEGRGMICGWAPQVEVLAHKAIVGFVSHCGWNSILESLWFGVPILTWPIYAEQQLNAFWMERQYGLAVELRLDYRRSSDLVTAKEIEEGLKKLMDKDSKVHKSVLAMKEKARKAVLTSGSSFISVGKLIDNILGRN

SEQ ID NO: 5658 - protein, 472 aa, Ricinus communis
MVASGSPVHVLLVSFPAQGHVNPLLRLGKRLASKGLLVTFAAPEIVGKQMRNANNITDHESIPVGDGFIRFEFFEEGLEEDDPRRKDLDQYIAQLELVGKQVIPEMIRRNSEEGRPVSCLINNPFIPWVSDVAEDLGLPSAMLWVQSCGCFSAYYHYYHDLAPFPSEENPETDVELPFMPVLKYDEVPSFLHPSTPFPFLRRAILGQFKNLEKPFCILMETFQELEHDLIEYMSKFCPIKPVGPLYKDPKALNSDVKGDFLKADDCIEWLDTKPPSSVVYVSFGSVVYFNQEQWIEIAYGLLNSDVSFLWVMKPPAKESVFEPVVLPDEFLEKVADKGKVVQWSPQEKVLAHQSIACFVTHCGWNSTMEALSSGVPVVCYPQWGDQVTDAKYLVDVFKVGVRMCRGMAENKLITRDEMKKCLLEATVGPKAAEIRQNALKWKEAAEAAVAEGGSSDMNMQGFVDKIKRMRNV

SEQ ID NO: 5659 - protein, 441 aa, Salvia splendens
MTSDSDQQNLRPPPHVLIFPMPVQGHLNSMLNLSHLFCLAEFDVTFIISDFSHRRLLQHTTVAATFARYPGFQFLAFPDGLPEDHPRSGHRAMEFMSSVNNVTVPLFKEMMIQENFLASATRRPVTCFVADGKSMDELIESIPGMEGFIRRRDLPSFYRVDDLNDPVLKDIVAVTMLIKRARVAIFNTCEDLEGQIVAEVRKHVPRVFSIGPIHEQVKYRLTEKKAESSIITASLWAEDRSCIDWLDAQPSKSVIYVSFGSLALVTTEQVLEVLHGLLDSSQRFLWVMRPDSITAGNDGEDPVLVELKELVKGKGLLVAWAPQEKVLNHPAVGGFMTHSGWNSTLESIAAGVPMVCWPYFGDQTTNSRFVSEVWRIGLDIKDTCDRKIIEKAIRDLMEVRKDEFMESSANLAKLVKNTVSKGGLSYDNLDGLTQYIKSLVI

SEQ ID NO: 5660 - protein, 433 aa, Solanum melongena
MTTSQLHIAFLAFPFGTHATPLLTLVQKISPFLPSSTIFSFFNTSSSNSSIFSKVPNQENIKIYNVWDGVKEGNDTPFGLEAIKLFIQSTLLISKITEEAEEETGVKFSCIFSDAFLWCFLVKLPKKMNAPGVAYWTGGSCSLAVHLYTDLIRSNKETSLKIPGFSSTLSINDIPPEVTAEDLEGPMSSMLYNMALNLHKADAVVLNSFQELDRDPLINKDLQKNLQKVFNIGPLVLQSSRKLDESGCIQWLDKQKEKSVVYLSFGTVTTLPPNEIGSIAEALETKKTPFIWSLRNNGVKNLPKGFLERTKEFGKIVSWAPQLEILAHKSVGVFVTHCGWNSILEGISFGVPMICRPFFGDQKLNSRMVESVWEIGLQIEGGIFTKSGIISALDTFFNEEKGKILRENVEGLKEKALEAVNQMMEVQQKISRF

SEQ ID NO: 5661 - protein, 480 aa, Vigna angularis
MAEEKEEVLLFPFMAQGHIIPFLALALHLEKRQKYHITIVNTSLNIRKLRSSLPPNSSITLSEIPFNPSQHGLPPNTENTDAIPYNLVIRLIQASTTLKPAFTNLLRSILLQNKNRRLLVIADIFFGWTAAVSKELGAFHVIFSGCGGYGLACYYSLWLNLPHRRVDPAQEYFTLPDFPEALDIHRTQLPNNIAEADGSDAWSLFQQQNLSEWVKSDGVLFNTVHGLDSVGLDYFKRKLNRPVWAIGPIISAGSGSRGKGGGINPKLCTEWLEAKPCKSVLFVCFGSMNTISASQMMELGKALERCGKSFIWVVRPPIGFDINSEFREDEWLPEGFVERVQESGKGLVVRDWAPQLEILSHSAVSVFLSHCGWNSVLESLSQGVPILGWPMAAEQFYNCKLLEEDVGVCVEVARGKSCEVKCDDIAEKIALVIEETEKGIAMRKKAGYVRDVIKDAVKDEDGFKGSSVNAMDEFLSAALS

SEQ ID NO: 5662 - protein, 441 aa, Trifolium pratense
MKKAEVVFIPSPGVGHLVSTLEFAKLLINRDNRLRITILVIKLPHTTETDVYTKSLPISDSLNVIHLPECSLPPTSNPGFAMVALLEAQKTNVKQAVSNLTTGKQHGHLAAFVVDMFCTNMIDIAKEFSVPAFVFFTSGVAFLGLSIYIHNLFERDNVDSTHLMQLTELAIPGFANLVPTKSLPSAVLRKEYESFFMSYAKGLKNTDGIIVNSFEELESHAVHSFSSHPDLVGLPIYPVGPILNLEPKTKGTVESADIINWLDDQPPSSVVFICFGSKGSFDEDQVKEIALAVENSGARFVWSLRKPPPKGTMAPPSDHPLSELVSVLPEGFLDRTADIGRVIGWAPQAQILAHPTTGGFVSHCGWNSTLESIYFGVPVATWPLSADQQTNAFELVTELKTAVEIALDYRVELSGAPNYLLTSDKIERGIRNVLEKDGEVI

SEQ ID NO: 5663 - protein, 412 aa, Citrus unshiu
METQNSKQIPRAHVAMVPTPGMGHLIPLAQLAKRLVRQHNFLVSIFIPTIDDGIGSFMQPQRQVLESLPTSISTIFLPPVSLDDLPDNVPIETRIILTLVRSLSSLRDALKVLTESTRLVALVVDCFGSAAFDVANEVGVPAYIFFTTTAMVLSFLFHLPELDVKFSCEYRDMPELVQLPGCVPVHGRDFIDPVQQRKNEAYRFLLSFRKQYRLAAGIMVNSFMELETGPFKALMEGESSFNPPPVYPVGPLIQTGSTNETNKRSPACLKWLDEQPSESVLFVCFGSGGTLSQEQLNELALGLEMSGQRFLWVAKSPHEEAANATYFSVQSMKDPLDGEGFFYRKGSWTGLKGEDIANYAKGLIQGEEGKLLRKKMRALKDAAANALSPDGSSTKSLAQVAQRWKNPEIETK

SEQ ID NO: 5664 - protein, 470 aa, Medicago truncatula
MEKTVHIAVVPGVGYSHLVPILQFSKRLVQLHPNFHVTCFIPTLGSPSNATKSILQTLPSNINHTFLPPVNPNDLPQGTTMESQILLTLTNSLPYLHQGLKSLAKEIPLVALVVDAFSVEVLNIGKELNMLSYIYFPSAATTLAWCFYLPKLDEETSCEYRDILEPIKIPGCVPLHGRDFLSIAQDRSSQAYKHFLPFVKLLSSADGVLVNSFLEIEMGPLSAMKEEGGDNPPVYPVGPIIETETKSGDDANGLECLAWLDKQQPCSVLYVSFGSGGTLSQEQIVELALGLELSNTKFLWVLRAPSSSSSSAGYLSAENDIDTLQFLPSGFLERTKEKGFVITSWAPQIQILSHNSVGGFLTHCGWNSTLESVVHGVPLITWPLFAEQKMNAVLLSEGLKVGLRASVNENGIVERVEVAKVIKYLMEGDEGEKLRNNMKELKEAASNAVKEDGSSTKTISQIALKWRNLV

SEQ ID NO: 5665 - protein, 468 aa, Glycine soja
MVSYPAQGHINPLLRLGKCLAAKGLFVTFTTSETAGKNMRTANNITDKSVIPVGDGFLKFDFFEDGMADDDDGPKKINLGDFSAQLVLFGKQYVSQMIKKHAEENHPFSCIINNPFVPWVCDVAAEHGIPSAMLWIQSSAVFTAYYSYFHKLVSFPSDSDPYVDVQLPSVVLKHNEVPDFLHPFSPYPFLGTLILEQFKNLSKPFCVLVDSFEELEHDYINYLTKFVPIRPIGPLFKTPIATGTSEIRGDFMKSDDCIEWLNSRAPASVVYISFGSIVYLPQEQVTEIAHGLTNSHASFLWVLKPPPKNFGVPPHVLPDGFFEETRDKGKVVQWSPQEEVLAHPSVACFLTHCGWNSSMEALTLGVPMLTFPAWGDQVTNAKFLVDVFGVGIKLGYGKAEKKVVSREEVKKCLLEATEGPKADELKQNALKWKKDAETAVAVGGSSARNLDAFVKEIKKRGAVGVSGR

SEQ ID NO: 5666 - protein, 484 aa, Citrus sinensis
MEQVPRPGPKYACYPPHVLIWPLPALGHVNSMLKLAELLSHAGIKITFLNSEHYHERLVRHSSDVFSRYMNLPGFQFKTITDGLPKDHPQTVDNFHELLNSLASVTPPLLKDMLTDAKSPVHCIISDGLMSFAIDVAKQVGIPIIYFRTVSACAFWAYFCIPEIIDAGELPIKGNEDMDRLIKHVPGMEKFLRCRDLPSFCRAEDPMNMNLQLVVSETRSSVRADGLVLNTFEDLEGPVLSQIRAHCPKIYTIGPLNAHLKARIPENTHSSNSLWEVDRGCIAWLDNQPSKSVIFVSFGSVAVMQRDQLIEFWYGLVNSHKRFLWVIRPDLISGKDGENQIPKELDKATKERGYIAGWVPQEEVLGHKAVGGFLTHCGWNSTLESIVARMPMICWPSFADQQINSRFVDEVWKLGLDMKDLCDRKIVEKMVNELLVERRAAFMKSADRMANLAIKSVNEGGSSYCNLDRLINDIRMMSSKSENS

SEQ ID NO: 5667 - protein, 488 aa, Jatropha curcas
MGNLGHQQLHISFFPFMAHGHVIPTVDMAKLFAFRGHKTTIITTPANEPLISKTIQRTKDLGFDINIQILKFPSVEAGLPEGCENLDSVISYDNSQDIMDRFWLATAKLEEPLEKLLQEFKPNCLVADMFFPWATDAAAKSGIPRLVFHGTSFFSLCAGESIRLYEPHKKVLSDSEPFVIPNLPGEIKITRKQLPVFFREEAENNFTKMIKASKESELKSFGVVVNSFYELEQAYADHYRNVLGRKAWHIGPVSLCNRGMEDKAQRGKEASIDEHECLKWLNSKKSNSVIYICFGSVSSFTDSQLKEIAIALEACGQNFIWVVRRNQNSERNEQEWLPEGYEKRMEGKGLIIRGWAPQMLILEHEATGGFVTHCGWNSTLEGVSAGKPMVTWPVSAEQFYNEKLVTEVLKIGIGVGAKEWVRLHGDYVKSEAIEKAISRVMEGEEAEEMRSRARKLGEMARQAVEEGGSSCSDFNTLIQELSCYHQLS

SEQ ID NO: 5668 - protein, 474 aa, Glycine max
MKDTIVLYPNVLRGHLVSMVELGKLILTHHPSLSITILILTPTTTSSTTSVSCNSNARYIATVTATTPAITFHHAPFATLPPSTPSLPSHILSIELTRHSTQNLAVALQTLAKASNLKALVIDFMNFNDPKALTENLNNNVPTYFYFASCASFLSLLLRLPTIHQTVTREKVKDQPLQIQIPGLPTISTDDFPNEAKDPSSESYQSLLQVAENMRCSVGIIANTFEALEEKSIRALCKDGTLPPLFFIGPLISAPYEEDKGCLSWLDSQPSQSVVLLSFGSLGRFSRAQLKEIAIGLEKSEQRFLWVVRSRLDDADSMEELSLDELMPEGFLERTKEKGLIMRNWAPQVQLLSHDSVGGFVTHCGWNSVLEAVCEGVPMVAWPLYAEQKMNRVIMVKEMKVALEVNENKDGLVSATELGDRVRELMDSVKGKEIRQRVFEMKKRAEEAMAEGGTSCVTLDKLAIKLWKGNMIDI

SEQ ID NO: 5669 - protein, 430 aa, Rosa chinensis
MLGLYLTVSFSGETISCKQRNDGERTRKAHCLVLTYPTQGHINPMLQFAKLHHHKGLKVTLVTTHFLLNTLQLHAGSSKCNIALETISDGYEEGGFATAESTDAYLNRFWEIGPQTLTKLLRRMSSSEYPVDCIVYDAFMPWSLDVAKKFGIFGAIFFTQTVEASFSGGDEEILIPGLQLPLEAVDFPSFLCDLGSYPAVYDMVVGQFSNVDEADWILCNTFHELEPEARPTIPSMYLDNRLKEDKDYGVSLFKQNNDACMKWLNEQPKVSVVYVSFGSGAELGAEQMEELAWGLRSSKSNFLWVVRESEAGKIPKGFVEETSENGLVVSWCPQLEVLAHEAVGCFITHCGWNSTLESLSLGVPLLAMPQWTDQGTNAKYIMDVWKTGLKALADEKGIVRKDVVEHCIIEIMEGETGKESKECYEMEASG

SEQ ID NO: 5670 - protein, 465 aa, Nicotiana sylvestris
MKQHHFLVISLPAQGHINPTLQMAKNLARAGARATFVTTVYGLKRMNNLPTQERLFYSSFSDGYDDDWISNTDHNDYMNNLKYEGSKNLKNLLRKFSDEGHPVTFLVYTILLPWVAVVARELHVPSAFLVIQCGTAFAIYNHLFNSINGVYSSSVSDITVTPSFAIEFPELPLFSSNDIPTIVLPNAPHSSVMIPIMREHIQNLEKDPNSCVLINSFDALEEKSMRIVDKLRIFSVGPLVPSAFSDGNDPKDKSFGCELFENREKNYRQWLDSKPEGSVIYVSFGSIAVLEKEQKEEILHGLLESERPFLWVMRKGKEEVEEGNNYKNEFDDILLNKKGIIIPWCAQMEVLFHKSVGCFVTHCGWNSTLESMVAGVPIVGCPQFSDQTTNAKMVEEVWGTGVRANAVEGVVGREELKRCLEILMGNGEKGEEIKRNVKKWRDLAVEAVKVGGSSYDNLKKFLEIL

SEQ ID NO: 5671 - protein, 481 aa, Elaeis guineensis
MDRGKNHQLHICFFPFMAHGHMIPMMEIARLFATRGLKISIISTPVNVPQYSKFTERSKILGYQVDILVIKFPCVEAGLPEGCEHLDMALSGDLNRNFFTAAGMLGPQLEQLLKKHRPDGLVADMFFPWATDIAHSLGIPRIVFHGTGFFSLCAAECVRLYEPHKKVSSDTEPFVIPNFPGEIKLTRNQLPHFAKIEGHHFAQLHIDIKESELKSFGVLVNSFYELEPAYADHFRNVFGRKAWHVGPVFLCNSDFEDKANRGKEASIEVLECLKWLDSKKPNSVVYISFGSLARFTSSQLLEIAMGLEDSGQHFIWVVKQEGDGQEGKEEWLPEGFEERMEGKGLTIKGWVPQVLILEHVAVGGFLTHCGWNSALEGIAAGVPMVTWPVSAEQFYNEKLVTEILGVGVGVGIQQWVVVVGDCVKKEAVAKAVNHIMVGKEAEEMRTRARELGELARRAVEEGGSSHSELNALIEELRNKKI

SEQ ID NO: 5672 - protein, 483 aa, Arachis duranensis
MGSEECNLHIFFFPFLAHGHMIPTVDMAKLFASRGAKATIITTPINEPFIFKTIEKAKTHGKGSIHIKTVEFRPVDFGLPEGCDNVDFIRSSDKIPLFFEATRFLQEPFERLLIQHNPDCVVSDMFYPWTTDSAAKFGIPRIMFHGTNFFFMCVSESTRLYEPHKNVSSDSEYFVIPNLPDEIKMTRMQMPPFALHNEGKGTHPIAKLSKEAIESEKKSYGTVVNSFYELEKDYADHFRNVLGRKAWHIGPLFLINKDDTQDKAQRRKDASIDENECLKWLDTKKPNSIVYVCFGSIANFPDSQLRDIAIGLEASGQHFIWVVKKSKEDGDEWLPEGFEKRMEGKGLIIRGWAPQVLILEHQAIGAFVTHCGWNSTLEAVTAGVPMVTWPIAAEQFYNEKLVTEILKIGVPVGAKKWLRLIGDTVKWEAVEKGVKKIMVGEEAEEMRNKAKVLSQLAKSAVEKGGSSYSDLDALIVELASHKH

SEQ ID NO: 5673 - protein, 483 aa, Medicago truncatula
MGSLGKKENKPHVVCVPFPAQGHINPMLKLAKLLHFKSDFHVTFVNTEYNHKRLLKARGPNSLNGLPSFRFETIPDGLPESDLDSTQDIPSLCESTSKTCLPHFKKLISKLNNAIDTPPVTCIIGDGVMSFTIDAAEELNIPAVLFWTTSACGFMCYMQFRQLIEKGLTPLKDSSYLTNGYLETTIDWVPGIKEIRLRDIPTFIRTTDPNDIVLNFALGECQRALKASAIILNTFDALEHNVLEAFSSIDNLPPVYSIGPINFLLKNVTDEELNSIGSNLWKDETDCLEWLASKEPNSVVYVNFGSITVMTNDQLVEFAWGLANSKKTFLWVIRPDLVSGKNAVLPQEFLEETKNRGLLSSWCPQEEVLGHSSIGGFLTHSGWNSTLESVCGGVPMICWPFFAEQQTNCRFCCNEWGIGLEIEDAKRDKIEILVKELMEGEKGKEMKEKALRLKELAHDNAYGAFGSSLVNLDNMIHHVLLLS

SEQ ID NO: 5674 - protein, 503 aa, Unknown
  Description of Unknown: Oryza sativa Japonica Group sequence
MAASASSSSPLHIVMFPWLAFGHMIPFLELAKRLARRGLAVTFVSTPRNAARLGAIPPALSAHLRVVPLDLPAVDGLPEGAESTADAPPEKVGLLKKAFDGLAAPFAGFVAEACAAGHGESTPTAAGFSRKPDWIILDFAQNWVWPIAEEHKIPCAMFSIFPAAMVAFVGPRQENLAHPRTKTEHFMVQPPWIPFPSNVAYRRRHGAEWIAAVFRPNASGVSDADRFWEMEHACCRLIIHRSCPEAEPRLFPLLTELFAKPSVPAGLLMPPPPPAAGVDDDDDDVSMDDQHIAMAMRWLDEQPERSVIYVALGSEAPLTVGHVRELALGLELAGVRFLWALRAPPSASSVNRDKCAADADLLLPDGFRSRVAAARGGLVCARWVPQLRILAHRATGGFLTHCGWSSIFESLRFALPLVMLPLFADQGLGVQALPAREIGVEVACNDDGSFRRDAIAAAVRQVMVEEKGKALSRKAEELRDVLGDEGRQEMYLDELVGYLQRYK

SEQ ID NO: 5675 - protein, 469 aa, Medicago truncatula
MSDEVVHVAMFPSAGMGHLTPFLRLASLFLNNNCKVTLITPLPTVSLAESQLLDHFHSSFPQVNFIPFHLQPSSPDSVVDPFFHRVQTLRDSTNLLPPLISSLSPPITVFISDIFLLSPLISITQQLSLPNYTLFTSSASMFSFFSHFPTLAQSISDASAEISEIPVPGIAFSPLPYSSIPPILFKPTIFRNLMMEDSPNLTKLQGVFLNTFKALESHSLQALNNGEVVKGMPPVYAVGPFVPLEFEKESQKETSSESPPLTKWLDEQPIGSVVYVCFGSRTALGRDQMREIGDGLMRSGYNFLWVVKDKIVDKEDKEVGLDEVLGVELVERMKKKGLVVKEWVDQSEILSHKSIGGFVSHCGWNSIMEAALNGVPILAWPQHGDQRINAGLVEISGWGIWNKNWGWGGERVVKGEEIGDAIKEMMKNELFKVKAIELKDGGLRAISIGGDCEVTIQKLIRKWKNNVNN

SEQ ID NO: 5676 - protein, 481 aa, Theobroma cacao
MEKGEQSEACPHVLIFPLPLQGHVNSMFKLAELLALTGFKVTFLYSEHNHGRLVKYTNVSAHFASYPGFEFRTVPDGLPDDHPRSGDWFLEMYYAMETKAKLSLREMLLNINPPVDCIIGDGFLGFVLDVAKELGIPVFYFRTSSACCFWAYYSIPDIIQAGEIPIRGIEDMNRLITTVPGMETFLRCRDLPSFCRASDMANSTIQLVVEQTRKSPQAHALILNTFEDLDRPILSHIRTKCPHVYTIGPIHALLNTRLKAKRGASSQFSNSLWEVDRNCISWLDKQPKQSVVYVSFGSITIPSREQLTELWYGLVNSKRRFLWVVRPNSVTGKDGQGEDVPVELLEGTKERGCIVGWAPQEEVLNHPAVGGFLTHSGWNSTLESVVAGVPMICWPYFADQQVNSRFVSEVWKLGLDMKDVCDRKVVEKMVNDLMMDRREEFVKSAAEMAKLAKESVNVGGSSYCNLDRLIEDIRLMSLKKP

SEQ ID NO: 5677 - protein, 529 aa, Cyprinodon variegatus
MTLNHFCGIITFSLNLVLFASHCNGGNILVFPVDGSHWINMKIVLEELHTRGHNITVIRSSNSWYIPEKSPIYTSITLEMDQGLENFFDIYLQEHMRAQREGASLMTFLKLTKDFLSMITKAHLLWCDATTQIFQNQTLVKKLKDSQYDLVLADPAMGPGALIAKHLKLPLVLNVRWITSGEGHFVLAPSPLSYIPVPGSGLTDKMDFIQRVKNMFFYSIVFFQEKFLIGPIYADLCNRHIEGGCDIVSLLQDADIWLFRSDFVFEFPRPTMPNVVYIGGFQCKPAKPLPADLEEFVQSAGEHGFIIMTLGTLVNALPKEVTDEIASIFAKMPQKVIWRHKGTRPSTLGNNTMIVDWMPQKDLLGHPNIKVFVAHGGTNGVQEAIYYGVPVLGIPLFFDQYDNLLRLQKREAAKVILLDNVNGPNFEKAIRELLYNDSYRQNMQRLSSLHRDQPMPPMDQATFWIEYVIRHKGATHLRTQAYKLPWYSYHCLDVLVVLIAVIMGLLFLVFAVFRFLFCRGGRNRKLKQY

SEQ ID NO: 5678 - protein, 436 aa, Vigna angularis
MDSEDTIHVLMVSYPGQGHINPFLRLAKFLAANGLFVTFSTTEIAGKQMRTTNNITHKSVTPIGDGFLKFEFFEDGGMKDVDADGSKMRSLTDFSAQVEHFGRQYVSQVIREHAEANHPISCIINNPFVPWVCDVAADHVLKYNEVPDFLHPFSPYPALGTVILEQFKNLSKPFCVLVDSFEELESDYIKYLSEFVDIRPIGPLFKIPTATDTSDIRGDFWKSDDCMEWLNSRAEASVVYISFGSIVCLPQEQVTEIAHGLLDSQVSFLWVLKPPVKEFGLPPYVLPDGFLEDTREKGKVVQWSPQEEVLGHGSVACFVTHCGWNSSMEGVALGVPMLTFPAWGDQVTNAKFLVDVYGVAIKLGYGQAEKKLVSRDEVKKRLLEATVGPKAEELKQNAFKWKKAAEVAVAANGSSARNLDAFLKDIKERGAVSINN

SEQ ID NO: 5679 - protein, 469 aa, Jatropha curcas
MAEPTHIAILPSPGMGHLIPLVEFAKRLAFQHNISVKFIVPTDGPPSKAQKSVLDSLPSTISYTFLPPVSFSDLPSDAKIETLISLTVTRSFPSLREELKSLVSTTRLAALVVDLFGTDAFDVAREFNVSPYIFYPSTAMALSLFFTLPKLDETTSCEYRELKEPVKIPGCIPIHGKDLLDPVQDRKDDAYKWVLHHAKRYRQAEGIMLNSFMEMEGGAIKALQEEEPGKPPVYPIGPLVNMDSKSKPEEAEILKWLDDQPHGSVLYVSFGSGGSLSYNQITELALGLEMSDQRFLWVVRSPNDGVANATYFSVQSQNDPFDFLPKGFLDRTKGRGLVVSSWAPQAKVLSHGATGGFLTHCGWNSTLESVVNGVPLIAWPLYAEQKMNAVMLTEDIKVALRPKPSENGLIVREEIANTIRSLMEGEEGKKVRNRMKNLKDAASDVLSENGSSTKALSRLALKWKTQNYN

SEQ ID NO: 5680 - protein, 507 aa, Unknown
  Description of Unknown: Oryza sativa Japonica Group sequence
MAATSDSTPAAAAAAAASSSSSPLHIVVFPWLAFGHMIPFLELSKRLASRGHAVTFVTTPRNAARLGATPPAPLSSSSRLRVVPLDLPAVDGLPEGAESTADVPPEKVGLLKKAFDGLAAPFARFVAEACAAGDGEAVTAAAGFLRKPDWIIPDFAHSWIWPIAEEHKIPYATFLIVPAALVAILGPRRENLTHPRTTAEDYMVQPPWIPFPSNIAYRRRHEAEWMVAAFRANASGVSDMDRFWESEQHPNCRLIIYRTCPEIEPRLFPLLTELYTKPAIPSGLLVPPALDDNDIGVYNRSDRSFVAVMQWLDKQPNKSVIYVSLGTEAPITADHMHELAFGLELAGVRFLWALRRPSGINCHDDMLLPSGFETRVAARGLVCTEWVPQVRMLAHGAVGVFLTHCGWGSTVESFHYGQPLVMLPFIADQGLIAQAVAATGVGVEVARNYDDGSFYRDDVAAAIQRVMVEEEGKELAHKAIELCGILGDRVQQEMYLYELIGYLQCYK

SEQ ID NO: 5681 - protein, 618 aa, Citrus unshiu
MDLKEEKEYGDHVLMVSLATQSHINPLLRLGKRLVSKGLSVTVATPEIAQHQLLKSFTSSKINDCVSDDIPCLYFSDGFDLDYNRKSDLDHYMETIEKAGPGNLSKLIKNHYHDKHKKLSCIINNPFVPWVVDVAAELGIPCAMLWIQPCSLFSIYYRFYNKLNPFPTSENPNSSVELPGLQTLHTHDLPSFVLPSNPFGSFSRILNDLFQNLNKQYKWVLANSFFELEKEATESMSQLCPIRPVGPLVPPSLLGQDEKLDVGVERWKPEDCCLEWLNKQSNSSVVYISFGSLTQLSANQMEVIATALKNIKLPFLWIVKQSESASSDGEGTLPLWFLEETKNRGLVVSWCPQTKVLAHPALACFVTHCGWSSLLETIVAGVPVIAYPQWSDQPTNAKLVADVFKIGLRLRPSEDGFVGNEELEKCVEEIINGPKSEYYKKNAVELKHAARQAVAGGGSSDQNIQLFADEILGNYSEGGARCGEKLASSMIVIKPTVQTPQVARRASQPASSEEAKSLRNLQRSMAMRPATAGPKAVELKENALKWKKEAEEAVADGGSSDRNIQAFVDEVRRTSVEIITSSKSKSIHRVKELVEKTATATANDKVELVESRRTRVQY

SEQ ID NO: 5682 - protein, 457 aa, Helianthus annuus
MFPLPYQGHVNPMFQLANLLYSKGFSITIFHTNFNKPKTSNYPHFTFRFILDNDPHDERYANLPLQGMGAFSRIILFNKCGADQLRHQLELELSAKDEPPVSCLITDASWHFAQSVADCLNLPRLVLRTSSLFCFLIYASIPFLDDLGYFNLSDNTATPLLDGLGYNNVPDDKRLEEQVAEFPVLKVKDVIKIGFKKDNDGMGDIISNMVKQTKASSGIIWNSFKELEQLQLETIRRDIPAPCFLIPFAKHFTTASSSLLDQDRSFLPWLDQQPRNSIVYISFGSVAQVEEKHFVEMVHGLVDSKQSFLWVVRPGFVSGSTWLEPLPDGFPGERGRIVKWAPQQEVLGHEAIGAFWTHSGWNSTVESVCEGVPMICSPFWGDQPLDARYVSDVWKVGVYLENGWKREEITNAIRRVMADEEMREKSRGLKQKLDASLIEGGSSYESVESLVDYISSF

SEQ ID NO: 5683 - protein, 483 aa, Helianthus annuus
MATTETNSSNDRKQLHVVMFPWLAFGHIIPFLELSKFIAQNGHKVSFLSTTRNIQRLPTLPSHLSPLINLVKLTFPRIQELPHNAEATMDIGTDDIPYLKRAFDGLQPDVTRFLEEESPDWIIYDFAPYWLPSVVAGLGISRAFFSIINAWFIAFQGPSPDDLINGSDDRTIANDFLAPPKWVPFPSKLCYRKHEASWMVGNLSVNASGVSDAYRGGMVLKGSDCIFIRHCYEFEPQWLTLLEKLLKLPVIPVGLMPPVTPTHVGDEKDATWVTIKKWLDGQQNGRVVYVALGSEVMLSKSELAELALGLELSGLPFFWALRKPVGSTESNLIELPEGFLERTRDRGVVWTSWVPQLQVLSHESVGGFLTHCGWGSIVEGLMFGHPLIMLPFLVDQGLNARILVDKQVGIEVPRNEEDGSFTKESVARSLKSVVVEDQGKIYKANAMELSQIFSNTNLEKRYINNFIDYLEKKRGVVAINDEA

SEQ ID NO: 5684 - protein, 466 aa, Helianthus annuus
MSTVEIAKLLVNRDQRLAITVLVIKPPSSSSGSAIDTYIESLAKSTMNRISFIQLPQDETPLVDPKSPMSTFSEFIPSHCKYVRNVVADMISQPGSGRIAGFVIDMFCTCMVDVANEFNVPTYLFFTSNATFLGFKFYIQTLSDDMNKDVIELGNSDTEISVPSFVKPLPTNAFWCLVHTREGLDFVLRSVRKLREVKAIMVNTFLELETHAMESLSADVSIPPVYPVGPILNLEGGSRGGKSFDHDIIRWLDGQPPSSVVFLCFGSMGSFDEAQVKEIARGLEQSGHRFLWSLRRPPSDQTSRVPGEYEDPSVVLPEGFMERTRGIGKVIGWAPQVAVLAHHAVGGFVSHCGWNSLLESLWFGVPLATWPLYAEQQMNAFQMVVELGLAVKIKLDYRKDAYTPKVNTVIVTAKEIESGIRRLMEDNEVRTKVKEISAKSRSTVVEGGSSYASLGCLIEDFVRNVS

SEQ ID NO: 5685 - protein, 486 aa, Morus notabilis
MKQTPPHIAILPGPGISHLIPFVELARRLVVHHELHVTCIIPCTPDDHPPSDATKAVLESLPKRNAHTIFLPPVNFDDLPNDTNPSRKNTLTMTRSLPSIHHVLKSLASSASTTALFVDPFGLDALDIAKELDISFYLFFPTNAMSLSLVLHLPKLDEIAASYDFMRDLPEPVKLPGCPPLRGGDLFASIQDRRTDTYKERVQFAKRIVSAGGIDGIIFNSFMDIEPDAIRALQERRIGGSVMPIYPVGPIVQTGSIGQINKDSECLTWLDNQPRGSVLYVSFGSGGTLSYDQVTELAFGLEMSGQRFIWVVKRPNNKFPNAAYLSHRPQGPFKPLDFLPHGFVERTKGRGLVVDFWAPQARVLGHSSTGGFLSHCGWSSTLESFLYGVPLIAWPLFAEQKLNAVLLVERLKVALRPKADEDGLIRRKEIACVVKALMEGTGEEGRIVRERTKALKDSTSKALDKDGSSARALSELASTLKTTASN

SEQ ID NO: 5686 - protein, 477 aa, Oryza sativa
MAAARRVVLFPSLGVGHLAPMLELAAVCIRHGLAVTVAVPDPATTAPAFSAALRKYASRLPSLSVHPLPPPPHPPASSGADAAAHPLLRMLAVLRAHAPALGDLLRGPHAARALVADMFSVYALDVAAELGVPGYLLFCTGATNLAVFLRLPRFCAGSSGSLRELGDAPVSFPGVRPLPASHLPEEVLDRGTDISAAMLDAFDRMADARGILVNTFDALEGPGVAALRDGRCLSNRATPPVYCVGPLITDGGAEEERHPCLAWLDAQPERSVVFLCFGSRGALSPEQVSEMATGLERSEQRFLWALRAPAGTKPDAAMSLLPDGFLARTADRGVVVTASWVPQVAVLQHASTGAFVTHCGWNSTLEAVAAGVPMVCWPLDAEQWMNKVFIVEEMKIGIEVRGYKPGALVQADIVDAILRRIMESDAQQGVLERVMAMKESAAAAWKEGGSSCTAFAEFLKDMEEGNVAMAHSNQVET

SEQ ID NO: 5687 - protein, 210 aa, Arabis alpina
MRLNLWEEEEEEAIQCLDWLDSKTKNTVVYVNFGSLTMLTKEQLIEFAYGLAGSGKEFLWVMRSGTVDSILPADFRSETANRAMLINGWCSQEKILSHPSIGGFLTHCGWNSILESLFVGVPMICWPFFADQITNRKFCCDEWRIGIEIGDEVKRERVEAVVKEVIDGEKGKRIRETVVKWRSMAEEASESPSGSSYLNFETVVNKVLMV

SEQ ID NO: 5688 - protein, 493 aa, Vigna angularis
MSSKVSPTKPTKMEKDTIVMYPAPGIGHIVAMVELAKLIQTHRFNITIILTTGLLDHPAIEVYIRRITAAHPSISFLRLPHIPLSASTSVSLAARAFGFIKANASSVATSLSQISQTSAVKAFVIDLFCTSTMESASSMGIPVYYFFTSGSAVLALFSYFPKLHEQRSESFKDMIGVELRVPGNAPLTAVNMPEPLLDRGDPAYWDMLYFCSSLPKARGIIVNSFPELEPLAVNAVAEGACFPNAESGPHVYYIGPLIAEAQQSDAKGSKGSDSKECLRWLEEQPSRSVVYLCFGSRGSFSVSQLKEIAKGLEKSGKRFLWVVKRPLEEEGAKQNKEAAKPGDAFDLASVLPDGFLERTKDRGMVVEAWAPQVEVLSHESVGGFVSHCGWNSVLEGVVAGVPMVAWPLYAEQHVNREVMVGEMKVAVGVNQRVEDGFVSAEEIEKRVREVMETKEIRERSFKLKQMAMAAVAQFGSSTTALANLLHSWTSFAS

SEQ ID NO: 5689 - protein, 466 aa, Sorghum bicolor
MAGSNNVSVRVLLVSYPAQGHINPLFQLGKRLAIHHGVRCTLAVARSALGSSVPPGPGAVPVVAISDGCDLGGYDEVGDVHEYLARLQSAGSRTLDELLGSESSHGRPVRVVVYDAFLLWVPRVARQHGASCAAFFTQACSVNVVYDHAWRGDVKLPVDKVLAELPGLPKGLQLEPRDCSSFLTQQDDSSSTSTYLDLLLQQCQGLEVADHVLINSFYELQTEEAEYMASRWAAKTIGPTLPSAYLDNRMPDDSSYSFSLHAPMATECKAWLAKRPARSVVYVSFGSIAAPGPDQLAEMAQGLYNSGKAFLWVVRGPETSKLPKSFVSKVKENEERGLIVAWCPQLEVLAHPAVGCFVTHCGWNSTMEGLGIGVPMVAMPQWSDQPMNAKYIEDVWRVGVRARPDMEGVIRKDEVERCVRQVMDGEKSKEYMENAMNWREKAKRAMSEGGSSDRNIIEFLGKFGWN

SEQ ID NO: 5690 - protein, 492 aa, Sorghum bicolor
MGSNAPPPPTPHVVLVPFPGQGHVAPLMQLARLLHARGARVTFVYTQYNYRRLLRAKGEAAVRPPATSSARFRIEVIDDGLSLSVPQNDVGGLVDSLRKNCLHPFRALLRRLGQEVEGQDAPPVTCVVGDVVMTFAAAAAREAGIPEVQFFTASACGLLGYLHYGELVERGLVPFRDASLLADDDYLDTPLEWVPGMSHMRLRDMPTFCRTTDPDDVMVSATLQQMESAAGSKALILNTLYELEKDVVDALAAFFPPIYTVGPLAEVIASSDSASAGLAAMDISIWQEDTRCLSWLDGKPAGSVVYVNFGSMAVMTAAQAREFALGLASCGSPFLWVKRPDVVEGEEVLLPEALLDEVARGRGLVVPWCPQAAVLKHAAVGLFVSHCGWNSLLEATAAGQPVLAWPCHGEQTTNCRQLCEVWGNGAQLPREVESGAVARLVREMMVGDLGKEKRAKAAEWKAAAEAAARKGGASWRNVERVVNDLLLVGGKQ

SEQ ID NO: 5691 - protein, 469 aa, Unknown
  Description of Unknown: Oryza sativa Japonica Group sequence
MAPPTATPHVLLVPFPAQGHALPLYDLAALLAARGLRLTVVTTPGNAAQLAPLLAAHPDSVRPLVLPFPSHPSLPAGLENTMNCPPVYIAVFIHALAALHRPILAWARSQPAHPVVAVVSDFFCGWMQPLAAEIGVPRVVFTPSGVLGTAVPHSLFRRLVKRPVGCDDGFPVAFPAIPGEPAFEWREISMLYKAYIEGLVEEQVGESLKQNCLWNLEGWGFVSNTFRALEGRYLDAPLEDLGFKRVWAVGPVAPDTDAAGERGGEAAVAAGDLSAWLDAFPEGSVVYVCFGSQAVLTPAMAAALAEALERSAVPFVWVVSGDGVVPEGFEARAAAAARGMVVRGWAPQVAALRHAAVGWFMTHCGWNSVLEAVAAGVPMLAWPMAADQFVNARLLVEDAGVALRACAGGAGVAPDAGELAAVLADAVGEKGSGARARAKELAADAAIAVRSGGSSYEDLERFVQEIQKL

SEQ ID NO: 5692 - protein, 213 aa, Cephalotus follicularis
EPSGSRSELFDWLDKQPSESVLYVSFGSGGTLSHEQTIELAWGLELSKQRFIWVARQPTKTTGDGCFFTVGNGGDDLSNYLPEGFLIRTHNLGLVVQEWAPQIDILSHPSIGGFLSHCGWNSTLESITNGVPMIAWPLYAEQRMNATLVTEELGIAVRSKTLASKGIVGREEIKTMVRSIMVDEEGHAIKAKVKELKHDAEKALNEDGSSYGA

SEQ ID NO: 5693 - protein, 295 aa, Medicago truncatula
MKDIRIKDLPSFVRVTDLSDILFNFVVSETQNCLRSSTIIINTFEELEGETLDTLRANNPNIYSIGPIHMLGRHFPEKEKGFKASGSSLWKSDPECIKWLSKWEPCSVLYINYGSITVMTNHHLKEFAWGIANSKLPFLWILRPDVAMGEETSTLPQEFLDEVKDKGYITSWCSQDEVLAHPSVGGFLTHCGWNSTLETISYGVPTICWPFFAEQQTNCRYLCKSWKIGMEINHDVKRDDITEIVMEMMKREKGKEMRHKCLEWKKKAAYTTDLGGYSYNNFHKLIRDVLHQNAI

SEQ ID NO: 5694 - protein, 370 aa, Ricinus communis
MAQGHMIPMIDIAKLLAKRGVIITIVTTPVNAARFKKTLARAQESDLSIRIIQLQFPCEESGLPKGCENIDLLPSSDIPKFMNFFTAANMLQEQVEILFQELMPRPSCIISDLCLPYTSHVACFFCAFVLSVSIMMLLKALIPLIQRAADLASFGVVINSFEELEPEYVEEYKKVRGGKVSCVGPVSLCNKDILDKAQRGNDASIAEHECLKWLDSQEPGSVVYVCLGSLCNVPPSQLVELGLGLEESEKPFLWVIRRNEKSKEIEKWILETGFEERIKGRGVGFLIHGFAPQVLKAGVSVGVERPMEWGEEEKIGILVKKEDVKKAVDMLMDEGEEGQARRERAKEIGNMAKRAVEEGGSSYRLYYNAN

SEQ ID NO: 5695 - protein, 458 aa, Cajanus cajan
MEKKSKANSVHCVVLAYPAQGHTNPMLQFSKLLQQEGVRVTFVSTLFYCNNLQKLPTGISHETISDGFDGGRIGEAKSFRVYLDRFWKIGPKTLVELLEKLMRSGYPVDCLIYDSFMPWALEVAKRFGIVGVPFLTQNLAVNSIYYHVHLGKLQVPLTNQEISLPALPQLQLGDMPSFFFNYLQDPAFLDFLVAQFSNIDKADWILCNSFYELEKEVADWTMKIWPKFRTIGPSIPFINLENQTQDGEDYGIAQFTSEECMKWLDDKPREFVVYVSFGSMAELSEEQIEELAYGLRDSGSYFLWVVRASEETKLPKGFEKNSEKGLVVTWCSQLKVLGHEAIGCFVTHCGWNSTLEALSLGVPMVAMPQEADQSTNAKHVEDVWKVGIKALVDGKHVVRREVLKHCVREVLESEGGKEMKRNAMHWRTLAANAVGNGGSSHANINEFVNSVQSECTQC

SEQ ID NO: 5696 - protein, 479 aa, Unknown
  Description of Unknown: Oryza sativa Japonica Group sequence
MERTVVLYPGLGVGHLVPMVELAKVFLRHGLAVTVAAVKPPLDSPDFSAAVARFAECNPAINFHVLPPPPPPPAPVGSGSDGKSASPIVGMLGFLNAMNAPLRDFLCSLPSVDALIVDMFCTDALDVASELRLPVYVFFTSAASDLAVFLHLTSMRDSINTSFGELGDSMIHIPGCPPFKASELPSDILSDNEASRLILLMFRRHPESRGILVNTFESLETRALRALEDGLCVPGRATPTVYSIGPIVSGGGGSDKDHDCLRWLDAQPDNSVVFLSFGSLGRFCKKQLEEIAIGLQKSEKRFLWVVRSPRIDEKNVFEPLAEPDLDALLPAGFMEATRGRGLVVKLWAPQVEVLRHRATGAFVTHCGWNSTLEGITAGLPLLCWPLYAEQRLNKVFVVEEMKLGVEMRGYDEEVVVAEEVEAKVRWVMESEGGQALRQRAAAVKDAAAQAIKEGGSSHAAFFKFLEDLPLQVSRGMVSA

SEQ ID NO: 5697 - protein, 469 aa, Vigna angularis
MGLIPSDGTRSHVLLFPFMSKGHTIPLLHFAQLLLRRSISVTVVTTPANHPFITEFLEGTTASVVTLSFPTVTNIPVGVESTDKLPSISLFYEFATATSAIQPQFEQLLQTLPPVNFMVTDGFLWWTLDSATMFGIPRFVYYGMNCYSSSVSIEAMTKGILNGSQPDNELVALTQFPWIRVCKEDFDPSFRNPNPNNVAHKFNMNSISSTHRSHGMLVNSFYELESTFVDYLKAGSSPKGWCVGPLCLAEWTPKVYPDEGLKPRWVTWLDQKLEEKRHVLYVAFGSQAEISVEQLGEIALGLEESEVSFLWVMRKEEWGVPDGFEERVKGRGMVVREWVDQREILMHGSVEGFVSHCGWNSVLESVCAGVPILAWPMMAEQYLNARMVEEEVKVGLRVETCDGSVRGFVKREGLKKTVMEMMEGDKGRKARQKVRELAEKAKFATQEGGSSWSTLESLLTEGCDSRDKE

SEQ ID NO: 5698 - protein, 492 aa, Beta vulgaris
MSSSTASLTVTADAELVFVPAPGMGHLKSAVELAKLIIQRNHRISIVILIINIPTTTSLINDFVHSQSRNNPYPTHLTFMTLPPLSNPPERSSPDFMRILIELHEPLVKQAVEERIRAGSSKLAGFVLDMFCTNMIDIATNLNVPAYIFFTSGANMLSLMFHFQSMNDEGVFDLTKDHISPNAEFDVPGFVNRVPEKVLPAVLIDKESGVPMLLNLVRGLRRSKGILVNSFTELETSGVQALLDQATEGGSIPAIYPVGPILELDSGSQGEDHVSILQWLDKQPSSSVVFLCFGSMGSFDANEVKEIANGLEKSGHRFLWSLRKPPSAGTTQPSQDQTFVEALPEGFVDRTAKIGKIISWAPQVSILSHPSVGGFVSHCGWNSTLESMWFGVPVATWPLHAEQQLNAFELIKELGLAVEIRMDYRHDWKTRKANFVVTAEEVENGVQKLMSLDEETKKRVRQMRDEGRKALEDGGSSHMSLARFIQDVLTFE

SEQ ID NO: 5699 - protein, 475 aa, Fragaria vesca
MVQHRFIMIAFPAQGHINPALQLAKCLIRTTGAHVTFVTAVSALRRMANGSTTPSGLTFSPFSDGYDDGVKPEDDKQHVLNELKHGSSQAIVGLVHSGANEGRPYTCIVYTLLLSWVAEVATELHLPTALAWIQPATVFDIYYYYFNGYKDLIKNNTGADNNDPSFALELPGLPLLFKSRDLPSFILASSPIIHRLVIQMFEDQFEDLGKLSKPIILVNTFDALEPGALKAIDKYNLIGVGPLMPSAFLDDKNSSDKSFGCDIFQKAKESSYMEWLNSKPEQSVVYVSFGSISVLSKNQMEELAKGLLDCGRPFLWVIRENQKKGEGKEEKEEEEELSCRAELEELGMIVPWCSQVEVLSNPSLGCFVTHCGWNSTLESLVCGVPVVAFPQWSDQGTNAKLIEDSWKTGVRVERNEEGVVVGEEIKRCLDLVMESDKMRRNAKKWKDLAREAVSEGGSSHKNLKAFLEEIEERLR

SEQ ID NO: 5700 - protein, 493 aa, Siraitia grosvenorii
MKKFELVFIPLPVMGHLAAMVEMANILVTRDQRLTVTILVIKLPLYGKTAEYIQSLSASFASESMRFIILPEVLLPEESEKEFMLKAFLESYKPIIREAIIDLTDSQMGPDSPRLAGFVLDMFCTTMIDVANEFGVPSYVFCTSNAGFLALSFHLQELYDENNSKEVVKQLQNSNAEIALPSFVNPIPGKMIPDIFSNDDTASWFHDQVERYRSGVKGILINTFAKLESHVMNSMSRSSSSRAPPLYSIGPILHLKNNNTVGPGGTLHCTDILKWLDNQPPVSVVFLCFGSMGSFDEDQVKEIAHALERSGVRFLWSLRQPPPKDKFEAPSEYTDIKYVLPEGFLERTAGIGRVIGWAPQVEILAHPATGGFVSHCGWNSTLESMWHGVPMATWPLYAEQQFTAFEMVVELGLAVDITLDYQKHPHGERSRVVSAEEIQSGIRKLMEEGGEMRKKVKAKSEESRKSLMEGGSSFISLGRFIDDVLGNGPEGGE

SEQ ID NO: 5701 - protein, 488 aa, Medicago truncatula
MYRTILVSLAQLIAQMVIEALEALTPNTITDRGLIASWCPQEKLLNHHSIGGFLTHCGWNSTTKNICAGVPMLCWPFFSDQPTNCRLICNELEIGVEIDRNVNRENVENLVNEIMVGEKGNKMRRKATELKKKAEEDTVPGGCSYMNLDKYYRYSLNAKLNRSGVENPWFFFSGSYSGALSAWFRLKFPHLTCECLASSAVVLAVQDFGEFDQQIGESAGPEYDLEIDGDFLYYLAAAAVIAFQYVKEYYIGTFGIAAKIYDQEYLKKTAIIEDTLLMGADYYETDADRGFLAAKGSVPIGIGKNSHIKRAIIDTNARINFLLIQSPPPLPKKPPDRHVSTVINSSSSMMQTGYEQKLKDLTTELADYKFKMEMLMDEHEKLSELVEDYKSRELKFKSTINSLESKLTDNEYERQQYMDESRNLNVQLQHACEFENEIMALKSELNTANTKKERLKASLCLKSDLNYVMIRRPKKQFILLKSLFVSKW

SEQ ID NO: 5702 - protein, 472 aa, Carica papaya
MEKKNQMKGATELTHLRVLVLPFPIQGHINPMLQFAKRLLSKGLTVTLLTPTSSAHNLIKPNPNSTSKSLHIQPIDDSFPPGTKPGVTAEYFNQFRAGITKSLTDLIRHDISATTTTTTTTTKPLPKFLVYDCFMTWALDVARESGIDAAPFFTQSCAVNAVYNDFKEAEVKGGDEGVSLPWKGLLSWNDLPSLVHETTVYGVLREFLMDQYYNVGEAKCVLANSFDELENQVMNWMPSQWRIKNIGPTVPSMFLDKRLEDDKDYGLTLFKPQAVTCLTWLDSKQPSSVIYVSFGSLASLSGEQMTELARGLQMSCDHFLWVVRDLEKLKLPESFKEETSDKGLVVSWSPQLEVLAHKSMGCFMTHCGWNSTLEALSLGVPMVAMPQWTDQPTNAKFITDVWQVGIRVEVNEEGIVTREEISKCINEIMEGEKGKDIKKNSEKWRDLAIAAMNEGGSSDKNIGEFIALLASN

SEQ ID NO: 5703 - protein, 536 aa, Caenorhabditis remanei
MEVKNLFILFYLFLFSFNNVSGYNFLVISPVYGFSHMKCMAAIANQLADAGHQVTYFQPFVVELFQNHDLIKNPNIKVIDFWHDEEGRKNLPSDGVLSDAWTSVKYQSDIGVKIFAPRVLHSAFQHMCRRMFEDKELHKMLKEQKFDVVLSETFDFCGLYLADYLEMPAIISVFTGSKLSAITDALGEPSFLHYYPSPSSNFGPKISLYDRMNNLWYKLLSTSAFGELFDRQYSDISKIMNGTVRHWKPILGDVTYHFANSNPYLDFVVPTIPKVVPIGGYTMDYKQVPPVSKELDTILNLRPYNVFISYGTMVASKYMPDDYKHAMINLFKHNQNVTFLWKYENAEKKYIKENIPENVHLSKWFPQQSLLADKRVNLFITHGGLGSTMELAYAAKTGIVTPLFAEQPSNAQMLARHGSVEVYSKHDIPNWKKQSDLLRKMLIDEKYQIAANRLAEILNHQPINPKDLVLKHAENAARFGKMPSLTPFAKDMGFLEFYNLDIIVYCISFALFAIYGAIETFLFVKKCFVTRRVKTE

SEQ ID NO: 5704 - protein, 206 aa, Rhodamnia argentea
MAADPGLDEGSNWIKFVAILDGLETDERKDSTKQLESMSRFYELTHGLEQLALPFLWVVHPNLTKGPVTEFHDRFLQRVRNYGKVVQWAPQEEVLAHPLVACFFPHCGWNSTMDGLGNGVPLLCKPFSANQHLNRSFICDVWRVGLGVGGGENGLITGHEVRDKVLALLGSEEIRANCLRVKEMARKSVSEGESSLKNLQSLIEPM

SEQ ID NO: 5705 - protein, 451 aa, Salvia splendens
MLKLAEMLSLAGIRVTFINSHHVHRRLPDSAYFSKYPNFRFETLPDGLPDDNPRTGDQILDLLQAMEAASQPVFREILSSGSPAATCLIAEGVFVWAASVAADVGVPLLYFDTISPCGLWGLLSLPNLIQSGEFPFTDEELDEVVAGTDGVMRRRDLPSFCRIKDVNDPIIQLVIEEANHIPLAQGLIFNTFHHLEAPILSQMLTISPNIYAVGPLHAHLKSRLAGGEPSIASDSIWEEDKSCISWLDKQPSKSVIYVSIGSLAVMTRDQLYEIWHGLVDSGSRFLWARRPGSVSVPRPGPEHDDDDVVVPLDLSQGTKARGCLVGWAPQEEVLAHPSVGGFLTHSGWNSTLESVVAGQPMICWPFHADQQVNSRYVEEVWRLGLDMKDSCDRVVVAEMVREVMGSRKDEFSERASEMAKFAKMSVNPGGSSFLDFDRLIEDIKTMKILSI

SEQ ID NO: 5706 - protein, 443 aa, Zea mays
MFQLAGLLHLRGFSVTVFHTDFNAPNKSRHPAYDFVPVPVRGCLPKGSSDALQVTVERILAVNRACEAPFRERLAALLAREDVACLVADAHLLTLLDVARGLGVPTLVLRTGSAACLRMFAAFPALCDKGTHVIHALTLLFVFQSDVESQLETPVTELPPYRVRDLPSTTSACHGVISEVISRLVTAVTTSSGLILNTMDALECGELASLRRDFGVPVFDIGPLHMLSPAASSSLLLQDRGCLEWLDAQAPASVLYVSFGSLASMSAAELVETAWGIANSGYTFLWVLRPGLVRGSQTSEAAPPLPDGFDAATRGRGMVVSWAPQEEVLAHPAVGAFWTHCGWNSTLESLCAGVPVIARPCFGDQMGNARYVDHVWRTGLTLDGVLERGEVEAAVAALMAPGEPGDGLRRRARELKSSAAECMAKDGSSCTNVDKLVDHILTL

SEQ ID NO: 5707 - protein, 361 aa, Genlisea aurea
VLFFPWLAHGHLSPFYELAKRLSEKNFKTYVCSTPINLMSIQASPDSAIELVELHMPPSPELPPEFHTSRNAPPNLGQTLMHEFQLCKSNFLDILKSIKPDLLIYDFLQPWSAKQASSMGIPSVFFATSSTACYSYYHHLYSNGFAKKYPFEDLYVHHHEKIVVRGYGNIIEDVGDGFLFGSFNLSTEIVLVKTYGKFEAKYVSHLSALSNKKLVVTGPLIAESVDLDGIEKSNEIMNWLNDQRKFSVVYISFGSEYFPSKEQIYEISKALELSRVKFLWVIRFDAGKKETSLKDVLPKGFMDRSKDDGMIVTEWAPQKKILSHPSIGAFISHCGWSSVMESLYFGVPIIAMPIHIDQPIN

SEQ ID NO: 5708 - protein, 471 aa, Medicago truncatula
MAKTIHIAVIPSPGFSHLVPIVEFTKRLVTNHPNFHVTCIIPSLGSPPDSSKSYLETIPPNINSIFLPPINKQDLPQGVHPGVLIQLTVTHSLPSIHQALESLTSKTPLVAIIADTFAFEALDFAKEFNSLSYLYFPCSSFVLSLLLHLPKLDEEFSCEYKDLQEPIKLQGCVPINGIDLPAATKDRSNEGYKMYIQRAKSMYFVDGILINSFIELESSAIKALELKGYGKIDFFPVGPITQTGLSNNDVGDELECLKWLKNQPQNSVLYVSFGSGGTLSQTQINELAFGLELSGQRFIWVLRAPSDSVSAAYLEATNEDPLKFLPKGFLERTKEKGLILPSWAPQVQILKEKSVGGFLSHCGWNSVLESMQEGVPIVAWPLFAEQAMNAVMLSNDLKVAIRLKFEDDEIVEKDKIANVIKCLMEGEEGKAMRDRMKSLRDYATKALNVKDGSSIQTLSHLASQMEMIGGI

SEQ ID NO: 5709 - protein, 450 aa, Medicago truncatula
MNFSGEDVCHIVAMPFPGRGHINPMLSLSKFLISRKPNNILITFVVTEEWLGFIGSDPKPKSVRYATIPNVVPPEREKTIDSFPQFYEAAITKMEAPFEQLLDQLELPVNVIVGDVELRWPVDVGNRRNIPVASLWTMSASFYSMLHHLEVFSRHQHLTHDKLENIPEISSVHMEDLRTVVRRNDQPTMQLALECISEVNKANYLLLTTVQELEAETIDTLKSIFPFPIYPIGPAVPYLELEEKISTNSNHSHDYIKWLDSQPAESVLYISFGSFNSASSAQTDEIIEALKNSEIRYLYVACGETSRLKDKCGGKGMVIPWCDQLKVLSHASIGGFWSHCGWNSTLEAVFSGVPILTFPLAYDQFPNSTQIVDEWKNGWKVEKSSKLESDVFFAKEDMEELVKRFMDLESQEGKKIRDRARELRIMCGKAICKGGSSDRNLDAFISDISS

SEQ ID NO: 5710 - protein, 519 aa, Bicyclus anynana
MHFILQLVFIIITMLFGTINAYKLLVMSPLPFKSHSILGEAMVEHLTNAGHEVTYVTVFLPEKPIPRVNVVDLSDNIKLIPPGGISIQAVMDNKHEGMSFFESVPLIMNLSRNTIAHPNVQKLINDKNQQFDAVIAEWMFNEVYSGFSGIFNCPLIWFSTVEPHWMVLRLVDEVTNPAYSVDVASNSVPPLTFVQRVEELGTQIVGRLTQALWVSGIENNLYDEYFVPVIEKRHSTAPSFETLRFNASLLLSNSHVSMGVPAVLPANVIPIGGYHIKPNVKQLPEDLQKLMDNAKHGVIYFSMGSNLKSKQFPEVIKLDLLKMFGKLKQTVIWKFEEDLPNRPSNVHIVQWAPQQSILAHKNCILFITHGGLLSTTETMHFGVPIIGIPVFADQFVNVARAVKKGYAQKVDLSYSMAADIELAINKLLDNPSYKTRVKELSQIYHDRPVPPARELVHWVEHVVKTRGATHLRSPASMVAWYQKLYLDLVLVLVVLVLVLKRVYIFIKSIFIAKRKVKTN

SEQ ID NO: 5711 - protein, 484 aa, Linum usitatissimum
  MOD_RES (106)..(106): Any amino acid
  MOD_RES (151)..(151): Any amino acid
MEDVVAAASPEPNLRVVMVPSPGHGHLIPFVELSKRLLLRHNFSTTIIVPDNGSGMIPQRQLLQTLPPTVSPLYLPPVSLSDVPSDANVITRVTLTMIRSFPAIRXAIINLQHSGEGLCGRVVAVVVDFLGADALQVATQLQIPPYVFYTXSAFHLTLGLNAPQLLHPTHQEDSTKLLKLPGCIPLLGADLPEPYIDKKKDAYKWMVHSHERISSDAVGIIINSFVDLESDIFKALTEERFRTGSGPTVYPIGPLKRLDSDEDLNQFSNESIDCLEWLDKQPESSVLLISFGSGIGARQSKAQFDELAHGLAMSGKRFIWVVKPPGNDVVPWNSSFLPEGFLKKTKGVGLVIPDWVPQIRILSHGSTGGFMSHCGWNSSLESITNGVPVLAWPQHADQKMNAALLVEDAKVALRVDQSSGEDGIVGREEIARYVKAVLDGDEAKLLRKKMRELKVAANNATGNDGSSTKSLDEVANLWKNQNPY

SEQ ID NO: 5712 - protein, 497 aa, Crocus sativus
MEQHQPNILVVTYPAQGHINPALHLAKHLAADTKGLLITFSTAISAHRKMFPESTEPDQEVEDGPITYIPFSDGYDDGFQRDKHDGKQFRSRFKTVGSNTLSAIIQNLEHRGRKVSCVIYTFFVSWAADVARQHAIPSVQYWIQPATVFAIYYHYFHGYESVVAAHSHDPSYPINLPGLSPVQVRDLPSFLTIKPDDPYAVVLSMIRDSFEGLDREETKTKVLVNTFGQLEADAILAVDKMDIIPVGPILPCKGGVSRGDLLKEDEKGYMEWLDSKPENSVVYVSLESLAVLKKQQKFLILKGLKDSGRPYLWVVRRDSGLEGVELGDWDGDGDGDNGMVVGWCSQVSVLSHPSVGCFVTHCGWNSTMESLASGVPTIGVPQWSDQPTCAALAEKDWGIGVRSEVNGDGILEGGELKRCLDLVLGDGERGVEIRRKVEFWKDKATEAISFGGSSDKNLRTFVDQITGYDPNVSSVGFWKDKAIHRQHCEESESASPS

SEQ ID NO: 5713 - protein, 471 aa, Nelumbo nucifera
MSHPHFLLVTFPAQGHINPSLQFAKRLIRIGAQVTFATSVSAHRRMSNACNPDGLTFAPFSDGYDDGFKLTDSVEHFLSELKRRGSETLRELILSLAREGRPVSCLVHTLLLPWAADVARNLDVPWALLWIQPATVFDIYYYNFTGYGDLICNNKNDNSYTVELPGLPPLTSRDLPSFLLPSNTYAFALPIFHEQIETLERETKPRVLVNTFDALEPEALRVVEKIDLIGVGPLIPSAFLDGKDPSDKSFGGDLFHGSADYMEWLNSKADSSVVYVSFGSIALLPKRQMEELASALIESGRPFLWVIRKNENASEETKKEEEAFLSRIEEQKREGMIVPWCSQVEVLSHPSVGCFLSHCGWNSTLESLVTGVRVVAFPQWTDQATNAMLIEGVCGTGVRVRAKEGEGDGVVEREEIMRCLDMVMEGENGEEMKRNARKWKELAKKAVKEDGSSDKNLRRFVEEIRKDCWIV

SEQ ID NO: 5714 - protein, 479 aa, Cicer arietinum
MGSEAPMKILLVSYPAQGHINPLLRLAKSLAAKGSSVIFTTTEQAGKSMLTVKNITNKTVTPIGDGSLTFELFHDGLSDDDPIKINLGAYSDQLELVGKQFVSQIIKNHAESNKPISCLINNPFLPWVCDVAAEHEIPSALLWIQSSAVLAAYYNYSNKLVRFPTETEPYIDVQLSSVVLKYNEIPDFLHPFSSYPFLRALILEQIKNLSKVLYILVDSYEELEHEFIDYLSKKSIFIKPVGPLFNNPKAKDASNIPSDFVKSNDCDTIEWLNSKSPDSVVYISFGTIVYLPQEQVDEIAYGLLSSKVSFLWVLKQPLKELGLKPHVLPDGFLEETNGRGKVVNWSPQVEVLAHPSVACFITHCGWNSSLEALTLGVPMLTFPAWGDQVTNAKFLVDVFGVGIRLGYGMAANKLVTRDEVKKCLLEATSGEKAEELKQNAIKWKKAAEEAVAVGGSSDRNLDAFLKDIKKRGAFNIQKI

SEQ ID NO: 5715 - protein, 324 aa, Helianthus annuus
MVCTPKIRSLFPLDRIAKCLLLTTTYELEADAIDEIVNNTFIPVYVLGPNIPYFRIRTSFPSSKSSYYSWLESKPPRSVLYVSLGSLVRVENNQIAEILAGLKQSGVAFMWAAGGEALRLSGDYGSDGLVVERCDRLRVLSHSSVGGFISHCGWNSTKESLFSGVPLLTFPTRGDQAFNGKRVCEDWKVGRRLKTCNAFVSRDVVKDVVREFMGLEGDLRACLMEHVKRVEGICRESVVEGGQVEKEIDSFMRDSETNWLMSSSNLGLTGSCGETFRILIQFDNKSVYTIYISILKTNIELQYLLLTSLEVLLHPRTHQLISKI

SEQ ID NO: 5716 - protein, 419 aa, Trifolium pratense
MMKKAEVVIIPSPGVGHLVSTLEFAKLLINRNNHLRITILVIKLPHTTETDIYTKSLSNSNSLNIINLPECSLPTNSNLGSAMNAILEAQKQNVKQAVADLITEREDGVLAAFVVDLLTCSALTLLMLLENSPSLRLCSSLPLIQLTELAIPSFANSVPTKSLPSSVLHKEYESFFMNYAKGIKNADGIIVNSFEELESYAIHSFFSHPGLAGLPVYPVGPILNPEPTTKGVVDSDDIIQWLNDQPHSSVVFICFRSRGYMDEEQVNEIALAIENSGAHFVWSLRKPPPKGTMVEPSDYTLSDLGSVLPVGFLDRTAKTGRVIGWAPQAQILAHQATGGFVSHCGWNSILESIYFGVPVATWPLFADQQTNAFQLVGELKMAVEIALDYSVHLNGERDYLLTADKIERGIRNVLEKDGE

SEQ ID NO: 5717 - protein, 481 aa, Gardenia jasminoides
MGSISLPEKHHAVCIPYPAQGHINPMLKLAKILHHKGFHITFVNTEFNHKRLLKSRGPDALNGLPDFQFKTIPDGLPPSDVDATQDIPSLCESTTTRCLDPFRNLLAELNGPSSSQVPPVSCIVSDGVMSFTLEAAAELGVPEILFWTTSACGFLGYMHYAKLIEKGLTPLKDASYLSNGYLEQSLDWIPGMKDIRLKDLPSFLRTTNPDDYMVKFVLQETERAKKASAIILNTFQELEDDVINALSAILPPIYTIGPLQFLQKEVKDERLSVLGSNLWKEEPECLDWLDSKDPNSVVYVNFGSITVMTPGQLVEFAWGLANSKQTFLWIIRPDLVSGDSAILPPEFLEETKDRGLLASWCPQEQVLSHPAIGGFLTHSGWNSTLESICSGVPMICWPFFAEQQTNCWFCCTKWYNGLEIDNNVKRDEVESLVTELMVGEKGMDMKKKALEWKNKAEEAAKSSGGSSYSNLEKVVQVLLSK

SEQ ID NO: 5718 - protein, 478 aa, Vigna angularis
MGSSIEQHSLHIFFFPFLAYGHIIPTVDMAKLFAEKGVKATIITTPGNAPFISKAIGKAKTENEIQIQTINFSSAEVGLPDGLEITDSITNPYLIESFFIATSLLQEPLEQLLHKQRPNCVVADMFFPWATDSAAKFGIPRLVFHGTSLFSLCATTCMQLIDPNNDVSSDSESLTIPNLPGEIKIARTSLGSYGMGDRTSMIKLLREANESELRSHGVVVNTFYALEKDYADLYSKVLGRKAWHIGPLSLCNRDVEEKAHRGKEASVHEYECLKWLDTKKPNSVVYVCFGSTTLLSDSRLREIAIGLEASGQPFIWVVRKSKEDEVEWLPDGFERRMEGKGIIIRGWAPQVLILEHKATGAFVTHCGWNSTLESVTAGVPMITWPIYADQFFNEKLVTEVLKIGVPVGAKKWNGLEGDSVSWDAVEKAVKSIMTGEAAIVMRNSAKNLSKQARLAMEEGGSSDSDLIALIEELSSMTF

SEQ ID NO: 5719 - protein, 284 aa, Ricinus communis
MLDVLDLNNQMCVEYIRMGVEIQTADGILVNTWHDLEPKTLFALGDEMKLGWVSQVPVYPVGPLVRPANATLRSKVFDWLDMLSEKSVIYVSFGSGGTLSAKQTMEMVGDWTATVFKTGHRSDDTPDFLPDGFLTRTKRMGMVVPTWAPQTEILNHPAVGGFLSHSGWNSTLESIVSGLPMIAWPLYAEQRINAAMLTEDNGVAVQSKAKPLREVVSRDEIETMIREIMELKGGARRARLETLKLSAEKALRNGGLSHNSLAQVANDCKIKVLRNRTHEHDHLL

SEQ ID NO: 5720 - protein, 527 aa, Cephus cinctus
MKFQYFLMLIGITFLSECPSGDAYRILGLFPLHGKSHFIMCNYLMKTLAARGHQVDVVSHFPLEKPVANYTDINISGSLPQIVNNLPFDVIQQFSSIDLTYLTNIAGLDICRLMDHPEIQKIIRNPPQDPPYDLVIHEMFAAECYLAFGHHLKVPVVGIITSVLFPWLNEPMGNPSNPAFVPSPFSDFQLPMTFWQRVKNVFMENMMTYSFRKNTEIQNEIVKKHFGPDAPTVRELERNISLILVNSHFSFNNPRPLTPAVVEVGGLHLQGDDGLEFSPDLKKWLDEADDGFIFFSLGSMARFETFPREIIEVFYEAFRKVAPVRILMKIAKKEDLPAGVPENTMILPWLPQTKVLKHKNIKAFISHGGLGSVQESLYYGVPLIGMPLFGDQIINIDHCARKKLAVPIDYATVDQKILTEAISTILHDPTYRDNMKKVSKLFQDRPTNPLDLAVYWVEYVIRNGNVLRSPALDLEWWQVALIDVYAFFFSCVAVVVFLIAMILRLLYGKLLAPRSTAGNRDQGKKRQ

SEQ ID NO: 5721 - protein, 485 aa, Medicago truncatula
MSNFAERIKPHAVITPYPLQGHINPLLKLAKLLHLRGFHITFVNTEYNHKRLLKSRGPKAFDGFTDFTFETIPDGLTPIEGDGDVSQDIISLSDSIRKNFYHPFCELLARLKDSSNDGHIPPVSCLVSDIGLTFTIQAAEEHGLPSVLFSSASACSLLSALHFRTLIDKGVIPLKDESYLTNGYLDTKVDWIPGLGNFRLKDLPDFIRTTDPNDIMIKFIIEAADRVHEANSIVFNTSDELENDVINALSIKIPSIYAIGPLTSFLNQSPQNNLASIGSNLWKEDMKCLEWLESKEQGSVVYVNFGSITVMTPDQLLEFAWGLANSKKPFLWIIRPDLVIGGSVILSSDFVNETSDRGVIASWCPQEKVLNHPSVGGFLTHCGWNSTMESICAGVPMLCWPFFAEQPTNCRYICNEWEIGAEIDTNVKREEVEKLINELMVGDKGKKMRQKAMELKKKAEEDTRPGGCSYVNLEKVIKEVLLKQN

SEQ ID NO: 5722 - protein, 483 aa, Ricinus communis
MGSEANVPHIFFFPFMAHGHMIPTVDMAKLFASRGLKTTIVTTPLNESFISKPIQRTKNLGLEINIKILKFPTVEAGLPEGCENLDFITSQNMDMEIVNKFLKAIALLQEPLEKLLSACRPDCLVADMFFPWATEASSKFRIPRLVFHGTSFFSLCATISVVLHEPHKKVASDSEPFIVPNLPGDIKLSGQQLPGFMREDGSYVAKFMEASIKSELTSFGVLANSFYELEPTYADHYKNVLGRRAWHIGPVSLCNRDMEDKARRGKEASIDEHECLKWLNSKKPNSVVYLCFGTIANFTASQLKEIAMALESSGQEFIWVVRKNKNPEEDNQDWLPEGFEERIEGKGLIIRGWAPQVMILDHEALGGFVTHCGWNSTLEGIAAGVPMVTWPVGAEQFYNEKLVTEVLKIGVSVGVQHWTVYGDSIKRECIEKAIIRIMEGAEAEEMRSKTKKLGKMAREAVEDGGSSFCDFNALIHELTFNYH

SEQ ID NO: 5723 - protein, 232 aa, Hordeum vulgare
MGANSSSRHQHELMCKLLSRAVEAVRSSAGFVFNPFDALEADDLAATRRDLAGVPVFAVGPLHKLSPASSSSLLQQDRSCLDWLDAQAPASVLYISFGSLASMSGAALAKVAWGVANSGRPFLWALRRGLARDAAVPDGFAAATGDRGLVVGWSPQEEVLAHGAVSGFWTQGVELGAGGRVRGRADALPAMLRRRDGQREARGARVSRGHRAGRRRALAGSGGGGHSTVDAG

SEQ ID NO: 5724 - protein, 465 aa, Polygala tenuifolia
MGMDASNLKRTHVVAMPFPGRGHINPMMNFCKLLTSRQPNNLLITFVVTEEWLGYIGSDPKPSNVRFATIPNVLPTERLKAVDFPGFYEAVMTKMEAPFEQLLDGLEPSVNVIIGDIELRWPIGLGNRRNIPVAAFWTMSATFLTMLYHYGIFLSDRHLPVDFLGHDDQTTQIPGISSMHLVDLKTVIHETDKRVMELALECILEVRKTQCLVFTSVQELEDQEFNSLKVLFPFPVYSIGPCIPYLELDEKIPKLLTGDDRLCHLQWLDSQPVGSVLYISLGSFLSVSPAQMDEILVALNSVGIRFFWIARGEATRLKEKCGERGLIVPWCDQLKVLSHCSIGGFWSHCGWNSTLEAVFAGVPMLTFPLFLDQVPNSRQIVQEWKNGVELKRDKGSKQILLGKKEISERVKGFMEAQTTQGKKMRENARGLRNMCQRAIAEGGSSYRNLDSLITSFSEGNCQFNV

SEQ ID NO: 5725 - protein, 561 aa, Frankliniella occidentalis
MQHASPARATARQNVVVLVAALLLPLLLMQCVSSAAPEVKTTAAAPAAGAVPARKPLRILALMTFDTMSHHIWMSALTVELAKRGHLVTSIDIHKHSENPPTLNTTVIETAFQFIDQEYMKLFMASTVPGQISMLQDMGEIDCKRDLASPTMQRLLDPAFKGAFDPIIIDYHADCMLGFVHRFNYPGVLAVSAFPVAPWVDDLMHNPQVPSILAHTLQPFPHPMNLWQRAWTLYLHAHQKFLVWWRRPVENSLIKRFFGDDAPSVEQLRQHVHVALVNENPVLEAPRPLLPSQIPVGGMHVKPADLGRIPAGLLKWMDDSKDGFIFVSFGSVMKGKSIDPVKKRALVNSFAALAPLRVLWKIEPDAVAAEPVTANVRVEAWAPQNDLFGHPNLRLFVSHCGGLSVQEASYHGVPVLGTPFVVDQFVNLEKVVGVGMGRRMPFKDITTERFVGEINEMLTNPRYLKAARHTRTLIHDQKETPLERAVWWAEYVGRHRGAPHLRSPARDLYWHQVMMLDIAALLALAVLAVLLVAFLVVKYTVYFVRKGSQQHKTPLKRAKKD

SEQ ID NO: 5726 - protein, 462 aa, Glycine max
MTMKDSIVLYSALGRGHLVSMVELGKLILSHHPSLSITILFLTPPPNQDTPTSPTAFTCDATAKYIAAVTAATPSIAFHRIPQISIPTVLHPHALNFELCRATGHHLRRILNSISQTSNLKAIVLDFMNYSAARVTNTLQIPTYFYYTSGASTLAVFLQQIIIHENNTKSIKELIIPGLPKIHTDDLPEQGKDQVFIDIATCMRDSYGVIVNTFDAIESRVIEAFNEGLMEGTTPPVFCIGPVVSAPCRGDDNGCLSWLDSQPSHSVVFLSFGSMGRFSRTQLREIAIGLEKSEQRFLWVVRSEFEEGDSAEPPSLDELLPEGFLERTKEKGLVVRDWAPQAAILSHDSVGGFVTHCGWNSVLEAVCEGVPMVAWPLYAEQKLNRVILVEEMKVGLAVKQNKDGLVSSTELGDRVMELMDSDRGKEIRQRIFKMKISATEAMSEGGSSVVTLNRLVDIWREH

SEQ ID NO: 5727 - protein, 214 aa, Moniliophthora perniciosa
MEKQFGGKSVVYISFGSLWYPPEVDTVYAILDELIVEKVPFLFASASPLAQVPDEVKQRVRDSGIGLSVSWAPQERVLGHPATGWFLTHGGWNSVQEALAYKIPLIFWPMGGDQCLNAVLLTLKYKAGFELVEVRTGESGKKRPYRCGPDGPFPRFTVESARDEFRGVLKSIREEEGEVVRANFTRIAEQVAKVWDDGGEAREQLETLLKIFVD

SEQ ID NO: 5728 - protein, 457 aa, Antirrhinum majus
MGEEYKKTHTIVFHTSEEHLNSSIALAKFITKHHSSISITIISTAPAESSEVAKIINNPSITYRGLTAVALPENLTSNINKNPVELFFEIPRLQNANLREALLDISRKSDIKALIIDFFCNAAFEVSTSMNIPTYFDVSGGAFLLCTFLHHPTLHQTVRGDIADLNDSVEMPGFPLIHSSDLPMSLFYRKTNVYKHFLDTSLNMRKSSGILVNTFVALEFRAKEALSNGLYGPTPPLYLLSHTIAEPHDTKVLVNQHECLSWLDLQPSKSVIFLCFGRRGAFSAQQLKEIAIGLEKSGCRFLWLARISPEMDLNALLPEGFLSRTKGVGFVTNTWVPQKEVLSHDAVGGFVTHCGWSSVLEALSFGVPMIGWPLYAEQRINRVFMVEEIKVALPLDEEDGFVTAMELEKRVRELMESVKGKEVKRRVAELKISTKAAVSKGGSSLASLEKFINSVTR

SEQ ID NO: 5729 - protein, 470 aa, Solanum lycopersicum
MGQLHFFFFPMMAQGHMIPTLDMAKLVACRGVKATIITTPLNESVFSKAIERNKHLGIEIDIRLLKFPAKENDLPEDCERLDLVPSDDKLPNFLKAAAMMKDEFEELIGECRPDCLVSDMFLPWTTDSAAKFSIPRIVFHGTSYFALCVGDSIRRNKPFKNVSSDTETFVVPDLPHEIRLTRTQLSPFEQSDEETGMAPMIKAVRESDAKSYGVIFNSFYELESDYVEHYTKVVGRKNWAIGPLSLCNRDIEDKAERGRKSSIDEHACLKWLDSKKSSSIVYVCFGSTADFTTAQMQELAMGLEASGQDFIWVIRTGNEDWLPEGFEERTKEKGLIIRGWAPQVLILDHEAIGAFVTHCGWNSTLEGISAGVPMVTWPVFAEQFFNEKLVTEVMRSGAGVGSKQWKRTASEGVKREAIAKAIKRVMASEETEGFRSRAKEYKEMAREAIEEGGSSYNGWATLIQDITSYR

SEQ ID NO: 5730 - protein, 374 aa, Helianthus annuus
MFQLANLLYSKGFSITIFHTNFNKPKTSNYPHFTFRFILNNDPHDERYANLPLQGMRLFSRIILFNKCGADQLRHQLELELSAKDEPPVACLITDASWHFTQSVADSLNLPRLVLRTSSLFYFLIYASIPLLDDLGYFNLSDNTATPLLDGLGYNNVPDDEQWNFVCRVTTASSSLLDQDRSFFPWLDQQPRNSVVYISFGNVAQVEEKHFMEMVHGLVDSKHSFLWVVRLGFVSGSTWLEPLPDGFPGERGRIVKWAPQQEVLGHEAIGAFWTHSGWNSTVESVCEGVPMICSPFWGDQPLDARYVSDAWKVGVYLENGWKREEITNAIRRVMADEEMRERSRVLKQKLDASMIEGGSSYESVESLVDYISSF

SEQ ID NO: 5731 - protein, 477 aa, Rosa chinensis
MENTIVLYAAPGMGHMISMVELGKLILKHYSHKFSVTVLYTTGSMVDTPSIPAYIDRITQSHPSISFRRFPRASPTNHHDQTRSLAAVMFDFIRQNDPNVRCALQELSKTFRVRAFIIDLFCTSAMAIAKELNIPTFYFFTSGAAALGAFLYFPTIHARVNESFKDMTDTVFEFPGLGTPLRAVHMPEPMLDRNDPAYLDMVYFCSHLALSDGIIANTFEELETPTAIKAISEGRCVPDAPTPPVYYIGPLIDEEKTSSSAHSEEDCLLWLDKQPSRSVVYLCFGSRGSFSEAQVREIASGLERSGQRFLWVVKKPPVDNTKQSHGVDDFNLEALLPEGFLERTIDRGLVVKSWAPQVPVLNKEAVGGFVTHCGWNSVLESVIAGVPMVAWPLYAEQHLNRSVLVNDMKMAIDVEQREEDGFVTGDEVERRVRELMESKKGRELRERSLKIGEMALGALGELGSSRRALANFVNAIE

SEQ ID NO: 5732 - protein, 441 aa, Helianthus annuus
MYPTHNNHNSKMTSEVAVVMVPFVAQGHLNQLLHLSHLISAYNIPIHFISTATHIRQARIRLHGWNSHNNLIQFHELPDPDFISPHPNPNGTVSFPTHLQPVFNSSLRLRGPVADFVRSLAETSRRVAVVHDSAMSYVVQDVKFMSNVETYIFRALSVFYTYCSNLDRLRRELPFAPKMLPRLPSSDETMSGEFMEFVKLQYEHQTFHVGNIYDSSRVIEGTFLESLEREGICGKNHWAVGPFNPVEIQTDVSNSDRHASLKWLDKQPERSVVYVSFGTTTTFTVSQIRELAMGLEKSEQRFLWVVEGRGLVVREWAPQVEILGHLSVGGFVSHCGWNSCMEAMTCGVAVAAWPIHSDQPRNAFLFVEVLKVALMMREWACRDKLLTSVMVEKVVRRLMDTKEGAAIRKRAAEVGGELRRSLANGGISRKELDSLIAYIRR

SEQ ID NO: 5733 - protein, 518 aa, Unknown
  Description of Unknown: Oryza sativa Japonica Group sequence
MADTDHRRRGGATRAHVVLFPFMAQGHVAPFRCIAALVRRCRPDARLTVVATPGMAEAFRAHLVADGVGDGRLAGVHELPFLPAEHGLPAGADTSASIGFQQLITLFLASESLRPAFRRFVDDLRAANPGDDIHVMADMFLGWAVDVARDAGASSSIVLTCGGYGSALYFSLWDSVPLPATASPDDGFPLPRFPDVRVQRSQLTNHLAAADGKDAWSTFIQRQIAAFSRADALLVNTAENLEPKGLSMLRQWLNVPTYPVGPLLRAPAPSPEAKKTSPILEWLDEQPPGSVLYISFGSLYRITAPQMMELARGLEQSSHRFVWVIRPPAGNDANGEFSPEWLPEGFRERAEAEGRGLVVRCWAPQVEILAHTATGAFLTHCGWNSVQEALGHGVPLLGWPLSAEQFYNSKLLAEEMVCVEVARGSAAVDAAKVAAAVEAVLGETSMERAAMKRRAAEMKEAIDAARDGDKSSVTVMRRFLDEVLPPRGAQFMASWALQSACFRDGAMSHQLRSSHPMM

SEQ ID NO: 5734 - protein, 308 aa, Helianthus annuus
MDYITNGYLETSLDWIPGMNNIRLRDFPSFIRTTDINDILLNYIMTQAEALPRGSAVVLNTFDALEQDSVKPLTARNPRIITVGPLHLMQQHLHDEGVKQVGSNLWKEDASCIHWLDTKDDGSVVFVNFGSITVMTKEQLIEFGWGLANSKKDFLWITRPDIVGGNEVVMPPEFLDETKGRGMITSWCPQEQVLKHPAIGGFLTHSGWNSTLESISSGVPVLCWPFFAEQQTNCRYSCVEWEIGMEIDTNVKRKDVEAQVRELIDGGKGKMMKAKVLELQKKAKEAVVNGGSSYLNFNKLVTEFLLKN

SEQ ID NO: 5735 - protein, 480 aa, Helianthus annuus
MGSTEANQPHVVCIPLPAQGHINPMLKLAKILHSKGFFITFVITEYNYQRLLGSLGSDALPDLPSFHFDTISDGLPPPENPDVGHDVVTTLKSLHENSLGPFKSVLSKVSTLYSPVTCIVADFIMSFTLSAAEELGIPAIPFWTSGAGSLVCYDHYPNLIQKGLMPLKDQTYLEDGYLDTTIDFIPTMTGIRLKDIPPFVRVVNPGDEFMVGFSQGEIERAKSAPAIIFNTFDDLECDILDVLSLKLPFCYGIGPLSLLENNISDKSLDSIKSNMWVEDPSCLKWLDAKEPLSVIYVNFGSVAVMTPQQLVEFCWGLAKSNNSFLWIIRPDLVIGDSAVLPPEFLAETSNRGLLASWCPQEQVLNHPSIGGFLTHSGWNSTIESISSGVPMICWPFFADQQPNCWWSCNKWMIAMEIDNNVKSDEVSKLVIELMSGERGNEMRKNAIAWKNKAKEACTFPSGSSVINLDKLIHLLQTSPK

SEQ ID NO: 5736 - protein, 482 aa, Gentiana triflora
MDQLHVFFFPFLANGHILPTIDMAKLFSSRGVKATLITTHNNSAIFLKAINRSKILGFDISVLTIKFPSAEFGLPEGYETADQARSIDMMDEFFRACILLQEPLEELLKEHRPQALVADLFFYWANDAAAKFGIPRLLFHGSSSFAMIAAESVRRNKPYKNLSSDSDPFVVPDIPDKIILTKSQVPTPDETEENNTHITEMWKNISESENDCYGVIVNSFYELEPDYVDYCKNVLGRRAWHIGPLSLCNNEGEDVAERGKKSDIDAHECLNWLDSKNPDSVVYVCFGSMANFNAAQLHELAMGLEESGQEFIWVVRTCVDEEDESKWFPDGFEKRVQENNKGLIIKGWAPQVLILEHEAVGAFVSHCGWNSTLEGICGGVAMVTWPLFAEQFYNEKLMTDILRTGVSVGSLQWSRVTTSAVVVKRESISKAVRRLMAEEEGVDIRNRAKALKEKAKKAVEGGGSSYSDLSALLVELSSYPHN

SEQ ID NO: 5737 - protein, 495 aa, Barbarea vulgaris
MVSEITHKSYPLHFVLFPFMAQGHMIPMVDIARLLAQRGVKITIVTTPHNAARFENVLSRAIESGLPISIVQVKLPSQEAGLPEGNETFDSLVSMELLVPFFKAVNMLEEPVQKLFEEMSPQPSCIISDFCLPYTSKIAKKFNIPKILFHGMCCFCLLCMHVLRKNREILENLKSDKEHFVVPYFPDRVEFTRPQVPMATYVPGEWHEIKEDIVEADKTSYGVIVNTYQELEPAYANDYKEARSGKAWTIGPVSLCNKVGADKAERGNKADIDQDECLKWLDSKEEGSVLYVCLGSICSLPLSQLKELGLGLEESQRPFIWVVRGWEKNKELLEWFSESGFEERVKDRGLLIKGWSPQMLILAHHSVGGFLTHCGWNSTLEGITSGIPLLTWPLFGDQFCNQKLVVQVLKVGVSAGVEEVTNWGEEEKIGVLVDKEGVKKAVEELMGESDDAKERRKRVKELGQLAQKAVEEGGSSHSNITSLLEDIMQLAQSNN

SEQ ID NO: 5738 - protein, 435 aa, Citrus unshiu
MQPRKQVLECLPPTSISTIFLPPVSFDDLPDHEDVSIEVRITLTLTRSLSSLRETLNNLTTDQSTRLVALVVDLFGLEAFTVTREFGVPIYVFFSTTAMDLSLVFYLPELDHKFTCDFKDLPEPVQLPGCVPICGPDLEDCLQERNNETYQSIIHLAKQYPLAAGILVNSFMDLEPGAFKALMESRESSFRLPPVYPVGPLILTGSINESDKTDCLKWLDDQPNGSVLFVCFGSGGTLSQKQLNELALGLEMSGQRFLWVVKCPDEKATNATYFGVHGMKEENPFDYLPKGFLDRTKGVGLVVPSWTPQIQVLSHGSTGGFLSHCGWNSVLESIVHGVPIIAWPLYAEQKMNAVLLTDDLKVAWRVKVNEDGLVGREEVATYARGLIQGEDGKLLRDKMRVLKDAAANALSPDGFSTKSLANVAQKWKNLENDTN

SEQ ID NO: 5739 - protein, 464 aa, Arabidopsis thaliana
MEERKVKRIIMFPLPFTGHFNPMIELAGIFHNRGFSVTILHTSFNFPDPSRHPQFTFRTITHKNEGEEDPLSQSETSSGKDLVVLISLLKQYYTEPSLAEEVGEGGTVCCLVSDALWGRNTEIVAKEIGVCTMVMRTSGAATFCAYTAFPLLIDKGYLPIQGSRLDELVTELPPLKVKDLPVIKTKEPEGLNRILNDMVEGAKLSSGVVWNTFEDLERHSLMDCRSKLQVPLFPIGPFHKHRTDLPPKPKNKDKDDDEILTDWLNKQAPQSVVYVSFGSLAAIEENEFFEIAWGLRNSELPFLWVVRPGMVRGTEWLESLPCGFLENIGHQGKIVKWVNQLETLAHPAVGAFWTHCGWNSTIESICEGVPMICTPCFSDQHVNARYIVDVWRVGMMLERCKMERTEIEKVVTSVMMENGAGLTEMCLELKEKANVCLSEDGSSSKYLDKLVSHVLSFDSSAFAS

SEQ ID NO: 5740 - protein, 485 aa, Citrus unshiu
MKKAQLVFIPSPGAGHLVSTVEVARLLVDRDDRLSVTVLIMKLPHDNTVAAYTQSLAASNLSSRIKFINLPDDQPDKESTPPKRFFGHFVESKKPHVKEVVANLTDESPDSPRLAGFVLDMFCTCMIEVADEFKVPSYLFFTSGAAFLGFMLRVQALHDEENTTITELKDSDAVLEVPGLVNSVPAKVWPSVVFNKEWAEVLNQQARTFRGTKGIMVNTFEELESHAVRSFSDGKSKTPPLYPMGPILNIKGENYDLGEGGADKKADIMAWLDDQPESSVVFLCFGSWGSFGEDQVKEIACALEQSGHRFLWSLRRPPSKDTFEKPSDYEDPTEVLPEGFMDRTANIGKVIGWAPQIAVLAHPAIGGFVSHCGWNSTLESIWFGVPIATWPMYAEQQFNAFELVVELGLAVEIKMDYRKDILMENPTVVNAEEIERGIRCLMEHNSEMRKRVKEMSEKARKALSDGGSSFSSMGRLIDDFLDNIA

SEQ ID NO: 5741 - protein, 471 aa, Panicum hallii
MASVHEARTGGGGDAGGRKSRRPRRVLVFPLPFQGHINPMLQLADALHARGLAVTVLHTHFNALDPARRPEFRFVPVPDGVPAGVAASGDAIDILHAMNAGMEAEESAALRGVLESVLADEEKTPAACIVFDANLLAVPRAAAAVGLKTVVLRTASAACLGCFMAYPMLHQKGYLPPQESKMYMPVKELPPLRVRDLFYSSWSDQEKMRNLLARAMEAVNNSSGLVINTFDALEPAELERIRDELRIPMVLAPGPLHKLSSKNTASSLLDEDCDCIKWLDKQPPKSVLYVSFGSLASLDPNEFLEVAWGLATSGHPFLWVVRPDSVRGLDGPGFPNGFEAAVEGRGKVIRWAPQQEVLAHRAVGGFWTHNGWNSTLESISEGVPMICRPQFADQMMNTRYVEKTWGVGFELEGELERGKIEKAIRKLMEEREGAEMRERAMELKMKVADCLKPGGSSEIAIDKLVRHILSL

SEQ ID NO: 5742 - protein, 491 aa, Unknown
  Description of Unknown: Citrus x paradisi sequence
MDTQANQLHFVLFPFLAQGHMIPMIDIARLLAQRGVIITIVTTPVNAARFNGILSRAIESGLQIKIVQFQLPCEEAGLPEGCENLDMVASLGLAFDFFTAADMLQEPVENVFAQLKPRPNCIISDMCLPYTAHIAGKFNIPRITLHGTCCFCLVCYNNLFTSKVFESVSSESEYLVVPCLPDKIEFTTQQVDSSLGSRFNVFQKKMGAADTGTYGVIVNSFEELEPAYIKEYKKIRHDKVWCIGPVSLSNKEYSDKAQRGNKASVDEHQCLKWLDSKAPKSVVYACLGSLCNLIPSQMRELGLGLEASNRPFIWVIREGETSKELKKWVVEDGFEERIKGRGLVIWGWAPQVLILSHPSIGGFSTHCGWNSTLEGVSAGLPLLTWPLFGDQFMNEVFVVQILKIGVKVGVESPMIWGEEQKIGVLMKRDDVRNAVEKLMDEGKEGEERRNRAVKLGQMANMAVQEGGSSHLNVTLVIQDIMKHVHSSSQAN

SEQ ID NO: 5743 - protein, 406 aa, Ricinus communis
MHSDPSCPIDIETISDGFDEGGSAQAESIEVYLSTLRIVGAKSLANLIKKLNESDCPVTAIIYDGFMPWALDVAKQYGILAVAFLTQACAVNNAYYHVQRSFLPVPVSSPTVSLPGLPMLQVSELPSLISDCGSYPGFRYLLVDQFRNIDGADWVLCNTFYRLEEEVVDWMAKSWRLGTIGPTVPSRYLDKRLEDDKDYGINLFKPDSSTCMNWLKTKPSSSVVYVSFGSMVELGTEQIEELALGLKGSNCYFLWVVRTSERSKLPENFIEETSEKGLVVSWCPQLEILAQEVIGCFVTHCGFNSILEALSLGVPIVAMPQWTDQPTNAKYVEDVWKVGIRARRNEKGIVRRETVELCIREVMEGQKGKEIKKNANKWKELAKEAIDEGGTSDKNIDELVTKLSSS

SEQ ID NO: 5744 - protein, 278 aa, Unknown
  Description of Unknown: Oryza sativa Japonica Group sequence
MSVAKRCSLAMERCTLAAMRSCPEWEPDAFQQVAAGLKNKPLIPLGLVPPSPDGGRRRAGMTDNSTMRWLDVQPAKSVVYVALGSEVPLPLEQVHELALGLELAGTRFLWALRKPHGVDLSDVLPPGYQERTKSHGHVAMGWVPQITILAHAAVGAFLTHCGRNSLVEGLLFGNPLIMLPIFGDQGPNARLMEGNKVGSQVRRDDMDGSFDRHGVAAAVRAVMVEEETRRVFVANAIRLQELVADKELHERYIDEFIQQLVSHGADGSCNTAAPVPSS

SEQ ID NO: 5745 - protein, 505 aa, Brachypodium distachyon
MPAMAREEKVAETKAKAKPAPPHYLVVTFPAQGHISPARHLAQRLLRATPGSRVTLSTAVSACRKMFPENNAAEVELVDGAGIHYAAYSDGHDEGFDREKGDNAAYMRALRLVGAQTLDALLGRFRDEGRPVTRIVYTLLLSWVAAVARAHGVPSALYWIQPATVLAAYFHYLRRTDGVDKAIADAARAGDLWAEVQIPGITAQLRVRDLPSFLISGAVVDDPASSDDPYVMVLAEFLEDLAALAREDDPKVLVNTFDAMEPDAVATLREHGLGVVPVGPLLSFLDAGLGTPAPASNNDLFQQDGKDYMAWLDAQQEGSVVYISFGSLSVMSERQVAEIARGMADSGRPFLWVLRKDNRAGAGIDVDGISEKGGNGMVVEWCEQGKVLGHAAVGCFVTHCGWNSTVESVACGVPAVGVPQWTDQGTNAWLLERIGVGVRAAVSEDDGVLEAEELQRCLAFAASEPVRAQAALWRDKARAAAAQGGSSEKNLRAFMEQAIAPGGGN

SEQ ID NO: 5746 - protein, 480 aa, Helianthus annuus
MGLDQEKKPHALCIPIPVQGHITPMLKLAKILHSKGFLITFVNTEFNHQRLLRSQGPDAVHGLPSFQFETIPDGLPPAQNLDATQEASILARAIEENFLGPFKTLVTKVNASYSPVTCIVADMLMGFTFAVASELGIPEFLLWTAGAGSLLCFDQYPYLLEKGLMPLKDSSYLLNGYLDTVLDTIPTMHGIRLKNIPPWITYINPGDEYMAQYFCLQLERAKAASAIFFNTFDELDRDILDAISAKFGPSYGIGPLNLLENKIVDNSVASFKSNLWKEEPECLKWLDLKEPSSVIYVNFGSITVMTSQQLVEFGWGLAKSNYPFLWIIRPDLVTGESAVLPPELLMEVGGRGLLAGWCPQDQVLSHPSIGGFLTHSGWNSTIESISSGVPMICWPFFADQQPNCWLGCNKWGIAMEIDNNVKSDEVQKLVIELMKGEKGNLMRKKVDELKKKAKEACAFPSGSSVVNLEKIINLMQTSSK

SEQ ID NO: 5747 - protein, 485 aa, Unknown
  Description of Unknown: Oryza sativa Japonica Group sequence
MAAAAAAAADHDAAPRAHALILPYPAQGHVIPLMELAYCLIDRGFAVTFVNTEHNHRRVVAAAAGAGGVQAPGSRARRLRLVAVADGMGDGDDRDNLVRLNAVMEEAIPPQLEPILDGAGGEGQLGKVTCVVVDVGMSWALDAVKRRGLPGAALWAASAAVLAVLLGAQKLIRDGVIDDDGAPLKLENNSFRLSEFTPPMDATFLAWNFMGNRDAERMVFHYLTSSARAAAAKADILLCNSFVELEPAIFTLKSPATILPIGPLRTGQRFAHQVEVVGHFWQTNDDTCLSFLDEQPYGSVVYVAFGSLTIMSPGQLKELALGLEASGHPFLWVVRPGLAGNLPTSFLDATMGQGKGIVVEWAPQEQVLAHPAVGCFVTHCGWNSTVESIRNGVPMLCWPYFTDQFTNQIYICDIWRIGLKMVQTCGEGIVTKEIMVERLKELLLDEGIKERVQRLKEFAETNMSEEGESTSNLNAVVELMTRPMS

SEQ ID NO: 5748 - protein, 484 aa, Brachypodium distachyon
MRQSDDDAVAAPRMYFIPFPTPGHALPMSDLARLFASRGADATLVLTHGNAARLGAPVARAAAAGLRIRIHGLTLPADAAGLKGGHESADDLPTREAAGPFAVAVDLLAPLFADLLRSQPADAVVFDGVLPWAATAAPELGIPRYAFTGTGCFALSVQRSLLLHSPQEAVGSSEHEPFLVPGLPDEVRLTRSRLAEATLPGAVSREFLNRMFDGERATAGWVVNSFSGLEERYVAHYERETRKPVFAVGPVCLINSDGDDALDRGGRRGEAAARVLRWLDGKPARSVVYACFGSLTRFPREQVAELGAGLANSGASFVWVVGEHTDMAALVPEDEERGLVVRGWAPQVAILRHAAVRCFVTHCGWGAVTEAAAAGVPVVAWPVFAEQFYNEALVVGVVGTGVGAGAERGYVWGAEETGGVVVGRETLAEKVRAAMADEGLRRRAGEMGERARRAVEDGGSSYQAVGALLEDVRRRRRSRGGRGG

SEQ ID NO: 5749 - protein, 482 aa, Vitis vinifera
MGNETDQLHVLFFPFMALGHMIPTIDMAKLFSARGVRATIITTPLNAPVVSKTMERGHYLGAQIGLRVIQFPSVQAGLPQGLENLDQDASPEIRLKFFLAMSLFQQPLEQLLQEYRPHGLVADAFFPWALDVASKFGIPRLAFQGTGFFAMCALQSLTAHKPYKGVGSDTEPFLLPDLPDEIKLTRLQISNDLTLGLENDFTRFFKEARESEERSYGTIVNTFYELEPAYAEHWRKVLGRKAWHIGPVSLCNRDAQDKTQRGKAASIDEDECLKWLNSKYPDSVIYVCFGSVSKFPAAQLLEIAMGLEASGQQFIWVVRKNKDEGDEEEWLPQGYEKRMEGKGLIIRGWAPQTLILDHEAVGGFVTHCGWNSTLEGVSAGVPMVTWPVFADQFYNEKLLTDVLKIGIGVGAQRWVPFVGDFVKQDAIEKAVKAVMAGEKAEELRSRAKSLGGMARRAIEKGGSSYTDMDALIEELKLYHAQI

SEQ ID NO: 5750 - protein, 241 aa, Manihot esculenta
CNKLKLDKAERGDKASVDNTELLKWLDLWEPGSVIYACLGSISGLTSWQLAELGLGLESTNQPFIWVIREGEKSEGLEKWILEEGYEERKRKREDFWIRGWSPQVLILSHPAIGAFFTHCGWNSTLEGISAGVPIVACPLFAEQFYNEKLVVEVLGIGVSVGVEAAVTWGLEDKCGAVMKKEQVKKAIEIVMDKGKEGEERRRRAREIGEMAKRTIEEGGSSYLDMEMLIQYVSERSPSRA

SEQ ID NO: 5751 - protein, 482 aa, Cyclamen persicum
MERAELAFIPIPGAGHLVPMVELAKALTTRDERISVTVFIMEVPFQSKLNSYTQSLLSNPPPSRVRFVHLTLDEPTTEDIRSKPGSFWLLDLIQINKSRVKDFYSSDSTRYELAAFVVDMFCSQFAEVASEFGVPDYVFFTSNAYFLSLMFYLQAIQDYQNRDIAEFKDSDVELSIPGFMNPVPTKVLPHVAFDKEKGGALFFVDVPRKLRKTKGILANTFEEFESYTIKCLAEDDKVPPIYTIGPVLNLKAETSNDQKDLVQYEEIMAWLDCQPSTSVVFLCFGSMGTFEAEQVVEIATALEHSGHRFLWSLRRPPPEGKKEPPSDYENLSDVLPEGFLDRTKEVGKVIGWAPQTAVLSHPAVGGFISHCGWNSIMESLWFGVPIATWPLYAEQQINAFEMVKELQLAVEISLDYKKENHAILTAEEIERGIKQLMDGNESVEIKKKVKAMSEKSRSAVEEGGSSYAAVGRFIEEVLNRSS

SEQ ID NO: 5752 - protein, 487 aa, Arabidopsis thaliana
MKITKPHVAMFASPGMGHIIPVIELGKRLAGSHGFDVTIFVLETDAASAQSQFLNSPGCDAALVDIVGLPTPDISGLVDPSAFFGIKLLVMMRETIPTIRSKIEEMQHKPTALIVDLFGLDAIPLGGEFNMLTYIFIASNARFLAVALFFPTLDKDMEEEHIIKKQPMVMPGCEPVRFEDTLETFLDPNSQLYREFVPFGSVFPTCDGIIVNTWDDMEPKTLKSLQDPKLLGRIAGVPVYPIGPLSRPVDPSKTNHPVLDWLNKQPDESVLYISFGSGGSLSAKQLTELAWGLEMSQQRFVWVVRPPVDGSACSAYLSANSGKIRDGTPDYLPEGFVSRTHERGFMVSSWAPQAEILAHQAVGGFLTHCGWNSILESVVGGVPMIAWPLFAEQMMNATLLNEELGVAVRSKKLPSEGVITRAEIEALVRKIMVEEEGAEMRKKIKKLKETAAESLSCDGGVAHESLSRIADESEHLLERVRCMARGA

SEQ ID NO: 5753 - protein, 459 aa, Helianthus annuus
MENTFAELVFIPAPAVGHIMSAMEMAKVLVNRHQSLSVTVFLMNPPLSMLALSTYIESLAKKAIERIRFIKLPQDQTPPKLDSKAPLMSFYEFINSHCKYVKNILEEMINQSSSRRVVGLVADWFCTGMIDVANEFNLPSYVYFTSSAAFLGFKLHFETLYVDQKQDLLELANSENGLDFLICAIGSMRKAKGILINTFLELETHAINWFSGTNFPPVYPVGPLLNLDSVAGKADDTNVFRWLDSQPWASVVLLCFGSMGCFDEAQLKEIARGLERSGHRFVWSVRRPPPQEKSFEVLQDDYDDPRVVLPDGFLERTSGVGKVIGWARRVSLLANEAVGGFVSHCGWNSMIESLWFGVPTTTLPIYCEQQMNAFEMVVDLGLAVDLKLDYKINVINPEGDTVIVMAEEIERGIRSVMEDNEMRAKVKEMSNMSRATVVEGGSSYTSVGYLIKDMMRNII

SEQ ID NO: 5754 - protein, 479 aa, Unknown
  Description of Unknown: Oryza sativa Japonica Group sequence
MAAAAAAADSPCSRAVRHDAQLPHVAIFPFMARGHTVPPIHLAHLLRHRGLAAVTLFTTPANAPFVRRVLDDDAVAVAELPFPDHLPGVPPGVECLDGLSSFPAFVEAVSALRPRLEACLAAARPRVGLLVADALLYWAHDAAAALGVPTVAFYATSMFAHVIRDVILRDNPAAALVAGGAGSTFAVPEFPHVRLTLADIPMDAKMANAIAGSHGLIVNTFDAMEGHYIEHWDRHHVGHRAWPVGPLCLARQPCHVAGDGAGAVKPSWLQWLDEKAAAGRAVLYVALGTLIAVQEAQLRELAGGLEASGVDFLWVVRPSDADVGAGFEERVEGRGLVVREWVDQWRILRHGCVKGFLSHCGWNAVVEGVAAGVPLATWPMGVEQPLHATLAVDELRIGVRVPAAATTGHGVVSGEEIARVARELMGMDGEGENGAGGEAARNAAALAAKAREAVAEGGSSWKTLEEMLAVVCLPTDPSE

SEQ ID NO: 5755 - protein, 489 aa, Polygala tenuifolia
MGSLENTNKPHAVCIPYPAQGHINPMLKLAKILYSRGFHITFVNTEFNHRRLLKSRGPDALNGFPSFRFETIPDGLPYSDADATQDVPSLCYSTSHNCLAPFKKLLHKLNQQSESSDVPPVTCIVSDGVMSFTVDAAEELGLPVVLFWTPSACGFMSYLHYSHLIEKGLVPLKEMSQISDGYMDSVVNWIPGMKDMRLRDIPSFIRTTDINDVMLNYILGECSRAPRASAIVMNTFDDLENDILKSFSCVLSPPVYSIGPLQLLLNQVEDNVELKSLAANLWKEEPECLDWLETKEPNSVVYVNFGSITTMTNEQLVEFAWGLANSRKPFLWVIRPDLVGGDTAVVPAEFVTETKDRGLLASWCPQEQVLKHSAVGGFLTHNGWNSTLESICGGVPMLCWPFFAEQQTNCRYCCTEWGIGMEIEGDVKRDGVEDLVRELMDGPKGKEMRIKATEWKTLANQSVQGPNPTSCKNLNDVISKFLLSARNDN

SEQ ID NO: 5756 - protein, 492 aa, Ricinus communis
MAPRRENIVMFPFMAQGHIIPFLALAFHIEQTKKYKITFVNTPLNIKKLKSSLPPNSSIRLLEIPFDSCDHGLPPNTENTDVLSYPRIIQLLHASTSLEPAFKKLILDITNEQEGEPPLCIIADIFFGWTATVAKELGVFHAIFSGAGGFGLAVYYSVWSSLPHRNAKSDEFELQDFQEVSKLHLTQLPLSILEADGTDSWSVFQRKNLSAWFDSNGILFNTVQEFDHVGLSYFRRKLGRPAWAVGPVLLSMENRNRGGKEAGISPDLCKEWLDNKPVSSVLYVSFGSHNTISPSQMMQLALGLEASGRNFIWVVRPPIGFDINSEFRVKEWLPEGFEERIKESGKGLLVHKWASQVEILSHKSTCAFLSHCGWNSVLESLNNGVPLIGWAMAGEQFFNVKFLEEELGVCVEVARGKTCEVRYEDIKDKIELVMSETGKGEEIKRKALEVKEMIKNAMKEENGIKGSSLKALEDFFQAAMSIGEKTDKNFTY

SEQ ID NO: 5757 - protein, 468 aa, Medicago truncatula
MEKTVHIAVVPGVGYGHLFPILQFSKLLVQLHPYFHVTCFIPSIESLPTDSKTIIQTLPSNINCTFLPSVSSKDLPQGIALVLQIQLTVIHSLPSIHQALKSLTLRTPFVALVVDSLAIDALDFAKEFNMLSYVYFPSSVTSLSSYFYLLKLNKETSCQYKDLLEPIQIPGCVPIHGQDLVDQAQDRSSQSYKFLLERVEKFRLFDGILINSFLEIEKGPIEALTEDRSGNPDVYAVGPIIQTPTKSGDDDNGLKCLAWLDKQQTCSVLYVSFGSGGTLSQEQINELALGLELSNHKFLWVVRSPSNTANAAYLSASDVDPLQFLPSGFLERKKEQGMVIPSWAPQIQILRHSSVGGFLTHCGWNSTLESVLHGVPLITWPLFAEQRTNAVLLSEGLKVGLRPKINQNGIVEKVQIAELIKCLMEGEEGGKLRKNMKELKESANSAHKDDGSFTKTLSQLALKWRNLV

SEQ ID NO: 5758 - protein, 466 aa, Ricinus communis
MAKNLHVMILPWSAFGHLIPFFQLSIALAKAGVSVSFVSTPNNIRRLPKIPQNLETLIKLVEIPLPTLESQSLPIGAEATVDLPSDKIDHLKIAYDLLQYPLKQYVMDQQLDWIIIDVIPHWMVEIAVEMKIPLMHFSVYSASAYLFLCDPGCLAGDNMRTSWESMTSPAERINFPSSVAYRKHEAIGAFEGIYGTNASGITDAERVAKILNSCQAIAIRSCTEFEIDSLNSFQKLMGKPVVPVGLLPLEKPKAREITDGSWGEVFKWLDQQKTKSVVFVSFGSEFKLSQEQVYEIAYGLELSGLPFLWALRKPSWANHGFDVLPSGFRERTSGKGVVSIGWAPQMEILGHRAIGGSLFHSGWGSIIETLQFGHSLVLLPFIIDQPLNARLLVEKELGVEVERSEDGSFNRDGVANALRLAMVSEEGKKLRAGASEAAQVFGNNNLHQDYYIEKFVEFLRNKDYQN

SEQ ID NO: 5759 - protein, 480 aa, Cephalotus follicularis
MEVSKPHAILLSSPGMGHLIPMLELGKRLVTLHSFEVTIFVVSSGTSPAESQTIQSSMSPKLCQVIELPPVDISSLVESKAKVVANLTVMMREIKPALRSAISTLKVPPTALIVDLFGTEALVIAHEFKIPKYVFIPTHAWFIAFSIYVPILDKVVKGEYVDQKEDFVIPGCRPARPEDVVEPMLDRTNQQYYEYLRMCKEFTMGDGILLNTWEELESSTLAALRDDKLFGDINRPPIYPVGPILRPNGSAGSRSHELFDWLDRQPSESVVYVSFGSGGTLSNEQMTELAWGLELSQRRFIWAVRQSTVRTGDGSFFITGKGGDDLSSNLPEGFLIRTQGLGVVVRDWAPQVDILSHPSVGGFLSHCGWNSALESVTNGVPMIAWPLYAEQRLNAALLTEELGVAVRSKILPSKGIVGREEINMTVRRIMADEEGHGIRARVKELKHKAEEALSEGGSSYHSLSQFTQNILMSMQKSPSP

SEQ ID NO: 5760 - protein, 471 aa, Cephalotus follicularis
MAHGHMIPSLDMAKLFASQGVKATIITTPLNVPFFSKSIQRASDHLGIDIDIRTLKFPAAEAGLPEGCENADAITSNEQAMGLLMKFLPATAMLQEPLEHLLQECRPDCLVADMFFPWATDAAAKFGIPRLVFHGTGFFAFCAAECIRLYEPHKKVSSDSDPFVVPNLPGDIKLTIRQLPTSFINQDNRNGLTRLLEEARESELKSFGVVVNSFYELEQAYADHFRQVMGRKAWHIGPLSLCNREIEDKAERGKEASIDERECLKWLDSKKPMSVVYVCFGSVANFISAQLMEIAVGLEASGQPFIWVVRRDKNDKGNEDWLPEGFEKRVEGKGLIIRGWAPQVLILDHEATGGFVTHCGWNSTLEAVSAGVPMVTWPVSAEQFYNEKLVTQVLENGVAVGVQRWVRFVGDFVESEKIEKAVKEVMVGDKAEEVRSRAKALADMAKRAIDKGGSSYSSLQALIEELSQSRH

SEQ ID NO: 5761 - protein, 798 aa, Helianthus annuus
MGSEESSEHNQLHFLVVPIGSPGHYIPIIDIAKLLAQHGVRVTIISTPVNTRRYGSVLDQAIQSGLPIRFIEFPFPYAEFGLPEGCESVDDLPNYALIPALTNAYNSLQQEVEHYIEKLDRMPDCIVADSFILWPGDTAKKFQIPRVIFDSMNCFTQMCNHVLYQSKVYENAGEDSFVVPGLPDRFELKRSQLPSTLNPNLKYTNDYYEKLRVSESEAYGVVVNSFEELEQAYVDEFKKLRGGKVWCIGPLSLCHNDESEKVQRGNKSSISKHECLEWLDSQETGSVIYVCLGSISRVEPEQLIELALGLESSNKPFIWVIRAGPNTKKVEQWIDEQGYAERTKDRALLIHGWAPQLLVLSHPAIGGFLTHSGWNSAFEGVAVGVPLITLPLFQEQFYNEKQIVQVLRTGVSVRDQHKSGMAIKSDDVKKVIEMVIEGGEDIRKRAKELGDTTKKFQIPRVIFDGMSCFTQMCNHVLYQSKVYENVGEDSFVVPGLPDRFELKRSQLPSALNPNLKYANDFFEKLRVSESEAYGVVVNSFEELEQAYVDEFKKVRGGKVWCIGPLSLCHNDESEKVQRGNKSSISKHECLEWLDSQESGSVIYVCLGSISRVEPEQLIELALGLESSNKPFIWVIRAGPNTKKVEQWIDEQGYAERTKDRALLIHGWAPQLLVLSHHAIGGFLTHSGWNSTFEGVSVGVPLITLPLFQEQFYNEKQIVQVLRIGVSVRDQKVGEHKSGMAIKSEDVKKAIEMVIEGGEDIRKRAKELGKMARNAVEEGGSSYRNMTRLIEDIKNYART

SEQ ID NO: 5762 - protein, 481 aa, Unknown
  Description of Unknown: Oryza sativa Japonica Group sequence
MAGPTIVLLPAWGSGHFMSALEAGKRLLVAGGGAVSLTVLVMQAPTEIEASVVEAHVRREAASGLDVTFRRLPAVEHPTGCEATEEFMSRYVERHAHHVKAAIAGLASPVAAVVVDLFFTPLLDAAHELSLPAYVYFASTAAFLALMLRLPELRDDLTVGFDGMEGTVDVPGLPPVPPSYMPVCLVSKTVKNYDWFEYHGRRFTEAKGIIVNSSVELEGAVLAAIADGRRPAPAIHAIGPVIWFDATLPPEQPHECVRWLDAQPAASVVFLCFGSIGFLDAAQVRELAAGLERSGHRFLWVLRGAPAGGVRYPTDADPGELLPEGFLEATAGRGMVWPRWAPQKDILGHAAVGGFVTHCGWNSVLESLWFGVPMATWPLYGEQHLNAFEAVASMGVAVELRRTTAKDGDAARSLVEAAEVERAVRRLMAPQGGGSSEAREKAAEVSAACRKAVEEGGSSHAALQRLVREIVRVVAGHTRPE

SEQ ID NO: 5763 - protein, 477 aa, Consolida orientalis
MASSSPKTPHIVCVPAPAQGHINPMFKLAKLFHSRGFYITFVHSEFSYQRLLQASALDHLKGLNNFRFETIPDGLPPENKRGVSDVPELCKSMRNTCADPFRSLILKLNSSSDVPPVTCIVADVAMDFTLQVSEELGPPVVLFFTLSGCGVLGYMHYGELLERGYFPLREESFLSNGYLDTEIDWIPAMKGIRLKDLPSFLRTTDPDDIMFNCKIIEVNSAFKAKGVILNTFDDLEQEVLDAIKSKIPQLYTIGPLSMLCDHMLQPDSKLCEASLWEEDTSCLEWLQEKDPKSVLYVNIGSLATMTSQQLGEFAWGLANSMCPFLWVIRPDILDRASGIVSEDYKKEIGGRGLLVSWCQQEKVLKHPSIGGFLTHCGWNSTLESLCEGVPMICWPFFAEQQTNCFYICNKWGIGMEIDFDVKRVEIGMMVKELMKGEKGLEMRNKVEDLMSKAIKATTPGGSSHTNFEMLMEDVAKW

SEQ ID NO: 5764 - protein, 358 aa, Ricinus communis
MTEMGQINCLITDAFLLFGGAIAEDLNVPWIPVWIPVPHSLSAHIYSDMIRKHYNINNLSSDNDSRDPENILEKIPGLGELRIADLPDEVLLNETQESLLCYMLSQVGNVLPQASALVMNFYKELYSTPLLDDLKTKFPSLLNVGFLTLSIPPCPLPLSNADATGCLSWLDSQKPTSVAYISFGTVVNIPSSEIVELAEALEETKLPFLWSLRDNLISKLPQGFLDRTKLDGKVVPWAPQNQVLAHNSINVYITHCGANSVYESMANGVPMICRPVFADNRINARIVEDIWGIGVRIDDGVFTKKGVIKSLELVLENEEGRRIRRKVHALQQLVFKAAKANGHAAQDFKTLVEKCSLK

SEQ ID NO: 5765 - protein, 424 aa, Theobroma cacao
MEELFSLTISLQAPFHRLLSDIKEKEGRPPLCTISDIFMGWAVEVAKSVGTINITFTTTGAYGGLAYFSLWLNLPHLRADSEELTIPGLPDRCRFHISQFHKFVRMADGSDPCSRFLQPQISQTFQSFGYLCHTAEEVEPLALEWLRNYIKLPIWAIGPLLPPVMLNKSPYSGSSMSKHRAGKQPGISLERCIEWLDLHCPDSVLYVSFGSQNTISPSQMMELAKGLEESRNPFIWVIRPPFGFDMKGEFKAEWLPEGFEERMSESKQGLLVRKWAPQVETLLHKSTGAFLSHCGWNSVLESLSQGVPIIGWPLVGEQPFNSKMLVEEMGVSVELTRGHDSTIEAKEAKKVIEMVMNKKGKGGEMRKKAVEIAEKIRAAVTEEGERKGSSITALDDFISAVLTKRFTSSLAANHSQGTSLILCH

SEQ ID NO: 5766 - protein, 478 aa, Unknown
  Description of Unknown: Oryza sativa Japonica Group sequence
MKKTMVLYPGLSVSHFLPMMKLADELVEHGYAVTVALIDDPLQKQIAFTATVDRVISSKPSICFHRLPRVDHLPAVTTNDGEFYLPGYLDLVRRHNEPLHGFLSSHFRGGIQALVVDMMSVEALDIAERLKVPGYLFHPSNASLFAFFLQIPSICAESKRSFSELGDTPLEIPGLPPMPASHFIDNRPEEPPESEVYKAVMDLVRRYTNKCSNGFLVNTVDSLEARVVNTLRHARRQGGRALPPFYCVGPLVNKAGERGERPERHECLAWLDRQPDRTVVFLCFGSTGIGNHSTEQLREIAVGLEKSGHRFLWVVRAPVVSDDPDRPDLDALLPAGFLERTSGQGAVVKQWAPQVDVLHHRATGAFVTHCGWNSVLEGITAGVPMLCWPLHSEQKMNKVLMVEEMGIAVEMVGWQQGLVTAEEVEAKVRLVMESEAGVELRARVTAHKEAAAVAWTDVGSSRAAFTEFLSNADSRQTS

SEQ ID NO: 5767 - protein, 456 aa, Crocus sativus
MNGSKGHVMVFCYPIQGHITPFVQFAKRLGNKGIVTTFIVADNHCDEGFTCNHFNLTAMASYPLDDGMFESDGFKVNFLEMINKFDSGANDEVTRMLDEYKIAIDPAKGLIHSPFLCFLSDIARNFQIYAVAMFTQPWLGVAGYYHLNRSAYDLPASHDCHTLASFPSMPVLCANDLPSFVSNLSCYPSLHELIIEQMSNLERGTGILPNTFGNLEEKVLKWMAQLWPVSLIAPLAPMFRMSKALQPDKSYDMDCATPRNADNCMEWLNSEPGDSVVYLSFGTIVNLCQKQLNEIAGLINCGRPFIWAVREEDQHTLPEGFLEEIKGRALVVGWGPQEKILAHGAVACFVTHCGWNSSLELLAAGVPAIAYGKLGDQITNAKFLTDVYGVGVRLRAPVTREEFLICVEEVTEGEKAERIRERSSEMKRAATEAVAEGGPSDKNIQAIGDEIMAIHE

SEQ ID NO: 5768 - protein, 481 aa, Vigna angularis
MESFHSSKPHIVCVPYPAQGHVNPLMKFAKLLHCKGFHVTFVNTEFNHNRFVRSHGADFVKGLQDFVFETIPDGLPPSDKDATQDIPLLCDSTRKNCYSPFKELVLKLNSSGDVPSITCIVADGVMGFAATVAKDLGIPEVQLWTASACGFVGYLQYDDLVDRGIVPFKDENFEIDGSLNQSLDWISGMKNIRLKDIPSFIRVTTLDDIMFDFLGSEAKNCWRSSSIIINTFEDLDGEALDALRAKNPNIYTIGPLDLLGRHFPEKDKGFMSGGSSLWKNDSNCLTWLDQWEPNSVVYVNYGSITVMTNHHLKEFAWGLANSNLPFLWIKRADVVLDESAALPQEFFDEIKDRGYITSWCMQEEVLSHPSVGVFLTHSGWNSTLESISAGVPMICWPFFAEQQTNSRYVSANWGIGMDVNHDVKREEITKLVTEMMKGEKGMQMRRKSLEWKKKAVRATDVGGSSYNNFYKLTKEVFHHAI

SEQ ID NO: 5769 - protein, 478 aa, Unknown
  Description of Unknown: Oryza sativa Japonica Group sequence
MRSRVVLYTWMVRGHLHPMTQLADRIANHGVPVTVAVADVPSSGESRKTVARLSAYYPSVSFQLLPPAAPARSGADTADPDADPFITLLADLRATNAALTAFVRSLPSVEALVIDFFCAYGLDAAAELGVPAYLFFVSCASALASYLHIPVMRSAVSFGQMGRSLLRIPGVHPIPASDLPEVLLLDRDKDQYKATIAFFEQLAKAKSVLVNTFEWLEPRAVKAIRDGIPRPGEPAPRLFCVGPLVGEERGGEEEKQECLRWLDAQPPRSVVFLCFGSASSVPAEQLKEIAVGLERSKHSFLWAVRAPVAADADSTKRLEGRGEAALESLLPEGFLDRTWGRGLVLPSWAPQVEVLRHPATGAFVTHCGWNSTLEAVTAGVPMVCWPMYAEQRMNKVFVVEEMKLGVVMDGYDDDGVVKAEEVETKVRLVMESEQGKQIRERMALAKQMATRAMEIGGSSTASFTDFLGGLKIAMDKDN

SEQ ID NO: 5770 - protein, 273 aa, Hibiscus syriacus
MFTTSMIDVANQLGIPCYLFFASPACFLGFMFHLPELGRQLTVDFVDLLPTSVLKRNKDGYFWYLEHACRYDETMGIVVNTFLELEPHAIDSLSFNGVPPAYPVGPIIDHAGAAQWHPDGAKQDSIMKWLDDQPPSSVVFLCFGSMGSLEVSQLREIAFGLEHSGYRFLWSIRKPPEGKLDLPGEYTNVADVLPLGFLDRTAGLGLVCGWVQQVRVLSHQAIGGFVSHCGSDYRDGSDLVASYEFERELRRLMDGEDEVKAKIKEMKIKSRWH

SEQ ID NO: 5771 - protein, 470 aa, Arabidopsis thaliana
MKVELVFIPSPGVGHIRATTALAKLLVASDNRLSVTLIVIPSRVSDDASSSVYTNSEDRLRYILLPARDQTTDLVSYIDSQKPQVRAVVSKVAGDVSTRSDSRLAGIVVDMFCTSMIDIADEFNLSAYIFYTSNASYLGLQFHVQSLYDEKELDVSEFKDTEMKFDVPTLTQPFPAKCLPSVMLNKKWFPYVLGRARSFRATKGILVNSVADMEPQALSFFSGGNGNTNIPPVYAVGPIMDLESSGDEEKRKEILHWLKEQPTKSVVFLCFGSMGGFSEEQAREIAVALERSGHRFLWSLRRASPVGNKSNPPPGEFTNLEEILPKGFLDRTVEIGKIISWAPQVDVLNSPAIGAFVTHCGWNSILESLWFGVPMAAWPIYAEQQFNAFHMVDELGLAAEVKKEYRRDFLVEEPEIVTADEIERGIKCAMEQDSKMRKRVMEMKDKLHVALVDGWIFELCSKEVCSRRGR

SEQ ID NO: 5772 - protein, 492 aa, Trifolium pratense
MKKAEVVFIPFPGVGHLVSTLEFAKLLINRDNRLRVTVLVIKFPHSTETDVYTKSLPISDSLHVINLPECSLPPNSDPVSARKALLEAQKPNVKEAVSNLTTGAENGVLAAFVVDMFCTTMIDVAKEFSVPTLVFFTSGVAFLGLSLHLHTLRERDNVDSTQLQQLTELAVPSFTNLVPSKSLPSSVLRKEWESFMMDFWKGLKNADGFIVNSFEELESHAVHSFLSDPSLAGFPIYPAGPLLNLEPKTKGTVVSNDIIKWLDDQPPSSVVFLCFGSMGSFDEDQVKEIACAIENSGARFIWSLRKPPPKGTMNIPPTDYTLSDLGSILPEGFLDRTAEIGRVIGWSPQTQILAHPATGGFASHCGWNSTLESIYFGVPIATWPLYAEQQTNAFELVHELKMGVEIALDYRVEFNGVPNYLVTADKIERGIRSVLDTDGEVRKNVKEMSEKSRKTLLEGGSSYTYLGRLIDYIMNQINNFHGDFGQEAYNHS

SEQ ID NO: 5773 - protein, 469 aa, Brachypodium distachyon
MDSTGKSAMATSEGPSILFLPFPGAQGHTNPMLQFGRRLAYQYGFRPTLVVTRHVLSRAPPPDAPFHVAAISDGFDASGMPSCFDMAEYLRRLEAAGSDALARLISDEARAGRPVRVLVYDPHVAWARRVAGDAGVPAAAFFSQPCSVNIFYGELHAGRMAMPVTEADARALLARGALGVELGMEDLPPFVAVPELQPVLTKASIGKFEGLEDADDVLVNSFRDIEPTEVEYMESTWRAKTIGPSLPSFYLDDDRLPSSKSYGFNLFNGDDVVCMEWLEKQTISSIVLASYGTFSEYDESQLEELGNGLCSSGKPFLWVVRSNEAHKLSEELKTKCKKNGLIVSWCPQLEVLSHKAIGCFLTHCGWNSTLEAMVNGVPLVGIPHWADQLTIVKYVESAWDMGVRVQKGLNGQVRREEVERCIKEVMDGERKDEYKRNVAKWMQKAKEAMRPGGSSDNHIAEFAAKYSSS

SEQ ID NO: 5774 - protein, 471 aa, Citrus unshiu
MAQVKHHVACMPSPGMGHLIPHVELAKQLVLRHDISVTFLVPTIGPPSKAITSVLQGLPEHINHVLLPPVNFEEDVKAEIQIVLAIKRSLSSVRDVFKSLVASTHLMALVVDPFGTDVFDVAREFYVPSYLYFLTNALSLSLLHYMPKLDEVISCEVRDMEQPLKLPGFTIPIHGRDFPDPLQDRKNDAYRFMIQMRKRYSLADGILINTFMELEPGVIKALQEEPSMRSIYPIGPIIRTVSDGELVDGSESHQCMCIRWLDNQASGSVLFVSFGSGGTLSYDQLEELALGLELSEQQFLWVVKSPDDKSASGSFFDVHSKTDPFGFLPTGFLDRTKEQGLVVPSWAPQVEVLGHPSTGGFLTHCGWNSTLESIVHGVPLIAWPLYAEQRLNAVILSEDLNVALRPPENENGLIRREEIAKVIKGLMHGEDGVIIRDRMNRLKDAAAAAVSDGGSSTKTLSQLVHKWKNQN

SEQ ID NO: 5775 - protein, 477 aa, Centella asiatica
MKTAEVVFIPAWGISHLVPMVEMAKLFITRHEQLSVTILIMKYDTDNGISPYVNSLLVSKIQRLSIVEVPQRDSKTYVSKHRSTRFSAFVETQKAHARDIILSIASSKTTRLVGCIIDMFCFTLADIADEVNVPTYVFSPASASFLGLMFYLQNLSDDHNQDITLFKNSETKFSVPSYTDPVPAKVLPLVLLDEEGGSDLFLSIARRLRDVKGILVNTFMELESHALESLASDCKIPTFYPVGPILNFTREGGNVEETVTVLCWLDKQPPSSVVFMCFGSHGSFQVHQVKEIALAVERSGRRFIWSLRPPPSEGETEVPREYSYLDEVLPSGFLDRTAEFGKVIGWAPQVSVLSHQAVGGFVSHCGWNSILESLWFGVPMAAWPLYAEQQVNAFKLVIELGLAVDIKMDYRNESGANKKVIVSADEIDRKISELMMDGSENEVRKKVAEMKEKSRLAVSENGSSYTSIGRLIKEMIS

SEQ ID NO: 5776 - protein, 473 aa, Cyclamen persicum
MANGTSPHVVLVPSPGMGHLIPLGELAKRLVLNHGLTATFVIPTDSPLSAAQKGFLEALPRGIDHLVLPPADLDDLPSDVKAETVICLTIVRSLHNLRAAIKSLKATNRLVAMVVDLFGTDAFEIAKEVNISPYIFYPSTAMALSFFLYLPTLDHSTPSEYRDLPDPVQIPGCIPIHGSDLLDPAQDRKNDAYKWLLHHAKRYTLAEGIMVNSFKELEPGAIGALQEEGSGNPPVYPVGPLVKMGHARGMVDRSGCLEWLDGQPHGSVLFISFGSGGTLSSEQTTELALGLELSEQKFLWIVRSPNDKTSDAAFFNPNAENDPSTYLPKGFLERTKGVGLVLPSWAPQAQILSHGSTGGFLTHCGWNSTLESVVNGVPLIAWPLYAEQKMNAVMLTEDIKVALRPKCSKSGLVERAEIAKIVKSLMEGEEGKRLRSRMRDLKNVSEKRLSADGESTKMLRELTQKWKNKAVGN

SEQ ID NO: 5777 - protein, 482 aa, Cephalotus follicularis
MQPTKPHAALLASPGMGHLIPVLELGNRLVSNYGFNVTIFVLQADDSTAQSQFLKSLHPTLLNIVSLPSVDISSLVAPDAQVAAKVAVMMRESLPALRSTINSMNFRPTALIVDLFGTEALAIANEYDMLKYVLIASNAWFLAATIFFPTLNRKEEDEIIKQKQALKIPGCKPVRFDDTLEAFLDRKNQGYDEYVRVGLEIPMADGILVNTWEDLEPTTLKALRDSKLLGRVTRVPVYPIGPLTRSVKPQVLGNQLMDWLNMQPLQSVIYISFGSGGTLSANQTTELAWGLELSKQRFIWVVRPPMDDDVSGAFFDVGNGHDGTPTYLPDGFVSRTKNVGRLVPMWAPQAEILSHSSIGGFLSHCGWNSTLESIVNGVPMIAWPLFSEQHMNATMLTEELGVVVRSEELPSKRILGREEIGKMVRKIMVYKEGHGIRNRVKELKYSASKALSIGDSSFNSLSQVANDVNSGLQFLKSMPQGA

SEQ ID NO: 5778 - protein, 476 aa, Trifolium pratense
MKKAQVVFIPFPVPSHLVSTLEFAKLLINHDNRLRITILLIKFPHTTETDVYTKSLPISDSLNFINLPECSLPPDTKPNLAMHALIEAQKPNIKQTVSDLTAGEGQHGHLAAFVVDMFCTNMIDIAKEFSVPTLVFSTSGVASLGLNLYLHTLREKVDLNQLLKHTEFSIPSFANSVPSYSLPGSVLNKEWEMFFMSYCRGLKNADGIIVNSFEELESYAVQSFYSHPELASLPIIYPVGPILNPEPKTKGTVDSDDIIKWLDDQPPSSVVFLCFGSMGSFDEDQVKEIAHAVENSGARFVWALRKPKPKGVMPAPTDYPLSELLSILPEGFLDRTAEIGKVIGWAPQTQILAHPATGGFVSHCGWNSTLESIYFGVPIATWPLFAEQQTNAFELVHELKIGVEIALDYKVDFNGGPNYLVTADKIEKGITNVLDTDGEVRKNMKEMSEKSKKTLSEGGSSYTYLGRLIDYIMNQV

SEQ ID NO: 5779 - protein, 484 aa, Cephalotus follicularis
MGSTGINKPHVVCIPFPAQGHVNPFMQLAKLLHARGCHITFVNTEFNHSRLVRSKGPDAVKDMPGFRFETIPDGMPPSNPDATQSVTYLLYYTKKHSVAPLRDLIVKLNSMEGLPPISCIISDGIMSFGIKVARELGIPEIQLWTASSCGFLSYLQFGELVKKGIFPLKDESDIINGHLETPLEWIPSMAHMRMKDMPSFVRSTDPHDIAFNRWLEEGEDNLKADAILFNSFYEFEHEVLKEISSFYPQIYCIGPLSTLCKTLPQSEITSRRSSLWKENTDCLTWLDKHKPNSVLYVNFGSIAMMTEDNFKEFALGLTNSGHPVLWILRSDVVMGHAATLTQDFLKETSERLLIVSWCPQDRVLTHPSIGAFLTHSGWNSTLEGICGGVPMICWPFFAEQQVNCRYACTTWGVGLEIDNNVTRREVEEVVREMMDGEKGMELRNKALEWKNKSDVAATQGGSSHHDFNRFVDYLFQLSINGKRP

SEQ ID NO: 5780 - protein, 495 aa, Vigna angularis
MVLQTNNIPHFVLFPMMAQGHIIPMMDIARILAQRGVIITVFTTPKNASRFNSVISRAVSSGLKIRLVQLNFPSKEAGLREGCENLDMVSSNDMSKIFQVIHMLQKPAEEFFQTLTPKPSCIISDFCIAWTLQLAEKYHIPRVSFHGFSCFCLHCRYVIHTSDFCRSITSESKYFTIPGIPDKIQVTKEQLPGSLATDLDDFKDQVRDAEKKSYGVIVNTFEELEKAYVRDFKKVKNNKAWFIGPVSLCNKDGLDKAQRGKQASINENHCLKWLDVQQAKSVVYVCFGSICNLIPSQLVELALALEDTKRPFVWVIREGSQLQELEKWFSEEGFEERTKGRGLIIGGWAPQVMILSHPSIGGFLTHCGWNSTLEGICAGVPLVTWPLFGDQFLNEKLVSDVLRIGVSVGAEVPLKWGEEEKRGVMVKKDDIKRAICMVMDDDEEGKERRERVCKLSEMGKRAVEEGGSSHLDVTLLIQDIMQQTNTKEDENLSDV

SEQ ID NO: 5781 - protein, 472 aa, Pueraria montana
MKDTIVLYPNIGRGHLVSMVELGKLILTHHPSLSITILILTPSTTPSTTTFACDSNAQYIATVTATIPAITFHHVPLATLPSNTPSLPPHLVSLELARHSTQNVAVAFQTLAKASNLKAIIIDLLNFNDPKTLTQNLNKNIHTYFYYTSGASTLALLLHYPTIHETLTKNYVKDQPLQIQIPGLRANITTDDFAKDSKDPSNYSSQAFLKIAETMRGSFGIIINTFEAIEEELIRALSEDGTVPPLFCIGPVISAPYGEDDKGCLSWLDSQPSQSVVLLCFGSMGSFSRTQLKEIAVGLEKSEQRFLWVVRAELDCADSVDEQPSLDELMPGGFLERTKEKGLVVRDWAPQVQILSHDSVGGFVTHCGWNSVLEAVCEGVPMAAWPLYAEQRVNRVIMVEDMKVALAVNEDKAGFVSATELGDRVRELMESDKGKEIRQRTFKMKISAAEAMAEGGTSRVALDKLAKLWKES

SEQ ID NO: 5782 - protein, 583 aa, Rosa chinensis
MANEIWIVPFFGQSHLFPLMELCKHLASRNFKAVFVISSEFSSSIPSSLRQYPLVEIAEISEAPPSDSSSPPQEPSSQPLHKHHARYSQIAVGLDKLLHDPDSVRRPLCAVVDMMMSWTSEIFNRYEIPAVNFFTSGACSAAMDYAMWKSHPLDDFKSGETRLLSGLPEEMAITVSDLKRQSRDGPQGGSSEGFPRLQPPRTKFGPQRHHPACPGAKPPWVEEVEPCVAVMINTCDDLEHPFIKYVSDKIEKPVWGVGPLLPEQYWKSVGSVLHDREIRTNRKSNLTDDEVNRWLQGRSQDKGYLGYSPRENLPQNRPGVVDSPLLTFSASPPVALCSCPHFASPSRVPAFQVRLVSPAVRQSAEPPPPPPSHLHSSTASLRLPQFQGFNPDPRDEHEILAEALEASARPFIWVVQANAGLWPGPRRPALPDSEPEEAYFPHGLDARVGKRGLIIPGWAPQLLILSHPSTGGFLSHCGWNSTVEAIGRGVPFLAWPFRGDQYPNAKLVVSHLKVGYLISEDLSQTIEEEDITRGIEKLLSDEDMKQRAVKLSAKFEHGFPTSSVAALDAFGDFLGRKNKASCR

SEQ ID NO: 5783 - protein, 491 aa, Vigna angularis
MAISRTHHHAFLLPSPGMGHIIPALELAKRLVTHKIIPKLTFFYTPIANSNPSKAETLVLHSAIKENLFDIIQQHPLDLTSEVDPDASAEDKIAILMHELPLLFVSTISTMNLNPTIIITDFFICQALPLVQNLNLPMFAFSPTNAWLVALGLHTPTLDKQIQGEYVDEIEPISIPGCKPIYPKDMFDMLKDRTHRLYREFIGACEGAALANAIFVNTFHELEPKTLEALGSGGISTVPVYPVGPIIREPSPRSPSPSPSPSSDEGKRSEIVEWLNRQEEESVVFVSLGSGYTMSGEEIKEMALALELSENKFVWSLRPSVNKAGHDHYLTAGDETGSTTSTVSNVEKSDLFPDEYHRIQRNGIVITDWAPQLDILKHPSIGGFVSHCGWNSVMESVSCGVPIVGLPIFADQMMNATMLVEEVGNAVRVKASPSTNMVQGDELGKAIRKIMNKDDKEGCVIRERAKQLKHLAERAWSHDGSSYSALSKIAL

SEQ ID NO: 5784 - protein, 469 aa, Vitis vinifera
MGSPHFLLVTFPAQGHINPALQFAKRIIRTGAQVSFATSVSAHRRMAKRSTPEGLNFVPFSDGYDDGFKPTDDVQHYMSEIKRRGSETLREIVVRNADEGQPFTCIVYTLLLPWAAEVARGLGVPSALLWIQPATVLDIYYYYFNGYGDVFRNISNEPSCSVELPGLPLLSSRDLPSFLVKSNAYTFVLPTFQEQLEALSQETSPKVLVNTFDALEPEPLRAVDKLHLIGIGPLVPSAYLDGKDPSDTSFGGDMFQGSDDYMEWLNSKPKSSVVYVSFGSISVLSKTQKEDIARALLDCGHPFLWVIRAPENGEEVKEQDKLSCREELEQKGMIVSWCSQIEVLTHPSLGCFVSHCGWNSTLESLVSGVPVVAFPQWTDQGTNAKLIEDMWKIGIRVTVNEEGIVESDEFKRCLEIVMGGGEKGEEMRRNAEKWKNLAREAVKDGGSSDKNLKGFVDEVGHGCYESIGS

SEQ ID NO: 5785 - protein, 319 aa, Unknown
  Description of Unknown: Oryza sativa Japonica Group sequence
FVGGNVWWWVHAEPRKDTITYVPGVEAIEPGELMSYLQDTDTTTVVHRIIFRAFEEARGADYVVCNTVEELEPSTIAALRRERPFYAVGPILPAGFARSAVATSMWAESDCSRWLAAQPPRSVLYVSFGSYAHVTRRELHEIARGVLASGARFLWVMRPDIVSSDDPDPLPDGFAAAAAADGRGVVVPWCCQVEVLAHPAVAAFLTHCGWNSILESAWAGVPMLCFPLLTDQFTNRRLVVREWRAGVAVGDRGAVDAGEVRARIEGVMHGEEGEVLREQVGKMRATLHAAVAPGGSSRRGFDELVDELKRRCGGGGGRH

SEQ ID NO: 5786 - protein, 487 aa, Unknown
  Description of Unknown: Fragaria x ananassa sequence
MAMETKSCQQLHIFFLPFMARGHSIPLTDIAKLFSSHGARCTIVTTPLNAPLFSKATQRGEIELVLIKFPSAEAGLPQDCESADLITTQDMLGKFVKATFLIEPHFEKILDEHRPHCLVADAFFTWATDVAAKFRIPRLYFHGTGFFALCASLSVMMYQPHSNLSSDSESFVIPNLPDEIKMTRSQLPVFPDESEFMKMLKASIEIEERSYGVIVNSFYELEPAYANHYRKVFGRKAWHIGPVSFCNKAIEDKAERGSIKSSTAEKHECLKWLDSKKPRSVVYVSFGSMVRFADSQLLEIATGLEASGQDFIWVVKKEKKEVEEWLPEGFEKRMEGKGLIIRDWAPQVLILEHEAIGAFVTHCGWNSILEAVSAGVPMITWPVFGEQFYNEKLVTEIHRIGVPVGSEKWALSFVDVNAETEGRVRREAIEEAVTRIMVGDEAVETRSRVKELGENARRAVEEGGSSFLDLSALVGELNDLAFGGLVE

SEQ ID NO: 5787 - protein, 498 aa, Helianthus annuus
MSTHKHKHIQSHKQMASSLPVDSTHRPHIVLFPFMSKGHTIPLLHLARMLVTRGITVTIFTTKANKPFIAQVLETCPDGNSISIIHLPFPSNIDGIPHGIESTDKLPSISLFPQFAAATKHMQPHFEMSLKNLGNVTCIVSDGFLSWTLASANKFGIPRLSFYGMNAYSTAVQHSVTVNQSLWGPESDDELITVPGFPWIQITRNDIDYPFTQRNPSGPFHDFIMESFVTSINSYGTIVNTFQELEPRFIDYINREMKPTPWCVGPLCLAEPFGCSDKQPNGSNSSKWITWLDQKLLQGCSVLYVAFGSQAEISTQQMEAISKGLEQSEVNFLWVVRNCESNVLSELGDKVGDRGMIVTEWVNQMEILKHESVNGFVSHCGWNSVLESICAGVPILAWPMMAEQPLNARMVVDEIKIGLRVETCDGSVRGFVKADGLKKMVKELMEGEKGKEVRKRVKEVGAAAKAAVADGGSSWRTLNELINEVESVRNKGKSDGEM

SEQ ID NO: 5788 - protein, 462 aa, Helianthus annuus
MEPEPPQTKHIIMLPFMAQGHLIPFLELAHHILNHNPTFTITIVNTPLNIHYLRSATTNHPSPPTQLHLKPLPFNSSDHHLPPNSENTDGLPLTQIIKLFHASAALEQPFRKFIHDVVVSEKRNKVCIVSDIFMAWANDVAKSFNIFNYTFSTGGAYGTAAFCSIWLNLPHRSLSGGTHDEFSVPGFPESSRFSITQLHQFLRAADGKDEWSRFFQVQISLSLKSNGWLCNTVEEMEPLGLDVLRNYIKLPVWCIGPLIPFKMLKKNLGSDTGVIGPRSGKQPGIQPEHCIEWLDSRATGSVLYISFGSQNTIGESQMMELAKGLEETKRPFIWVIRPPIGFDLKGDFRAKWLPNGFKDRIGKQGLVVHNWAPQLEILCHRATGAFLSHCGWNSVMESLSQGVPIIGWPMAAEQGYNAKMLVEEMGVCEVLTRGVHSRITKEEVSRVINVVLDKSEGGKVKI

SEQ ID NO: 5789 - protein, 346 aa, Manihot esculenta
FCTPMMDLADEFGIPSYIFFASGGGFLGFMLYVQKIHDEENFNPIEFKDSDTELIVPSLVNPFPTRILPSSILNKERFGQLLAIAKKFRQAKGIIVNTFLELESRAIESFKVPPLYHVGPILDVKSDGRNTHPEIMQWLDDQPEGSVVFLCFGSMGSFSEDQLKEIAYALENSGHRFLWSIRRPPPPDKIASPTDYEDPRDVLPEGFLERTVAVGKVIGWAPQVAVLAHPAIGGFVSHCGWNSVLESLWFGVPIATWPMYAEQQFNAFEMVVELGLGVEIDMGYRKESGIIVNSDKIERAIRKLMENSDEKRKKVKEMREKSKMALIDGGSSFISLGDFIKDAMEG

SEQ ID NO: 5790 - protein, 476 aa, Citrus unshiu
MAAESLQPHVAVLPSPGLGHLIPLLEFAKRLVLNHGVHVSFLVITTNEASAAKDKLLRSLPHGLDVVDLPPVDVSAVTSDDMPVVTRLHAIVEESLSKSLKSVLTELCNPNALVIDLFCTQAFEICSQLSIPTYSFVTTSVHFFAFITYLPTLDHEVQGEFVDLPEPIKIPGCPPVRPEDLLDQVRNRKIDEYKFFLLHVSRLPLAAGIFLNSWENLEFVPLKAIGEHSFYLQIPTPPINPIGPLIKQDEPLSASDEECLAWLDKQPPDSVLFAVPGSGGTLTAEQVTEMAWGLEQSKQRFIWVVRMPSDASASATFFNVGSDVNDPKAYLPEGFLQRTRAQGAGMVVPSWAPQVHILRHPSTGGFLSHCGWNSTLESICHGVPMIAWPLYAEQRMNAAMLTAEETGVAVKPETEPGKKVIGREEIERVVRLVMESEEGKVMRRRVQELKESASRELGDGGSSSDSLASFIKKCKH

SEQ ID NO: 5791 - protein, 466 aa, Nicotiana sylvestris
MAKMKENCHVLLVTFPSQGQINPSLQFAKRLIKLGVNVTFSTSLSALNCMSNNLSSIKGLTFAPFSDGYDNGYPNVGKSLDEYREFYASFIALGSEFVSEIFADRAKEGRPFSRIIYTTVLSWVGIVAKRLNAPATLLWIQPATLLDLYYYYFTSYKDAFKNCPDEDKSLEIPGLPFLVSIREIPSFLLSSDGLMDWLIQTMKEHVELINSESNEIVLVNTFDALEFEALRAIKNVNMVGIGPLVPSSFLDGKNPSDTSHGGDLRQRSKDYMEWLNAKPNASVVYVAFGSYSELPKQMMEEIAQGLIGSERPFLWVINGEKPMENLSCKEELEKQGKIVSWCSQVEVLQHPSLGCFLTHCGWNSTLESLVFGIPVVACPLWTDQGCNSTLIQDIWKTGVRVNANEEGVEGAEFKRCIEIVMGDGKEGEELRKKAKKWRDLAKDAMKEDGSSNENLKAYVDEILNHA

SEQ ID NO: 5792 - protein, 543 aa, Citrus unshiu
MGLGVTDLWSLHSSSSCTGQKCYVMMCVDNYSTELIGIHDVIRMSHSYLASFLSTRNLKPKAVNKNRRHVVLLPYPSQGHINPLLQFAKRLASKGVKATLATTHYTAKSICAPHVGVEPISDGFDEGGYAQAKNEDLYLKSFEDNGSRTLSELIKRYKNSSFPVNCVVYDSFLPWALDVAKEYGLYGAAFFTNSATVCNIFCRMHHGLLTLPVKLEDTPLSIPGLPSLNFIDLPTFVKFPESYPAYLAMKLGQYSNLDKADWIFGNTFQELEGEGARSISELWPGKLIGPMVPSAYLDGRIKGDSGYGSSLWQPLSEECSEWLETKPQQSVVYISFGSMVSLTAEQMEEIALALKDSSLDFLWVVRESQQEKLPNWFMDSTKQKGLVVSWCNQLEVLEHPAVGCFVTHCGWNSTLEGLSLGVPMIGLPQWADQLTDAKYIEEVWGIGVRAKEDEKGIVRKEEILKCFKEVMEGERSQVIKKNASEWKKKSEKAMREGGSSDQNICDFVNALMCSSNGKLKHSNDNCVQAWMPVAKRCLRQTPR

SEQ ID NO: 5793 - protein, 457 aa, Zostera marina
MANNPPHVVILPSPGMGHLIPLAEFAKLLTTNYGVNVTFLTLDDSPQIKSFINALPDTITYIPLPIPDLPPTEIAVKRMILIVAHCLPFLREVMAKLKASTNLVAFVVDLMGTKTFEVAKELGVSPYIMFPSTATFLNLIFHLPELDRTIQGEYKDHPHLIQIPGSAPIHGKDFPMPFLQDRKSQAYISSFQICVRFKEAAGIFINSASAIESGPIKALMNMNSPPVYPIGPLVHDTNSEDDSSGCIKWLDEQLPGSVLFVSFGSGGRLSSEQFTELAVGLEMRGHRFLWIARSPTETEERGFFEVKSKSDPLLFLPDGFLERTKEIGLVVDSWAPQLAILKHAAIGGFLTHCGWNSSLESIVHSVPMIAWPLYAEQNMNAAMLAGELKIAIRPVVDEKRGLIGRDEISKVVRELMEGEEGKKLRIHVKRIAENAIKEDSYRSLDPIVNIWKNNIST

SEQ ID NO: 5794 - protein, 476 aa, Helianthus annuus
MANTVAELVFIPAPAVGHIMSTIEMAKVLLNRDQRLSINVLLISPPYPVPALTTYIESLAKNTIERIQFIELPKDQTPPKLDPKAFLTSLYEFYSSHCKHVRNIVADMINQTGSGRVVGFVVDVFCTGMIDVANEFNLPTYVFFTSSSAFLGFNLYIETLCVDHNQDHVMELSNSGGEMVVPSFVNPVPKKAFPAMYEIQDGLDMLINSFRELRKAKGIMVNTFLELETHAMKSFTDTNFPPVYPVGPLLNLDGVAGKADDMDVIKWLDSQPPLSVVVLCFGSMGSFSEVQVKEIALGLEQSGHRFVWSLCLTPSKEQLLDDPRELLPDGFLERTVGIGKVIGWAPQVSLLSHEAVGGFVSHCGWNSMLESLWFGVPTATWPMYAEQQLNAFEMVVELGLAIDLKMDYKIDMFNPAAIVVVTAEEIENGITRLMEDNNVRAKVKEISKLSRVTVAEGGSSYALVDYLVQEIMSNII

SEQ ID NO: 5795 - protein, 644 aa, Drosophila guanche
MRLLQLLLPLSLLCGAISCANILAVLPSVWKSHYLFGRRLLQELVASPRNHSVTLISPHAVEAGGMDGDVELPNIREIRIEGLKDNWVGMGMSFEPEQMRAQSVMERFTRLIYAGTTNVDLLLSDQQVRKLMNSGEMFDLLIVDLFLSDALLGLAYYYGIPTVAISPTGANSWLNNMFGNPQSSSLDPSNFLPFTERMNTQQRIVNSLMSTFERLTYNFFHLISQQTVYSKHFELLVQELPQYRDLTKNLSLALINSHPGLSYPRAYLPNMVEVGGLHLTQHKEQLLLPNHLLSFMEGAAGGVIYMSLGADVQTAKLPNEKLAIVMDVFGHLKEFHFVLKWENEDFVSNLELPENVMIANWWPQQAILSHPLVKLFISSCGQLSVWESIMGDTPILAIPILAEQEVMAKRLQLHGVSLTVNYDTIAYDSLLHGIRQLTLNTSYAESLTQLKKRLMGGSSPSVLAVGQIELILDSGGADFLKSHANTLNYWRLEGLDVLVIITIGFVGILTVPFLVISCILRKSYYSETCQQPVHRSTLKVVGRVHSYGEPGTFSTATSTEPLRRTRSAQSLSARSSTSSFSSETTASTTPLDMTPPPPVAQLLGHVPSPLQLYVNQQQHQQQRHQRRIYSNKASQEDNTERRFS

SEQ ID NO: 5796 - protein, 482 aa, Medicago truncatula
MNLASNFMDKTIHIAVVPGVGYGHLVPILHFSKLLIQLHPDIHVTCIIPTLGSPPSSSETILQTLPSNIDYMFLPEVQPSDLPQGLPMEIQIQLTVTNSLPYLHEALKSLALRIPLVALVVDAFAVEALNFAKEFNMLSYIYFCAAASTLAWSFYLPKLDEETTCEYRDLPEPIKVPGCVPLHGRDLLTIVQDRSSQAYKYFLQHVKSLSFADGVLVNSFLEMEMGPINALTEEGSGNPSVYPVGPIIQTVTGSVDDANGLECLSWLDKQQSCSVLYVSFGSGGTLSHEQIVELALGLELSNQKFLWVVRAPSSSSSNAAYLSAQNDVDALQFLPSGFLERTKEEGFVITSWAPQIQILSHSSVGGFLSHCGWSSTLESVVHGVPLITWPMFAEQGMNAVLVTEGLKVGLRPRVNENGIVERVEVAKVIKRLMEGEECEKLHNNMKELKEVASNALKEDGSSTKTISQLTLKWRNLVQKNQI

SEQ ID NO: 5797 - protein, 478 aa, Unknown
  Description of Unknown: Oryza sativa Japonica Group sequence
MKQTVVLYPGGGVGHVVPMLELAKVFVKHGHDVTMVLLEPPFKSSDSGALAVERLVASNPSVSFHVLPPLPAPDFASFGKHPFLLVIQLLRQYNERLESFLLSIPRQRLHSLVIDMFCVDAIDVCAKLGVPVYTFFASGVSVLSVLTQLPPFLAGRETGLKELGDTPLDFLGVSPMPASHLVKELLEHPEDELCKAMVNRWERNTETMGVLVNSFESLESRAAQALRDDPLCVPGKVLPPIYCVGPLVGGGAEEAAERHECLVWLDAQPEHSVVFLCFGSKGVFSAEQLKEIAVGLENSRQRFMWVVRTPPTTTEGLKKYFEQRAAPDLDALFPDGFVERTKDRGFIVTTWAPQVDVLRHRATGAFVTHCGWNSALEGITAGVPMLCWPQYAEQKMNKVFMTAEMGVGVELDGYNSDFVKAEELEAKVRLVMESEEGKQLRARSAARKKEAEAALEEGGSSHAAFVQFLSDVENLVQN

SEQ ID NO: 5798 - protein, 276 aa, Vigna angularis
MMMEDSLKLTKLDGVFINSFEELEGEALAALNEGKVVRGMPPVYAIGPLMTCEFENVDQGQKGCMSWILEWLNERAEGSVVYVSLGSRTETRREQIKDMALGLIECGYSFLWVVKLKRVDREEDEGLEDVLGSELMGKVRERGVVVKEFVDQMKILGHPAVGGFVTHGGWNSITENIREGVNILTWPQGGDQKINAEVVRMSGVGIWAEEWGWGTQKVVEGKEIAKRIKEMMSNESLRVKAGEMKEAARKACGVGGSCEVIVKRLIEEWKRNAQVN

SEQ ID NO: 5799 - protein, 468 aa, Gossypium raimondii
MSQPHFLLVTFPAQGHINPTLQFAKHLIRIGVRVTFITCISAHRRMSKVPTAQGLTFLPFSDGYDDECQPGDDIDHYLSELRRRGKEAVSEFITSSENEGKPVTCIVYTLFIHWASEVARKHHIPTALLWIQPATVFDIYYFYFNGHESTFKAQADEKNPKRSIKLPGLPLLATRDLPSFLTALNVYRWALSLIQEQMDVVADESNPKILVNTFDALEHEALNAIENFIMVGIGPLIPSSFLNSNDSLDNSLRTDLFQSDSKDYLQWLDSKPKSAVVYVSFGSIAVLTEQQVEEIARALISSRRPFLWVVRNRKDGGEEEKEEDKLTCREELEQFGMVVPWCSQVEVLFHPSLGCFVTHCGWNSRLESMVAGVPVVAFPQWTTAKLIEDVWGNGVRVSANEEGMVERDEIVRCLDLVMGDDEKGMEVKKNVEKWKGLASEAAMEGGSMDMNLKAFVDDIAEGCLLTDE

SEQ ID NO: 5800 - protein, 768 aa, Citrus unshiu
MADHNNKTIVLYPSPGRSHLVPMIELGKLILTHHPSFSITMIVPTFPNTVAGDTSHYIFAVSGITFHHLPTVSDELGLKYYPSIDEVTRLRDRLAELNNSNLRQTLLTLFKTLTLKALVIDFFCKAALQVSSSLNIPTYFFFTSGATALAQILHYPNLKNITDNDCFRVDAESEMLLDHIPGLPPIRAKEMFPPDDSVLKNTIDTAIQMTKSCGIIINTFETLEQRASQALKDGKCVPNGETMPPVYCLGPVLAATVDNKNDYHMCLSWLDLQPKQSVVFLCFGSMVFFSSKQLKEMAIGLERSRVRFLWVVRVPPPEDEFRRNLAVADAEVSVEMFLPEDFLERTRDRGLVVKSWAPQTDVLSHDSVGGFVTHCGWNSVIEALCAGVPMVAWPFIGDQMVNRSFLVEDIEVAVPVVESEDGLVYGAELEKRVIELMDSENGKGKVLRERTRALKEKAMGALREGGCSLAALAELAARFDKEWRSSHLLSMDELGKLILTHYPYFSVTIIISTFPTPNLHKTLIIQSKTSNLKTLIIDFFHKVALQVSCSLNIPTYLFYASSASALAQVLYLPNTYGTTNGLKDPQMQMPPLYCTGAILAATSSDNKNDDHTCFSWLDKQPKMAMRLKRSGAAFLWVVLFPPLEDEFRQTLTVADAEASAELFLPEGFVERTRDWGLPVKSWAPQVDVLSHDSVVAVRTGVPMVAWPSNGDQMVNMAFLVEKIRDPLTVAERRVIEGIRAPKEQAVGALSEGGRSLAVVAELAESFRK

SEQ ID NO: 5801 - protein, 301 aa, Vigna angularis
MCNPTWFPFQTTLHLRPYEIIRAMISRKDVDTGRTASFDLGKVYSSCDMFLLRTCRELEGEWLDYLAGRYNMPVIPVGLVPPSIQIKDVGEEDRNPDWVKIKEWLDSRESSSVVYIAFGSELELSQEDLTELAHGIEFSKLPFFWALKKVKGDSAELPEGFEERTKDRGFVWKSWAPQTKILGHAAIGGCITHCGTNSLVEMLNFGHVLVTIPYLLDQALFSRVVEEKKVGIEVARSKEDGSFTRESVAKTLRFAMVDEEGSSYRNNAKQMGKLFSSTYIHNQYIDDCILALQNYKAPSNT

SEQ ID NO: 5802 - protein, 233 aa, Spatholobus suberectus
MNALSSILPHVYRVGPFLSFLNQSPQNHLASLGSNLWKEDTEFLKWLESKEPESVVYVNFGNTTVMSPEQLFEFAWDEGLIGSWCPQEQVLNHPSVGGFLTYYGWNSTIESICAGVPMLCWPIVADRPTNCRYICNEWGIGIEIDTNVKREEMEKVINELMVGKKAKTMRQKVMELRKKAEEYTKLGGRSYMNLDIVISEVLLKQNLMLLKQNLIEESFFSIMQYCDNSLFFP

SEQ ID NO: 5803 - protein, 495 aa, Cephalotus follicularis
MASQSYQPHFILIPLMTQGHLIPMVDIARLLAQRDVTVTIVTTPHNFARFGSIIDRDIRSGKQINVLQLPFQSTENGLPEGCENVDTLPSPSLIPNLMAAIAMLQKPLEQLFEELKPSPSCIVTDKYLAWTADTAAKFKIPRIVFDGTSCFASLCSHNLDISKVYEKVSESSETFVVPGLPDRIEFTRAQLPGSFNPGSLLDLKKFRDKIRAAEAEEYGVLVNTFEELEPEYAKGYQKAKGKKVWCIGPVSLCNKELLDRAQRGNKASTDENQCLKWLDSWAPNSVIYACFGSINRITPPQLIELGLGLEATNRPFIWVIRGAYKKEDIEKWLIEDGFEERVRGRGLIIRGWSPQVLILSHPAIGGFLTHCGWNSTTEGICAGVPMITWPLFAEQFYNEKFVVQILDIGVRVGAEVVVHMGEEDKVGVVVKREQVKEAIEKIMGEGKEREERRERAKNLAKMANKAVDEGGSSYLHLTLFIEDVIHQVRDKNVRL

SEQ ID NO: 5804 - protein, 486 aa, Helianthus annuus
MAKTVAKLVFIPAPGLGHIMSTIEIAKVLANRDQRLSVTVLIIKPPNSSSNSPVTTYIGSLAKRSMDRISFIELPQHETPTTRDSKGPLASFAEYMNNHREYVRNIVGGMISQPGQSRIVGFVIDMFCLCMIDVANEFDIPTYVFFTSSAAFLGLKLYIQTLCDDHNQDVVELSHSNTEIAVPTFVKLVPTKVFPNMAQTRETLEFLLSSARRLREVKAIIVNSFSELETHAIESLSSDNSIPTLYPVGPILNLESGSGAEKPLDDDLIRWLDNQPPSSVVFLCFGSMGSFEEVQVKEIARALEHSGHRFVWSLRQPPVDKRSRLTRDYEDPGVVLPEGFLERMAAIGKVIGWAPQVAVLGHCAVGGFVSHCGWNSLLESLWFGVPVATWPMYAEQHMNAFELVVELGLAVEITMDYKKNLSKPMAEAVVVKAEEIENGIRRLMEDDLVRTKVKKISEKSRSTVVEGGSSYSAFGYLIQDFIKNVS

SEQ ID NO: 5805 - protein, 475 aa, Rosa chinensis
MGSYSPTNIPSEPPQRRHVVLFPFMSKGHTIPLLHLSRLLLSRGLNVTVFTTPANRPFIDQFLYGTTAASVVDIPFPQNIHPEIPAGVESTDKLSSVDERLFYPFALATRHMQADFEKALGSLPRVSFMVSDSFLWWTLDSATKFGFPRLAFYGFNNYAGSVTRFVAQNGLLHGPESDNELITLTRFPWIKITKEDFGSSFRNHSPEGSEFLMNVVGAVVNSFAVVTNSFYELEPVFVDCWNTESSPKSWNVGPLCQLKPKSVLQDDKPVWIEWLDKKKVEGSRVLYVAFGTQAVISSEQLQEIANALEKSDVNFLWVIRKKESYTWWDSEFEERVRGRGMVVSEWVDQTEILNHESVEGFLSHCGWNSAMEAICAGMPILAWPMMAEQPLNARMVVEEIKVGLRVETCDGSVRGFVKAERLEKMVKKLMEGEEGEVVRKKVKEVGEVARKAVEEGGSSWRTLGLLIDEVCSKEN

SEQ ID NO: 5806 - protein, 510 aa, Quercus robur
MGSEALVHVFLVSFPGQGHVNPLLRLGKRLAAKGLLVTFSTPESIGKQMRKASNITDEPAPVGEGFIRFEFFEDGWDEDEPRRQDLDQYLPQLELIGKDIIPKMIRKNAEMGRPVSCLINNPFIPWVSDVAESLGLPSAMLWVQSCACFCAYYHYYHGLVPFPSEAEPFIDIQLPCMPLLKYDETPSFLYPTTPYPFLRRAILGQYGNLDKPFCILMDTFQELEHEVIEFMSKICPIKTVGPLFKNPKAPNSVRGDFMKADDCLEWLDSKPPQSVVYISFGSVVYLTQKQVDEIAFGLLQSGVSFLWVMKPPHKDAGLELLVLPDGFLEKAGDNGRVVQWSPQEQVLAHPSVACFVTHCGWNSTMESLTSGMPVVAFPQWGDQVTDAVYLVDVFKTGVRMCRGEAENRVITRDEVEKCLLEATVGPKAVEMKQNASKWKAAAEAAFSEGGSSDRNIQAFVDEVRARSVAITGKSTANGVALDLAEKSAEINGKVDLVETKTNGKVELVEA

SEQ ID NO: 5807 - protein, 291 aa, Citrus unshiu
MSNMRLKDFPSLMRVTDANDILFNYMKTEVQNCLESSAIIFNTFDEHEGKVLEAIASKSPNIYTVGPLHLLCRHLPESEFKSFRSNLWKEDPECLKWLNEKEPNSVAYVNYGSITVMTDEQMKEFAWGLANSGHPFLWIVRPDMVTGDSAILSQEFYEEIKDRGMIANWCPQDKVLSHPSVSVFLTHGGWNSILESVSGGVPIICWPFFAEQQTNCRYASTTWGIGMEVNRDASREDIAALVKEIMEGDKGKLIRQNVQDWRKKAEAATDVGGASFNNFNKCIKEVLHYHH

SEQ ID NO: 5808 - protein, 486 aa, Medicago truncatula
MASQTNQQHFLLIPLMSQSHLIPFTEMAKLFASNGVTVTIVLTPLNAARFNMVIDQAKSSNLKIQFQLLPFPCVEAGLPKGCENMDTLPSPKYQPLFFAACNMLKEPLENWLSGLEKLPSCIVSDICLPWTSNVASKFNIPRVVFHAISCFTLLCSHNISLSKVHEKVDSMSTPFVVPDLPDTIEFTKAQLPEVMKQDSKAWKGAIDQFKESELSAQGILVNTFEELEKVYVRGYEKVAKKVWCIGPLSLHDRLTFNKFGKDDKGFIDDSETKCLKFLISNKACSVIYACFGSLSFIPTSQLKELALGLEASNHPFIWVIGKNDCSIELEKWLKEENFEERTKGKGVIVKGWAPQVEILSHPSTGGFLSHCGWNSTMEAISSGVPMITWPMFAEQFFNEKLIVQVLKIGVRIGVEAFVDPMEIYKGEKVLVKKEDVKRAIENLMENGVEGEQRRNKAKEIKDMAYKAVEDGGSSDSNCKLFIQEKL

SEQ ID NO: 5809 - protein, 272 aa, Corchorus olitorius
MKYQVVFISTPAMGNQVPTLEFAHHLTHRDPRFLATVLIITLHQRTIVNAYIRSRSSSATYNDRIKFIYLPTVDPPTPDQYQSSLGYFSRLLDKQKPHVKQAISNLMSTSPPPSFDNQTTLPSSPCIPTVDATKLQLCSTQPPISESVLGFLRIWPKIVESRLNSLCSIAIDLQIKPSDGFEFQVPLPFGNGIDELAGSVLDDGSMSLKHNGIDHDAMKRAKPSRPLKEEPLESQQLYFSNPFSVVEDDKNGKGNGLANEQVRGYVVNFPFN

SEQ ID NO: 5810 - protein, 473 aa, Panicum hallii
MGSNTGGDGERKASGGGSHVLLLPYPSQGHVHPMLQFGKRLALHGLRPTLAVTRFILATCAPDAAALGGVRLAAVSDGFDRGGFGECGDVTAYLARLEAAGSATLAELLRDEAAGGRPVRAVVHDAFLPWARAAARRHGAAAAAFFTQPCAVNVTYGHVWRRRVGVPADKGMVRLPGLPALEPEGLPWFLRVGPGPYPAYFELVMRQFQGLEEADDVLVNSFHELEPEEAEYMASAWRAKTIGPTVPASYLGDGRLPSDTKYGLHLFELTSAPCVAWLDAHPPRSVVYASFGSLSDLDPSEMREVARGLLDTGRPFLWVVRASEAHKLPAGYEEEARGRGGLVVSWCPQLEVLAHRAVGCFLTHCGWNSTAEALVAGVPMVAVPQWTDQPMNARYVEAAWRVGVRVRPAAADGLVRRAEVAGGIEEVMAGERSGEYRRNAAAWMEKARAASREGGSSDRNIAEFVGKYSSNSK

SEQ ID NO: 5811 - protein, 469 aa, Unknown
  Description of Unknown: Oryza sativa Japonica Group sequence
MASSERGGGGGIHVVLLPYPSQGHINPILQFGKRLAGHGGVRCTLAVTRFILRQGEPPSTGAVHVAAYSDGYDAGGFHEAGSAGEYLSRLESRGSDTMDALLRAEAEQGRPVDAVVYDSFLSWAPRVAARHGAATASFFTQACAVNAAYESVFTGRVELPLAADGEEPLRLPGISVGLTLDDVPTFMANTEDSPAYLDLLVNQFKGLDMADHVLVNSFYELQPQEAEHMASAWRAKTVGLTVPSAYLDNRLPDDTSYGFHLFSPTTETKAWLEARPPRTVAYVSFGSVATPSPAQMAEVAEGLYNTGKPFLWVVRASETSKIPEGFAAKAAKQGRGLIVTWCPQLEVLAHPAVGCFVTHCGWNSTTEGLSAGVPMVAVPQWSDQTMNAKYIEDVWRVGVRVRPDGEGVVRKEELERCVREVMEGERSKEFMENANGWKEKARNAMCEGGSSDKNIVEFIAKIGVDRKFK

SEQ ID NO: 5812 - protein, 462 aa, Oryza sativa
MSEAVQAAADASSSSSSSSSSSSSSPLHIVVFPWLAFGHMIPFLELSKRLASRGHAVTFVSTPRNAARLGAIPPALSANLRVVPLDLPAVDGLPEGAESTADVPPEKVGLLKKAFDGLAAPFASLVAEACGGGSAGDGEEAAAGFSRRPDWIILDFAQNWTTWLRHRGSHSPPPSPTGAMKQSGSLLHSSLTPLECPMLTVCWKWNAPAAALSSCPEAEPRLFPLLNKLFARPAVPASLLLPADIVHDEDAPNTTSNQSFVSAIQWLDKQPNGSVIYVALGSEAPITTNHVRELALGLELSGVRFLWALRPPSGINSQTGTFLPSGFESRVATRGIVCTEWVPQVRVLAHGAIGAFLTHCGWGSTVESFCFGHPLVMLPFVADQGLIAQAMAARGIGVEVARNYDDGSFYRDDVAAAVRRVMVEEEGKVLARKAKEVHSILGDRAREEQYLDEFVGYLQRYK

SEQ ID NO: 5813 - protein, 423 aa, Unknown
  Description of Unknown: Oryza sativa Japonica Group sequence
LQPPQKAIVASQLHKVEEEEKGDRQIWLRVTSSCCRCHARATSSRSWSSPTASPTRASRSPSSTRRWTTRWWWPRCRRAAPRSSGSGGSTSPPSPTASPATRTARTSTSSSTPTRAKLIEDGVLNEKGWPERQETLQLAPGMPPLHTSLLSWNNSGAAEGQHIIFDLVCRNNKFNDDLAEMTVCNSFHEAEPAVFKLFPDLLPIGPLVADRELRRPVGHFLPEDAGCLDWLDAQPDGSVVYVAFGSLAIFDARQFQELAVGLELTGRPFLWVVRPDFTPGLSTAWLDAFRRRVAGRGVIVEWCSQQRVLAHAAVACFVSHCGWNSTLEGVRNGVPFLCWPYFCDQFLDRSYITAVWRTGLAVAAGEEDGVVTRDEVRSKVEQVVGDGEIRERARLLRDTARACVSEGGSSHKNFRKFIDLLSE

SEQ ID NO: 5814 - protein, 465 aa, Solanum lycopersicum
MNKQHFLVISLPAQGHINPTLQLAKNLARAGARATFITTVYGLSRMNNLPTQDGLFYSSFSDGCDDDSWMNSNSTVDYFMNDLKINGSKNLRDLVRKYSDEGHPVTFLVYTILLPWVAVVAREIHVPSAFLVIQCGTAFAIYYHLLNSTNGVYSNSSSDFTVMPSFPIEIPELPLFSCNDIPTIVLPNNHLSSIMIPILREHIQNLENDPNSYVLINTFNALEEKSMRVIDKFRLFSIGPLVPSAFSDGNDPKDKSFGCELFDKPEKNYHQWLDSRHEGSVVYVSFGSLAVLKKEQEREILRGLLESERPFLWTRRKGEDEGKKKNLECDDVITDEKLGLIVPWCSQMEVLCHKSIGCFVTHCGWNSTLESLVSGVPIVGYPQFSDQTTNAKMLEEVWGIGVRVKEVEGLVKKEELKRCLGILMENGEKGEEIKKNVKKWRNLALDALKIGGSSHDNIKKFIEGL

SEQ ID NO: 5815 - protein, 473 aa, Cucumis sativus
MEAHPSIPHLAILPSPGMGHLIPLIEFAKRLLSHHRLTFTFIIASDGPPSQPQQALLNSLPSGIHHLFLPAVTFDDLPPNSKIETIITLTISRSLPSLRNVLKSMVSQSNLVGLVVDLFGTDGFDIAREFDISSYIFFPSTAMFLSFALFLPKLDESIVGEFRDHPEPIKIPGCIPIQGKDLLDPVQDRKNEAYKWTLHNARRYALADGIFLNSFPELEPGAIKYLQEEEAGKPLVYPIGPLVKIDADEKEERAECLKWLDEQPHGSVLFVSFGSGGTLSSAQIDELALGLEMSGQRFIWVVRSPSDKAADATYFSVHSQSDPLDFLPEGFVERTKNRGMVVPSWAPQAQILSHGSTGGFLTHCGWNSTLESVVNGIPLIAWPLYAEQRMNAVILTEEINVALKPKRNDNKGIVEKEEISKVVKSLLEGEEGKKLRRKMKELEEASKKAVGEDGSSTKIVTDLVNNWKAKIST

SEQ ID NO: 5816 - protein, 344 aa, Solanum lycopersicum
MGCFSLLCLHNLKDWEGLEKIESDTEYFRVPGLFDKIELTKNQLGNAARPRNEEWRVMSEKMKKAEEEAYGMVVNTFEDLEKEYIEGLMNAKNKKIWTIGPVSLCNKEKQDKAERGNEAAIDEHKCLNWLDSWEQNSVLFVCLGSLSRLSTSQMVELGLGLESSRRPFIWVVRHMSDEFKNWLVEEDFEERVKGQGLLIRGWAPQVLLLSHPSIGAFLTHCGWNSSLEGITAGVAMITWPMFAEQFCNERLIVDVLKTGVRSGIERQVMFGEEEKLGTQVSKDDIKKVIEQVMDEEMEGEMRRKRAKELGEKAKRAMEEEGSSHFNLTQLIQDVTEQAKILKPM

SEQ ID NO: 5817 - protein, 481 aa, Eucalyptus grandis
MEPSVTKPHALCIPLPAQGHINPMLKLAKLLHHKGFHITFVHTEFNHQRLEESLGEGALRGLDDFRFEVISDGLPPSNPRGILDLPSLCLTLPVDGLRSFRELVMKLMNSDAPPLTCIVSDGVMSFTLKVARELGVPEVMFFTPSGCGMLGYLHFEELVDRGLFPLKDESCLSNGFLDTAVDWIPAMQGIRLRDLPTFIRTANPDDIMFKYNSESVNNAFKADGVILNTFDDLEGEVVLAIKAKYPQLYTLGPLPMLHQQLLPSPNSLESIQSSLWREDGGCLGWLDGREPESVLYVNFGSLITVTREELREFAWGLANSRCPFLWVIRPNVVDGGEDVISEEFREEIRDRGLIVGWCAQERVLGHSSVGGFVTHCGWNSTLESLCAGVPLVCWPFFAEQHMNCLYACARWGIGLEMIDGGSDGLKRGRVEGVVRELMEGEKGREAREKAVEWKERGEAATRPGGSSHTNLEMLVNKLRGL

SEQ ID NO: 5818 - protein, 473 aa, Unknown
  Description of Unknown: Rosa hybrid cultivar sequence
MGGDAIVLYPYPGLGHLISMVELGKLLLTHHPSFSITILASTAPTTIAATAKLVASSNDQLTNYIKAVSADNPAINFHHLPTISSLPEHIEKLNLPFEYARLQIPNILQVLQTLKSSLKALILDMFCDALFDVTKDLNIPTFYFYTSAGRSLAVLLNIPTFHRTTNSLSDFGDVPISISGMPPIPVSAMPKLLFDRSTNFYKSFLSTSTHMAKSNGIILNTFDLLEERALKALRAGLCLPNQPTPPIFTVGPLISGKSGDNDEHESLKWLNNQPKDSVVFLCFGSMGVFSIKQLEAMALGLEKSGQRFLWVVRNPPIEELPVEEPSLEEILPKGFVERTKDRGLVVRKWAPQVEVLSHDSVGGFVTHCGWNSVLEAVCNGVPMVAWPLYAEQKLGRVFLVEEMKVAVGVKESETGFVSADELEKRVRELMDSESGDEIRGRVSEFSNGGVKAKEEGGSSVASLAKLAQLWKQK

SEQ ID NO: 5819 - protein, 490 aa, Unknown
  Description of Unknown: Oryza sativa Japonica Group sequence
MENGKCNGSSTTKCNGAAAAAMHVAMLVTPGMGHLIPLAELAKRLAARHGVTSTLLTFASTASATQREFLASLPPAIESVSLPPVDLSDLPADAAIETLMSEECVRLVPALTAILSGIRERRRLVAFVADLFGADSFDAARDAGVPRRYLFFPTNLHALTLLLHLPDLDVSIPGEFRDLDEPVRLPGCVPIPGKDILMPLQDKSRACYGWMVHHGTRYRDADAILVNSFDAVEPDAARVLRHPKPGVPPVFPIGPLIQTHCAGDDDAAAPPSPRAACLDWLDRQPDRSVIFVSFGSGGALPTEHMRELALGLELSGQRFLWVVRSPSDEGEVSANYYDAETKKNPFGYLPEGFVERTKEVGLLVPSWAPQTKVLAHRATGGFLTHCGWNSVLESLVHGVPMVAWPLFAEQRQNAVMLTEGAGAAIRVPESKGKEKIAAVVREMMVGEGRGAAVRAKVAELQKMATDGLRDGGAATSALDEVVDKWTGGEK

SEQ ID NO: 5820 - protein, 482 aa, Ricinus communis
MEMTSMANKPHAVCIPYPAQGHINPMLKLAKLLHQRGFYITFINTEHMQRRLLKSRGPDALNGLPDFQFETIPDGLPPSPDLDSTQDILALAQSVTNNCPVPFRNLLAKLESSPNVPPITCIVSDGIMSFTLDAAEEIGVPGVLFWTASACGFLAYAYNKQLVERGLIPLKDESYLTNGYLDTTVDWIPGMKGIRLKDLPTFRTTDPNDFFLNFSIQEVYGALRASGIILNTYDELEHEVLVALSSMFPPIYTIGPLDLVGAKNAEKDQNTSIGSNLWTDDLECLKWLDSKEPNSVVYVNFGSMTNMTRQQLVELAWGLGNSKQTFLWIIRTDIVKGESTILPEEFVDETKERGLRTSWCPQERVLKHPSIGGFLSHMGWNSTIESLSNGVPVICWPFGGEQQINCWFACNKWGIGMEIENEVKRDEVEKLVRELIEGEKGKEMRKKAMEWKRKAEEATDPNGKSSMNLDRLVNEVLLSQHK

SEQ ID NO: 5821 - protein, 476 aa, Rosa chinensis
MGTIRSETPTHIFLVCFPAQGHINPMLRLGKHLASKGLLVTFSTTEDYGNKMRKATGIVDNKTSPVGNGFIRFEFFDDGLPDPEDPRRTQLDFYIPLLEKVGKELVTGMINKHGEQGGVRVSCLVNNPFIPWVCDVATELGIPCATLWIQSCAVFSAYYHYNAGAVAFPTEAEPDLDVQLPSMPLLKHDEIPSFLHPFAPFRILGMAILGQFKKLSKSSYVLMDTIQELEPETIEEMSKVCIVKPVGPLFKIPEANNTTIRGDLMKADDCLDWLSSKPPASVVYISFGSIVYLKQEQVDEIAHGLLSSGISFLWVLRPPRKAAGFDMHVLPEGFLDKVGDNGKLVQWSPQEKVLAHPSLACFLTHCGWNSSVEALTLGVPVVTFPQWGDQVTNAKYLVDVFGVGLRLCRGEAENRLVLRDEIEKCLLEAMVGEKAVELKQNALRWKKVAEEAVAEGGSSQRNLQDFLDEIARTCIA

SEQ ID NO: 5822 - protein, 468 aa, Citrus unshiu
MKKTIALYPGPAFHHMISMVELGKLILQHRSDVSITILVPSMPLEESKTCSYINSISHRLNPIISFYYLPTIQMPSETLSRADIAIESIKLNSSNVFQALENISLTSKILSFIITSTTSFSYHPNIPTYTYFNSCASTLAAILYLPTLHNQITSSFKDHPSSLLFIPGLPPVKSSFMPEPVLDRQKPIYDFFLNYSTSLSKSNGIIINTFDFLEQQAIKAIVHGACVTNGTTPPLHCIGPLIVDAKDRAGGVSDDVSSDCLTWLDSQPSGSVVFLCFGSRGTFSAPQLKEIAIGLERSNQRFLWVVRNPSNAAEAELPEGFLERTKERGLVVKSWAPQSTILGHESVGGFVTHCGWSSVVEAVTYGVPMIAWPLYAEQFLNSVALVQEMKVAMPMFLNGEEETIGNGEGVVSAERVEERVRELMMGKALRERSLEMRMMAATAWNNNDGGSSFTAFSNLVASWNSLYS

SEQ ID NO: 5823 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 5824 - protein, 502 aa, Medicago truncatula
MYYTQLQETFGMPFYSVPTNLRVQSQERKKKQNKRKMASNEAPIHILLVSFPAQGHINPLLRLGKCLAAKGASVIFTTTEKAGKDMGIVDDITNKLATPIGDGSLIFEFFDHSLLDNGSVNHAELERIGRQFVSQMIKNHADSNKPISCVINNPFLPWVCDIAFEHNIPSALLWTNSSAVFAVCYDYVHKLVPFPSNEEPYIDVQLNSSIVLKYNEIPDYIHPFNPFPILGTLTTAQIKDMSKVFCVLVDTFEELEHDFIDYISKKSITIRHVGPLFKNPKANGASNNTLGDFTKSNDDSTIIEWLNTKPKGSVVYISFGTIVNHTQEQVNEIAYGLLNSQVSFLWVLKQHVFPDGFLEETSGRGKVVKWSPQEQVLAHSSVACFITHCGWNSSMEAITLGVPMLTFPAFGDQLTNAKFLVDVFGAGIRLGYGDKKLVTRDEVKKCLLEAITGEKAERLKQNAMKWKTAAEDAMAVGGSSDRHLDAFIQDIKKHGTGNIQKM

SEQ ID NO: 5825 - protein, 274 aa, Helianthus annuus
MLKVKDIVKMGFKREKDGAGGMIDNMVKQMKASSGIIWNSFKELEESELETIRRDIPAPSFPIPFAKHFTASSSSLLEHDRSFFPWLDQQPPKSVVYVSFGSVAQVEEKHFMEMVHGLVDSKQLFLWVVRPGFVSGSTWLEPLPDGFPGERGRIVKWAPQQEVLGHEAIVAFWTHGGWNSTLESVCEGVPMICSPFWGDQPLDARYVSDVWKVGVYLENGWKREEITGAIRRVMTDEEMRERARVLKQKLDVSLMKGGSSYESVESLVAYVSSF

SEQ ID NO: 5826 - protein, 468 aa, Helianthus annuus
MAKPHVIVIPYPAQGHVIPTLELAQCLVTQGVKVTFINTEVSHNLVTNNCLDKDGFGGLMQMVSLPDGLEPWDDRSDPCKLALSILQTMPLKLEELIVRINKEEESSRVSCVIADDCLGWAIKVAKKMGVRRAAFRPASVATLATILSCQKLIDEGIINKNGIPLSDEMIQLSETMPPIKPQNLAWACFEDSTITQVFFKFVVQTEEASRLIERFICNSCPELEAAAFSMYPQLQPIGPLLARNRLADQAGQFLQEDTTCLTWLDQQPPCSVIYVAFGSSTTFNQTQFEELALGLELSNRPFLWVVRPGMTKETATGYPDGYVKAVGSRGRIVKWAPQQKVLARPSVACFMSHCGWNSTLEGVTNGVPLLCWPHFCDQFQNASYACDIWKTGLEFEKDEEAGIVTRIEIISKVEQLLSDKTYKVKALEIKEKVTSSVSKGGYSHRNLDSFVQWIHKNDADAKDEPDFM

SEQ ID NO: 5827 - protein, 466 aa, Medicago truncatula
MIPTIDMAKIFASKGVKATIVTTPLNKPFFSRSIEQFKIHFNNIDIQTIKFPCVEGGLPEGCENVDAIPTISLLPTFFTATKLLQQPFEELLLQQKPHCIVADMFFPWATDSATKFGIPRIVFHATGFFSLCVSQCLEQYEPFKNVSSETEEFFIPNLPGNIKMTRLQLPNIFTKNDAITQNIAKLYAEMRESEARSYGVIVNSFYELDGVYADYYREVLGKKEWHIGPFSVYNRDMDTSYCRKEPSINKHECLKWLDTKDINSIVYVCFGSKNHFLNSQLKEIAMGLEASGKDFVWVVKKNAEDREIKGLLEFEKRMKGKGLIIRGWSPQLLILQHKAIGAIVTHCGWNLTLESVAAGVPMITWPIAPEQFYNEKLVTDVLKIGVPVGAKTWDGKVSDKVHWDAVEKAVKKVMEGEEAKEMRNKAKVLAKMAKKAVEEGGSSYSQLNALIEELGSLCHHQHISKE

SEQ ID NO: 5828 - protein, 319 aa, Genlisea aurea
MMAVPFFTECAGVDAVCYHLNKGNVTFPYEEEFLYRLPCLPALEAGDLLYLPEKIDKRGGIVRYLAAQFDRLENADYIFVNTFYHLEPEVLDWLEERYPKLRTIGPTFLLPGIATESVAPQQESYAEWLDSKQPNSVIFVSFGTIVAIGSNQMEEVAHALLMSNFNFLWVVRDTEEVEKLPEEIRGSKAGMIVNWCNQLSVLSHPAVSCFVTHCGWNSTLEALSIGVPIVAVPWWVDQLTNAKFIEDTWRVGVRLQRGWKSDEIFGRERIAKCIEEVVNDVELRKNSLKWKALADEAVRKGGTSIDNVDEFVQKLLLID

SEQ ID NO: 5829 - protein, 202 aa, Genlisea aurea
LMDHMGKYVAMKAIGPTVPSMYSDERLPEDREYGLSFFLPESTLCTDWLNRQPPASVVYVAFGSMAQLSQRQMEELARALEQIRRPFIWVVRSSERNKLPPGFPADIAAGLIVSWSPQLDVLAHRSVACFVTHCGWNSTLEALCLGVPVVALPQGSDQTTNSKFVADVWRTGVRAVACDGDGGVVDRITIERCVRDVIEGEE

SEQ ID NO: 5830 - protein, 474 aa, Unknown
  Description of Unknown: Oryza sativa Japonica Group sequence
MAAISPASDGVGRRRRRVLMFPIPFQGHVTPMLQLADVLRSRAGLAVTVFHAPVNAPAAAEQSAAEEDYRFVTVGAGVAGEAAALMPTGGSGSDFAGALMRLDALLRAPFDDALRQALLADDEEEAAATCLVVDSNLRGVQEVAERRGVRTLALRTGGACCLVAYMAFPELCGKGVLPPLSRDQLQLDMPLDELPPLRLRDMMFSATTTHGTMATCLERLLDSARCSSGVILNTFDDLENSDLRKIANGLSVPVYAIGPLHKISIGQESSLLTQDQSCLEWLDKQEAESVLYVSFGSLASMDSQELLETAWGLVDSEIPFLWVIRPNSVQGSEQTCLPDGFEEATRGRGMVVSWAPQQDVLKHRAVGGFWTHNGWNSTLESICDGVPMICRPQFADQMINARYVQEVWKIGFELEGKLERRMIERAVRRLLCSEEGKEMRHRAKDLKNKATTCIEKGGSSNTAIDMLVNLIMSF

SEQ ID NO: 5831 - protein, 485 aa, Ricinus communis
MRKLQVLFISTPAVGNLVPTVEFAQRLTDHDPRFSSTVLIISMAQRPIVNAYIQSCCSTASSATAINFIHLPSPEDPPSPDQYQSSFGYMCLLIDRHKVHVKHAISQLLHNEVQVSGLFVDMFSTSMVDVADELNIPCYLYFASPASFLGFMLHLPILDTQLATDFIDSDNDSIVPKDPSTKLIIPGFANPLPPQVLPTYVLRRKQDGYSWFLYHASRYKETKGMVVNTFQALEQHAINSLSASGLPPIYPIGPVLDLGGPIQWHPNRGQHHTILKWLDDQPMSSVVFLCFGSMGSLGSSQLREIAIALERTGFRFLWSIREPGKGKLDVPADYANAKEILPEGFLDRTAGIGLVCGWVPQVTILAHQAIGGFISHCGWNSILESLWRGVPIATWPIYAEQQMNAFQLVKELGLAVEIRLDYRNEGNDLVPSEEVERGIKCLMEGDNEVRKRVKEMSQKSRIAAVENGSSYASLTSLTDRLAAGI

SEQ ID NO: 5832 - protein, 293 aa, Medicago truncatula
MMFPWTVEAAAKLGIPRIHYYSSSYFSNCAEHFIMKYRPHDNLVSDTQKFTVPGFPHSIEMTPPAASFLKISYGTLYNSFHELESDYEKLGSTTMGIKSWSVGPVSAWTNKNDEKKANRGHIEELGKEEEWLNWLNSKENESVLYVSFGSLIRLDNAQIVEIAHGLENSGHNFIWVVRKYERDESENTFLQDFEERMKESKKGYIIWNWAPQLLILDHPATGGIVTHCGWNSILESLNAGLPMIAWPIFAEQFYNEKLLVDVLKIGVPVGAKVNEFWNSTSETVAVKREDVTP

SEQ ID NO: 5833 - protein, 462 aa, Medicago truncatula
MEQQKEIAKGHKIILMPSPFQGHITPLLQLATILHSKGFSITIVHTVFNSPNPSSYPHFTFHPLHGALSDTEASKVDAVHLTEVINVRCVQPLKECLTMLLDKEDDGVCCFVSDAALYFTQAVCVEFGIPRIVLRTGGASSFLVFASFPILREKGYFPVQESRMEEAVEDLPPLKVKDLPVFQSKEPEAFYKLVCRFIDECKKSSGIIWNTFEELESSALTKLRQDFSVPIYPIGPFHKYSLAGSNSTSLLTPDKTCISWLDKQEHKRVVYVSFGSIVAISEAEFLEIAWGLVNSNQPFLWAIRPGTIRGSEWLEPLPSGFLENLGERGYIVKWAPQEQVLKHPAVGAFWTHNGWNSTLESVCEGVPMICMPSFGDQKINAKYASDVWKVGVQLEGKLERGEIEKVIRKLMVGDEGNEIRENVMNLKEKANVCLKEGGSSYSFLDSLVSEILSLKSSTSRAH

SEQ ID NO: 5834 - protein, 465 aa, Erythranthe guttata
MEQQRHVLLVTFPVQGHINPSLQFAKRLTAMGIKVTFATSLYARRRMSRTAAGLPKGVTFAAFSDGYDDGFNPGNDDAGKYMTEIRSRGSQSLRDTILAAAEQGCPVTQLVYTLLLPWAPEVAREFHVPSALLWIQPATVLNIYYYYFNGYGDEIAANSNDATWQIQFPGIPALNFSKRDLPSFILPSSSDKHSVELPSFKEQLETLDAEKTKPKVLVNTFEALEPHALKSIDNYELIGVGPLIPSAPSDKSFRGDLFEKSDDNSVELWLNAKPESSVVYVSFGSILKLPKAQMEEIAKGLLESDRPFLWVIRINEDNKNEEEEEKLSCLDELEKIGKFVPWCSQLEVLTHASVGCFVSHCGWNSTLESLSSGVPVVAFPQWTDQGTNAKLIEDVWKSGVRVRGVGGDGVVESGEINRCIEEVMDGGERSRELRANAREWKSLAREAMDENGSSCNNLKAFLEDN

SEQ ID NO: 5835 - protein, 493 aa, Morus notabilis
MTQPPRFLLVTYPAQGHINPCLQFAKRLVGAGADVTFVTTYFAHRHMTKSRGDTTAAANRNGVVSISYVPFSDGHDDGFKPGDSVDHYLNEIRRRGSQAISDLVISAAKEGHPYTCLVYSLLLPWAALTAEELCLPSVLLWIQPATVFDIYYYYFHGYEDIIIENSTKDPSTDHNSSTTLPGLSLTLTRRDLPSFMDAANTYSFAIPLFKEQLEVLDKIKNPKILVNTFDQLELEALKAIEKLNLIAIGPLIPSAFLDEKDPSDTSFGGDLFHVDNQNYIEWLNSKPKGSIIYVSFGSMVELSRPQMEEIAKGLLDCGRPFLWVIREKAKKKESEKKNEEREEEEEKLSCHEELSKLGMIVPWCRQVEVLSSASLGCFVTHCGWNSTLESLVCGVPVVAFPQWTDQGTNAKLIEDMWKTGVRVKPNEKGIVESQDIKRCLDLVMEGEELRRNAVRWRDLAREAAKEGGSSDKNLKAFVAEMIGEGDHDHGFLD

SEQ ID NO: 5836 - protein, 481 aa, Medicago truncatula
MDLLAGTKKPHALLIPFPTQGHINPFLKLAKILHNKGFYITFVNTEFNHKRLLKSIGPNVVNCLQDFQFETIPDGLPPTNNMDATQSIPDLCDSTSKNCLVPFCKLVSKLNDPPVTCIISDGVMSFTIQASRQFGLPNVLFWAHSACVFMSYKQIKNLTERGLTPLKDASYLTNGHLDTIIDWIPGMKNITLRNLPGIYHTTDPNDTLLDFVTEQIEAASKASAIILPTFDALEYDVLNELSTMFPKLYTLGPLDLFLDKISENNGFESIQCNLWKEESECLKWLDSQEENSVLYVNFGSVIVMKYNQLVELAWGLANSKKKFLWVIRPDLVKGESETLLVPQEIVEETKDRGLMVGWCPQEKVLKHKAVGGFLSHCGWNSTIESISNGVPLICCPIFNDQILNCKYICSEWKFGMAMDSDNVTRDEVEKLVVELIEGEKGKEMRIKAIEWKKMAEEATNVDGSSSLNLEKLVSEVLLFKS

SEQ ID NO: 5837 - protein, 606 aa, Artemisia annua
  MOD_RES (436)..(436): Any amino acid
MGSKQDLVHVFLVTFPAQGHVNPLLRLGKLLASKGNLLVTFSASKSIGNKMKKAGAAVSGDPTPVGNCGGMIRFEFFDDGCSEDNDDERYDLDAYLPKLEAYGKSSLTGIINHHAEHGQPVSCLINNPFVPWVVDLAEELNIPCAMLWVQSCACFSSYYHYENSLVPFPTEEQPDIDVQLPHMPLLKSDEVPSFLHPSTPYPFLRRAVLGQFKNISKVFCVLMETFQELEGDLINYMSQICPIRPVGPLFKNPLLETSSNISGDLIKADDCLEWLDSKDPSSVVYISFGSVVSLSQEQVTEMAYGVLNSGVSFLWVMRKGATSTGESGVLPEGLLEKAGDRGLVVHWSPQAQVLAHPAVSCFLTHCGWNSTMEALSSGVPVVAFPGWGDQVTDAKYLADEWKVGIRMCRGEAENRVIGRDEVEVCLREATSGLKAXRKYCVSFLWVMRKDANSTGVLPEGFLEEAGDRGMVVHWSPQAQVLAHPAVSCFLTHCGWNSTMEALSSGVPVVAFPQWGDQVTDAKYLADEWKVGIRMCRGEAENRVIGRDEVEVCLREATSGLKATELKKNALNWKKAAEEAVAKGGSSDRNIQEFVDEVRKIRAKKSV

SEQ ID NO: 5838 - protein, 379 aa, Linum usitatissimum
MPALKEAFDDSRPEFCKILKRLKPDLLVYDVLQPWAAEAAAESNVVGIKCVLFVPGGAACYSFLAHYSIKPAGAQYPLQDWGIASREGFLKKRATYPNGLRDEDLDTYTDCMKRSSDIILIKTSRNIEAKYIDYLSELLGKEVVPVGPLVNDKPEDHRTGAEGDDDNKILKWLNSIDSDSPVVYVSFGSEYFPSKEEMGEIARGLEMNQALIRFIWVVRFPPDDHHREKNNKTLLLQEALPEGFLERVEGRGLLVEGWAPQAEILRNERVGGFVSHCGWSSVIEAVVYGVPIVAMPMQLDQPWNANLVEEIGVGVEVKGNKDGMIKRIDGDEMGRVIGEVLGDMEMRNRVRELSEKLKGDADAEMDCVVDRLRSLVEGV

SEQ ID NO: 5839 - protein, 432 aa, Punica granatum
MQPDTTSMTQPHLQQQQQERRPHVAVLAFPFSSHAASLLTVIRHLASAAPASTAVFSFFSTHKSNRSLFPIPPQPTTSTITTTTTTTTTTTTTTTTSSSSSSAFNMIKAYDVTDGVPEGYVFHGKPQEDIGLFMRAAPEGFRKAMEAAAVDSGKRITCVVADAFFWFAEEIAAELRVPWVAFWTSGPSSLAAHLYTDLLRNKLHITDGIAGLGDERLNDFIPGAPRGSDEYGCLPWLDNQKPAPASVAYISFGSVTVPPRSELVAIAEALEASGVPFIWSLKEEVWDHGLPDGFLGRTREQGMLVPWAPQVDILSHGAVGAFVTHCGWSSLLEGIAGGVPMICRPFFGDQRLNGRMIGDVLGIGLTVEGGAITKEGLVRSLGMILNGDEGKRMREIVRHLRLQAGKALSPTGSSTGNFNKLLQVITTGAPPC

SEQ ID NO: 5840 - protein, 499 aa, Oryza sativa
MAINGVAGAGAGDVDVDVDVDASAPPPPLHLVMFPWLAFGHLIPFLQLAKRLAARGHAAVTFLATPRNASRLAALPPELAAYVRVVSLPLPVLDGLPEGAESTADVPPEKVELLKKAFDGLAAPFAAFLADACAAGDREGRPDPFSRRPDWVVVDFAHGWLPPIADEHRVPCAFFSIYSAAALAFLGPKAAHDAHPRTEPEDFMSPPPWITFPSTIAFRRHEAAWVAAAAYRPNASGVSDIDRMWQLHQRCHLIVYRSCPDVEGAQLCGLLDELYHKPVVPAGLLLPPDAAGDDDDGHRPDLMRWLDEQPARSVVYVALGTEAPVTADNVRELALGLELAGARFLWALRDAGERLPEGYKARVAGRSVVEAGWVPQVRVLAHAAVGAFLTHCGWGSTVESLRFGGLPLVMLPFIADQGLIARAMADRGLGVEVARDDDGDGSFRGEDVAAAVRRVMAEEEGKVFARNAREMQEALGDGERQDRYVDELAERLRRRRSLS

SEQ ID NO: 5841 - protein, 494 aa, Centella asiatica
MDSKSNQLHLVLIPLMSPGHLIPMVDMAKLLTQRAVNVTIITTPRNATRSAAVIGRAIESGLPIRVLQVRFPSMAAGLPEGCENMEDVPSHDMFINFFKAIGMLQEPMEKLFEEIKPSPSCIISDKNVLWTAETAKRFQIPWIIFDGMSCFTQLCTHNIYTTSVHTSVPESEPFDVPGLPDRIQFTNAQLPGLFRSSPVTEYRTRIREAEGGAHGVVINSFEELEKDYLNEFKKVRGDKVWSIGPLSLCNIDNLDKAQRGSEASIDKHKCLEWLDSCEPGSVVYACLGSLSSLSPAQLMELALGLEAQAHPFIWVVKTIESKQKEIEKWISEEGFEERIKGRGLVIRGWALQVLILSHPAIGGFLTHCGWNSTMEGVCAGVPMVTWPLSAEQFFNEKLIVQVLGTGVSVGARVAMNFREEENYGVKVRREDIKEAIECLMFEGEEGEKRRKRARKLAEMAVQAVEEGGSSHLNLTLLIQDIIQYKTSKLSMNTA

SEQ ID NO: 5842 - protein, 486 aa, Arachis duranensis
MPYHHFLLITYPAQGHINPSLQLAKRLINLGARVTVSTTVHVHRRMSDKPSIPGLSFAPFSDGYDDGFTRSDDSSYAHYAAEYKRRGTEFVTDLINSAAEEGQHPFTCVVYTFLQNWVAEVARAFHLPAVVLWTQPAVLLDIHYFYFHGYRDYVNEKITQEPSSCSLELPGLPPLQPSRDLPSFYLESNSSTKFRNSFIVSRIEKQFRDLDQEVKPRILANTVEALEPDALRAVDDKLDVIPIGPLIPSAFLDDDQDGGGDSSYGGNIFKRSDDYVEWLDSQAEKSVVYVSFGSFCVLAKKQMEEMARALLDLGHPFLWVIREKVKKEKEREEEEEEELSCREELEARGKIVEWCSQVEVLSHGSLGCFVTHCGWNSTMESLASGVPMVAFPQWLDQKTNAKLVEDVWKTGVRVDREEEKEEGVVEAGEIKRCLDMVMGSGEKAKELRENADKWKRLAREAVKEGGSSDKNLKTFLHHVHDLMPRS

SEQ ID NO: 5843 - protein, 280 aa, Helianthus annuus
MKSSTVILYPSPGIGHLVSMVEIGKLIHTHHPSLSVVILIIPAHYETGSTGKYINTVSTTTPSITFHRLPAIPLPPDFSSDFNDLAFGIPELYNPVVYDTLVSISQISTIKAVILDFYVDAAFQVTKSLRLPTYYFYTSGASGLCGFLYSPYAHKTTCKSYKDVNDFLDIPGVPRMHSSYMPTAVSDRESNSYKYFLKSAINMAKSSGVIANSFFELEERAAQTLRDGKCIPEGPTPPTYLIGPLLASGEQVDDDDDDDEHECLKWLKTQPSKSQWRASG

SEQ ID NO: 5844 - protein, 241 aa, Citrus unshiu
MIGWAPQQKALNHPSIACFLSHCGWNSTLEGVSNGIPFLCWPYFAEQFLNEKYICDSWKVGLRFDKKESGIITREEIKNRVDQVLGDRDFKARALGLKEKAMSSIREGGSSRKAFQNFLEWVKTNALAHNSPVMGEDEIPLVSSSRAIYTLRFEHKLSTRSHPQTSEVEEHLIRLRTSLAASTSSLGHELNDLQDSCDSVEKILQLQILNVCSTAQNALLQIKESTLGIRSVLCKRGDEEN

SEQ ID NO: 5845 - protein, 502 aa, Cephalotus follicularis
MEKQKSRGRRLLLVPCPFQGHINPMFQLGTILHSKGFSIAIAHTLFNFPNPSDHPDFDFLPIADGISKEESTEDFITFILSLNVNCRIPFQESLCGMIENQDLLDEIPCIIYDSLMYFAGDVAHHLKLPNIILQTCCVTNLVLYKIYPRLQEEGYLPVKDFTFLPMYNEQVSSQDVVELIKGFNINCKAPLQELLAPRASKDSISLDLVPGFHPLRFRDLPIFNYKNSDALLQVLADFCSLIRYPSAIIWNTIEFLEHSSLEKYQQRHQIPFFTLGPLNKFAPASSSSLLEEDISCISWLDKQRPNSVLYVSLGSLASMDKKQLNEMAWGLANSKQPFLWVIRPGSVSGSEWIELLPDGFVEVVCERGCIVKWAPQKVVLAHDAVGGFWSHCGWNSTVESISEGVPMICWPYFLDQRVHARYLSHVWRLGIAYENELESGEVKETVRRLMVSEEGQEMRQRAMEFKEKVELCIKPGGCSYNSLNELAKYISTLKKSPTDSIL

SEQ ID NO: 5846 - protein, 436 aa, Cajanus cajan
MLQFSKRLVQRGVKVTLITVVSNWKTMSNKNITSIEVESISDGYDDGGLAAAESLEAYIDTFWRVGSETLAELVHKLAGSSHPPDCVIYDAFMPWALDVAKKFGLLGATFFTQSCSTNNIYLHAYKKLLELPLSQTEYLLPGMPKFAAEDFPSFLNKYGSYPGFFGVVVNQFANIYKADWVLANTFYELEQGAVDWLVKIWPLKTIGPCLPSMYLDKRLQDDKDYGVNMYNPNSEACIKWLDDKPKGSVVYVSFGSMAELSEEQTEELAWGLRDGGNYFIWVIRDSEQGKLPKDFVGTSEKGLIVAWCPQLQVLIHEALGCFLTHCGWNSTLEALSLGVPLIAMPLWTDQITNAKLVRDVWKIGVKAVADEKEIVRRETITHCIKEILETEKGNEIKKNSIKWKNLAKNYVDEGGNSDKSTTEFVTELAHRCAASK

SEQ ID NO: 5847 - protein, 477 aa, Barbarea vulgaris
MVKKIELIFIPVPSTGHLLVHIEFAKRLINLDNRIHTITILNLTSPTSPHASVFARSLIASQPRIRLHDLPSVDDHPPLDLYQRAPEAYIVQLVKKTTPLIKDAVSSIVASRRQGSDSVPVAGLVLDFFCNSLIAVVGNQLNLPSYIFLTCNARYLGMMKYLPDRHRNIASAFDRSSGDEELPIPGFVNSIPAKFMPPGLFNREAYEAYVELAPRFGDAKGILVNSFAELEPHPFDYFSHLESFPPVYPVGPILSLEDRASPNEEAADRDQIVRWLDDQPESSVVFLCFGSKGSVDEPQVKEIARALELVGCRFLWSIRASGVETNPNDMLPEGFMGRVAGKGLVCGWAPQVEVLAHKAIGGFVSHCGWNSTLESLWFGVPIATWPMYAEQQLNAFTLVKELGLAVDLRMDYVSGLGGLVTCDEITRAVRSMMDGGEGKRKKVKEMADAARKALVDGGSSSLATARFIGELLDNGSC

SEQ ID NO: 5848 - protein, 460 aa, Ricinus communis
MAQPKSSNFHIVMFPWFAVGHMTPFLHLANRVAERGCSTTFLLPNKAKLQLEHFNTHPDLITFHSITVPHVEGLPLGTETASDIPIHLTHFLAIALDRTRRQVEKVIVDTRPKLVIFDVAHWIPKITKDLGIKAINYNVVCAASIAIALVPARNVTKDRPVTEAELLQPPAGYPSSNVVLRGHEVRSLLFVSLPFGEGITFYERIYTAIKGSDAIAIRTCHEIEGKLCDYIASQYEKPVFLTGPVLPEPSKAPLEDQWTKWLGGFEKDSVIFCAFGSQIKLEKNQFQELVLGLESTGLPFLAALKPPNGASTVEEALPEGFEERVNGRGVIWGGWVQQLLILDHPSVGCFLNHCGFGSMWESLMSDCQIVLVPHLGDQILNTRIMAEELKVGVEVVRDESGWFSKESLRKAITSVMDKNSEVGSMVKENHRKWTEILGGEGFMTSYIDKFVQNMQDLVNN

SEQ ID NO: 5849 - protein, 455 aa, Hordeum vulgare
MTMTTTPVRPHALLVSTPFQGHINPLMRLGRRLAAKGVLVTFTTALRAAVRVEEDSDGHERAGFRFERLHGGGLWEPEDPRFSDAGDMARHVEAAGPAALKELIRREAEAGRPVTCVVTNAFVPWALRVAGELGLPCGMLWIQSCALLSVYYHYVHSLAAFPEADDDAPGRSLLVAIPGLPDLAMDELRPLLIYASDQYMWRKMLVEDLGGIRERVSWVFVNTFDELEHEAIAALGEHVQVIPVGPLIEPETDGPSDDDGCIAWLDAQAPRSVVFVAFGSLVKTDDDETAEIAEGLVSTGRPFLWVMRDDNRAVLFQGTLDGLKAATLCGRGKVVPWCKQAHVLAHGAIGCFVTHCGWNSTAEALAAGVPVVASPRWSDQNINAKFLVDVYRIGVRAPTPVTREALHLSIEEVMSGPEAGEMELRAASWKEKARAALAGGGSSDNGVQAFVDQIK

SEQ ID NO: 5850 - protein, 478 aa, Glycine max
MLDRVEMINTEMEPLKLYFIHYPTAGHMIPLCDIATLFASRGHHATIITTPVNAQIIRKSIPSLRLHTVPFPSQELGLPDGIESLSSLIDDIRHFPKVYHAISMLQPPIEQFVEQHPPDCIVADFLFPWVHDLANKLNIPSVAFNGFSLFAICAIRAVNLESSDSFHIPSIPHPISLNATPPKELTQYLKLMLESQLKSHAIIINNFAELDGQDYIRHYEKTTGHKTWHLGPASLISCRTAQEKAERGMKSAVSMQDCVSWLDSKRVNSVLYICFGSLCHFPDEQLYEIACGMEASGHEFIWVVPEKKGKEHESEEEKEKWLPRGFEERNAEKGMIIRGWAPQVIILGHPAVGAFITHCGWNSTVEAVSEGVPMLTWPVHGEQFYNEKLITEVRGIGVEVGAAEWTTTGFGERYQMLTRDSIQKAVRRLMDGADQALEIRRRAKHFQEKAKQAVRVGGMPSFHLQIPQKAKQFIFIRY

SEQ ID NO: 5851 - protein, 480 aa, Eutrema halophilum
MEEQKAPHVAIIPSPGMGHLIPLVQFAKRLVHRHGFTVTFLVVGEGPPSKAQRTVLESLPSSISSVFLPPADLTDLPQTTRIETRISLTVSRSNPELRRVFDSFAAEGRLPTALFVDLFGTDAFDVAVEFHVSPYIFYPSTANVLSFFLHLPKLDETVSCEFTELTEPVMIPGCVPVSGKDLLDPAQDRKNDAYKWLLHNTKRYKEAEGILVNSFLELEPNALKTLQEPGLDKPPVYPVGPLVNIGKQESNGVEESECLKWLDNQPIGSVLYVSFGSGGTLTCEQFNELALGLADSEQRFLWVIRTPSGIANASYFDSHSQNDPLTFLPPGFLEHTKGRGFVIPSWAPQAQILAHPSTGGFLTHCGWNSTLESIVSGVPLIAWPLYAEQKMNAVLLTEDIHVALKVRAREDGIVGKEEVARVVKGLMEGEEGKGVRNKMKEMKEGASRALKDDGSSTKALNLVVLKWKAHQKELEQNGKH

SEQ ID NO: 5852 - protein, 491 aa, Medicago truncatula
MEDQTKPKLKSIFLPFLSTSHIIPLVDMARLFALHGVDVTIISTKYNSTIFQNSINLDASRGRSIRTHIIDFPAEKVGIPAGIEAFNVNTPKEMIPKIYMGLYILQPDIEKLFETLQPDFIVTDMFFPWSADVAKKLGIPRIMFHGASYLARSAAHSVEVYRPHLKAESDTDKFVIPDLPDELEMTRLQLPDWLRSPNQYAELMKVIKESEKKSFGSVFNSFYKLESEYYDHYKKVMGTKSWGLGPVSLWANQDDSDKAARGYARKEEGAKEEGWLKWLNSKPDGSVLYVSFGSMNKFPYSQLVEIAHALENSGHNFIWVVRKNEENEEGGVFLEEFEKKMKESGKGYLIWGWAPQLLILENHAIGGLVSHCGWNTVVESVNVGLPTVTWPLFAEHFFNEKLVVDVLKIGVPVGAKEWRNWNEFGSEVVKREDIGNAIRLMMEGGEEEVAMRKRVKELSVEAKKAIKVGGSSYNNMVELIQELRSIKLAKV

SEQ ID NO: 5853 - protein, 464 aa, Setaria italica
MAGQEQRRRRHRVVLFPLPFQGHVTPMLQLAALLHSRGLAVTVLHTAFNAPDPARHPELAFVPIHEALPDEVTCPGADIARQLLALNTACEAPFRDALASLLLLRGRRGQDQDQGSVACAVVDGQCYAAVDAAAQLGVPVLALRTDSAATFRTMLAFPRLRDAGYVPIKEEMLDELVPDLEPLRVRDLIRVDGSDADALCGFIARVAGAVRSSASGVVVNTFEGIEAPELAKIRRELSLPVFAVGPLHLMSRAPAEQTTLRAPDGGCLAWLDTRPPRSVLYVSLGSVATVGHAAFEEMAWGLAGSGVPFLWVVRPGLVAGGEEEAPPPLPDGFSEEIKNRGKIVTWAPQREVLAHAAIGAFWTHCGWNSTLESVCEGVPMLVQPCFADQTVNARYVTHVWGVGMEVGEVIERGIVAEAVAKVMVGEEGARMRERAHRLKMEASAATSLSIDSLIHYISSLPTAN

SEQ ID NO: 5854 - protein, 469 aa, Brachypodium distachyon
MDSTGKSVMATSEGPSILFLPFPGAQGHANPMLQFGHRLAYQYGFRPTLVVTRYVLSTALPPDAPFRVAAISDGFDAGGIRSCLDMAEYWRRLEAVGSETLSRLISDEAREGRPVRVLVYDPHVAWARRVAREAGVPAAAFFSQPCAVDIFYGELHAGRMAMPVTEADARALLVRGAIGVELALDDVPPFVVVPESQPVFTKASIGQFEGLEDADDVLVNSFRDIEPMEVEYMESTWRAKTIGPTLPSFYLDDDRLPSNKSYGFNLFNGGDAVCMKWLDQQSMSSVVLVSYGTVSNYDESQLEELGNGLCSSGKPFIWVVRSNEAHKLSGELKAKCEKKGLIVSWCPQLEVLAHKATGCFLTHCGWNSTLEAIVNGVPVVGIPHWADQPTIAKYVESAWDMGVRVKKSLNGQLRREEIERCIKEVMDSERKDEYTRNAAKWMQKAKETMHAGGSSNKHIAEFAAKYSSS

SEQ ID NO: 5855 - protein, 456 aa, Ricinus communis
MATHQCQKTLHLNVQTALKPTRVIVVMVPLPAQGHLNQLLQLSRLILSYNIPVHFVGAATHNRQVKLRDHGWDTQNKFPSHLQPAFLASSNLRDPVSLLLRSLASKARKVVVIHDSLMGSVIQEVRYISNAESYTFHSVSAFTIFLFHWERMGKHIRPNGLIPKDVPSLEGCFTSEFLSFIYSQYKHQDFCSGYVYNTCRLIEGSYMDLLEKQHKETTVKEKKTHWALGPFNPVSITERTDSDQRHSCLDWLDKQARNSVIYVSFGTTTTMNNEQIKQLATGLKQSQQKFIWVLRDADKGDVFNGEHGQRVELPTGYEDSLSGMGLIARDWVPQLEILGHPATGGFMSHCGWNSCMESITMGVPIAAWPMHSDQPRNAVLITEFLKIGIYVKDWTCRDEIVTSKMIETCVKKLMASDEGDAVRKRVAELGGSVQRSMGEGGVSRMEMDSFIAHISS

SEQ ID NO: 5856 - protein, 446 aa, Rhodamnia argentea
MSRENKTVHVLMLPWLAHGHISPFLELGKRLSKRNFHIYLCSTPVNLSSIKPKISEKYSSSIELVELHLPSLPDLPPHYHTTKGLPPHLMNTLKVAFDMASPGFSNITKDLSPDLIVYDFLQPWAPEIARLHNIPAVNFWSAGAGIASFFFHAIKNIDGEFPLEAISLHDQERRKIDRMYENSAGGIKDRDRALQCVGKSSGIILVKTFRELEGKYMDYLSSHVGKRVVPVGPLVQDPSQEDGDDNIIGWLDRKEKCSSVFVSCGTEYFLTEREREEIAYGLELSSVNFIWVIRFPVGESMELEEALPVGFLERVGDRGLVREGWAPQVKILEHRSISGFVSHCGWSSIMESMKLGVPIIAVPMQLDQPLNAQIVEKVGVGLEVKRSKSGELERGEIAKAIRSVVVEKDGEGVRKKAREMSASIRNKGERELDEVVDALVDVLHAA

SEQ ID NO: 5857 - protein, 445 aa, Unknown
  Description of Unknown: Oryza sativa Japonica Group sequence
MDTGRSKSSSRLHLVIFPWLAFGHLLPYLELAERVASRGHRVSFVSTPRNLARLPDGTECTNDVPSGKFELLWKAFDALAAPFAEFLGAACDAAGERPDWIIADTFHHWAPLVALQHKVPCAMLLPSASMMAGWATRSSEPAGASIFQVLGVWAQKASFFVDHGASGMSVAKRCSLAMERCTLAAMRSCPEWEPDAFQQVAAGLKNKPLIPLGLVPPSPDGGRRRAGMTDNSTMRWLDVQPAKSVVYVALGSEVPLPLEQVHELALGLELAGTRFLWALRKPHGVDLSDVLPPGYQERTKSHGHVAMGWVPQITILAHAAVGAFLTHCGRNSLVEGLLFGNPLIMLPIFGDQGPNARLMEGNKVGSQVRRDDMDGSFDRHGVAAAVRAVMVEEETRRVFVANAIRLQELVADKELHERYIDEFIQQLVSHGADGSCNTAAPVPSS

SEQ ID NO: 5858 - protein, 276 aa, Medicago truncatula
MSFYDFEGAYEEHYKNAFGTKCWGIGPVSLWANQDVSDNDESGGTKVEEGNNDLLKWLNSKKENSVLYLSFGSLNKFPTSQLIEIAHALEASSHDFIWVVRKNNDKEGEGFMEEFEKRVKESNKGYLIWGWAPQMLILENKAIGGIVTHCGWSTIMESIKVGLSMVSWPLFADQFFNEKIIIDVLRIGVSVGAKEWRNWNEFGSEVVKREEIGKAIALVMENGKESEEMRLRAKALSENAKKAILVGGSSHANLMQLIHELKSLKLQRLKANTKDL

SEQ ID NO: 5859 - protein, 474 aa, Cephalotus follicularis
MEEAIVLYPSPGIGHLIPMVELGKLILTHQSSLSIHILITPPPYSAGPAAPFIASVSSKFPSIIFHHLPIITLPPSITSSSRHHETLTFEVARRNNLNVHQAILSISKTFAINCLILDFFCIAALSVANELNLPAYCLFTSPAGFLAGLLYLPTLHSKTSKSFKDLNAPLDIPGVPPIPSSDMPTPTLERNDLAYQGFFEVSTKLPKVSAIIVNSFEPLEQRTVRAITDGLCVPDGPTPPVYSIGPLIAEERGHTNGSDAILDCLSWLKMQPSKSVVFLCFGSLGLFSKEQLHEIAIGLERSGQSFLWVVRNPPPQNQSLATTALPDPDLASLLPDGFLDRTKDRGFVVKSWVPQVTVLSHDSIGGFVTHCGWNSVLEALSEGVPMVAWPIYAEQRYNRVLLVEEMKIALPMNELENGFVSAAEVEKRVRELMDSVEGNLVRERTMAMKNAAMYALSEGGSSRIALAKFVESWK

SEQ ID NO: 5860 - protein, 482 aa, Vigna angularis
MASSATIKKPHAVCVPHPTQGHINPMLKLAKLLHFKGFHITFVNTEYTHKRLLKSRGPDSLKGLSSFRFETIPDGLPEPAVDATQDIPSLCDSTRRTCLPHLNNLLAKINSSDAPPVTCIVADGVMSFTLDAAEELGVPLALFWTPSACGFMCYVQFQQLIQKGIIPLKDSSSITNGYLETTIDWIPGIKEIRLRDFPSFIRTADSEDFMIEFLQWECGRAREASAIILNTFDAMEHDVLEALSSILPPVYSIGPLNLLVKDIDDEDLNAIRSNLWKEEFECVEWLDTREPNSVVYVNFGSITVMTSEQLNEFAWGLANSNKSFLWVIRPDVVGGENVVLPPEFVEQTKDRGLLSSWCSQEQVLAHPAVGGFLTHSGWNSTLESVCGGVPMICWPFFAEQQTNCRFCCREWGIGLEIEDVKRDKIESLVKELMDGKKGREMKEKAMQWKDLAVSATSGPYGSSFLNLENMIREVLVRGNDKN

SEQ ID NO: 5861 - protein, 453 aa, Vigna angularis
MNIPNLLVVPFPVQGHVNPLMNFSQKMVEHGCKITFVNTDFSQKRMMSSEGKQESLEESPTIKLVSIPDGLEADDDRSDLGKLCDSVLSTMPSMLEKVIEEIHVNSGERITCIVADVIMGWALEVGRKLGIKGILFCTASAATFALEYKIPKLIQDGIIDSHGCPITKGTFQISPSMPSMDVKAIWWSNVYNPTTERKIFKYLVHCMQNSNLAKWCICNTTYELEPSALSCVPKLLPVGPLLRSYDKTNVTARSLGQFWEEDHSCIDWLNQQPRCSVLYIAFGSFTLFDQNQFNELALGLDLTNRSFLWVVRQDNKMAFPSEFLGSKGKIVGWTPQLKVLNHPSIACFLSHCGWNSIIEGFSSGVPFLCWPYFTDQFQNRNYICDELKVGLGLNSDENGLVSRWEIKKKLDRLISDEQIRTKSLELKETVMSNIAEGGGSSENVSRLLSWLKS

SEQ ID NO: 5862 - protein, 491 aa, Sorghum bicolor
MAIKDELQPLHILFFPFLAPGHLIPIADMAALFAARGVKCTILTTPVNAQVIRSAVDHANDASRGTDGALAIDIAVVPFPDVGLPPGVESGPALNSMEDREKFSHAAQLLRDPFDRFLVENRPDAVVSDSFFDWSVDAAAEHGVPRIAFLGISLFARSCSDTMLRNNPVEAAPDDPDAPVLLPGLPHRVELKRSQMMEPKKRPEHWAFFQRVNAADQRSYGEVFNSFHELEPDYLEHYTTTLGRRAWLVGPVALASKDAATRGAGNGLSPDADGCQQWLDTKPEGSVLYVSFGTLSHFSPPELRELARGLDMSGKNFVWVINGGAETEESEWMPDGFAELMACGDRGFIIRGWAPQMVILTHPAVGGFVTHCGWNSTLEAVSAGVPMVTWPRYADQFYNEKLVVELLKVGVGVGSTDYASKLETRRVIGGEVIAEAIGRVMGDGEDAEAIREKAQELGGKARRAVAKGGSSYDDVGRLVDELMARRSSVNV

SEQ ID NO: 5863 - protein, 554 aa, Capsella rubella
MESVKYRVSIRTNRLLSNFILLPSNFFIHNTFNFFFNLFSTEPQILISYQQDMGTSSEVSNKLHFLLFPFMAHGHMIPTLDMAKLFATKGAKSTILTTPLNSKLFFEKPIKSFNQENPGLEDITTQILDFPCTELGLPEGCENTDFIFSSPDLDKGDLGQKFLLAMKYFQEPLEHVLETMKPDCLVGNMFFPWATKVAEKFGVPRLVFHGTGCFSLCASHCLRLHKPYKNVASSSELFVIPELPGDIVITEEQVIEKEEESVMGKFMKGIRESERESFGVLVNSFYELEPAYAGFLKRFVARRAWHIGPLSLGNRKFEEKAGRGKKASIDEHECLKWLDSKKCDSVVYLSFGTMSSFNKDQLIEIAAGMEMSGHDFVWVVNKYGSQGEKEEWLPEGFEEKTKGKGLIIRGWAPQVLILEHQAIGGFVTHCGWNSLLEGVASGLPMVTWPVGAEQFYNEKLVTQVLKTGVSVGVKKMMKVVGDFISREKVERAVKEVMAGDERRKRAKELGEMAKTAVKEGGSSYIELNTLMEELKLVKLQKEKESQQKTERFAR

SEQ ID NO: 5864 - protein, 499 aa, Polygala tenuifolia
MDYLNSLEKPHAVFIPYPAQGHINPMLKLAKLFHFRGFHITFVNTEYNHKRLLKARGSNSLDGLPDFCFETIPDGLPPSDADATQDIPTLTFSIRDTFFFPFLRLLTKLNESASAGFLPKVSCIVSDSTTTWISVKAADQLGIPTVSFWTVSASTFNCFAHIPHLIDRGLIPLKDKSCLTNGYLDKKLEWIPCLKNVRLRDLPSFFNSTEPNDLDSKITDFVREAMVMTTKATAVIINTFSELEQDVVSSLSTMFPKLYTIGPVHLLADQVIKKHLESIGSNLWKEEAECMQWLDTKQPNSVVYVNYGSITVMTPDQLTEFAWGLANSKKPFLWIIRPDLVNGSSDILSSEFENEIKERGLITGWCPQEQVLSHPSIGGFLTHCGWNSTIESMTQGVPLVCWPFYGDQQTNCRFACTEWGIGIEIDTNVKRGEVETLVNELMEGDKGKAVKANVMEWKKKAEQAVRPDGSSSMNLDKLIEEVLLKARHDSEFMIHPPEL

SEQ ID NO: 5865 - protein, 519 aa, Heliothis virescens
MKLLIFFIFYCIIKCESYKILAIFPYSGRSHHIYFTALVEELALKKHDVTVINYHPVPALPTLRHISLQEGKENSSDDVNIEEHLKVLSNSDFLTVAYDGAQAFKHLAHTNCKKLINNREVRELIQSEVSFDIVIVEQFVTDCGLAVAYKLNAPVIGMTAHILMSWTYSRLGAPNHPAYVPNHFFASGKKPNLWNRIKSAIINFGMNMYYAHVIQKQDQEIVHAVYPDTPLLEELGKNISLLLINQYFPLTGSRLHGSNVVEVGGMHIKENAQIEDKRLKTFLDNADRDVVFISFGSVAKNFPQKIINEIKNLIKSNGDILFIWKSDASDWEPPTNAYVDKWMPQKAILCHPKVVAFITHSGMLSTSEAMYCGVPIVGVPLFGDQFANAQFAVENGLGVAVDILSLNERVLTDALNVILQDKYRQQANVLSQQWKDRPQSPMDTAIFWIEYVAKYKGVENLKPSSVDLPMYQYLIIDVILVLGSVFLLLLFIIVKIIFLIVKINSKQKDLKKEKRKKRD

SEQ ID NO: 5866 - protein, 494 aa, Morella rubra
MRPETPTHVLLVSFPGQGHINPLLRLGKRLAAKGLLVTFSTTENFGKEMRKANNIPDQPTPVGDGSLRFEFFEDGWEEEEPRRKELDEYLPQLEHGGKEAIHQIIKKYAEDHPVSCVINNSFIPWVCDVANDLGIPNAVLWVQSCTVFSVYCHYFHNLVPFPSEAEPKIDVQLPCMPLLKYDEIPDFLHPSSPFPFIGRLILSQFKNLSKPFCVLMDTFQELEPDSINSMSKFYMIKPVGPLFVKPKASNTSIRGDFLKADDCIEWLNSKSPASVVYISFGSIAYIGQEQVDELAHGLLNSGISFLWVMKPPNKTTNFKPPVLPDGFMEKVGNKGKVIQWSPQEEVLAHASVACFVTHCGWNSSMEALTLGVPVVTFPQWGDQVTNARFLVDVFGVGVRLSRGVAENILILRDDIERCLLEAMVGPKAVEMKHNALKWKMAAKEAVEEGGSSNQNIQAFVDEIRKRCVAVASETTTQKQENNINPTCFMDKPTI

SEQ ID NO: 5867 - protein, 408 aa, Cajanus cajan
MLRLGKCLAARGCYVTFSTTKGTQNLLDYTAHLDRIGKQFVSEMLKKHAEAKRPVSCIINNPFFSWVNDVAAEHGIPTALYWIHSAATFTACHRYFQKLSPFPTDSSPYTLVELPGGVVLKHSEIPDFLHPFSRTPFLKTLVRQQFENLSKTFCVLMDTFQELEQGYLDYLSQFHLVRPVGPLFKNPSSAALRNDDCMEWLNSKPRASVVYISLGTIVSLSVEQIGEFAHGLLNSRVSFLWVLSGSEREEALKANVMPDGFFERTSERGKVVQWSPQVEVLAHPSVACYLSHCGWNSTMEALASGVPMLTFSQISDQVTNAKFVVDVYGVGIRVRGDETEEKVISRDEIQRLLVEAMVGPKAEELKQNALKWKSAAEAAWAHGGSSHRNLDAFVEDLKKLSHVTKTPQ

SEQ ID NO: 5868 - protein, 447 aa, Aegilops tauschii
MARGHVALFPLPFQGHLSPALQLADALYGRGLAITVLHATFNAPDPAAHPEFGFVAVADGGMPDAKDGIGKILAMNDAMEASGCVRDALAALAPRPACLVIDTSLPAAQKAAAELDMPTVVLHTGSAAAIRLFRSYAMLHDKAYLPAQEHELDKPVKELAPIRVSDLFDPSKYPNPEMANRLLDTATEVTDNSSGVVINTFEALETPELEAIRSELAASGVRVFAIGPLHKLSTIGGAGSSLLKEDRSCIEWLDAQAAGSVLYVSFGSVAPVSREDFEEVAWGLANSGRPFLWVVRRGLVIGSGAEDIELPEGFQRAAEGRGKVVRWAPQQEVLGHRAVGGFWTHSGWNSTLEGICEGVPMLCRPLFGDQLANGRYVEEVWRTGALLVGKLERGKVEEAIARFMDGEDGAAMRERAKELQIKAMEALSSAGSTQLAVDKLIDHILSL

SEQ ID NO: 5869 - protein, 481 aa, Arabidopsis thaliana
MADGNTPHVAIIPSPGIGHLIPLVELAKRLLDNHGFTVTFIIPGDSPPSKAQRSVLNSLPSSIASVFLPPADLSDVPSTARIETRISLTVTRSNPALRELFGSLSAEKRLPAVLVVDLFGTDAFDVAAEFHVSPYIFYASNANVLTFLLHLPKLDETVSCEFRELTEPVIIPGCVPITGKDFVDPCQDRKDESYKWLLHNVKRFKEAEGILVNSFVDLEPNTIKIVQEPAPDKPPVYLIGPLVNSGSHDADVNDEYKCLNWLDNQPFGSVLYVSFGSGGTLTFEQFIELALGLAESGKRFLWVIRSPSGIASSSYFNPQSRNDPFSFLPQGFLDRTKEKGLVVGSWAPQAQILTHTSIGGFLTHCGWNSSLESIVNGVPLIAWPLYAEQKMNALLLVDVGAALRARLGEDGVVGREEVARVVKGLIEGEEGNAVRKKMKELKEGSVRVLRDDGFSTKSLNEVSLKWKAHQRKIDQEQESFL

SEQ ID NO: 5870 - protein, 513 aa, Mucuna pruriens
MKKEARLVFIPSPEVGHIVATIEFAKLLTKRDDRLWITLLVINLPFDPTIGDYTHSHASQRIEIINLPECPSESTTIIDLLEKHKPNVKQVVSNLPSTPPLAAFVVDMFCTTMIDVAKHFEVPSLVFFTSGVAFLGLLLRLHTLREQDNIDFKDSHTDLVIPSFANPVPSMALPTFTLHKEWESFFLAFGRGLKEADAIIVNSFQELESHAVHSFSDGPLPIFPVGPILNPKPKPHAQADNTQIFNWLDHQPPSSVVFLCFGSVGFLPEDQVREIALALEHSGARFLWSLRKPPPKGSHIRTPPSDYLLSDLDAVLPGFLDRTAGIGKVIGWAPQAQILAHPATGGFVSHCGWNSTLESIYFGVPIATWPLFAEQQSNAFELVRELKIAVEVALDYRMDVKVGITTLLSADKIEKGIRSVLNIDEDKRKRVKEMSEQSKKTLLEGGWWDGNRCWSGGLPLDFSKGLYLEGLDAVSFILLTLYIYFIQAMKTDRLQNVLNVMKNVPDVECVVHQ

SEQ ID NO: 5871 - protein, 211 aa, Unknown
  Description of Unknown: Oryza sativa Japonica Group sequence
MWQADSTCIRWLDAQPAASVVYVSFGSWVGPIGHDKIRELALGLEATGRPFLWAIKDDPSWRAGLPAGYAGSVAGRGKLVDWAPQDDVLGHAAVGCYLTHCGWNSTVEAIQHGVRMLCCPVSGDQFINCAYITRVWEVGLKLGSVRRDVVRDCIERIMGGAEGTRLQEKMDALRQRAVTAEARCLAQGNLRSFVNEIKRDHPLLTQIYNIL

SEQ ID NO: 5872 - protein, 438 aa, Arabidopsis thaliana
MVALAFQGHLNPMLKFAKHLARTNLHFTLATTEQARDLLSSTADEPHRPVDLAFFSDGLPKDDPRDPDTLAKSLKKDGAKNLSKIIEEKRFDCIISVPFTPWVPAVAAAHNIPCAILWIQACGAFSVYYRYYMKTNPFPDLEDLNQTVELPALPLLEVRDLPSLMLPSQGANVNTLMAEFADCLKDVKWVLVNSFYELESEIIESMSDLKPIIPIGPLVSPFLLGNDEEKTLDMWKVDDYCMEWLDKQARSSVVYISFGSILKSLENQVETIATALKNRGVPFLWVIRPKEKGENVQVLQEMVKEGKGVVTEWGQQEKILSHMAISCFITHCGWNSTIETVVTGVPVVAYPTWIDQPLDARLLVDVFGIGVRMKNDAIDGELKVAEVERCIEAVTEGPAAADMRRRATELKHAARSAMSPGGSSAQNLDSFISDIPIT

SEQ ID NO: 5873 - protein, 484 aa, Unknown
  Description of Unknown: ACX17726.1 Sequence 45306 from patent US 7569389 sequence
MNREVSERIHILFFPFMAQGHMIPILDMAKLFSRRGAKSTLLTTPINAKIFEKPIEAFKNQNPDLEIGIKIFNFPCVELGLPEGCENADFINSYQKSDSGDLFLKFLFSTKYMKQQLESFIETTKPSALVADMFFPWATESAEKLGVPRLVFHGTSFFSLCCSYNMRIHKPHKKVATSSTPFVIPGLPGDIVITEDQANVAKEETPMGKFMKEVRESETNSFGVLVNSFYELESAYADFYRSFVAKRAWHIGPLSLSNRELGEKARRGKKANIDEQECLKWLDSKTPGSVVYLSFGSGTNFTNDQLLEIAFGLEGSGQSFIWVVRKNENQGDNEEWLPEGFKERTTGKGLIIPGWAPQVLILDHKAIGGFVTHCGWNSAIEGIAAGLPMVTWPMGAEQFYNEKLLTKVLRIGVNVGATELVKKGKLISRAQVEKAVREVIGGEKAEERRLWAKKLGEMAKAAVEEGGSSYNDVNKFMEELNGRK

SEQ ID NO: 5874 - protein, 480 aa, Vigna radiata
MANKNASLHIFFFPFLAHGHMIPCVDMAMVFAAKGVRTTIITTPLNAQTISKAIQKTKIHQTKEINIQTINFPSTTETGLPEGCEHVNTLPSLASLSAFHKATRLLEEPFEQLLLHHHPNCVVADMFFPWATDSAAKFGIPRLVFHGMSFFSLCAYEVMRLYEPYKNTSFDSELFVLPNFPGEIKMTRLQVGSFFRKDDVEAKRFWEEIHESEVRSYGVVVNSFHELEKDYADHYVKKFGRRAWAIGPLSLCNKDKEKKRYRGGKEDEHECLKWLDTKATGSVVYVCFGSMTKFPDSQFREIALGLEASGKEFMWVVGKREKNEEEWVPEGFEDRTKEKGVIIRGWAPQALILEHEAIGAFVTHCGWNSTLEGVVAGVPMITWPVGAEQFYNEKLVIEVLKIGVPVGARKWSNFVADEDCCIKWDAVEKAVKRVLAEEEAEGMRKRAKLLAHTAKRAVEEGGSSYSNLDSLVQELIPLSL

SEQ ID NO: 5875 - protein, 473 aa, Glycine max
MKDTIVLYPNLGRGHLVSMVELGKLILTHHPSLSITILILTPPTTPSTTTTLACNSNAQYIATVTATTPSITFHRVPLAALPFNTPFLPPHLLSLELTRHSTQNIAVALQTLAKASNLKAIVMDFMNFNDPKALTENLNNNVPTYFYYTSGASPLALLLYYPPINQVLIEKKDKDQPLQIQIPGLPTITADDFPNECKDPLSYVCQVFLQIAETMMGGAGIIVNTFEAIEEEAIRALSEDATVPPPLFCVGPVISAPYGEEDKGCLSWLNLQPSQSVVLLCFGSMGRFSRAQLKEIAIGLEKSEQRFLWVVRTELGGADDSAEELSLDELLPEGFLERTKEKGMVVRDWAPQAAILSHDSVGGFVTHCGWNSVLEAVCEGVPMVAWPLYAEQKMNRMVMVKEMKVALAVKENKDGFVSSTELGDRVRELMESDKGKEIRQRIFKMKMSAAEAMAEGGTSRASLDKLAKLWKQS

SEQ ID NO: 5876 - protein, 491 aa, Medicago truncatula
MAEKQSIILFPFMAQGHIIPFLALALNLEQKSKNYNITIINTPHNIQKLKTSLPPNSSINLLTIPFISSDHNLPPNTENTDTVPYNLVIKLIQASLSLKPSFKYIIQNILTQQPNHKLCIISDIFFGWTSTVAKELGVFHVVFSGASGYGLACYYSLWMNLPHRFTDSDEFPLSDFPEARLIQRNQLPNNISQADGFDDWSIFQRKNNLCDWVNSDGIIFNSVSDFDSVGLNYFTRKFNIPVWSIGPVVLSTGSRGKVGGINPKVCKEWLDTKPSNSVLFVCFGSMNTISATQMMQLGTALEKSGKNFIWVVRPPIGFDINSEFKYEEWLPLGFMEKIVETKRGIIVNDWAPQVEILSHGSVSAFLSHCGWNSVLESLSHGVPILGWPMAAEQFFNCKLLEEEMGVCVEVARGKSCEVKYEDIVEKIELVMGESSESGVKIRENACKIKDMIRNAVKDGEEDGVKGSSVRGIDEFLSAAGKSNKTTLNDRE

SEQ ID NO: 5877 - protein, 475 aa, Ricinus communis
MGKAELIFIPAPGVGHIVSTIEFANSLIKQDGQLFITILVMKLPITPFLDAYTKSLTASQPNINLIDLPQVDLPSLQLFKKSVESYVVDLIDRYKPHVKNVVTDIMSSRTSSDSVSVVGIVLDFFCGCMIDIGNEMGLPSFIFLTSGSGFLNLMLYLPSRHEQIGTEFSSSDPDVSIPGFVNSVPVTVLPAAVFNTDGGYDAYIKVAQRFKDAKGIIINTFTELEPYAIEPFNNGQAPKVYPVGPVLNLKGQPHPDMNRSQWDKIMEWLDEQPESSAVFLCFGSAGFFNVPQVKEIALGLEQSGCKFLWSLRVPLIQDEGTQIIKKPEEMLPEGFLERVEGRGMVCGWAPQVEVLGHKAIGGFVSHCGWNSILESLWHAVPIVTLPIYAEQQLNAFTMARELGLAVDLKLDYRPNGEIAKAEEVERALKCLMDSDSEVRKKVKDMAGMARKAGMEGGSSFNSILQFIEDIKGSSY

SEQ ID NO: 5878 - protein, 476 aa, Barbarea vulgaris
MKKAELIFIPLPETGHLLSTIEFGKRLINLDPRISMITILSMNLPYAPHADASLVSLTASEPRIRLISLPKINDPPPIKLLDTSSETYILDFVDKNIPILRKTIQDLVSSSSSECHVAGLVIDFFCVGLIDIGHEVNLPSYIFMTSNFGFLGFLQYLPERHRLKPSEFDDSSAEEELPIPAFVNRVPAKVLPPGVFDKLSYGSLVKIGERLKVSKGILVNSFSEVESYAAEHFSRGQDYPHVFPVGPVLNLTGRANPGLASAQYEEMMKWLDEQPDSSVLFLCFGSMGVFPAPQITEIAHALELVGLRFIWAIRTNMAGDGDPHEPLPEGFVDRTKGRGIVCSWAPQVDILAHKATGGFVSHCGWNSVQESLWYGVPIATWPMYAEQQLNAFEMVKELGLAVEIRLDYVADGDRVTLEIVSADEIAVAIRSLMDGDNPIRKKVKEISAVARKAVGDGGSSMVATGDFIRDILGDHF

SEQ ID NO: 5879 - protein, 511 aa, Eucalyptus camaldulensis
MGSEALVHVLLVSFPGQGHVNPLLRLGKRLASKGLLVTFTTPESIGKAMRKASNIGEELSPVGDGFIRFEFFEDGWDEDETRRQDLDQYLPQLEKVGKVLIPEMIRRNAEQGRPISCLINNPFIPWVSDVADSLGLPSAMLWVQSCACFTSYYYYYHGLVPFPSETAMEIDVQLPCMPLLKHDEVPSFLYPTTPYPFLRRAIMGQYKNLDKPFCILMDTFQELEHEIIEYMSKISPIKTVGPLFKNPKAPNATVKGDFMKADDCVGWLDSKPASSIVYVSFGSVVYLKQDQWDEIAYGLLNSGVNFLWVMKPPHKDSGYEVLKMPEGFLEKAGDRGKVVQWSPQEQVLAHPSVACFVTHCGWNSTMEALTSGMPVVAFPQWGDQVTDAKYLVDVFKVGVRMCRGEAENKLITRDVVEQCLREATSGPKAEEMKQNAKKWSAAAEAVVAEGGSSDRNIQAFVDEVKRRSLEVLAASGKSTANGGADLANKVAGNGVAELGEPKVNGELKVVS

SEQ ID NO: 5880 - protein, 476 aa, Medicago truncatula
METKTHIALVTVPVYSHLRSILEFTKRLVHLNQNIHVTCINPTFGSSICNNVKSLFESLPSNINYMFLPPINLEDLPKDIHPALKVEATLHRSIPSIYDVLNTLHSSSKLVAVISDGLINEVLRLTKKLDILAYSYFPSTTMLLSLCLHSSNLDKTISSANKDLLEPLEIPGCIPINSTDLPDPMLDRSSEGYKIFLEANDRFYLADGIMINSFLALEETTIRALQEKEDEGIPSIYPIGPFVQNVSCDNGSDLEYLQFLDKQEKKSVLYVSFGSGGTLFSEQIIELAFGLELSGQNFLWVLRPPNKHGVIDDLDSGEYEDEILYNFLPNGFLERTKGKGLVVPYWAPQIEILGHSSIGGFLTHCGWNSTLESVVNGIPIIAWPLFAEQKMNAVLLSDGLKVAIRPKVNENGIVEREEIAKVVKNLMVGEEGKEIHQRMEKLKGNAIDALKENGSSTMTLTHLALKLESLGSHLGT

SEQ ID NO: 5881 - protein, 479 aa, Barbarea vulgaris
MKIELVFIPSPGVGHIRSTTALAKLLVDSDDRLSVTLIVIPSQFSKDASSSVYTESEDRLRYCLLPANRDQSTQQDFISYILSQKPHVRAAVSELVREVSTRSGSPRFAGIVMDMFCTSMMDIADDLNLPAYIFYTSNASYLGLQFHVQTLYEEKKLDVSELKDDSDVKFDVPTLTRPFPANSLPSMMLDKEWFPYIVRRAKSMRGTKGVLVNSVAEMEPQAVKFFSDGNGNTPPVYTVGPILDFKTNGDGEDEKRREILCWLEEQPPSSVVFLCFGSMGGFGEEQTREIAVALERSGHRFLWSLRRAYPVKSMTGSRPGEFTNLEEVLPEGFLKRTSGIGKIISWAPQVAVLESPAVGGFVTHCGWNSILESLWFGVPTAAWPIYAEQQFNAFQMVEELGLAADIRKEYRRDSLIPKPEIVSAEEIERGINCAMEQDSEIRKRVIDVRDKLHVALLDGGSSNAALRKFVQDVIENIPS

SEQ ID NO: 5882 - protein, 470 aa, Helianthus annuus
MEKPAHIAIVPSPGMGHLIPLVEFAKKLTAQHNLSATFIIPNEGPLSHSQSEFLDSLPNAINYTLLPPVNFDDLPQDAKIETRISLMVTRSVTALHATISSMMADKNIVAFFVDLFGTDAFDAAVELGVPRYLFFPAAAMTLSLCLHLPKLDQMVSCEYRDVPDPIQIPGCIPVHGKDLPDPLQDRSNDAYKRVLHNVKRYFMADGIVVNSFKGLESEAIEALQQVEPDKPPVYPVGPLIQSWSVQSNKGVNESSCLKWLDDQPSGSVLYICFGSGGSLSSEQFTELAMGLEMSEQRFIWVVRKPNDKVADATYLNSHGDEGTFDFLPKSFLERTKNRGLVVLNWAPQAQILSHSSTGGFLTHCGWNSILETIVLGVPMIAWPLYAEQKMNALMLTEGLKVAMRAKLNESGIVDHSEIVRVVKALSKGDQGKAIRVRIKELKEAALSALRKDGCSTKTLDQLVSKLKNKI

SEQ ID NO: 5883 - protein, 454 aa, Centella asiatica
MLKLAKLLHKKGFHISFVNTEFNHNRLIKSRGPDALDGLPDFRFYAIPDGLEVTNPDATQDIPTLCKYISINCLAPFTDLITKLNDRSSGSDGVPPVSCIVSDGIMSFTLKAAEKFGIPEVLLWTTSACGLLAYTQYRQLVERGYTPLKDMSYVTNGYLDTKLSWVPGTKDFKLRDFPSFIRTTDIDDVILNFILTECEALPKARGLILNTFDALEQDVLHALSAIQPRIYTIGPLLLDQDDKLKFMGSNLWAEDRSCIDWLDTKDPNSVVYVNFGSITVMSAQQLTEFAWGLANSKKHFLWIIRPDVVVGDSAMLPPEFVTATENRSILASWCPQEEVLRHRAVGGFLTHSGWNSTLESIAGGVPVICWPFFAEQQTNCRYSCVEWGIGMEIDNDVKRDEVELLVRELMDGEKGLEMKNNAMEWKNKAQVARGPRGISLANFDKLVDEVLLEK

SEQ ID NO: 5884 - protein, 492 aa, Unknown
  Description of Unknown: Oryza sativa Japonica Group sequence
MDAGSKSSSSGPLHLVIFPWLAFGHLLPYLELAERVASRGHRVSFVSTPRNIARLPPVRPAAAARVDLVALPLPRVDGLPDGAECTNDVPSGKFDLLWKAFDALAAPFAEFLGAACRDAGDGERRPDWIIADTFHHWAPLVALQHKVPCAMLLPSASMMVGWAIRSSEPAGASMFEVLGAVEERRMDMPCYEWEQKAALFVADGASGMSIMKRCSLAMERCTVAAMRSCPEWEPEAFQQVAAGLKKKNKPLIPLGLVPPSPDGGRRRAGSMSTDNSTMQWLDAQPAKSVVYVALGSEVPLRLEQVHELALGLELAGTRFLWALRKHAGVDAADDVLPPGYRERTNGHGHVAMGWVPQIAILAHAAVGAFLTHCGRNSLVEGLMFGNPLIMLPIFTDQGPNARLMEGNKVGLQVRRDDTDGSFDRHGVAAAVRAVMVEEETRRVFVANALRMQKIVTDKELHERYIDDFIQQLVSHVADSSCNIATPVPSSSS

SEQ ID NO: 5885 - protein, 467 aa, Citrus unshiu
MDLQNRQKLHIAMFPWLAYGHIMPFFQVAMFLAEKGHHVSYISTPKNIDRLPQIPTNLSSRLSYIQLPLPQLDGLPEGAESTAELPIHKVPYLKKAHDLLQLPLTNFLQDSRVNWIIHDFISHWLPPVAAQLGVNSVFFSIYSAATLCFTGPPSDVIAGRRQKPEDFTVVPEWIDFQSNLAFKPYETLINQDGMDDSVSDYLRAAFVLQDCRVVILRSCAEFEPDALRLLGKMLQKPVLPVGLLAPSLQDSAAGEHWPVLKDWLDSMENNSVVYAAFGTEMTLSQELLHELAYGLEKSGLPFIWIIKNRPLVEGESGLDHLLPPGFQDRVSGTGLVWTDWAPQLRILAHPSIGGFLTHSGWSSVIEALGLGRPLILLPGSSDTGLVARLMHSRRLGLEVERNEQDGSFTRDSVADCIRRVVVDQEGEPLRANARAVRDIFGSTHLSYKHLDEFTRFIENYTASTKSL

SEQ ID NO: 5886 - protein, 479 aa, Vigna angularis
MSNEVHSLHVFIIPFLAYGHLIPTVDMAKLFAEKGVKTTIITTPLNEPFIIKTIGKPKTSSTMIHVQTIELPCAEAGLPKGCENTNSITSGALFPAFLRACGLLQDQFEQLLLEQRPNCVVADVMFPWAINSAAKFGIPSLVYDGTSFFSICANECMGLYEPYKNVSSDSEPFLIPNLPGEITMTRMQVSPHVLSDESAGVTKLLEEVRESELKSYGMVVNSFYELEKDYADHLRKVLGRKAWHIGPMFLSNRVKEEQAHRGEEHECLQWLDTKKPNSVVYVCFGTTTKMTTSQLKDIATGLEASGEKFIWVVRKSEEDGVEWLPEEFEKKMEGKGLIIRGWAPQVLILEHEAVGAFVTHCGWNSILEGVVAGVPMVTWPIAYEQFFNEKLVCEILKIGVPIGAKKWAAGVGDTVKWEAVEKAVKRIMSGEEADEMRNKVKVLSHLAREAVAEGGSSNSDLNALIAELGSLTDRNKSIL

SEQ ID NO: 5887 - protein, 469 aa, Zea mays
MAADAARTPAPHALLLPYPAQGHVIPFMELADRLLDRGFAVTFVNTEFNHRRVVVAAAGGRAPDGRLRLVGVADGMGDGEDRDNFVRLNACMKEAMPLRLDALLDADDERLGRVTCVVVDVGMSWALDAVKRRGLPAAALWPASAAVLAVLFGAKKLIRDGVIDDDGAPVKLENHSFRLAESMPPMDAVFLAWNYMGNRDVERMVFHYLTTTAWAAVAKADVVLCNTFEDLEPDIFGAHSPAAASILPIGPLRTWQRRTSEAPAGHFWRADDEACASFLDAQPRGSVTYVAFGSLTVMSPAQLQELALALLASARPFLWVFRPGLAAELPPAFTDLLPRHARGKVVEWAPQEKVLAHPAVGCFLTHCGWNSTLEGVRHGVPLLCWPYFSDQFTNQAYICDIWKVGLRVVPDGGDGIVAKERIMERLTSLMGDSGVKERVKRLKELAERSMGPEGKSLKNINAFMESMTK

SEQ ID NO: 5888 - protein, 477 aa, Malus domestica
MKKVELVFIPSPGAGHHLPTLQFVKRLIDRNDRISITILAIQSYFPTTLSSYTKSIAASEPRIRFIDVPQPQDRPPQEMYKSRAQIFSLYIESHVPSVKKIITNLVSSSANSSDSIRVAALVVDLFCVSMIDVAKELNIPSYLFLTSNAGYLAFMLHLPILHEKNQIAVEESDPDWSIPGIVHPVPPRVLPAALTDGRLSAYIKLASRFRETRGIIVNTFVELETHAITLFSNDDRVPPVYPVGPVIDLDDGQEHSNLDQAQRDKIIKWLDDQPQKSVVFLCFGSMGSFGAEQVKEIAVGLEQSGQRFLWSLRMPSPKGIVPSDCSNLEEVLPDGFLERTNGKKGLICGWAPQVEILAHSATGGFLSHCGWNSILESLWHGVPIATWPMYAEQQLNAFRMVRELGMALEMRLDYKAGSADVVGADEIEKAVVGVMEKDSEVRKKVEEMGKMARKAVKDGGSSFASVGRFIEDVIGQN

SEQ ID NO: 5889 - protein, 501 aa, Unknown
  Description of Unknown: Oryza sativa Japonica Group sequence
MQATSLNTQSLSLSRTQATPTPAMARQHFLVVAYPGQGHINPARALAARLARATGAHVTLSVAVSAHRRMFPSLAAPDEEVHDADAGGGGISYVPYSDGYDEGFRLFASDGEAAWRHSETFGRVGREAFAGVVDRLAARGRPATCVVYAFLMWWAADVARERGIPRVLYWIQPATMLAVYYHYLHGLEELVTEHAGEPEFTVDMPSLPPMAIRDLPSFFTDLADTRLAAAFHGVRTTIEQLDIDRRSSSKPPMVLVNTVEELELDVLAASFPDLDILPIGPAATSLDGGGAAAAARASHDLYRHDEKGYMEWLDAKPAGSVVYVSFGSMSVVSRRQKEELRRGLAATARPYLWVVRSDDRDDGDGDGDGGGMVVEWCDQVRVLSHGAVGCFVTHCGWNSTLEAVACGAPMVAVPQWSDQDTNARLVAGWGVGVRAATGADRVVEAGELARCVETVMADTEAAAAVRRSSVAWKAKVREAVAEGGSSDRNLKAFLDRIANVA

SEQ ID NO: 5890 - protein, 359 aa, Arabidopsis thaliana
MFCSSMIDIANEFGVPCYMIYTSNATFLGITLHVQEMYDDKKYDVSDLDESVNELEFPCLTRPYPVKCLPHILSSKDWLPFFAAQGRSFRKMKGILVNTVAELEPHALKMFNNVDLPQAYPVGPVLHLDNGDDDDEKRLEVLRWLDDQPPKSVLFLCFGSMGGFTEEQTREVAVALNRSGHRFLWSLRRASPNIMMERPGDYKNLEEVLPDGFLERTLDRGKVIGWAPQVAVLEKPAIGGFVTHCGWNSMLESLWFGVPMVTWPLYAEQKVNAFEMVEELGLAVEIRKCISGDLLLIGEMEIVTAEDIERAIRCVMEQDSDVRSRVKEMAEKCHVALMDGGSSKTALQKFIQDVIENVA

SEQ ID NO: 5891 - protein, 485 aa, Vigna angularis
MAEMKKKAGLIFFTIPGIGHLGSSLELAQLLINRHNHLSITMICMKLPHAPYSDAYIRSITASQPQIQAIDLPHVEPPPQELLNRSIPHYIWTLLQILKPQVKATVQNILSSSQSNPVIGLVIDVFCSPMIDVGNDLGIPSYLFMPSNVGFLSLMLSLQKRQVGDVFCDSDSKWLIPGFPDPFPSSVMPDAVFSKEGGYAAYYNLAKRFQDSKGIIVNTFQELEQYAINALCNGQIQTPSIYAVGPLINLKGHPNPNLDHAQHDRILKWLDEQPDSSVVFLCFGSRGSFDPPQTREIAQALQRTGVRFLWTKRSPPTTTKKEERTLPEGFLEWTEGRGMLCDWAPQVEVLAHKAIGGFVSHCGWNSILESLWFGVPILTWPIYAEQQLNAFRMVREFRLAVELRLDYRRGSDLVMAEEIENGLKQLMDRDNMVHKKVKEMQEVARKVVLSGGSSFSSVEKLIDVMTLNFMVGLPSHFDESINEKA

SEQ ID NO: 5892 - protein, 486 aa, Amborella trichopoda
MVVEHVVMMPFMAQGHLIPFAALAELLSELHPLKITLVNTPHNASKLRSMMNPKAAGAIDVAEIPFSSADHGLPPDAENTDALPYPLILRLCEASETLEPAFESLISDIARKDGRLPLCIVADVFCGWTVLVAERLGIHHVVFTTCGAFGTLGYASTWLHLPHVGTDADEFPVPGMPGVRLHRKQIPSHLRVADGKDGWSIFLQKHISLSMHRSRGDMLCNTVAELEPDVLRLLQAMTGRRVLPIGPLLPLSLFSENWARERGGKPLGISAESCIAWLDTQPLRSVLYVSFGSQNTVSGWQLKELGLGLEASGAGFIWVVRPPLEFPMTAEFRSEWLPEGFEERVKDRGLIVKGWAPQLAILSHKGTGAFLSHCGWNSVLESLSQGVPLIGWPLAGEQFYNTIMLGDEKVGVCVEVGRGKEVGVDREKVARVVAEVVKGEKGAEMRRKAGEMREALRKGMAEEESGGGSSLRALDEFVASIVSPHV

SEQ ID NO: 5893 - protein, 482 aa, Unknown
  Description of Unknown: Oryza sativa Japonica Group sequence
MAASTSAAAAGDEPCRCHVVAVPFPGRGHVNAMMNLSRLLAARGAATVTFVVTEEWLGLLSSSSAPPGVRLRAIPNVIPSENGRAADHAGFLDAVGARMEAPFERLLDRLRLEEEEETAAPVAAFVADFYVPWVVDVGNRRGVPVCSLFPMAAVFFSAYYHFDSLPSWLAKPPHQPVAGATTDNPDQRLEHYISSLASSSIMLSDLKPLIHSERTVEYILACISSIRKAQCLLFTTIYELEASVIDSLESLVTCPVYPIGPCIPYMTLENEHTKSNGEAPGRIDYFAWLDCQPENSVLYVSLGSFVSVSSSQLDEIALGLATSEVRFLWILREQSTRVRELVGNTNKGMILPWCDQLKVLCHPSVGGFLTHCGMNSTLEAVFAGVPMLTLPLFFDQPINGRLIVEEWKIGVNLRDSTDKDRLIRREEIARAVKRLMASEEAEMKAIRRHALEWKEISHRAVDKGVSSHCNLASLMEMICPSR

SEQ ID NO: 5894 - protein, 490 aa, Jatropha curcas
MEKSSNNSSSHVLIFPFPAQGHVNSMLKLAELLSLSGLTITFLNTQHSQECLARFTDIKARFLKYPGFRFVTVPDSLPIDSGNVAKVLDALKLESKPVIEKLLIESNPRINCFIVDGILGFVTDLASELAIPIIYFRTISACAFWSYFCIPDMIEAGELPIKGEEEMDRLITKVPGMETFLRKRDLPSFCRANGMTEPTFYMIMNETQQTTRAQALIMNTFEDLESPILSQIRNHCPKTYTIGPLHELLKSIKIRSTNKQELHQSSNSLWEVDRTCIAWLDNQPSQSVIYVSFGSFANLTLDQLIEFWHGLINSNRRFLWVIRPSSVTDKEGIVVEKFPEELQEGCKENGYIVKWAPQEEVLAHKAIGGFLTHSGWNSTLESIVAGVPMICWPYFADQQTNSRFVSEVWKLGLDMKDVCNRKVVEKMVNDLMVNKREEFVRSAARMAELARKSISEGGSSFCNLNRLIEDIRLMSVQTHHNSQEDNKTSF

SEQ ID NO: 5895 - protein, 502 aa, Unknown
  Description of Unknown: Oryza sativa Japonica Group sequence
MDCHRNESQRELEMGTKPHFVVIPWLATSHMIPIVDIACLLAAHGAAVTVITTPANAQLVQSRVDRAGDQGASRITVTTIPFPAAEAGLPEGCERVDHVPSPDMVPSFFDAAMQFGDAVAQHCRRLTGPRRLSCLIAGISHTWAHVLARELGAPCFIFHGFCAFSLLCCEYLHAHRPHEAVSSPDELFDVPVLPPFECRLTRRQLPLQFLPSCPVEYRMREFREFELAADGIVVNSFEELERDSAARLAAATGKKVFAFGPVSLCCSPALDDPRAASHDDAKRCMAWLDAKKARSVLYVSFGSAGRMPPAQLMQLGVALVSCPWPVLWVIKGAGSLPGDVKEWLCENTDADGVADSQCLAVRGWAPQVAILSHRAVGGFVTHCGWGSTLESVAAGVPMAAWPFTAEQFVNEKLIVDVLGIGVSIGVTKPTGGMLTAGGGGGEETAEVGTEQVKRALNSLMDGGVEGEERAKKVHELKAKAHAALEKEGSSYMNLEKLILSAV

SEQ ID NO: 5896 - protein, 490 aa, Unknown
  Description of Unknown: Oryza sativa Japonica Group sequence
MAPAMASSAATVVLIPFCVSGHLTPMLEVGKRMLRSRCCGDDDDGRPAMSLTVLLAQLPESHRAPEIDEIIRREAAGASEHSGFDVRFHCLPAEELPDFRGGEDFISRFMQQHASHAREAIAGLESRVAAVVLDWFCTTLLDVTRDLGLPGYVFFTSAASMLSLLLRLPALDKEVAVDFEEMGGAVDLPGLPPVPAALLPTPVMKKGCNYEWLVYHGSRFMEAAGIIVNTVAELEPAVLEAIADGRCVPGRRVPAIYTVGPVLSFKTPPEKPHECVRWLDAQPRASVVFLCFGSMGSFAPPQVLEIAAGLERSGHRFLWVLRGRPPAGSPYPTDADADELLPEGFLERTKGRGMVWPTWAPQKDILAHAAVGGFVTHGGWNSTLESLWHGVPMAPWPLYAEQHLNAFELVRDMGVAVEMEVDRKRGNLVEAAELERAVRCLMDEGSEEGRMAREKAAAAKAACRNAVDGGGSSIAALRKLTQEMAHMSSI

SEQ ID NO: 5897 - protein, 458 aa, Actinidia chinensis
MSDHSKALHVAVLAFPFGSHAAPLLALVCRLATSNPTVRFSFLSTAQSNTHTFPSTRTNEFDNVRPYNVWDGVPEGHQISGNPHVGTGFFLKALPHNFKAGMAKAEEESGATINCLLTDAFFWFAGDLAEEMGVPWVPYWTAGACSLSAHVNTDVIRITLGSTRTTQNTNQTLNFIPGLSAVHMNDLPGGVLHGDLESPFAQMLHKMGLNLPRATAVVLNSFEELEPAITTDLKLRLQKVLHVGPPSLSSSPTSSLDESGCLLWLDKHEAASVAYISFGTIITPPPNELLALAEALRASKIPFLWSLRDHSRPIFPEGFLENVLAFGKVVSWAPQSQVLAHPSIGVFVTHCGWNSILESITGGVPMICRPFFGDQTLNSRMVQDAWRIGVRLDGGVFTKSSMMSAVELIFSREEGKKLRENIILLKQKATDAVGASGSSTENFNVLLEVIKTCKHPKS

SEQ ID NO: 5898 - protein, 483 aa, Arachis duranensis
MKPPQTSSAHVLIFPCPAQGHVNSMLNLAQLLALRHLHVTFLNTEHTHNRLTRFADIESLLARYPTLRFKTIPDGLPEEHPRSGERAAEPLLSLKVHGKPLLRDILVKEKVTCLVADGLFAKLANDMAEEVGVATIHFRTIGASCFWTYFWAPYLFQSNELPVTGEEDMDRVITSIPGMENLLRCRDLPSFFRPNRDTGKPHVHFETVVSETQQSLRASAVILNTFDDLEAPALSHIRRHFPTIFTVGPLHQHRESRAPTSITTSNNSMWEEDMSCMEWLDSHPFRSVIYVSFGSLTTMTKESLMEFWCGLVNSKMRFLWVVRSDMIAAGEGKDESVPAELVEGTKERGLMVGWVPQVEVLSHKSVGAFMTHCGWNSTIESVVAGVPMICWPYFADQQVNSRLVGESWKIGLDMKDVCDRKVVENMVKDVMVNRKEEFLQSAEKLAVLAKKSVSEGGSSYDNLDRLIDFIELISQEHLPTETS

SEQ ID NO: 5899 - protein, 500 aa, Brachypodium distachyon
MAMKDEQQPPLHILFFPFLAHGHLIPIADMAALFAARGVRCTILTTPVNAAIIRSVIDRANDASRQGTGFPEIEISVVPFPDVGLPAGVENGMALTSRGDRDKFYEAVKLLREPFDRFLAVHSHFDAVVSDSFFSWSVDAAAEHGIPRLGFLGTSMFARSCSDSMLRNNPLETAPDEPDALVALPGLPHRVELRRSQMMDPKKLPDHWEFFQSVNAADQRSFGELFNSFHELEPEYVEHYHTTLGRRTWLVGPVGLASKDMAARGTNTLSPDADSCLRWLDTKDANSVVYVSFGTLTSFSTGELRELARGLHLSGKNFVWVLRGAGAESSEWMPEDFAELMERGERGFIVRGWAPQMLILNHAALGGFVTHCGWNSTLEAVSAGVPMVTWPRYADQFNNEMLIVEVLKVGVSIGAKDYASSVETHEVIGGEVIAESISRLMGNTEEGDAIQKKAKDLGVKARSAVENGGSSYNDVGRLMEELMARRSSAKVERARTADGL

SEQ ID NO: 5900 - protein, 473 aa, Glycine max
MTMKDSIVLYSALGRGHLVSMVELGKLILSHHPSLSITILFLTPPPNQDTPTSPTAFTCDATAKYIAAVTAATPSITFHRIPQISILTVLPPMALTFELCRATGHHLRRILSYISQTSNLKAIVLDFMNYSAARVTNTLQIPTYFYYTSGASTLAALLYQTIFHETCTKSLKDLNTHVVIPGLPKIHTDDMPDGAKDRENEAYGVFFDIATCMRGSYGIIVNTCEAIEESVLEAFNEGLMEGTTPKVFCIGPVISSAPCRKDDNGCLSWLNSQPSQSVVFLSFGSMGRFSRTQLREIAIGLEKSEQRFLWVVRSEFEEGESAEPPSLEELLPEGFLDRTKEKGMVVRDWAPQAAILSHDSVGGFVTHCGWNSVLEAICEGVPMVAWPLYAEQKLNRVILVEEMKVGLAVEQNNNGLVSSTELGDRVKELMNSDRGKEIRQRIFKMKNSATEAMTEGGSSVVALNRLVEIWREH

SEQ ID NO: 5901 - protein, 545 aa, Vollenhovia emeryi
MSSCFILSFYFICCISIGLVTSKPLSVLLIQSIPSTSHHIWTEHLVKGLLRKGHHVHTVSVLETKIEGKLAENLTYDVFADVMTSHDKFEDYCPDQWEEFNEFYMAYVAYLWGIIKCDTVIKTKAAKELLEMIKTVEFDVIVHDVTLQQCFYGLWEDAKGKPPIVGLIPLGSAPWLKDFTGGPSYPTVRPYTSSVIAKPVGLWQTTWNTLYFMVDDLLRHYYFLPNAQRIAEKYVGHAIRPLHEIEKDSINIVLINSYCAFEPAIPVPPNTLETGGLHVQTVQPIAGDKVVTYPKNVHVFLDEAKSGAIVISLGTNVRWKCFGPDKIKAVILALSKLKQRVLWKLDIIDRDIEASFQMPDNVMTMKWIPQKEVLSHKNVKAVWMHAGLLSTQEAIWEGIPMIVTPFFMDQKSNAEVLVAKGVGIRLDFKILSTQSVLHAIEKILYNKSYTRNMKRLSSEFRDRPIPPLDLAVWSIEYTARHPNGSLATPLRSQSWMVQNLIDVYAVLFLIFFIILLSIYFLTRKLINFCYNYTYIVFKLCKSKQA

SEQ ID NO: 5902 - protein, 458 aa, Medicago truncatula
MENKSKKHAPHILVFPYPLQGHINPMLQFSKRLSQKGVKITLVNTISIWNKINNNIDLNSIETESISDGYDNGGMSSAENMESYKDTFWKVGPKSLSQLLHKLQSSNNPVDCVVYDAFLNWTFDVSKSFEIPVAVFLTQACSVNTINFHAFMKWIELPISKSEIVLPGLPTLQDADLPSFLYQYGTYPGYFDILTNQFSKIDQVDWVLVNTFYELEPEVVDWMAKKWRLKTIGPCIPSMFLDKRLEDDNDYGISTFGPNSEACIKWLDNKPKDSVVYVSFGSLAGLSEDQTKEMAYGLRDCGMYFLWVVRDSEKSKVPKEMLESSIEKGLIVNWCSQLQVLTHEAVGCFVTHCGWNSTLEALSVGVLVIAMPLWTDQITNAKFIVDVWKIGVKAHADEKGVVRRETIMDCLKEIMEIEKGDAMKKNAMKWKNLARISVGEDGSSHKNIVEFVNELTLC

SEQ ID NO: 5903 - protein, 464 aa, Sorghum bicolor
MESVAVVAVPFPAQGHLNQLLHLSLQLASRGLPVHYAAPAAQVRQARARVHGWDETALRSVEFHDLGISEYVSPPPDPTAPSPFPTHLMPLFEAYTAGARAPLAALLARLSASHRRVVVVHDRINAYAAEEAARLHNGEAFGLHCLAASTLAGKTDAGLRLLRERGLAFLDVAHHASREFADYVAKRAMPTKDISPGAGILVNSCRALEGEFIDVVAGDLAADGKKYFAVGPFNPLLDLRADAQTQSKPRHECLDWLDKQPPASVLYVSFGTTSSLRTEQIAELAAALRDSDQRFIWVLRDADRGNESADDGESQNRHAELLSKFTDQTEGRGRVITGWAPQLEILAHGATAAFMSHCGWNSTMESLSNGKPILAWPMHSDQPWDAELVCKYLNAGILVRPWEKHGEVIPAEVIRQVIEDAMLSDQGVAVRQRAKVLGEAVRACLADGGSSRKDLDDFIAHITK

SEQ ID NO: 5904 - protein, 499 aa, Eucalyptus grandis
MEQESDRGVHVLFFPLMAHGHMLPTLDMARLFTARGARATIITTPHNAPVFQNSLQIDAGSRIDLRTIEFPTREVGLPEGLENLDMVTTQDIQLKFFRAISMLSRPLEALVEELAPDALVADIFFPFANDIAAGHGIPRLAFHGTSFFSMCAAESVQRHRPHEKVSSDDELFRLPGLPDEIMMTRSQIRDELKISVETDFTRLLKRSHQAAGRCFGMIVNSFHELEPSYVDHYRNALGKRAWHIGPVSLCNRNLQEKAQRGGKGVSIDGHECLKWLDSRGPGSVVYVCFGTTSKFSDAQLQEIATGLEASGQDFVWVVSRDRKQEKGNEGEGQDDWLPEGFGKRIQGRGLIIRGWAPQVLILDHRSVGGFVTHCGWNSVLEGISAGLPMVTWPIFAEQSTTRKLVTRGPWRIGGRGSGPRRWGKWVGIVADREIVSKDRIEKALRQVMVGDEAEAMRDRAKLLADKARRAIEDGGSSYSDMNALIRELALHRIARDAKK

SEQ ID NO: 5905 - protein, 499 aa, Helianthus annuus
MKHKLINNKQAPNTPLMENTFVELVFIPAPAVGHIMSAMEMAKVLVNRHQSLSVTVLLMNPPLSMLALTTYIESLAKKAIERIRFIKLLQDQTPPKLDSKAPLMSYYEFINSHCKYVKNILEEMINQTGSRRVVGLVADWFCTGMIDVANEFNLPSYVYFTSSAAFLGFMVHFETLYVDQKQDLLELANSEGEIVIPSFVNPVPMRVFPELYQKQDGLDFLICTIGSMRKAKGILINTFLELESHAINWFSGTNFPPVYPVGPLLNLDSVAGKADDTDVFRWLDSQPRASVVLLCFGSMGCFDEAQLKEIARGLERSGHHFVWSVRRPPPLEQSFEVLPDDYDDPRVVLPDGFLERTLGVGKVIGWAPQVSLLAHEAVGGFVSHCGWNSMIESLWFGVPTATLPIYCEQQMNAFEMVVDLGLAVDLKLDYKINVINPEGDTVIVMAEEIERGIRSVMEDNEVRAKVKEMSKMSRATVVEGGSSYTSVGYLIKDMMRNII

SEQ ID NO: 5906 - protein, 480 aa, Helianthus annuus
MVNECAPKPHVALLASPGMGHITPLYELAVRLVTQHNFQVTFLVITAGSTVAQDSYLTAYPIPDLHIVDLPPPDMSNELLNNMKTVARLCYIVEQSIRPLRSVLNGLKRPKVKALIIDMFCTGVFEACKDLSIPVYSFFTASAALLTFSLYLPTLDCKADGEYVDLPEPVKVPGCNPIQTQDLMYLVPKSMINEYQQWFMHVSRLPMVTGIFVNSWEDLESVSLKAVKHEPFFANIPTPRVYPIGPLTKQAEPVLTKYEKETIAWLDKQPKDSVLFVALGSGGTLTSEQLTELAWGLELSQQRFVLVVRKPSDCAISGFFSAGSDVDDPIAYLPDGFVERSKGVGLVVSGWAPQVGVLSHPSTGAFLSHCGWNSTVESVKYGVPIIAWPLFAEQGINAALLSNEVGVAMRMPMVGEGGEAVVVRRKKIESVVKAVMEGEEGKKLRRRAKELQASGRETLSRGGSSYETLARVAESWNIET

SEQ ID NO: 5907 - protein, 487 aa, Unknown
  Description of Unknown: Oryza sativa Japonica Group sequence
MAMASANVLLLPEAGSGHLMSLIEAGKRLLAHGGRGDGEGPAVTVTVLVVRPATSESAAEVDAHVGRVEASGLGVRFHRLPAVEPPPMGCAAGNVQEFKSRYMQLQAPHVRAAAAELGAAALVVDFFATGVLDAAREAGVPTYVYFTSTAALLALMLRLPALEEEVPVDFEEFDGTVDVPGLPPVPAGSLPAFMGRKESPNFKWFLYHGRRFMDADGIIINTVAELEPALLAAIADGRCVPGRTAPPLYPIGPVLDLEDKPSSNARCVRWLDAQPPASVLFLCFGSMGWFDAAKAREVAAGLERSGHRFLWALRGPPAAGTVHPTDASLDELLPEWFLERTKGRGLVWPTWAPQKEILAHAAIGSFVTHCGWNSTLESLWHGVPLVPWPLYAEQRLNAFELVRDMGVAVPLGVDGKRRDSFVEAAELERAVRSLMDDASEVGRKVREKAAEMKAVCRNAVAPGGGSSYAALQRLLGAIRGGFSTMTQ

SEQ ID NO: 5908 - protein, 482 aa, Nicotiana tabacum
MKETKKIELVFIPSPGIGHLVSTVEMAKLLIAREEQLSITVLIIQWPNDKKLDSYIQSVANFSSRLKFIRLPQDDSIMQLLKSNIFTTFIASHKPAVRDAVADILKSESNNTLAGIVIDLFCTSMIDVANEFELPTYVFYTSGAATLGLHYHIQNLRDEFNKDITKYKDEPEEKLSIATYLNPFPAKCLPSVALDKEGGSTMFLDLAKRFRETKGIMINTFLELESYALNSLSRDKNLPPIYPVGPVLNLNNVEGDNLGSSDQNTMKWLDDQPASSVVFLCFGSGGSFEKHQVKEIAYALESSGCRFLWSLRRPPTEDARFPSNYENLEEILPEGFLERTKGIGKVIGWAPQLAILSHKSTGGFVSHCGWNSTLESTYFGVPIATWPMYAEQQANAFQLVKDLRMGVEIKMDYRKDMKVMGKEVIVKAEEIEKAIREIMDSESEIRVKVKEMKEKSRAAQMEGGSSYTSIGGFIQIIMENSQ

SEQ ID NO: 5909 - protein, 795 aa, Unknown
  Description of Unknown: Oryza sativa Japonica Group sequence
MARRQQAHFLIVTYPSQGHVTPARHLARRLVHGAGVRATVCVPVSAFRKMFPADDGEVVVEEEGGAVAYAAYSDGYDGGFDRAVDDHTRYMAQLSTVGARTVAGVLRRLRGEGRPVTCAVYTLLLPWVAGVARDHGVGAVAVFWIQPTTALAAYYHYFRGGRDAVVAAAASGDASAEVNLLPGLPPLRVRDIPSFLAITSDDDPFAFVLSEFAELIDTLERGGGGGGELPTYVLANTFDAMERDALASLRPHIDVVAVGPVLSFLHDADETKTASSPNDLFDHDGGGYLDWLGTKPARSVVYISFGSSSVMSKNQVAEIAAAMAESKKPFLWVIRKDNCKDDDDDNEAIKKLVAAAAAADTGGGGMAVEWCDQARVLSHASVGCFVTHCGWNSTVEAVACGVPVVAAPQYSDQGTSAWVVERIGVGVRAAARAGDGVVEAAELGRCVGAAMSEAVAGRAAAWREEARAAVARGGASERNLRFKSQWMKSCTHNSTATPLVLPCIFAMLIVCVMNARVLGGGGGGGGDGETTVVLAHGYGGSSHIWDDVAPALAKTFRVVVFDWSFSGDVVVDDDDDAAAVSEDISCSYFGFADELVAMMDELALTAVVFVGHSMAGMIGCIASVARPELFRHLVLVGASPRYINDDGDGYVGGFERGEVDAMLAAIEADFAAWAPLFAEAVVGPAPSPGAGAVAKFAKQLGRMRPAAALRVMRAVLTCDVRAVLRDVAAPCTIVHCARDAVAPLAVARYMQRAMARGVDGAPAPAVVVMDSSGHFPQLTAPMEFVRVMEAILLDH

SEQ ID NO: 5910 - protein, 473 aa, Prunus mume
MGSETPSTHIFLVCFPAQGHINPMLRLGKRLAAKGMLVSFSTTENYGKEMRKANSDINDQATPVGSGFIRFEFFQDGLPEDDPKRSDMDYYVPKLELVGKELVAQMIKRHATEGRPVSCLVNNPFIPWVCDVAVELGIPQATLWIQSCAVFSAYYHYNSKTVSFPTEAEPNIDVQLPGMPVLKHDEIPSFLHPSDPYQVLGRAILGQFKKISKSFYVLMDTFQELEPEIIEHMSQVCIVKPVGPLFKNPKAPETSIRGDLMKADDCLDWLDSKPPASVVYISFGSIVHLKQEQVDEIAHGLLSSGVSFLWVLKPPAKAYGLEKHVLPQGFLEEVGDKGKLVQWSPQEQVLGHTSVACFLTHCGWNSSVEALTSGVPVVTFPQWGDQVTNAKFLVDVFGVGLRLSRGMAENRLVTRAEVEKCLLEATVVDKAVELRQNALKWKKEAEKAVGEGGSSDRSLEDFLGEISKITSVA

SEQ ID NO: 5911 - protein, 493 aa, Oryza sativa
MAAATADGHGGRRRLRVFFLPFFARGHLIPMTDLACLMAAASTDAVEVEATMAVTPANAAAIAATVAGNAAVRVVCYPFPDVGLARGVECLGAAAAHDTWRVYRAVDLSRPAHESLLRHHRPDAIVADVPFWWATGVAAELGVPRLTFNPVGVFPQLAMNNLVAVRPDIVRGGADGPPVTVPGMPGGREITIPVSELPDFLVQDDHLSMSWDRIKASQLAGFGVVVNTFAALEAPYCDEFSRVDARRAYFVGPVSQPSRAAAAAVRRGGDGDVDCLRWLSTKPSQSVVYVCFGSWAHFSVTQTRELALGLEASNQPFLWVIRSDSGDGGGERWEPEGWERRMEGRGMVVRGWAPQLAVLAHPSVGAFVTHCGWNSVLEAAAAGVPALTWPLVFEQFINERLVTEVAAFGARVWEDGGGKRGVRAREAETVPAGVIARAVAGFMAGGGGRRERAAAMATALAESARVAVGENGSSWRDIRRLIQDLTDATASQP

SEQ ID NO: 5912 - protein, 465 aa, Cephalotus follicularis
MATPSTPTPHVVIFPFMAQGHILPLLDISKAMASNGVRVTIITTPSNSPFILSKTSHYSQISLSIIPFPKVEDIPEGCENVTDLPSLQFFNPFVKATRNLKQPFEDILAKMSKAGCLPICVISDMFLGWTVETCRSFGIPRIVSHGMGVLPMLIAKDGVLHAPYIRSLLDSDNVELLSIPKLPFPLIKADLPDAIRSYDPDLISLEIQEADKNSWGVIVNSFEELEGEFVVALESFFQKGAKAWCVGPTFLYDQVDQHYEKQSCPYIKWLDKQVGLDVVIYVSFGTQSHISNTQMDEIALGLEMAGQPFILVERSKTWVPPEGWMERIDEKGLVVRDWVDQRSILSHRATGGFLSHCGWNSVLEGLSMGVPLLAWPMGAEQKLNAKYVAMGLGAGLMVPQGSLIDRHVICDGVKGLMEGERGREARERAKFWSEIAIKAVEKGGSSRRNLDELVQCLVHRERRVI

SEQ ID NO: 5913 - protein, 486 aa, Eucalyptus grandis
MGSEARDNPHAVVIPFPAQGHINPILMLARILHHRGFHITFVHTEYNHKRLLKSRGLTSLDGLPRFRFETIPDGPQSDSDEDVTQHIPSLCESTSKNCLVPFMDLLGRLNDKSVDDTEVPKVSCVIADGGMSFALDAAEKLRLPGVLFWTPSACGSLVYTQYHMLREKGLFPLKDASYLTNGFLDTTIDWIPGMKNIRLRDLPGFIWTTDGNDIMVNYIIRQVERTHKASAVILNTFDCLEKDVLMALSSIFPNLYTIGPIHLLLNEIEDDNSSCIGSNLWKEDPACLGWLDSKEPNSVLYINFGSIAVVTSEQLIEFAWGLANSRKPFLWIMRPDLVAGDTAVLPSEFLAETKERAMLAGWCPQERVLRHPSVGGFLTHCGWNSMLESICGGVPVLCWPFFAEQQTNCFYSKNEWGIGMEIDNSVKRDEVEKLVRELMDGEKGKAMKKKAMEWKRKAEEATEPGGSSYEDLEKLLSQVLVKKLNG

SEQ ID NO: 5914 - protein, 369 aa, Genlisea aurea
LIGRQKSAVRDAVVGAFHGRESNIPAGFVVDMFCTAMVDVADELGIPSYVFFTCGAATLGLCFHVQGLKDYLNEDISKFDVPGEFFAVPGYRNPFPTNVMPGMLYDKERREDFVESVRIFRRLKGILVNSFLELEEDAIKFMSEDTRTPPIYAVGPVLQDSGDETRQGFREIMDWLDEQPDSSVVFLCFGTRGAFDEDQVKEIAAGIQRSGHRFLWSLRKPPPNGHRGFPSEYENFEEILPAEFLNGNGKVIGWAPQAAVLAHRAVGGFVSHCGWNSTLESVWFGVPVAVWPLGAEQQANAFQLVKEFETAVEIKMDYRVGSGEKIPAEKIEAAIRELMDLNNPIRLKAKELKEKSRTTLLPNQSSSNF

SEQ ID NO: 5915 - protein, 476 aa, Nicotiana tabacum
MGQLHFFFFPVMAHGHMIPTLDMAKLVASRGVKATIITTPLNESVFSKSIQRNKHLGIEIEIRLIKFPAVENGLPEECERLDLIPSDDKLPNFFKAVAMMQEPLEQLIEECRPNCLVSDMFLPWTTDTAAKFNMPRIVFHGTSFFALCVENSIRLNKPFKNVSSDSETFVVPNLPHEIKLTRTQLSPFEQSGEETTMTRMIKSVRESDSKSYGVIFNSFNELEHDYVEHYTKVLGRRAWAIGPLSMCNRDIEDKAERGKQSSIDKHECLKWLDSKKPSSVVYVCFGSVANFTASQLHELAMGIEASGQEFIWVVRTELDNEDWLPEGLEERTKEEGLIIRGWAPQVLILDHESVGAFVTHCGWNSTLEGVSGGVPMVTWPVFAEQFFNEKLVTEVLKTGAGVGSIQWKRSASEGVKREAIAKAIKRVMVSEEAEGFRNRAKAYKEMARKAIEGGGSSYTGLTTLLEDISTYSSTGH

SEQ ID NO: 5916 - protein, 421 aa, Unknown
  Description of Unknown: Oryza sativa Japonica Group sequence
MDASPLHVVVFPWLAFGHLLPALELAGRLASRGLRVSFVSTPRNIARLRRPCPSVEFVELPLPRVDGLPDGAEATTDVPDHMSSALWKASDGLTAPFSAFLDAAAAAGNKVDWLILDGMLSWAAASAADRKVPCVLMMPYTATACAHFGVPDEARDADRFPSAIARRFVSAFRSSELLAVRSCVEFEPESVPLLSNIFGKPVVPIGLLPPPQVDGDGDGDTALMSSWLDRQPPKSVVYVALGSEAPLTAEQRRELALGLELSGAPFLWALRKPHGGDDDGGLLPPGFEERTRGRGMVKTEWVPQLKILAHAAVGAFLTHCGHSSVIEGLRFGHPLVMLPLFLDQFTNASYLEGARGVGVQVARDGEHGGAFDRDGVAAAVRAAVVDEESKKAPPARHPHHVSCAAPATCPHHAGRCNKSPL

SEQ ID NO: 5917 - protein, 515 aa, Caenorhabditis briggsae
MRFLILLTLIFSFSNALNILFYQAVIGPSHIAYLRTTIKKLLDRGHTVDVVFAVYNEMTNLELSPEVRRVYYNRHADPDYWKKNANHFSNMFEKPSTPIGEFEIYHESGYQLCRIAINDNELFDFLKTGEYDIGFSSDYDPCGNILMTAAKIPSIGSLMATPIFYPQIVSAGLPTVASVFGTPFFPENDGSLYHKTFSLLRLTYYHYVIAPNLEQKYNQLIRQRFGNVFPDVSKIERDLDIVFVNSHDFLETQRPMSPKIKYIGGMAIREAKNLPEEFDRLLSVPASACVLFSFGTQVPTHKMPFQIRKNFVEAFKKFPNVTFLWKYDNMELDTEIFEGVDNVHRLEWLPQTELLHDDRVKLFISHMGLNSYLETATAGKPVLAIPLFADQQNNAQNAKNREMGLLLDRDQLTVRKIESTLRELLENPKYLSNAKSISKMILEQPEKPTEKFIKWLEFAARNPGLNKVFRMPGSDLSPFYYYCGDILMILIFITFMVFQFFLKQVSAFTRKIKTD

SEQ ID NO: 5918 - protein, 443 aa, Unknown
  Description of Unknown: Oryza sativa Japonica Group sequence
MESAPATTTSSSTQHGGGGGHIFLLAFPEAHGHVNPILQLGRHLAAHHGLLPTLVTTRHVLSTLPPPPAPFRVAAISDGFDSGGMAACGDAREYTRRLAEVGSETLRALLRSEADAGRPPRVLVYDPHLPWAGRVARGAGVPAAAFFSQPCAVDVIYGEAPESYPPFLEAVLGQFDGLEDADDVLVNSFQELEPKEADYLASAWRFKTVGPTVPSFYLDDDRLQPNKNYGFNISDSTSPCLAWLDNQPPCSVVYASYGTVADLDPTQLDELGNGFCNSGKPFLWVVRSCNEHKLSEELRDKCKERGLIVSWCPQLEVLSHKATGCFLTHCGWNSTTEAIVTGVPLLAMPQWTDQPTTAKYIESAWGNGVRVRRDKEGMVRKEEVERCIREVLESERKADYMKNANRWMKKAKEAMKKGGSSYNNIVEFASKLLIGQMMTNQVG

SEQ ID NO: 5919 - protein, 404 aa, Papilio xuthus
MNVFQFLILFTLYIPYGDVHKILVITHLPIKSHAILSHVLVKLLLEAGHEITHIAMFPFNYSHPNLHQIDASWNEKYTRGNDLQFYSQISSKIFTVTLQHKDVDKLFRDTTQRFDLIIAEWMFNDICIGVAALYDCPLIWFSASECHWSLLQLIEESTSTYTMGRTSRRIESFESASLRKEAYLRSFDKESFNKIFEPLMALRGQPLRPYVELMYYSSLVLVYSRVLLGDATRWPENFKPVAGYHIDQKVKPLPKDLKSIMDNAKYGVIYFSLGSHLKSKDLPEEFKQEIINMLRELKQTVLWKLESEYPDLPNNVHIMKWAPQQSILAHQNCVLFITQGGILSLTEAIYFGVPIIGIPIFADQFTNVDRAVKEGYGKKVDFSTKETVKSIKDAIEEMLHNPSK

SEQ ID NO: 5920 - protein, 474 aa, Arabidopsis thaliana
MAKQQEAELIFIPFPIPGHILATIELAKRLISHQPSRIHTITILHWSLPFLPQSDTIAFLKSLIETESRIRLITLPDVQNPPPMELFVKASESYILEYVKKMVPLVRNALSTLLSSRDESDSVHVAGLVLDFFCVPLIDVGNEFNLPSYIFLTCSASFLGMMKYLLERNRETKPELNRSSDEETISVPGFVNSVPVKVLPPGLFTTESYEAWVEMAERFPEAKGILVNSFESLERNAFDYFDRRPDNYPPVYPIGPILCSNDRPNLDLSERDRILKWLDDQPESSVVFLCFGSLKSLAASQIKEIAQALELVGIRFLWSIRTDPKEYASPNEILPDGFMNRVMGLGLVCGWAPQVEILAHKAIGGFVSHCGWNSILESLRFGVPIATWPMYAEQQLNAFTIVKELGLALEMRLDYVSEYGEIVKADEIAGAVRSLMDGEDVPRRKLKEIAEAGKEAVMDGGSSFVAVKRFIDGL

SEQ ID NO: 5921 - protein, 485 aa, Arabidopsis thaliana
MKLELVFIPSPGDGHLRPLVEVAKLHVDRDDHLSITIIIIPQMHGFSSSNSSSYIASLSSDSEERLSYNVLSVPDKPDSDDTKPHFFDYIDNFKPQVKATVEKLTDPGPPDSPSRLAGFVVDMFCMMMIDVANEFGVPSYMFYTSNATFLGLQVHVEYLYDVKNYDVSDLKDSDTTELEVPCLTRPLPVKCFPSVLLTKEWLPVMFRQTRRFRETKGILVNTFAELEPQAMKFFSGVDSPLPTVYTVGPVMNLKINGPNSSDDKQSEILRWLDEQPRKSVVFLCFGSMGGFREGQAKEIAIALERSGHRFVWSLRRAQPKGSIGPPEEFTNLEEILPEGFLERTAEIGKIVGWAPQSAILANPAIGGFVSHCGWNSTLESLWFGVPMATWPLYAEQQVNAFEMVEELGLAVEVRNSFRGDFMAADDELMTAEEIERGIRCLMEQDSDVRSRVKEMSEKSHVALMDGGSSHVALLKFIQDVTKNIS

SEQ ID NO: 5922 - protein, 495 aa, Arabidopsis thaliana
MKFELVFIPYPGIGHLRSTVEMAKLLVDRETRLSISVIILPFISEGEVGASDYIAALSASSNNRLRYEVISAVDQPTIEMTTIEIHMKNQEPKVRSTVAKLLEDYSSKPDSPKIAGFVLDMFCTSMVDVANEFGFPSYMFYTSSAGILSVTYHVQMLCDENKYDVSENDYADSEAVLNFPSLSRPYPVKCLPHALAANMWLPVFVNQARKFREMKGILVNTVAELEPYVLKFLSSSDTPPVYPVGPLLHLENQRDDSKDEKRLEIIRWLDQQPPSSVVFLCFGSMGGFGEEQVREIAIALERSGHRFLWSLRRASPNIFKELPGEFTNLEEVLPEGFFDRTKDIGKVIGWAPQVAVLANPAIGGFVTHCGWNSTLESLWFGVPTAAWPLYAEQKFNAFLMVEELGLAVEIRKYWRGEHLAGLPTATVTAEEIEKAIMCLMEQDSDVRKRVKDMSEKCHVALMDGGSSRTALQKFIEEVAKNIVSLDKEFEHVALK

SEQ ID NO: 5923 - protein, 319 aa, Unknown
  Description of Unknown: Spirochaetales bacterium sequence
MKILFYAVNGLGLGHVTRLLAMAREIRKLKPRWEILFITTSESDALYREGFASVKLPSKTVARATGMSVPGHLSILHQAAWSVFASFKPDTTVVDTFPEGFAHELDQVLRWEESKFVYVFRQRREVKLNDRYFQSLLRRYRLILVPHNPGEEGIRITGNDRVVHTGPILIRGRRDLRDADEVKRAYGLPQDKKLILINMGGGGQAGLETILGKIVRAVNGVPGCYPVAALGGLSPDMALSGCGIIRGCYPVCELYKAFTGIIAGCGYNTVHEVLYFRKPGIFIPFERTVDDQERRALWVKEKGAGLTADPGNLDMISGL

SEQ ID NO: 5924 - protein, 463 aa, Ziziphus jujuba
MFNPPRIIVVTYPAQGHLNPALQFSKNLTAIGAEVTFLTSLSAYRRMNTLSFPNSLTFFPFSDGHDDSVGFDPKNSLDHYMFELSHCGSQALSDLIVSGEKEGRPFCCVVYTLLLPWAGKVAKELRVPSALLWIQAATVFDIYYYYFHGYDGVMSNNYSDGSSLIELPGLPLKLTGIDLPSLMDSANIYTFAMPTLKDLFEMLDKEGNPKVFVNTFNDLEPKAIKAIGKFDLIGIGPLIPSAFLDGKDPSDTSFGGDLLQHPKDYYMEWLSSKPKGSVIYVSFGSMSKLSKPQMEEIGRALLDIKRPFLWVNIGEEGEDELSCREELEKLGMIVPWCSQMEILSNPSLGCFVTHCGWNSTLESLVCGIPMVGFPQWSDQGTNAKLVMETWKSGVRARANQDGIVEGDEIKKCLELVMGDGEKGEEIRRNAKTWKDLGREAAMDDGSSYKNLKAFLDDIIQDRN

SEQ ID NO: 5925 - protein, 505 aa, Medicago truncatula
MVSQDPKVHFVLFPMMAQGHMIPMMDIAKILAQHQNVIVTIVTTPKNASRFTSIVARCVEYGLDIQLVQLEFPCKESGLPEGCENLDMLPALGMASNFLNALKFFQQEVEKLFEEFTTPATCIISDMCLPYTSHVARKFNIPRITFLGVSCFHLFNMHNFHVNNMAEIMANKESEYFELPGIPDKIEMTIAQTGLGGLKGEVWKQFNDDLLEAEIGSYGMLVNSFEELEPTYARDYKKVRNDKVWCIGPVSLSNTDYLDKVQRGNNNNKVSNDEWEHLKWLDSHKQGSVIYACFGSLCNLTPPQLIELGLALEATKRPFIWVLREGNQLEELKKWLEESGFEGRINGRGLVIKGWAPQLLILSHLAIGGFLTHCGWNSTLEAICAGVPMVTWPLFADQFLNESFVVQILKVGVKIGVKSPMKWGEEEDGVLVKKEDIERGIEKLMDETSECKERRKRIRELAEMAKKAVEKGGSSHSNISLFIQDIMKKNKDMMSSFIHGNANSK

SEQ ID NO: 5926 - protein, 479 aa, Arabidopsis thaliana
MVKETELIFIPVPSTGHILVHIEFAKRLINLDHRIHTITILNLSSPSSPHASVFARSLIASQPKIRLHDLPPIQDPPPFDLYQRAPEAYIVKLIKKNTPLIKDAVSSIVASRRGGSDSVQVAGLVLDLFCNSLVKDVGNELNLPSYIYLTCNARYLGMMKYIPDRHRKIASEFDLSSGDEELPVPGFINAIPTKFMPPGLFNKEAYEAYVELAPRFADAKGILVNSFTELEPHPFDYFSHLEKFPPVYPVGPILSLKDRASPNEEAVDRDQIVGWLDDQPESSVVFLCFGSRGSVDEPQVKEIARALELVGCRFLWSIRTSGDVETNPNDVLPEGFMGRVAGRGLVCGWAPQVEVLAHKAIGGFVSHCGWNSTLESLWFGVPVATWPMYAEQQLNAFTLVKELGLAVDLRMDYVSSRGGLVTCDEIARAVRSLMDGGDEKRKKVKEMADAARKALMDGGSSSLATARFIAELFEDGSSC

SEQ ID NO: 5927 - protein, 426 aa, Unknown
  Description of Unknown: Oryza sativa Japonica Group sequence
MSQETPARRSLPHLLLVSAPLQGHVNPLLCLGGRLSSRGLLVTFTTVPHDGLKLKLQPNDDGAAMDVGSGRLRFEPLRGGRLWAPADPRYRAPGDMQRHIQDAGPAALEGLIRRQANAGRPVSFIVANAFAPWAAGVARDMGVPRAMLWTQSCAVLSLYYHHLYSLVAFPPAGAETGLPVPVPGLPALTVGELPALVYAPEPNVWRQALVADLVSLHDTLPWVLVNTFDELERVAIEALRAHLPVVPVGPLFDTGSGAGEDDDCVAWLDAQPPRSVVFVAFGSVVVIGRDETAEVAEGLASTGHPFLWVVRDDSRELHPHGESGGGGDKGKVVAWCEQRRVLAHPAVGCFVTHCGWNSTTEALAAGVPVVAYPAWSDQITNAKLLADVYGVGVRLPVRRRGHERAGGGGDAAEGAGVERQGERGGG

SEQ ID NO: 5928 - protein, 478 aa, Medicago truncatula
MEAKTHIALVTIPVFSHQVSLLEFAKRLNHLYKNSFQVTCIIPTISDSPSISSKHYFDDLPSNIQCIFLPPINFEDLRSESLVLESQVQIAVTRSMPLVCETLRSISSSSNVVALIVDSFVHEAHEFAKELNILSYIYFPCSAMVLSMCLYSSKLDETITCEYKDHPQPIEIPGCMSVQGTDLPDSLQNRSSLAYKLFLHRSQQLRQADGIIINSFHEMESKALKAISLISPKNLYGTTFDVYPVGPIIQTRPNIKKHACECWLDNQQPKSVLYISFGSGGTLSQDQINELALGLELSNHKFLWVNVRPPNNKATASYLSNEEMDPLHFLPLGFLQRTKGQGFVMCGWAPQVEVLKHKAIGAFLTHCGWNSILESIVHGVPMIAWPLFAEQRSNAALVTNGLKIAMRTKYNSKGIVVKEEVANIIKGIMEGLESGEIRRRMKELQKFANCAIMENGSSMKTFSLLALKWKSLSRPIED

SEQ ID NO: 5929 - protein, 411 aa, Medicago truncatula
MSDEVVHVAMFPSAGMGHLTPFLRLASLFLNNNCKVTLITPLPTVSLAESQLLDHFHSCFPQVNRVPFNLPPPPPSSSISVDPFFLRVQTLRNSTHLLPSLISSLSPPITVFISDILLFSPLNKITQKLSLPNYILNTSSSAMFSLFSHFPTLAQSLSSQEQEYDASDGVLVPGIPFSPLPYSSIPPFLLQPTSILRNLAMEDSPKLVYLHGVFANTFEALESHSLEALNSGKVVKNMPPVYAVGPFVPFEFEKGQKEASSPRSIKWLDDQPIGSVVYVCFGSRTTLGREQMKEIGDGLMRSGYKFLWVVKDKIVDKEEEVGLDEVLGVELVEKMKDRGLVVKEWVDQSEILSHKSVGGFVSHCGWNSITEAALNGVPILGWPQHGDQKINAKLVEISGWGVVEQELGLGW

SEQ ID NO: 5930 - protein, 1714 aa, Frankliniella occidentalis
MKHASPARAVAPKNVAVLVATLFLPLLLMQCITSAASEVKSTAAAPAVAPAAAPAGAPVAAATPAREPLRILSIMTVGTMSHHIWMSALTVELAKRGHLVTSIDIHKHGENPPTLNTTIIETAFKLANPEHMKRWLAATVVQQISLLQEIVEKECIRDLGAPAMQRLLDSAFESTYDLIIIDYMSDCMLGFAHRFNYPGMIAVSPFPISPWIDDLMYNPQVPSILAHTMQPFPHPMNLWQRAWTLYLHAHSKLVVWWWRPVQDSLIKRFFGEDAPSVEQLRQHVHVALVNENPILEAARPLPPSLIPVGGMHVKPADLGRIPSDLRKWMDDAKDGFIFVSFGSIMKGKFIDPVKKRALVDSFAALAPVRVLWKIEPDSVAAEPVAANVRVEAWAPQNDLFGHPNLRLFVSHCGGLSVQEASHHGVPVLGTPFIVDQFVNLEKVVGIGMGRGMPFNELTKERFVAEIKEMLTNPRYLKAARHTRTLIHDQKETPLERAVWWAEYVGRHRGAPHLRSPARDLYWHQVMMLDIAALLALAMLVVLLIAFLVAKCAVYVSRSIGLQLKDPLKSTKKDCWAQRCPLGLRPSESTSQVAGPAVRPSASEMQHASPARASARQSVAVLVIALIMPLLLKQCVSSAAPEVKTTAASHAREPLRILALMTIDTMSHHIWMSALTVELAKRGHLVTSIDIHKHSENPPTLNTTIIETAFRVFDDPEDMGRWFAASVVKQISMLQSMSEEDCKRDLGSPTMQRLLDPAFKGAFDLIIFDYMSDCTLGFAHRFNYPGMLAVSPFPVSPWIDDLMYNPQAPSILAHTMKPFPHPMNLWQRTWSLFLHAQYKLTVWWRRPVQDGIIKRFFGDKAPRVEQLRQHVHVALVNENTVLGAARPLPQSLIPVGGMHVKPADLGRIPADLRKWMDEAEDGFVFVSFGSIMRGKDIDLVKKRALIESFAALAPVRVLWKIEPDAVAAQPVAANVRVEAWAPQNDLLVHPNLRLFVSHCGGLSVQEASYHGVPVLGTPVAVDQFVNLEKVVSIGMGRRMPYTEITKERFVNEIKEMLTNPRYLKAARHTRTLIHDQKETPLERAVWWAEYVGRHRGAPHLRSPARDLYWHQVMMLDIAALLTLAVLAVLLVALLVVSLPAKTKRTSRDNGLAVRPSASDMQHASPARAAARQNVAVLVIASLLPLLLMQCVSSTAPEVKTTAAGTARKPLRILALMTFDTMSHHIWMSALTVELAKRGHLVTSIDIHKHSENPPTLNTSIIETAFRIFDDPEDMGRWFAASVVQKIGIVQSLLEEDCKRDLGAPAMQRLIDPAFKGTFDLIIIDYQADCMLGFAHRFNYPGMLAVSPFPIAPWVDDLMHNPQVPSILAHTMQPFPHPMNLWQRASTLFLHAHSKLTVWWRRPVQDSLIKSFFGEDAPSAEHLRQHVHVALVNENPVLEAARPLLPSQIPVGGMHVKPADLGRIPADLRKWMDEAEDGFVFVSFGSIMKGKDIDPSKKRALVDSFAAVAPVRVLWKIEPDAVGEQPLAANVRVEAWAPQNDLLVHPNLRLFVSHCGGLSVQEASYHGVPVLGTPVAVDQFVNLEKVVGIGMGRGMPYTEITKERFENEIKEMLTNPRYLKAARHTRTLIHDQKETPLERAVWWAEYVGRHRGAPHLRSPARDLYWHQVMMLDIAALLALAVLAVLLVAFLVVKCAVQVVRKNMQQRKESLKSAKQD

SEQ ID NO: 5931 - protein, 203 aa, Rosa chinensis
MSKLWPLKTIGPTIPSMYLDNRLKEDKDYGVSLFKQNNDACMKWLNERPKVSVVYVSFGSGAELGAEQMEELAWGLRSSKSNFLWVVTESEAGKIPKGFVLAHEAVGCFITHCGWNSTLEALGLGVPILAMPQWTDQGTNAKYIVDVWKIGLKALADEKGIVRKDVVVHCIIEIIEGATGKERRRNAMKWKQVARKAMDEGGS

SEQ ID NO: 5932 - protein, 496 aa, Triticum aestivum
MTFAGSGDGQSGSARAHFVLVPMMAQGRTIPMTDMACLLAEHGAQVSFITTPVNAARLEGFAAKVEAAGLVVQLVELHFPSVEFGLPDGCENLDMIQSKNLFFNFMKACAALHEPLMAYLREQQRSPPSCIISDMAHWWTGDIARELGIPRLTFSGFCGFSSLVRYIVFHNNVLENVTDDNELITIPGFPTPLELTKAKLPGTLCVPGMEQIREKMFEEELRCDGEITNSFKELETLYIESYEQITRKKVWTIGPMCLCHRNSNRTAARGNKASMDEAQCLQWLDSRKPGSVIFVSFGSLACTTPQQLVELGLGLEASKKPFVWVIKAGAKLPEVEEWLADGFEERVKDRGLIIRGWAPQLMILQHQAVGGFVTHCGWNSTIEGICAGVPMITWPHFGEQFLNEKLLVDVLQIGMEVGVKGVTQWGSENQEVMVTRDAVETAVNTLMGEGEATEELRMRAEDCAIKARRAFDEEGSSYNNVRLLIQEMGNKTNACG

SEQ ID NO: 5933 - protein, 489 aa, Medicago truncatula
MEEKTKMDMEEGEEKALTIYFIPYLAPGHMIPLCDIATLFALRRQKVTIITTPSNAQILGKSIPLNQHLRIHTVPFPSHEVGLPDGVESLSAATDLENLRKIFQATTLLQPPIQHFVEQHPPDCIVADFLFPWVDELANKLQIPRLSFNGFSLFAICAIESVKAHSLYESASFVIPGLPHSIAMNAAPPKQMSDLLEALLETVFKSNGIIVNNFSELDGEEYIEHYEKTTGHKAWHLGPASLIRRTVQEKAQRGQQSVVSVHECLSWLDSKPDNSVLYICFGSLCLFPDKQLYEIACGIEASGHKFIWVVPEKKGKEDESEEEKGKWLPKGFEERNIGKKKGLIIRGWAPQVMILSHKALGAFMTHCGWNSTVEAVSAGVPMITWPVHGEQFYNEKLITQVRRIGVVVGAAEWSSTGIGEREKVVGRDSIEKAVRRLMDGGDEAEKIKKYAREFGDKAKHAAQEGGSSHRNLTAVIDDLKILRDRKLRV

SEQ ID NO: 5934 - protein, 482 aa, Capsella rubella
MNRERTHILFFPFMAHGHMIPTLDMAKLFASRGAKSTLLTTPINAKILEKPIEAFKVQNPDLEIGIKIFDFPCVELGLPEGCENVDFINSYKESDSGDLFFKFLFSIKYMKQQLESFIETTKPSALVADMFFPWATESAEKFGVPRLVFHGTSFFALCCSYNMRIHKPHKKVATSSTPFVIPGLPGDIVITTDQANVVVDEETPFGNFWKEVRESEISSYGVLVNSFYELESTYVDFYRSFVAKRTWHIGPLSLSNRELAEKAGRGKKANIDEQECLKWLDSKTQGSVVYLSFGSRASFTNEQLLEIAFGLEGSGQNFIWVVSKNENQGESEEWLPKGFEERTKGKGMIIRGWAPQVLILDHKAIGGFVTHCGWNSTMEGIAAGLPMVTWPMGAEQFYNEKQLTKVLRIGVNVGATELVKKGKLISREEVEKAVKEVLVGEEAEERRIRAKKLGEMAKAAVEEGGSSYSDVTKFMEELNGRK

SEQ ID NO: 5935 - protein, 355 aa, Medicago truncatula
MDALDFAKEFNLLSYVYYPASATSLSSYFYLLKLDKETSCEYRDLPGPIQIPGSVPIHGRDLFELAQDRSSQSYKYLLQGVEKLRLFDGILINSFIEIENGPIEALTDEGSENLLVYAVGPIIQTLTTSGDDANKFECLAWLDKQRPCSVLYVSFGSGGTLSQEQINELALGLELSNHKFLWVVRSPSNTANAAYLSASDVDPLQFLPSGFLERTKEQGMVIPSWAPQIQILRHSSVGGFLTHCGWNSMLESVLHGVPLITWPLFAEQRTNAVLLSEGLKVGLRPKINQNGIVEKVQIAELIKCLMEGEEGGKLRKNMKELKESANSAHKDDGSATKTLSQLVLKWRNFGIEKQV

SEQ ID NO: 5936 - protein, 487 aa, Polygala tenuifolia
MEKNQPRLHAIMFPLPFQGHVNPLMQLAIKLASMGVTVTFVNTQFIDQQINKARAYDYTAGDDMFAEARQSGLDIRYTTITDGFPLKFDRNAIDKFWPGLEIVFPAHVDELLSNMMGSDLDPTLTCLIADTFFNWTSDLARKHNLVNVSCWTQPALTYSINYHMDLLKMNGHFGSHDIREDAITYIPGVPAIDLEDLPSFFQQNDPSDLIVRIAETSFQCCRRADFVLFNTIEELESETISALQHDQQQIYAVGPLVSSLELAKGMVPSASFHFESDCAQWLNTKPHGSVLYVSFGSACLIGKLDIMELAYALFLSEVNFVWVLPPHLVGSDPISFLPAGYEEDIKDKGLIVQWCNQVAVLSHSATGGFLSHCGWNSTLESIWCGIPLLCSPLSYDQTPNRKLIVDAWKIGLNLCQKKSIRREEAARNIQKLMHGEIADELRSNVSVMRQTMKHATVAGGSTERNLDRFINSVKAKSNMKFDNDRKI

SEQ ID NO: 5937 - protein, 597 aa, Papilio xuthus
MFPVPGRSHAILGEGFVRHLLNDGHEVTYITPIIMKMTHPRLRQIDISNSKLMPPDQMFDTQNILMNKWDFKNIKFMLFVTTNFVNGTLTHPNIQRLIHDPSEQFDAVIVEWLYSELYAGFASVFDCPLIWSSSLDPHWLVLDLIDEIPNPAYNPQHLADIVTPLGFWNRAEELWHVIHTKYFKWRLRHKENHIFDNAFASSVALRGRILPPLNEVRYNGSLILGNSHLSAGTAMRLPPNYIPIGGYHIKENIDPLPPNLQDIADNARNGFIYFSMGSMLKSSRIPDEMKKGLLNVFSKLDQTIIWKFEQELPDRPNNVHIVSWAPQLSILAHPNCKLFITHGGLLSVLETLHFGVPIIGVPMFGDQHMNINRVVEKGFGMRVDLNDDVVGNMEIAIREILDNPRYAQKVKEYSFIYHDRSTSPGQELTHWVSHVIRTKGAPHLRSPGYMLPWYQKLYLDLAIVIFITHVTGIPYNISHPNLRRFEVDYFLESIPNMDSSRAFGRIIRELFISSLREKDVNMLLRDTKERFDLVVAEWMFNDLYAGLSALYDCPLLWFSATESHWMMLRLLEDTINSQDTTSKYIPPFITSYIIQDM

SEQ ID NO: 5938 - protein, 464 aa, Zea mays
MAERVSQHIVHVLLLPNPTQGHINPILEFGKRLAAHRGVQCTLAVTRFVLSKSGQSSAGGAVHIAPISDGCDRGGYGEAGGIEACTARLESAGSATVGELLRSKAERGRPVRALVYDAFLPWAQRVGRRHGAACAAFFTQPCAVDVAYGHAWAGRVEPPLPLGEEQLEPLPGLPGGLRPCDLPTFLTDKDDRAYLDLLVSQFVDLDTADHVLVNSFYELQPQESDYMASTWRAKTVGPAVPSAYLDNRLPDDTSYGFHLYTPMTETTKAWLDARPARSVVYASLGSIAKPDAAQTAEMAEGLYGSGKAFLWVVRASESAKLPENFAGRTTEERGLVVTWSPQLEVLAHPAVGCFVTHCGWNSTMEALGAGVPMVAMPQWSDQTMNAKYIEDVWRVGVRVRPDGRGVVRKEELERCVREVMEGERSLDYIRNAAGWKEKARSAMSEGGSSDKNVLDFLGALGLKK

SEQ ID NO: 5939 - protein, 478 aa, Ricinus communis
MKNKAELVVVSMPGVGHVVSTIEFAKNLIERNDQLHISIIVMKFPTTPFVDQYAKSLTASQPNLQLIHLPDQVEGLPTLQVFAKSVQSYYSAVIACYKPHVRKIVSDMISSRSSPDSVPVVGLVLDLFCVSLIDVGNEFDLPSYIFFTTGTPFLSLMLHLPPRHEQVGTEFSFSDPDVSLPGIANPVPIKCLPDAVFNKDGGYDTYLNVGRRLKDVKGILVNTVSELESQALQYLNSAQITSIYTVGPVLHLKSQPHPDMEQGRWGKIKTWLDEQPESSVVFLCFGSSGSLSVSQVKEMALGLEQSGHRFLWSLRLPPVKLQETMYKSAEEMLPEGFLERVRGRGMVCGWAPQVEVLAHKATGGFVSHCGWNSILESLWYGVPIVALPIYAEQQINAFAMVKELGLAVELKMDYRQSDVIPAEEVKTTLTRLMDNEEELKRKVKNMSEISRKALKEGGSSSISISRFMKDLLGSSYFD

SEQ ID NO: 5940 - protein, 469 aa, Cephalotus follicularis
MATKMQPTGSSPKQHVGVMVFPFGSHVISLFHLVRKLATAIPNTHVSFFNTAKSNNSIFLASKSTHEDIPSNIKAYNIGDGVPMNHVFTSYPGEAVELFLKATPDNFYQGFDTAVSEIGLKISCLITDGLLSFAGDISKEMHVPWIPVWSPVPHSLYVHVYTDLIRQHYANVEGSDSGDKTLEFIPGLSKIHMDDLPDGILPKSSSNLEESLFHSMLSKLGHMLPQSATVVMNYYQELYPVPLLDDLKFKFPGLLNVGYVTLSMPPPPLLPSNLDATGCLSWLDGQKDMSVAYISFGTVAVVPPNETLELGEALEASGVPFLWTLKDDLKDHLPNGFLERTSMQGKVVPWAPQTQVLAHSSIGVCVTHFGANSVNESIANGVPMIGRPFFADHHINGRIVEEIQGIGLRVEALTKSGVIESLELVLVHEQGKEMRKKVQSLKEIVLKAAGPTGSATKDFQTLVEKISIL

SEQ ID NO: 5941 - protein, 483 aa, Prunus mume
MSPVASKEKPHAVFVPFPAQGHINPMLQLAKLLNYKGFHITFVNTEFNHKRMLESQGSHALDGLPSFQFKTIPDGLPPADADARRNLPLVCDSTSKTCLAPFEALLTKLNSSPDSPPVTCIVADGVTSFTLDAAEHFGIPEVLFWTTSACGLMGYVQYYRLIEKGLTPFKDAKDFANGYLDTEIDWIPGMKDIRLKDMPSFIRTTDPNDIMLHYMVSETERSKKASAIILNTFDALEQEVVDALSTLLPPIYSIGPLQLPYSEIPSEYNDLKAIGSNLWAENTECLNWLDTKEPNSVVYVNFGSTTVMTNEQLVEFSWGLANSKKPFLWIIRPGLVAGETAVVPPEFLEETKERGMLASWCPQEQVLLHSAIGGFLTHSGWNSTLEALCGGVPLICWPFFAEQQTNVRYSCTQWGIGIEIDGEVKRDYIDGLVRTLMDGEEGKKMRKKALEWKKLAEEATAPKGSSYLALENVVSKVLLSPRD

SEQ ID NO: 5942 - protein, 455 aa, Vigna angularis
MTIMMARPHVMVVPYPAQGHVIPLMDLSLILVKQGIKITFVNTKENHDRIKSALPCGDGLLSQIYLVWISDGLESSEERKKPGKSSGAVLKVMPEKVEELIECINGSESEKITCVLADQSIGWALDLAEKKGIRRAAFCPASAAQLVLGLSIPKFIHNGIIDKDGTPLEKKGIQLSPTMPSVSTEKLVWVCVGNKTIQRHIFQLMVKNIESMKKTEWLLCNSSHELESEAITMAPEIIPIGPLLSCDQFGHSAGNFWPQDLSCLKWLDQQSPNSVIYVAFGSFTKFSPPQFQELCFALELSNRPFLWVVQPEESKLAYPEGFVERVVERGRVVGWSPQKKILIHPSVACFISHCGWNSTLESVSNGIPVLCWPYFADQFLNKSYVCDIWKVGLGLEPNESGMITQGEIQSKIHQIFIDEQLKSRARDFKEKIHIGTGQGGLSNKNLDSFISWIKS

SEQ ID NO: 5943 - protein, 484 aa, Eucalyptus grandis
MGESHQVHIFFFPFMASGHMIPMIEMAKLFAIRGCKSTLIATPHDKPTFLKSITKTKDAGFDIDVVTVTLPLKEVGLPEDSDNMNKITTEEIRKQFYRAIRMLDQQLERLIEKLAPNCLVSDMFLPWTTEIAAKWGIPRLVFHGSSAFSSAGAGCVRIYEPHKKVSHDSEPFIIPNFPGEITMSRMQLPDFYREETEFTKFFNEVKESEKRSFGVVMNSFYELEPAYADHYRTFLGRRSWFVGPLSLCNKESEDKAHRGNQASIDQHECLKWLDSRQPNSVIYICFGSMANFNASQLHEIVVGLEASGQQFIWVVKKDPNVEEGKEEWLPDGYESRIRNKGLIIRGWAPQVLILDHEAIGGFVTHCGWNSTLEAITAGVPMVTWPVAAEQFFNEKFVTQVLKVGVSIGVKQWVRLFGDSVKSERVEDAVKRVLVSEEAEEMRRRAKALAEMARGAVEEGGSSWSDLGALLQELGQLRLAHIKKI

SEQ ID NO: 5944 - protein, 472 aa, Unknown
  Description of Unknown: Oryza sativa Japonica Group sequence
MTTKTFVMYPSLGVGHLNPMVELAKHLRRRGLGVVVAVIDPPNNDAVSADAMARLAAANPSITFRLLPAPDSPDVGAHPIKRSHDTLKLANPVLREFLRSLPAVDALLLDMFCVDALDVAAELAIPAYFFFPSQASALAVFLHLPYYYPNLPTFMEMGKAALLRFPGMPPIRTVDMPAMLRDKDSEATKVRLYQFKRMTEAKGVLVNSFDWLQPKALKALAAGVCVPDKPTPRVYCIGPLVDAGRKSRIGGERHACLAWLDAQPRRSVVFLCFGSQGAFPEAQLLEIARGLESSGHRFLWTVRSPPEEQSTSPEPDLERLLPAGFLERTKDRGMVVKNWVPQAEVVQHEAVGAFVTHCGWNSTLEAIMSALPMICWPLYAEQAMNKVIMVEEMKIAVSLDGYEEGGLVKAEEVEAKVRLVMETEEGRKLREKLVETRDMALDAITEGGSSEMAFDKFMRDLEESSLENGVRS

SEQ ID NO: 5945 - protein, 503 aa, Medicago truncatula
MASQDPKLHFVLFPMMAQGHMIPMMDIAKILAQHHNVMVTIVTTPHNASRYTSILARYLESGLHIQLVQLKFPFKESGLPEGCENLDMLPSLGAATNFFNSSKFLQQEVEKLFEELTPSPTCIISDMCLPYTVHIARKFNIPRISFGGINCLYLLCLHNLHVNNIMQTMANNEFEYFDVPGIPDKIEINIAQTGLGLKGEAWEQFNSDLAEAEMGTYGVIMNSFEELEPAYAREFKKVKNDKVWCIGPVSLSNTDYLDKIQRGNNNKVSIDEWEHLKWLDSQKQGSVLYACLGSLCNITPLQLIELGLALEATKIPFIWVLREGNELEELKKWIEESGFEERINGRGLVIKGWAPQLLILSHLAIGGFLTHCGWNSTLEAICAGVPMVTWPLFADQFLNECLVVQILKVGVKIGVKSPMKWGEEEDGVLVKKEDIERGIEKLMDETSECKERRKRIRELAEMAKKAVEKGGSSHSNISLFIQDIMKKNKDMMSSFTNGNANSK

SEQ ID NO: 5946 - protein, 457 aa, Unknown
  Description of Unknown: Oryza sativa Japonica Group sequence
MAAPPPPRPQPHVMVLPFPAQGHVMPLMELSHRLVGLGFEVEFVHTDFNRDRVINAMANETGAIPDGIHMVSFPDGMDPAGDRANIAKLGDGLPAAMLGGIEEMIRSEGIRWVIADVSMAWVTELAATVGVHVALFSTYSAAVVAHRLQVPKLIQDGVLDEIGNVRRNEMIQLRPTMPPVLAVELPWVTLSGTPDGRRMVIQNVFKTNPTISSAEVIICNTFQDIEPGALALVPNVLPVGPLEAPATSRLAGHFWPEDTTCLAWLDEQDACSVVYVAFGSFTVFDMARVQELADGLVLSGRPFLWVIRQNFTNGAGEGWLEEFRHRVSGKGMIVGWAPQQSVLSHPSIACFVSHCGWNSTMEGLRHGVPFLCWPYFADQYCNQSYICNVWGTGVKLQADERGVVTKEEIKNKVEQLVDDKEIKARAAKWKHAACTSIAEGGSSHENLLKFVNLLREQ

SEQ ID NO: 5947 - protein, 489 aa, Unknown
  Description of Unknown: Oryza sativa Japonica Group sequence
MEPFTSAAVEPAPPTADDQRDAPRPHVVLLASPGAGHLIPLAELARRLADHHGVAPTLVTFADLDNPDARSAVLSSLPASVATATLPAVPLDDIPADAGLERMLFEVVHRSLPHLRVLLRSIGSTAALVPDFFCAAALSVAAELGVPGYIFFPTSITALYLMRRTVELHDFAAAGEYHALPDPLELPGGVSLRTAEFPEAFRDSTAPVYGQLVETGRLYRGAAGFLANSFYELEPAAVEDSKKAAEKGTFPPAYPVGPFVRSSSDEAGESACLEWLDLQPAGSVVFVSFGSFGVLSVEQTRELAAGLEMSGHRFLWVVRMPSLNDAHRNGGHDEDPLAWVPDGFLERTRGRGLAVAAWAPQVRVLSHPATAAFVSHCGWNSTLESVATGVPMIAWPLHSEQRMNAVVLEESVGMALRPRAREEDVGGTVVRRGEIAVAVKEVMEGEKGHGVRRRARELQQAAGRVWSPEGSSRRALEVVAGKWKAAAQK

SEQ ID NO: 5948 - protein, 470 aa, Medicago truncatula
MEKTIHIAVIPGAWYSHLVSILEFSKLLVQLHPDFHVTCFIPTLGSPSSASKSFLQTLPSNIGYTFLPPVNPNDLPQGTSVECQIHLATTLTLPYLHQALNSLTLRTPPVALVVDSLSAEALDLAKEFNMLSYVYFPPAATTLSFYFYLLKLDKETSCEYRDLPEPIQAPGCVPIRGRDLVAQAQDRSSQSYKFLLQRIKRFCSVDGILINSFLEIEKGPIEALTEEGSGNPAVYPIGPIIQTRTESGNNGMECLTWLHKQQPCSVLYVSFGSGGALSQEQIDELAIGLELSNHKFLWVVRAPSSSASGAYLSAENDVDLLQFLPPGFLERTKEQGMVIPSWAPQIETLSHRSVGGFLSHCGWNSILESVMHGVPLITWPLFGEQRMNAVVLSEGLKVGLRPRVNDNGIVEREEISKLIKGLMEGEECENLRNNMKELKEASTNALKEDGSSRKTISQLALKWRNLVHEN

SEQ ID NO: 5949 - protein, 468 aa, Medicago truncatula
MNKKPCIAMVPSPGLSHLIPQVEFAKQLLQHHNEFIVTFIIPTLSPLTPSMQQVLNNLPPNIDFILLPQVKNIQQSHDPAAQMKLIVKHSIPFLQQEVKSLISKTNLVSLIFSIFSTDAYEVAKQFNLSSYLFYASGAVPTSFYLTLLNLDDSISSEIEFLESAYETVNVPGSIVPYHIKDIPDPLLCERSSLEYKSFLDVCQKFSLVDGVIINTFNDLEPEVIRLLQEKEKPCFYPVGPLHRNESNCEDNINSMCLRWLENQPPSSVLYVCFGSGGTVSHEQLNELAFGLELSGKKFLWVVRVPSKVVSSAYFVGEKDDPLDYLPSGFLERTKENGLVVPSWAPQVEILGHGSIGGFLSHCGWGSTLESVVNGVPMIAWPLFAEQRMNAKLLTDELKVAVRPKIDDESGIVKREEVANCVKRIMEGDESLEIQKRIKELSVGAAVATSENGSSKKALSSLASRLQNF

SEQ ID NO: 5950 - protein, 224 aa, Cajanus cajan
MYLDKRLQDDKDYGVNMYNPNSEACIKWLDDKPKGSVVYVSFGSMAELSEEQTEELAWGLRDGGNYFIWVIRDSEQGKLPKDFVGTSEKGLIVAWCPQLQVLIHEALGCFLTHCGWNSTLEALSLGVPLIAMPLWTDQITNAKLVRDVWKIGVKAVADEKEIVRRETITHCIKEILETEKGNEIKKNSIKWKNLAKNYVDEGGNSDKSTTEFVTELAHRCAASK

SEQ ID NO: 5951 - protein, 488 aa, Polygala tenuifolia
MGSISFDELSAPKPHVVLFPFMSKGHTIPILHLARLLIARDLAVTVFTTSANRPFISHFLTGTTVSIIDLPFPHDVEGTGIPQGIESTDKLPSISMIFEFALATERMKDDFERVLETLPRPIIFMVCDDFLWWTQDSADKFDIIRLSFMGMSAYATAVCRDAAYSGVFDDQKHHSDDELIALSRLPWISITKNDFSPEFFNRDTQSLSSQFHAKVFATIARRYGQILNSFYELEPVFVDYLKNEVAIKAWCIGPLCLTQPPFRSTSTTSAGMEEDDSKPTWVRWLDQKLEKGSSVLYVAFGSQAEVSPEQLREIAMGLEESYVNFLWVIRKNESELPDNFGERVGERGIVVSDWVDQMEILKHESVKGFLSHCGWNSVLESVCVGVPILAWPFMAEQHLNARMVHEEIKIGLRVETINGSVRGFVSGEELRKKVKELMEGENGRQVRKNVNELSVMAKKAVEKGGSSWQSLDSLIQETCDKAMPDVPN

SEQ ID NO: 5952 - protein, 455 aa, Polygala tenuifolia
MSEYFPHIALLPSAGMGHLTPFLRLAAMLVNNHCKVTLITPTPTVSLAESKFISRFLSAVPQVNHTEFHLMPFDASAANSTDPFFLQFEAIRRSAHLLPSLLDFISPPLSALVYDVSLISPVLAAIESMFLPRYILFTPSAKMFSIFSYFPTAVASKQITGDGEIEIPGIIPRIPGSSIPPLLFDLNSLFAKIFMEDSPKLKRLDGVLLNTFEDLEGKTLEAINEGNVVKGLPHAFAIGPLIPLQFEKGDQSQSALNWLDDQREGSVVYVCFGSRNAMKRDQIREIGKGLMRSGCKFLWVVKDKLVDRDENDSLDEVLGYKLAESMKEKGLVVKTWVCQVEILGHKGVGGFLSHCGWNSVTEAAWQGVPILAWPLAGDQKVNAELVEKSGWGMWMRNWGWLGEKLVDEEEIGKAIKDMMGSRMLKVNAVKIREAARNSNAINLEKLIQDWKKHNG

SEQ ID NO: 5953 - protein, 473 aa, Unknown
  Description of Unknown: Oryza sativa Japonica Group sequence
MDGDGVGGSMHVVMLPWLAFGHILPFAEFAKRVARQGHRVTLFSTPRNTRRLIDVPPSLAGRIRVVDIPLPRVEHLPEHAEATIDLPSNDLRPYLRRAYDEAFSRELSRLLQETGPSRPDWVLADYAAYWAPAAASRHGVPCAFLSLFGAAALCFFGPAETLQGRGPYAKTEPAHLTAVPEYVPFPTTVAFRGNEARELFKPSLIPDESGVSESYRFSQSIEGCQLVAVRSNQEFEPEWLELLGELYQKPVIPIGMFPPPPPQDVAGHEETLRWLDRQEPNSVVYAAFGSEVKLTAEQLQRIALGLEASELPFIWAFRAPPDAGDGDGLPGGFKERVNGRGVVCRGWVPQVKFLAHASVGGFLTHAGWNSIAEGLANGVRLVLLPLMFEQGLNARQLAEKKVAVEVARDEDDGSFAANDIVDALRRVMVGEEGDEFGVKVKELAKVFGDDEVNDRYVRDFLKCLSEYKMQRQG

SEQ ID NO: 5954 - protein, 470 aa, Helianthus annuus
MASEPVNQLHILLIPYLAPGHTIPMIDMAKLLAQRPNVMVTIVTTPLNAIRYGSTLQQHIESGLPVRFLELPFPATENGLPEGCESLDALPGLHLVTNFTAAYLLWTGDTAAKCKFPLVIFDGMSCFKQLCTHHLYASKVFNDLPESEPFVLPGLPDRIEITRAQLPTEFNPSRFTMPERLERVRESESRAYGMVINSFEELEQDYVNEFKKLKRGKVWCIGPLSLSNSNDSGKSLRGNSTSSDDQLYLKWLDSKEPGSVVYGCFGTISQITPPQLIELGLALEASKSPFIWVIRAGDKALEVEKWLSENGFENRIKDRGLIIRDWAPQLQILSHPSVGGFLTHCGWNSVLEGVSAGVPIITWPQFTDQFLNEKLVVHVLGIGVGVGAPGVVWGEEDRLGVTVKSEQVKTAIEKVMDPGSEGNERRKKAKALGMVAKKVIKEGGSSHHNLTLLIQDLQELANVRSQKPLI

SEQ ID NO: 5955 - protein, 485 aa, Paeonia lactiflora
MGSIAAEKPHLVCMPFPAQGHVKPMMQLAKLLHSRGFFITFVNNEFNHRRLIRNKGPDAVKGSADFQFETIPDGMPPSDENATQSITGLLYYTKKHSPIPLRHLIEKLNSTEGVPPVSCILSDGIMCFAIKVAQELGIPDVQFWTASTCGLMAYLQFGELVKRDIFPLKDVSYLSNGYMNTHLDWIPGMKDMRIKDLPSFVRCTDPDDIAFNRWLEEGEDNLKADAIIFNTFSEFEQEVLDALAPISPRTYCVGPLSLLWKSIPQSETKAIESSLWNENTECLNWLDKQKPNSVVYVNYGSIAVMTDANLKEFAWGLANSGHPFLWIVRADLVMGGSAIFPEEFFEVIKDRGMIVSWCPQDQVLKHPSVGVFLTHSGWNSTIEGICGGVSMLCWPFFAEQQVNCRYACTTWGIGMEIDSKVTREEVKQLVKEMLEGEKGNKMREKALDWKKKAEASVVEGGSSFSDFNRLAEDLMQLCLNGKYLG

SEQ ID NO: 5956 - protein, 502 aa, Helianthus annuus
MVDKYNHKKTFMNQKNMANTLAELIFIPAPGVGHLKLTMEIAKLLVNRDQRLFITVLVIKPLSVSSGTAVTAYIESLAENNMNHISFILLPQDETQPFHDPKDPSNSPIEFINSHSKYARNAVTDLKSQPGSRWIVGFVVDMFCTSMIDVANEFDVPTFVFFTSNAAFLGFTLYIKTLCDDLNRDVVDLSNSGTEILVPSFVNPVPTKVFWSGVKTRSGLDFVQWFARKLGEAKGIIVNTFLDLETHAIESLSADTSIPPLYPVGPILNLEGGSGGGKPFDDDVVRWLDSQPSSSVVFLCFGTNGSFDEVQVKEIARGLEQSGYRFVWSLRRPPSDQTSRDPSDYEDPSVVLPEGFLERTRGIGKVIGWSPQAPVLGHEAIGGFVSHCGWNSLLESLWFGVPTATWPMYAEQHMNAFEMVVELGLAVEIELDYMKDLYNTKANTIIVTAEQIESGIRRLMEDNEIRRKVKEMSAKSRSAVVEGGSSYASIGCLIQDFVRDNF

SEQ ID NO: 5957 - protein, 485 aa, Eucalyptus grandis
MGRESRQLHIFFFPFVAPGHMIPMIDMAKLFAMRGCKSTLIATPHDEPTFLKSIAKPRDSGFDIDVVTVSLPLKDVGLPEDCDNLNKAATMDMHRQFMRAVMMLDRQLELLIEKLAPDCLISDMFLPWTTEIAAKCGIPRLVFHGTSAFSVGGTECVRLYEPHKKVLCDSEPFVIPNFPGEITLSRMQLQDFVREETEFTKFYAQVKESEKRSFGVVMNSFYELEPAYAKHYSTFLGRRSWFIGPLSLCNEEIEDKAHRGSQASIDQHECLKWLDSKQPNSVIYICFGSMANFNAAQLHEIAVGLEASGQQFIWVVKKDPIVEEGKEEWLPDGYESRIRNKGLIIRGWAPQVLILDNEAIGGFVTHCGWNSILEAITAGVPMVTWPVAAEQFYNEKLVTRVLQIGVNVGVKRWVRYFGDSVKSDRVVEAVKRVLVGEEAGEMRRRTKALSEMARGAVEEGGSSWSDLGALLQELRLQRLARQKKI

SEQ ID NO: 5958 - protein, 1000 aa, Vigna unguiculata
MSNVPVVLVLPYPAQGHVNPLMILSQKLVENGCKVVFVNTEFDHKRVVSSFGAQQHSTKHEEESMMKLVSVPDGLGADEDRNDLGKLCDALQKTMPKELEKVIENMHLKSDNNKMSFIVADLGMAWALDVGRKFGMKGAIVWPASATTFALIRSLPSLIHDGSLDSDDRRIRISPCMPEMDTEDFFWLNMGEPKTGKKVLKYLLYCAEHIHLTEWWLCNTTPELEPGTLLYMPKILPIGPLLRNNDNDNNKSATTKSMGQFWEEDHSCMSWLDEQAHGSVVYVAFGSFTLFDQNQFNELALGLDLTNRTFLWVIREDNKMEYPTEFKGHKGKIVSWAPQQKVLSHPAIACFVTHCGWNSTMEGLINENKYPRIITIIEGLRNRKSPKEKMSNIPVVLVLPYPAQGHVNPLMILSQKLVKNGCKVVFVNTEFDHKRVVSSFGDQEHSRKHEEESVMKLVSVPDGLGADDDRNDFGKLCDALQNSMPKELEKLIHNMHLKGENKISFIVADLFMAWALDVGKKFGMKGAIVGPASATTFALTYSIPSLIHDGTLDSDAQGHVNPMMTFSQKLVENGCKVIFVNTEFNHRRVVSSMVEQQDEESVLKLVSIPDGLGPHDDRNDQAKLCEAIPKAMPEALEKLIEDIHLKGESKINLIVADLCMAWALDVGRKMGIKGAVLCPASASIFTLLHSVPMLIHDGIVDSDLGSILTSKKTIQLSPSMPEMEPRTFFWLHMAGIIDSSHYLNYLVHHCTPALNLTEWWFCDTAHELEPEVLTLLPKLIPIGPLLRIDHRSKTNNAPPRSLGQFWEEDLSCMSWLDEQAHGSVVYVAFGSFTLFDSNQFNELALGLDLSNRPFLWVIREDNKMEYPTEFKGHKGKIVSWAPQQKVLSHPAIACFVTHCGWNSTMEGLSNGVPLLCWPYYGDQLYNERHICDELKVGLGFDKDHNGLVSRKELKTKVEQIFNDEKIKSRSVALKGKVMKNVAKGGTSYENLEKFVKEIKQ

SEQ ID NO: 5959 - protein, 456 aa, Unknown
  Description of Unknown: Oryza sativa Japonica Group sequence
MHSSYPSIAIIRNNSLRICRRFCITFNFFCHTQSISNYVRFFNISLRRFSTSFGLFFCNRTFWRLLNSRRICIFNNRCILVNSSEPFSIDFGGESSSKLHLVIFPWLAFGHVLPYLELAERVASRGHRVSFVSTPRNIARLLPVSPAVAPRVDLVVLPLPHVDGLSVGAECTNDVPSDKFELLWKAFDALAPPFAEFLGAACVGTRALPAGGDVHEKAACPPRPSAAVARRRTPPHRRDGRRRHHAVAGRAAARFSGVRRAGERGAVRVELVHELALRLELAGTRFLLALRKPCGVDDSDVLPLGFLEQTHGHGHVAMGWVPQTTILAHAAVGAFLTHCGRNSLVEGLLFGKPLIMLPIVGDQGPNAWSMEGNMVGLQVRRDENDGSFDRHGVTAAVRAVMVEEETRSVFVTNALKMQEIVADRELHERYIDGFIQQLIFHVADGNSDTAAPDPSS

SEQ ID NO: 5960 - protein, 475 aa, Vitis vinifera
MGDKPHVVCIPFPAQGHIKPMLKLAKLLHYRGFHITFVNTEFNHKRLLRSRGPHALDGMPGFCFESIPDGLPPVDADATQHIPSLCESTPKSCLIPFQQLIAKLNDAPSSNVPPVTCIVSDGSMCFTLKASEELGIPNVLFWTTSACGFMAYKQFRPLIDGVLVPLKDLSYLTNGYLETIIDWVPGMKNMRLRDFPSFIRTRDPSDHFMLDFIIDTTDSASKASGLILNTFHALEHDVLNPLSSMFPTICTVGPLPLLLNQIPDDNSIESNLWREETECLQWLNSKQPNSVVYVNFGSITVMTPEQLVEFAWGLANSHKPFLWIIRPDLVVGDSVILPPEFVNETIQRGLMAGWCPQEKVLNHPSVGGFLTHSGWNSTIESICAGVPMICWPFFAEQQTNCRYACTEWGVGMEIDNNVERDEVEKLVKELMEGEKGKSMKKAAMEWRTKAEEATAPCGSSYLNLDKLVDILLTKP

SEQ ID NO: 5961 - protein, 473 aa, Helianthus annuus
MANEVVVVMVPFLAQGHLNQLLHLSRLISTYNIPIHFISTATHNRQVRIRLHGWNPNNNLIQFHDLDDPIVTPHPIIPNTTSHPNFPTHLQPYFNSSLLLRTPVADVIRSVSQTARKVAVIHDSLMSYVVQDVCLIPNAETYIFRGLSVFYYFCSTNMNLGRELPFEPDKICQLPAPGESISPEFSEFIKLQYDHQKNHVGNVYDSSRIIEGKFVESLKRDQVNGKYHWAVGPFNPVEMDSDCLDRHICLQWLDKQPARSVLYVSFGTTTTFTSDQIAELALGLERSTQRFLWVLRDADKGDGSVGVKAAGPSHEKPLFDNYQTLHSTCRSVGLPEGVAGRGLVVREWAPQIDILGHLSTGGFVSHCGWNSCMEAMTAGVAVATWPIHTDQPYNAILLSNVLGVAVVMRDWEHRDELLTSVMVEKVVRKLMDTEVGEAVRKRAAELGGEWRKSMADGGVTHEDLNSLISYIHK

SEQ ID NO: 5962 - protein, 383 aa, Ipomoea batatas
GTVAGEALVTHEEFIMAMPGNYQTAIAEAEAEMGTKFGCFLTDSFLWFGGDLAAERGGVPWISFWTAGACSISAHLYTDFVRSLVAATPNANGNGLDQKLKVIPGMSEVSIGEMPGEILAKDLQAPFPGMIYNMALKLPGANALVLNSFQKLEPTVTDDLRSKVQVFNIGPMILQPATPKPPISDDHNCIPWLDSLPPASSAVYLSFGSGITPPPDEIVGLAKALEAKRAPFLWSLKPHGVKHLPEGFVERTKEFGKIVPWAPQVQVLSHPGVGVFVTHCGWNSTLEAISCGVCMICRPFYGDQKINTRFVESVWEIGVKIEGGIFTKDGTMKALNVVLDSDRGKLLKENVVKLKGEALEAVKPNGSSTKDFQELVHLLNDSF

SEQ ID NO: 5963 - protein, 504 aa, Gentiana triflora
MVGRGKGKGREHVLLVVFPAQGHISPALQLAFKIVAHSSIDLTFLTSSSAVASILIGLPPTAPALNFAAFSQGNLHNDDDDDDDAKDYMHTLCKHGSQSVRDIIHSTKKGQGQGQGQGQGQGQGQGHPITRILYTTLLPWAADVAREFRLPSVLLWTQPVTTFLTFHYYFTGYEDAINKVRNQQGTEDDSTIQLPRLPLLSSRDLHSFMLPSNPFKGAINTFKEHLEALDAEETPPTILVNSYDALEEEALQAMIPKYKTMGIGPLIPSSVFDTRETTCEVVSLVPDLAQKSKDDCQWHGWLNSKAEGSVIYVSFGSHVKQSKAQTEEIAKGLLASGHPFLWVITSNEEEEGDEIMEQNLVEEIQEKGMMIVPWCAQFQVLKHPSVGCFMTHCGWNSTLESIACGVPMIGFPKMFDQPTISKLIAHVWKVGVRVNAAVDGIVGQEVIKNCIESVMDPDGIGRELNENVRKFMSLGKKAAEEGGSSHNNFKAFLQDMTGGTTTIN

SEQ ID NO: 5964 - protein, 486 aa, Vigna angularis
MESSPRTTTHIALVSVPAFSHQVSILEFAKRLLHLHADTFHVTCIIPTLSSSPSKHSIFFDSLPHNIHCIFLPSVNFHDLNNNGVSVEVQTQLSASRAMSSVRETLVSLSKTTDISALVADAMAPEALEFGKELHILSYIYFPCSTMVLSVCFHSQNLDEEVSCEYKDHPGLIHLPGCIPISGRDLPDSMQDRGSLAYKLFLQRCQRYLNGHDGILVNSFMEFEEEATKAISQHGNGGDYPPVYSVGPITQSGPSGSKSRCECLLWLDKQEPNSVLYVSFGSGGTLSQEQIDELALGLELSKQKFLWVNLRAPNDRASATYFSEGGLVDDDPLHFLPKGFLERTKEQGLVMCGWAPQVEVLGHRSIGAFLSHCGWNSVLESVVHGVPMIAWPLFAEQRSNAALVSDGLKVALRPKMKNPSGINGVVVKEEIVKLIKGVMEGLEGEEIRRKVKELKKLANCAMMGDGSSTRTIANLANKWKRLGKSL

SEQ ID NO: 5965 - protein, 488 aa, Cicer arietinum
MASQNNPLHIFFFPFMGHGHMIPSIDMAKLFASKGVKATIVTTPLNKPLVTKAIEQFKTHSNNIDIQIIKFPCVEGGLPEGCENVDSIPSPHLIPAFFKATWLLQEPLEQLLQQQKPNCIVADMFFPWSTASAAKFGIPRIVFHGTSFFSLCASQCLNLYEPFKNVSSDTELFEITNLPGNIKMTKLQLPSIFTQNDTMTQNTAKLFAAIRESEKKSYGVIVNSFYELEHVYADYYRDVLGIKAWHIGPLSIHNKKDKEITSYRGKEDSIDKHECLKWLDTKEKHSVVYLCFGSTTHFLNSQLKEIAVGLEASGKNFIWVVNKKKEDGEEWLPEGFEKRMEGKGLVIRGWAPQVLILNHEAIGAFVTHCGWNSTFEGVSAGVPMITWPVAAEQFYNEKLVTEVLKIGVPVGVKKWVGLFGDSIQCDLVEKAVKRVMEGEEAEEMRNKAKLFAEMAKKAGEEGGSSYLKLNALIEELGSLSQHQPILQD

SEQ ID NO: 5966 - protein, 457 aa, Arabidopsis thaliana
MELHGALVASPGMGHAVPILELGKHLLNHHGFDRVTVFLVTDDVSRSKSLIGKTLMEEDPKFVIRFIPLDVSGQDLSGSLLTKLAEMMRKALPEIKSSVMELEPRPRVFVVDLLGTEALEVAKELGIMRKHVLVTTSAWFLAFTVYMASLDKQELYKQLSSIGALLIPGCSPVKFERAQDPRKYIRELAESQRIGDEVITADGVFVNTWHSLEQVTIGSFLDPENLGRVMRGVPVYPVGPLVRPAEPGLKHGVLDWLDLQPKESVVYVSFGSGGALTFEQTNELAYGLELTGHRFVWVVRPPAEDDPSASMFDKTKNETEPLDFLPNGFLDRTKDIGLVVRTWAPQEEILAHKSTGGFVTHCGWNSVLESIVNGVPMVAWPLYSEQKMNARMVSGELKIALQINVADGIVKKEVIAEMVKRVMDEEEGKEMRKNVKELKKTAEEALNMTHIPSAYFT

SEQ ID NO: 5967 - protein, 370 aa, Ricinus communis
MQDTIVLYPSSGIGHVISMVELGKLILRHYNHHFSITILLFTADLCHTSAITSYINAISQAYPSISFRRFPRVFVDTTPTRSNPAMAFEAILLNKPYVLDSLQEISKVNTFEDLETKAIKTIADGVCVPDAPTPPTYYIGPLIAGDSRHEAQHDCLSWLDRQPRNSVVFLCFGSRGSFSRQQLKEIANGLERSGQRFLWVVKNLPEDERSKTTEDMGDFDLESILPEGFLNRVKEKAMVVKSWAPQVAVLNHKSVGGFVTHCGWNSVLEAVVAGVPMVAWPLYAEQHLNRNILVEDMKMAIQVEQRDDDDGFVTGDELEVRVRELMESEKGKEMRQKSWMMRQRSLDSWLESGSSIRALGKLVEPWKKIC

SEQ ID NO: 5968 - protein, 219 aa, Medicago truncatula
MYDGDEVSAIVIDLGSHTCKAGYAGEDAPKAVFPSRYYYFVLFVVADDSDEAGTEIEANCKKPFLWITRPNLVIGGSVVLSSEFRKEISDRGLISNWCPQEKVLNHPSISGFLTHCGWNSTTESICAGVPMLCWSFFADQPTNCRFICNEWKIGMEIDMNVKIEDLEKLINELMVGENGKKMRQKAMELKKKAEENTRPGGCSYMNLDKVIKEVLFKQN

SEQ ID NO: 5969 - protein, 496 aa, Culex quinquefasciatus
MGSTTRLLTLLFLVTTTSVILLNGADSARILCVFPTASKSHVLGMQALMKNLAKRGHEITMVSAFPLSKPVQNYRDVYVPIEGAFGPLMANFMQGKDRNMLKVMPVIVAASLEYTNATLNSPQFRRLVDEERFDLAVVGWFMNDYVAGIGQLFKCPTVLYFSAGFSSMVNFFGNPTEVAAVPHMLLGNKNPMGFLDRLQNTMIYGVDAAIGQYLRYKTKPYYDYNFPEERGFLPYDEAKRHVSLVIFNSYFTQAVPRPYLPNVIEVGGLQIKPKPDPLPADIQAWLDGAEHGAIFLSFGSNLKSSNLRQDKFDAILAALSKLKQRIIWKWDTDVMPGKPANVMIGQWLPQDDILAHKNLVLFVTHCGLGSVTESMYHGVPIVGIPMFGDQEHNAAQVLKEGWGEVVTFEDLTEETLSSAIRGVLGNEQYRQTVQKMADLYRDRPQTGLDLATFWLEYVVRHKGAPHLHYQGADLNFLQRNLVDVFAAIGAVLSFKR

SEQ ID NO: 5970 - protein, 472 aa, Setaria italica
MAGDDGVQGVRDGGGDPRPRRVLVFPLPFQGHIDPMMHLAGALHARAGLAVTVLHTRFNALDPARHPEFRFVEVPDGVPAGVAATGRIIDVILAMNAAMEASPEAVRGALASAMIAEDEDEEAPHAACLVIDSNLLAVQRAAEKLGLPTMVLRTGSAACLRCFLAYPMLHDKGYLPFQESQLYMPVPELPPLRVRDLFQTKISSHEMVREVIARITETVRNCSGLIINTFEALEPDELQKLRGELDLPLLLAAGPLHKLSSKTTGSSLLDQDYSCIEWLDTQPPGSVLYVSFGSLAAMDSGEFVEVAWGLANSGHPFLWVVRPNLVQDTDIAQLPDGFEDAVKGRGMVIQWAPQQEVLAHRAVGGFWTHCGWNSTLESVGEGVPMICRPNAVDQMMNARYVEEVWGVGFELEGELERGEVEGAVRKLMGGGREGAEMTERAEVLRRKVAECLDGSGSSRTAIDMLVDYMLSL

SEQ ID NO: 5971 - protein, 614 aa, Spatholobus suberectus
MAEAAGAHVLIFPCPLQGHVGSMLKLAELLALEDLHVTFLNTECIHNRLTRFGDIQALSACYPTLHFETISDCYNEGHHPGSGDSTMGDIMISTSLHAKPFFREILVSQHPGIPKVSCIIQDGIFGSLSNDLAAELRIPLIHFRTSSACCFWPYFWIPKLFECKELPIRGTKERGFIVGWAPQEEVLAHRAVGGFLTHSGWNSTLESLVAGVPMICWPYFADQQVNSRFVSEVWKLGLDMKDMCDRHVMENMVNDLMVHRREEFLRLSSNNGYVGPQELKMKAEETTDAHTHVAIFPCPVQGHVNSMLKLAQLLALRRFHVTFLNTDHIHHQLHRFGDIEALLQTYPTLQFKTIPDGLPHHHPRSGDTVLDLFQSINLHAKPHMRDILLSQSLGKPRVTCFIGDGVFGGLITDVANEVGIPIIHFRTISASCFWTYFCAPNLFESNQLPIRGFKLKLYHKNSEIAMENDDRAPAELEEGTKERGFIVGWAPQEEVLAHRAVGGFLTHSGWNSTLESLAAGVPMICWPSFGDQYVNSRIVSEVWKVGLDMKDLACDRNLVEKTVNDLMGHRREEFLNSAQAVAVLADHSVSPAGSSYSNLEGLIQYIKSVSEEVI

SEQ ID NO: 5972 - protein, 484 aa, Cephalotus follicularis
MGSTILSKRPHAVCIPFPAQGHINPMLKLAKLLHHKGFHITFVNSEFNHRRLLKSRGANSLNGLSSFRFETIPDGLPPTDVDATQDIPSLCESTRKTCLAPFRKLLSRLNDTSSSNVPPVTCIISDGIMTFTLDAAEELGIPEVLFWTTSACGFLAYVHVRQLIEKGYVPLKDASYLTNGYLDSVIDFLPGMKGIRLKDMPPFIRTTDKDDLMIDFILDVTERAKRASAIILNTFNSMEYQFLSALSSMLLPIYSIGPLQLLLNQVPNTDLKQFGSNLWKEEPECLEWLGSMKPNSVVYVNFGSITVMTPYQLVEFAWGLANSKQTFLWIIRPDLVSGDSAILPPEFLTDTKDRALLASWCPQEQVLNHPAIGGFLTHSGWNSTIESICGGVPMICWPFFAEQQTNCRYCCTEWGIGMEINNDVKRDEVESLVRELMEGDKGEEMKQKAMEWKKMAEESTASPNGSSYKNLETMINQVLLSIRN

SEQ ID NO: 5973 - protein, 451 aa, Pueraria montana
MKGTIVLYPAMGRGHIVPMVELGKFLSTHHHATLSVKILLPSPPNSTTLRYITAVSAATPSITFLHLSPSQHLLRVLQTLISQSSKPKAFILDFFNHSAADVTQTLNIPTYYYFPNAASCVALMLYTPTIHHNTKNGNSSYNDTLRRIPGLPPLSPEDMPAPLLDRRSFESFANMSIQMRKSDGIIVNTFEKLENKAFLALKNGTCVSETSRSHSSTPETRKPRIFCVGPLVSNGGGEHDNDDSGCMSWLDLQPSRTVVFLSFGSYGRFSKSQIREIALGLERSGQRFLWVVRDPYERSELSLEELLPKGFLERTKERGMVVKNWAPQVKVLSHDSVGGFVTHCGWNSVLEAVSWGVPMVAWPLYAEQRLNRVVMVEEMKVALPLKEVDEDGFVRASELEERVRELMDSERGRGKEVRKRVLGATNDAVAALSDGGSSRIELNDLVGLWMQ

SEQ ID NO: 5974 - protein, 452 aa, Arabidopsis thaliana
MKKIELVFIPSPGIGHLRPTVKLAKQLIGSEEHFFNHQSQDRLRYEPISVEKQPPTANLEPSQVYIEKQKPQVRDTVSRIINPTRKLAGFVVDMFCSSMIDIANEFGVPCYMIYTSNATFLGITLHVQEMYDDKKYDVSDLDESVNELEFPCLTRPYPVKCLPHILSSKDWLPFFAAQGRSFRKMKGILVNTVAELEPHALKMFNNVDLPQAYPVGPVLHLDNGDDDDEKRLEVLRWLDDQPPKSVLFLCFGSMGGFTEEQTREVAVALNRSGHRFLWSLRRASPNIMMERPGDYKNLEEVLPDGFLERTLDRGKVIGWAPQVAVLEKPAIGGFVTHCGWNSMLESLWFGVPMVTWPLYAEQKVNAFEMVEELGLAVEIRKCISGDLLLIGEMEIVTAEDIERAIRCVMEQDSDVRSRVKEMAEKCHVALMDGGSSKTALQKFIQDVIENVA

SEQ ID NO: 5975 - protein, 480 aa, Citrus unshiu
MSSCSNSRATHVLVFPYPAQGHMLPLLDLTHHLSLKNLDITILITPKNLPIVSSLLDARPAIQTLVLPFPSHPSVPAGVENVKELGNRGNLPIMSALGKLYDPIIQWFHSHTNPPVAILSDFFLGWTLNLARQLNIVRITFFSSGSFLASVSDYCWNHTGVVKPLDVVEFRDLPRSPVFKEEHLPTVFRIYMVSDSDPEFEFVKDGMVANTLSWGWGCVFNSFDDLESEYLDYLKRKMGHDRVFGVGPLSLLGPESTRGGDSGLDPNDNVSKWLDGCPDGSVVYACFGSQKVLSKEQMEALALGLEKSGIRFLWVVKTSVIHAEGNGYGLIPYGFEERVAGRGLVLKGWVPQVSILSHKAVGGFVSHCGWNSMLEGIVSGVTILAWPMEADQFVNARLLVDDLRVAVLVCEGGDSVPDSDELGKVIGESLSQCGETKIKARELRDKALAAVKSGGSSTRDLETLVQELRKLRFHTSCIKS

SEQ ID NO: 5976 - protein, 266 aa, Triticum aestivum
MSIGQFDGLEEADDVLVNSFSDIEPTEAEYMELTWGAKTVGPTLPSFYLEDDRLPSNKSYGFNLFGDDAPCLDWLQEQSISSVVLVSYGTFSNYDATQLEELGNGVCSSGKPFLWVVRSNEAHKLSEEVKAKCEKNGLIVSWCPQLEVLAHKAIGCFVTHCGWNSTLEAVVCGVPLVGIPHWADQHTIAKYVESAWDIGVRARKSENGLLRSGEVGRCIREVMDGERKDEYKRNATKLMQKAKEAMRDGGSSDKHIAEFAAKYSSI

SEQ ID NO: 5977 - protein, 456 aa, Cephalotus follicularis
MGHLTPFLRLAASLVHQKCRVTVLTIHPSVSHAESQLISRFFSAFPQVTQKHFPLLPVDPSTAKSDDPFWLQREAIRRSAYLLSPLLSSFSPPLSALIYDKFLVSPLIPISTSLSLPGYIFFTSSARMCSLFASLSTTVADKISSGSYHLSDHLEIPVIPPIPVSSIPPLFLNPNSIFATIFKEDSREVLKSNGILINTFEMLEQDSLDALNDGRVRKGLPPVYAIGPLEPCEFENGERGSPLKWLNDQPAGSVVYVSFGSRTARSMEQIREIGHGLVRSGCRFLWVVKTKEVDRDEEEDLHEVLGHELMQKIQGKGLVVKHWVDQSEILGHKAVGGFLSHSGWNSSMEAAYHGVRMLAWPQHGDQKINAEVVEMSGLGLWVRSWGWGQEVVVKGEEIGEKIKEMMESESSSLLRVQAARVGEEARKAVGVCGNSETTLKELIQEWNDIDRAKDFQ

SEQ ID NO: 5978 - protein, 479 aa, Genlisea aurea
AVAGGERKPHALCIPFPAQGHITPMLNLSKLLHEKGFHVTFVNTHYNHRRLIKSLGADAVSGLPGFLFASIPDGLPPSDADVTQDVPSLLRSTHATCLEPLCELIRDLNKESPPVSCIVSDGILSFTLAAAERFRLPEVLFWTASACGLLGYMQYPRLVEQGIVPFNNKKQVTDGAHLEKVIDWVPGVNGGLRLRDFPSFVRTTDPRDVFLNFAIQEATALGESRAVGGLILNTFDALEEGVLTAMAEILPPPIYTVGPLNLLLDRLPESPLAANLWKEETDCIEWLDGRKPRSVLYVNFGAVAAVTPSQLTEFAWGLANSGHPFLWTIRPDILSGENPSAVLPPEFLTETGDRSKLSSWVPQEKVLSHAAIGGFLTHCGWNSMVESISHGVPMICWPYFAEQPTNCRFGCVEWGIGMEIGKNANREEVENVIREIMEGEKGKKMKENAAEWQKKAAAATSPGGSSEVNLNRFIEEVLM

SEQ ID NO: 5979 - protein, 469 aa, Vitis vinifera
MGSPHFLLVTFPAQGHINPALQFAKRMIRTGAEVSFATSVSAHRRMAKRPNLEGLQFVPFSDGYDDGFKSSDDIQQYMSEIKRRGSETLREIVVRNSDEGRPFTCIVHTLLVPWAAEVARGLVVPYALLWNEPATVLDIYYYYFNGYGDAFRNISNEPTCSIELPALPLLSSRDLPSFLVNSNAYTFFLPMLQEQLEALNQETNPKVLVNSFDALETEALKAVDKLHLIGIGPLVPSAYLNSKDPSDTSFGGDLFQGSDDYMEWLNSKPKSTVVNVSFGSISVLSKTQKEEIARGLLDCGQPFLWVIRAPENGEEVKEEDKLSCREELEKKGMIVPWCSQIEVLTHPSLGCFVSHCGWNSTLESLVSGVPVVAFPQWADQGTNAKLIEDIWKIGIRVIVNEEGIVESDEIKRCLEIAMRGGVKGEEMKRNAEKWKNLAREAVKDGGSSDMNLKGFVDEVGQGCNESIGS

SEQ ID NO: 5980 - protein, 475 aa, Sinningia cardinalis
MEDTIVFYTSPGIGHLLSMVELGKLILHRYHFSTIHVLITTGFDDSPTTAAYIHQISETNPFITFHRFPSLHMETSPNASFGTRLFEFIRLNATNVHQTLQEIMKTSNVRALVIDFFCSSAFPVSESLGIPVFYFFTSGLAALAAYLYFPTLHNQVDQSFRDLVNTKFHIPGLPPLPAKHMPRPVWYRNEPSYHDILYFSQHLAKSSGILVNTFDGLEPNALKAITDGLCIPDVPTPPIYNIGPLIADAVRTAGDQNLMHHSLTWLDAQPNQSVVFLCFGSRGSFSADQLREIATGLERSAQKFLWVVKKPPVDETNKEVKELGELNTTGIMPEGFLDRTKDRGTLVDSWVPQVKVLEHPAVGGFVTHCGWNSTLEAVMAGVPMVAWPLCAEQHLNKAALVEDMKMAIPMELREVDEFVLAEEVEKRIREVMEVDKSKELREQCHKMKSMSFDARGKLGSSTAALDKVVQVWYGN

SEQ ID NO: 5981 - protein, 508 aa, Cephalotus follicularis
MKRAELIFIPSPGVGHLVSTLEFSKRLIERDDRISITVLVMKFPIATFVDEYTKSLTASQSRIQLIGLPPVDPPPPTLMKESGERYLCSFIESYIPHVKNVVKDIVTSSDSSSGSVQVAGLVLDFFCVSMIDVANEFGLPSYMFLTTNAGFLDFMLHLPTRHKQISFEFEKTDPEILLPGFLDLMLYLPTRHIQIGFEFEKTDPEILLPGFANPVPPCVLLDGLFNKQGGYSSCIKLAQRFKDVKGIIVNTFVELETYTVNSFSNAQIPPVYPVGPVLEDKRQPHPDLNQAEYDKIMKWLDDQPQSSVVFLCFGSRGSFEVPQVREIALGLEQSGCRFLWSIRVPPTKAEASVTSPYTNYKDMLPEGFLERIKGRGKTCGWAPQVEVLAHKSIGGFISHCGWNSILESLWHGVPIVTWPMYAEQQLNAFEMVKELGLALELRLDYRSTDSQLVTGDEIERAIRCLMNGDEELRKKVKGMSEMARKALMDGGSSFNSIGQLIEDMIGRS

SEQ ID NO: 5982 - protein, 483 aa, Cinchona calisaya
MGSSQDSNLPPHVLIFPLPIQGHVNSMLRLAELLCLSDLDITFIVSEFSHNRLLKHTSVALRFARYPGFRFQTISDGLPDDHPRAGEQVMDIMPAIKNVTGPLFKRMMIEKNCFASANRRPITCIIADGVLSFAGDFAEQKRIPLVYFRTVSACSFWACFCMPQLIEAGDIPVKGEGMDLPVKSVPGMEGFLRRRDLPGFCRVNDINEPKLQIIKNETRQTPRAQAAILNTFEDLEGPILAEIRKYMPRLYTIGPSHSQLTARLEAQNTKTSISSGSFWEEDRSCIEWLNSQPPKSVIYVSFGSITVVTREQLLEFWCGLVNSGQRFLWVMRPDSLMGKDGESQIPAELEKGTKERGYMVGWAPQEEVLNHSAIGGFFTHSGWNSTLESIVTGVPMICWPYFADQMINSRFVSEVWKIGLDMKDTCDRIIIEKMVRDLMDVRKDEFSQRADDMAKLARKAVNEGGSSYQNLDALVEYIKSMVV

SEQ ID NO: 5983 - protein, 486 aa, Vigna angularis
MDSEGGSKKPHALLIPFPSQGHINPFLKLAKLLHSRGFYITFVNSEFNHRRLLKSRGPDALNGLSDFHFEAIPDGLPPTDMDATQSIPALCDSTRKNSLLPLCNLISKLNHSHHTPPVTFILSDGIMSFTLKASQQFGLPNIFFWTHSASGVMSYKQCKNLMERGLTPLKDASYLTNGHLDTVIDWIPGMKDITLRYLPDIYRTTDPNDILLDFVVEQTEATSRASAVILPTFDALEHDVLEALSTMFPKLYTIGPLDLLLDQTSESKFDSIKCNLWKEDSECLKWLDSQQPNSVLYVNFGSVTVMTHQQLVELAWGLSNSKKKFLWVIRSDLVKGEAPILPPEIVQETKDRGLLVGWCPQEQVLKHPAVAGFLTHCGWSSTLESLTSGVPLICCPFFNDQILICRYICREWAFGMEIDSDNVNRDEVEKAVNELLEGEKGKEFKKNAIEWKKKAQEATSTGGSSFLNLEKLVDELLLFKSLAARN

SEQ ID NO: 5984 - protein, 389 aa, Oryza sativa
SFLIDRSHEDKDVCVVPVSWRRPPQPHGGDGQAPAPPRPRRRRRGDRPARQRRHLGRRDGAPRRGQPVHHVPPPAGAAQPGRRRAPGQARPRRAPPGQPRAPGVPPLAARRRRRPPARRVLRRRARRRGRARHPGLLLLPDKPTPRVYCIGPLVDAAAGKNGERHPCLAWLDAQPRQSVVFLCFGSKGAFPAAQLKDIARGLESSGHRFLWAVRSPPEEQSTSPEPDLERLLPAGFLERTKHRGMVVKNWAPQAEVVRHEAAGAFVTHCGWNSTLEAIMSALPMICWPLYAEQAMNRVLMVEEMKVAVALDGGEVGGALVAVAAEEVEAKVRLVMETEEGRKLRERVVETRDMALDAINRGGSSEIAFDEFMRDLEKMNSLENGGGRSC

SEQ ID NO: 5985 - protein, 477 aa, Vigna angularis
MESEAPIHVLMVSYPGQGHVNPLLRLAKFLAAKGFFVTFSTADTVGKLMRTANDISHKQVTPVGDGFLKFEFFDDGGVTNSDGSKRSLTDFNAQVEHFGRQYVSQVIKDHADTHRPISCIINNPFVPWVSDVAADHGIPSAVLWVQSAAVLTAYYSYFHKLLPFPSHADPYLDVQLPSVVLKYNEVPDFLHPFSPYQALGTVILEQFKNLSKPFCVLVDSFEELESDYIKYLSEFVNIRPIGPLFKIPTATDTSDIRGDFWKSDDCMEWLNSRAEASVVYISFGSIVCLPQEQVTEIAHGLLDSQVSFLWVLKPPGMAFGLPPYVLPDGFLEETKEKGKVVQWSPQEEVLGHGSVACFVTHCGWNSSMEGVTLGVPMLTFSAWGDQVTNAKFLVDVYGVAIKLGYGQAEKKLVSRDEVKKRLLEATVGPKAEELKQNAFKWKMAAEAAVAPNGSSARNLDAFLKDIKEGGAVRVNEI

SEQ ID NO: 5986 - protein, 479 aa, Vigna angularis
METPRPLEICFLPFFAQGHQIPMVQLARLIASRGQHVTIVATSANAHLFQKTIDDDIASGHHIRVHLIKFPNTQVGLPEGIENLVSATDNITAGKIHMAAHFIQPQVEAVLKESPPDVFIPDILFTWSKDLSKRLQIPRLVFNPISIFDVCLIQAIKAHPEAFLSDSGPYQIPGLPHPLTLPVKPSPGFAVLTESLLEGEEDSHGVIVNSFAELDAEYTQNYENLTGRKVWHVGPSSLMVEQIVKKPAVVSEIRQECLTWLDSKEKDSVLYICFGSLVLLSDKQLYELANGLDASGHSFIWVVHRKKKEGQEEEEEEKWLPEGFEEKMEKEKRGMLIKGWAPQPLILNHPAVGGFLTHCGWNAVVEAISAGVPMVTMPGFSDQYYNEKLITEVHGFGVEVGAAEWSMSPYEGKKTVLSGERIEKAVKRLMDKGNEGEKIRMKAKEMQDKAWRAVQEGGSSHNNLTALIDHLKSLFPVST

SEQ ID NO: 5987 - protein, 526 aa, Unknown
  Description of Unknown: Oryza sativa Japonica Group sequence
MQSPENAAPRVYFIPFPTPGHALPMCDLARLFASRGADATLVLTRANAARLGGAVARAAAAGSRIRVHALALPAEAAGLTGGHESADDLPSRELAGPFAVAVDLLAPLFADLLRRRPADAVVFDGVLPWAATAAAELRVPRYAFTGTGCFALSVQRALLLHAPQDGVASDDEPFLVPGLPDAVRLTKSRLAEATLPGAHSREFLNRMFDGERATTGWVVNSFADLEQRYIEHYEKETGKPVFAVGPVCLVNGDGDDVMERGRGGEPCAATDAARALAWLDAKPARSVVYVCFGSLTRFPDEQVAELGAGLAGSGVNFVWVVGGKNASAAPLLPDVVHAAVSSGRGHVIAGWAPQVAVLRHAAVGAFVTHCGWGAVTEAAAAGVPVLAWPVFAEQFYNEALVVGLAGTGAGVGAERGYVWGGEESGGVVVCREKVAERVRAAMADEAMRRRAEEVGERARRAVEVGGSSYDAVGALLEDVRRREMAADPRNVKELEQCPPTPFGGRKPQRGRGTEGCGLEPPTWSRL

SEQ ID NO: 5988 - protein, 481 aa, Crocus sativus
MEPENPDAPHILLVSFPARGHLNPLLHLAKRLASCQGNHVTVCTCESHGKKMRTNASTNSGLADPVGEGFLRDYFNDGFDEGDECPRKDINTYMGQLRVIGRQNLTRLIKKTREDSRHPVCCVINAPFLGWVNDVADVKIPNALNWLQNCASLAAYYHYFRAIGEFPILCDNEPEIDVRLTGMPLLRHDEIPSFVHPSEGPYGFIRDALIEQVRALCRGEKFCILIDTFANLEKDLIAHLKRVSLEVDIKPVGPNNRANKSAALTLTTSEDAAKNNTDSFLEWLDNQPPASVVYISFGTISYLRQEQLNELNFGIVNSGLPFLWVLHGPEFGVREARATAPDRNLGRGRLIDWCSQDRVLAHPALNCFVTHCGWNSTMEAISSGVPNLTFPQWNDQVTAAMYIGDLYRTGIRASKGEADQKLDSRDEVLRCAAVTGDKAEALKANVGVWKEKAAAAIGVGGSSDKNLRAFIDQIRSDRIND

SEQ ID NO: 5989 - protein, 469 aa, Helianthus annuus
MEKPAHIAIVPSPGMGHLIPLVEFAKKLTSQHNLSATFIIPNEGPLSKSQSEFLDSLPNAINYTLLPPVNFDDLPQDAKIETRISLMVTRSVTALHATISSMMADKNIVALFVDLFGTDAFDVAIEFGVPRYLFFPASAMILSLCLHLPKLDQMVSCEYRDVPDPIQIPGCIPIHGKDLLDPLQDRSNDAYKRVLHNAKRYLMADGIVVNSFKGLESGAIEALQLEEPGKPPIYPVGPLIQSGSVESNKGVNESSCLKWLDGQPCGSVLYICFGSGGTLSSEQVTELAMGLELSEQRFIWVVRTPNDIADATFFNSHGHEGSFDFLPKTFLEKTKNHGLVVPNWAPQAQILSHRSTGGFVTHCGWNSVLETIVQGVPMIVWPLYAEQKMNALMLAEGLKVAMRAKLNENGIVDRLEIVRVFKGLLEGDEGEAIRIRTQELKEAALSALSNDGYSTKTLDQLAFKLKNKI

SEQ ID NO: 5990 - protein, 498 aa, Citrus unshiu
MTMRKLNLVFTSTPGIGNLVPVVEFARLLTNRDRRFSATVLIITIPERPIVNSYILTRGTALSVHDNDDVNFLHLPTVDPLSPDEYQSSLGYLCTLIEKHKPHVKHAIANLMATESGSDNAVSVRVAGLFVDMFCTSMIDVANELGIPSYLYFASPASFLGFLLYFPTLDTQLATEFVDSDTEFIVPKDSSITELKIPSFANPLPPLVLPTTALKRKQDGYMWYLYHGRRYLETKGMIVNTFQELEPYAIDSLRVTEMPPVYPIGPVLDLHGLAQWHPDRASQEKIMRWLDDQPPSSVVFLCFGSMGSLSEAQLREIAVGLERTGFRFLWSIREPSKGTIYLPGEYTNLEEILPEGFFHRTAKIGLVCGWVPQVAILAHQAVGGFVSHCGWNSVLESLWFSVPMATWPVYAEQQMNAFQLVKEFGLAVEIRLDFREGSDVVLAEELEKGLQQLMDGDDEVRRKVKQMKEKSRTAMMEDGSSYNSLGSLIEDLMANIGC

SEQ ID NO: 5991 - protein, 489 aa, Helianthus annuus
MAKTVTELVFIPAPGVGHIMSTMEMAKVLVNRDQRLSITVLLINPPYSILALNTYIESLAKNTIERIRFIELPQDQTPPKLDSKAPFMSFYEFIKSHCKYVRNILEDMIDQSGSCRVVGLVVDILCTSMIDVANEFNVPSYVYFTSNAAFLGFKVHFETLYVDQKQDLMELANSEGEIVIPSFVNPVPMRVFPELYQKQDGLDFLICAIGRMRKAKGIMVNTFLENKTELETHAINWFSGTNFPPLYPVGPLLNLDGVAGKADDTDVFRWLDNQPRASVVLLCFGSMGCFDEAQLKEIARGLERSGHRFVWSVRRPPPLEQSFEVLPDDYDDPRVVLPDGFLERTSRVGKVIGWAPQVSLLAHEAVGGFVSHCGWNSMLESLWFGVPTATLPIYCEQQMNAFEMVVDLGLAVDLKLDYKINVINPEGDMVIVMADEIERGIRSVMEDNEVRAKVKEMSKMSRASVVEGSSSYTSVGYLIKDMMRNIIYV

SEQ ID NO: 5992 - protein, 489 aa, Helianthus annuus
MDQSNQQNKTLEPHVLVFPIPFQGPVNCALKLAELLCLSGICVTFLNTEHIHRPLLRHTQVLSRFSRYPNFKFETVPDGLEHEKPVSGDGFMEVMAAVDAVSKPLFREMMVSGSLSRKSDRPVTVMIPDACFSFAVDIAIEASVPVICFETVSPCCLWTSYLNLPTLIEAGDVPFKGNDLDQFIKSVPGTEHIIRRRDLASFCRTNDLSDPVIKLIVKEAHSVPRTQGLILNTFEELDSLILKHMRKLCPNIYTIGPLHTLHKTQVTANTTKQSEETTFSNSVWKEDRTCLNWLDKHDPKTVIYVSIGSLATMTVEQLLEIWYGVVNSVKPFLWVRRPGSITGGYDESKVPPELLERTKEIGCIVEWAPQEDVLAHPAIGGFLTHSGWNSTIESIAEGVPMVCWPYFVDQQVNSRFVEEVWKMGVDMKDTCDRLRVEKAVRDIMDSKHNVFTQHARTWESLAKESISKTGSSSNHVGRLIDDILAMSST

SEQ ID NO: 5993 - protein, 470 aa, Setaria italica
MAAASASAASSGGGRPRRVLMFPLPFQGHLNPMLQLAGALHARGGGLVGITVFHAAFNAPNPARHPPGYRFVPVGEGVPSADLIPSGSDADFAGALGRINDRLREPFRDLLRQALADAEDDEAAACLVVDSNLRGIQLVAEELGVPTLVLRTGGAACLVAYMAFPALCDKGLLPPASQDKVQLDMPLDELTPLRLRDMVFSRTTTHANMRRCLQDLLDAGSSSSGIILNTFQDLENSDVQKISNGLGVPLYTIGPLHKISSGTEGSLLAQDQTCLKWLDKQEADSVLYVSFGSLASMDEKEMLETAWGLANSQMPFLWVIRHNMVKSSHQMSIPEGFEEATRGRGMVVTWAPQQEVLGHHAIGGFWTHNGWNSTLESICEGVPMICRPQFADQMINMRYVQEVWKIGFEIEGELERGEIEMAIKKLLCTEEGRQMRLRAKDLQDKAVKCIEEEGSSKSAMESLLKRIMSF

SEQ ID NO: 5994 - protein, 498 aa, Sorghum bicolor
MVSLTTAADHGQRPHAVCMPYPAQGHVTPMLKLAKLLHARGFEVTFVNTEFNHRRLHRSRGALDRVPGFRFDAIPDGLPPSDADATQDIPALSYSTMTTCLPHLLALLARVDADAASPRVTCLVTDAVMSFGFDAAREFGVPVAALWTASTCGFMGYRNYRSLVDSGLVPFKTAADLEDGVEGGHLATVVTGARGMCDGVQLRDFPSFIRTTDRADIMLNFLMREAERLSLPDGVIVNTFEDLEGASLDAMRAILPTVYPVGPLLLRERLEIPAGSPLAGLGSNLWKEQEGLPEWLAGRAPRSVVYVNYGSITVMTNSQLLEFAWGLANSGYPFVWNIRPDLVKGDSAVLPPEFTSAVEGRALLTTWCPQEAVLPHEAVGVFLTHSGWNSTLESLCAGVPMLSWPFFAEQQTNCRYKRTEWGVGMEIGGEVRRDEVSAILKEAMDGEKGREMRRRAEEWKEKAVKVTLPGGPAQTNLERVIDEVLLSKMKGQKQTANV

SEQ ID NO: 5995 - protein, 473 aa, Citrus unshiu
MLPAGSHILVYPFPTSGHIIPLLDLTNRLLTLGLNVTVLITQNNLPLLDSLNANHPSTSLQSLVLPQPKWPAGSPATRLLKFMRVLRELHYPALLDWFKSHPSPPVAILSDFFLGWTQGLAAELGLPRVVFSPSGAFALSVSFAMWTDLPTNDDPDNVDALVSFPRVPNCPVYPWYQISHLYRTLKEGDPDWDLHRSNMMANKTSWGIVFNSFAELERVYIDHMKKEMGHDRVWAVGPVLPPDDDLVESMCRGGSSSVPAHDVLTWLDSRRDESVVYVCFGSRYVLTAKQIHELAAALEKTDVNFVYCVREPDERHASQDCGVLPDGFEDRVAGRGYVIRGWSQQVAILRHKAVGAFLTHCGWNSVLEGVSAGVVMLTWPMDADQYTNAQLLVDQLGVGISVGEGTRNIPESGELARLLAQSVDGTRRERLKARELSGAALSAVVKGGSSDRDLNDFIRRINELKSGKNLTAV

SEQ ID NO: 5996 - protein, 1332 aa, Helianthus annuus
MTITVTKAKKSIDYLLDNRLHKDLTMSSSSSYPLSLNTISMNTSTHTNQPIHPSSLQLPPQSTTLPHTQLTKDHPHPLHKPRTIRYRLSQLCREGHPHLAHQLFDEIPKPTTVVWNSIIIGFICNNMAHEAILLYTQMKSRSFLPDSYTYSSVLKACAETRDIRVGKAAHCHVLRSGLYPSKIVCNSLLNMYASCLDYGVERVFGWMPKRNVVSWNIMISWFVKVGLFEEGVTHFVKMMKDGVKPTAVSFVNVFPAVVGLGDSRLADVVYGLLVKFGDEFSTDLFATSAAISMFSELGFVESARNVFDNCLDRNVEVWNTMIGGYVQNNMPVEAFDLFVQALRSSDDVVIDKVTLISVLTAASQLQQLDLAKQIHAYIIKSVAVLPVIVMNALIVMYSRCDSIQESSNIFNCMNEKDTVTWNTMISSFVQNGMNDEGVVLVRDMLKQGFTIDDVTITALLSAASNLRNREVGKQTHGYLLRRNIHFKGIESYLIDMYAKSGLIRVAQNLFERSCANDRDQATWNAMIAGNCHNGLIDQTFSVFRQMIDHGVSPNAVTIASILPACSIIGSSRLAKQIHAFTVRTFLDDNVFVHSALVDTYSKLGILTLAENVFEFSHPKNAVTYTNMILAYGQHGMGEKALDLFNSMRENGTRPDSVTLVAILCACSYSGLVDDGLKLFESIEAEYKIVPSLEHYCCVVDMLGRVGRVSEAYDFVEKLGENGNYLKVWGSLLGSCRTHGEFRLAKVVASKLVEMGLGNKNAGYHALLSNIYADEGNWEFVDRLRKEMYEKGLVKETGCSWIDNDGRSDYFTSRDKNYAHDDDMKKQWNWLIGIIYTERWINIRNMANEVAEVIFIPSPGVGHIKSTIELAKLLVNRDQRLGITVLVIKPPGATSGSAITTYIESLAENTIDRISFIQLPQDETPPIVDPKDQRNFKIEFINSHCKYVRDAVADLKSQPGSGRVVGFVVDMFCASMIDVANEFNVPTFVFFTSNAAFLGFTLYIKSLCDDLSKDVDVVELSNSDTEILVPSFVKPMPTKVFWSRVKTRAGLDFDRWFAQKLGEAKAIMVNTFLELETHAIESLSADSSIPPVYPVGPIVNLEGGSGGGKAFDNDVIRWLDSQPPSSVVFLCFGSMGSFDEVQVKEIARGLELSGYRFVWSLRRPPSDQTSRSPSDYEDPSVVLPEGFLERTHGIGKVIGWAPQAEVLRHDAVGGFVSHCGWNSLLESLWFGVPTAAWPMYAEQQMNAFEMVVELGLAVEMKLDYMKDLFNPKANAIIVTAVEIESGIRRLMEDDEIRRKVKEMSAKSRSAVVEDGSSYASLGCLIQDLTRDIS

SEQ ID NO: 5997 - protein, 484 aa, Unknown
  Description of Unknown: Oryza sativa Japonica Group sequence
MAEAATGATDTSLPPPPPHVVLMASPGAGHLIPLAELARRLVSDHGFAVTVVTIASLSDPATDAAVLSSLPASVATAVLPPVALDDLPADIGFGSVMFELVRRSVPHLRPLVVGSPAAAIVCDFFGTPALALAAELGVPGYVFFPTSISFISVVRSVVELHDGAAAGEYRDLPDPLVLPGCAPLRHGDIPDGFRDSADPVYAYVLEEGRRYGGADGFLVNSFPEMEPGAAEAFRRDGENGAFPPVYLVGPFVRPRSDEDADESACLEWLDRQPAGSVVYVSFGSGGALSVEQTRELAAGLEMSGHRFLWVVRMPRKGGLLSSMGASYGNPMDFLPEGFVERTNGRGLAVASWAPQVRVLAHPATAAFVSHCGWNSALESVSSGVPMIAWPLHAEQKMNAAILTEVAGVALPLSPVAPGGVVSREEVAAAVKELMDPGEKGSAARRRARELQAAAAARAWSPDGASRRALEEVAGKWKNAVHEDR

SEQ ID NO: 5998 - protein, 463 aa, Cephalotus follicularis
IVLYPSPSIGHLISLVELGKLILKHQPSFSITILTFIAPYNTGSTASYIAAVSATVPSITFHHLPAVALPLTSNSFEDLAFQLPHLLNPSVHQALNTISQSCKLKAFIIDFFNDAAHDVATSLNIPTYYFFTSSGSSLAAFLYLPIIHQITSKNIKDEDVLLHVPGLPPFLASLLPTPFHHRNSMAYNSFINSSLHMSKSCGLIVNTFESLEARPIKAARVGLCVPNGRTPPIFCIGPLIATIDDNPGGEHECISWLNSQPRKSVLFLCFGSMGLFSANQLMEIAIGLERSAHRFLWVVRSPPMDDINKGQSILAQPEPNLHQLLPKGFLERTKDRGLVVKYWAPQVAVLSHDSIGGFVTHCGWNSVLESVCAGVPMIAWPLYAEQNLNQVFVVEEMKIALAIKKSEVGLVSAAELEERVSEMMDSERGKDMRERILGMRDGALLAAKQDGGSSYVDLCKLAD

SEQ ID NO: 5999 - protein, 476 aa, Citrus unshiu
MMETAAKSSRPHVAVLASSGLGHVIPPLEFAKRLVINHGVHVSFLVITTNEASAAQEKHLRSLPDGLDVVDLPPVDVSAVTRDDMPVITRLHAIVDESLKSSLKSVLIELCNPRALVIDLFCTQAFEICSQLSIPTYSFVTTSIHFFAFALYLPTLDREVQGEFVDLPEPIEIPGCPPVRPEDLLDQVRNRKIDEYNLFLLHISRLPLAAGIFLNSWENLELVPLRAIREHSFYLQIPTPPIYPIGPLIKQDETLSASDEECLAWLGKKPSDSVIFVAPGSGGTLTAEQVTEMAWGLEQSKQRFIWVVRMPSDASASATFFNVGSDVNDPQAYLPEGFLQRTQGVGMVVPSWAPQVEILRHSSTGGFLSHCGWNSSLESICHGVPMIAWPLYAEQKMNAAMLTEEIGVAVKPVIESGKKVIGREEIERVVRLVMESEQGQVMRRRVKELKESASRALEDGVSSSDSLARFVKKWKD

SEQ ID NO: 6000 - protein, 492 aa, Ricinus communis
MACQPHFVLVPLMAQGHMIPVIDMARLIAEKGVIVSLITTPYNASRFDRIIYRAEESGLPIRLVQIPFPCQEVGLPIGYENLDTLPSRDLLKKFFTALAKLQQPLESILEHATPPPSCIISDKCLSWTSRTAQRFNIPRIVFHGMSCFSLLSSHNVRFSNAHLSVSSDSEPFLVPNMPQSFQVTRCQLPGSFVSLPDIDDVRNKMQEAESTAFGVVVNSFNELENGCAEAYEKAIKKKVWCIGPVSLCNRRNLDKFERGNKASIDEKQCLEWLDSKKPRSVIYACLGSLCRLEPSQLIELGLGLEASKKPFIWVAKTGEKTSELEEWFLKEKFEERIKGRGLLIKGWAPQVLILSHPAIGGFLTHCGWNSTIEGVCSGIPMITWPLFAEQFFNEKLVVEILKIGVRVGVEVPVRWGEEEKVGVLVKKDEVEKAVNTLMNGGEEGEKRRNKASELGDKARKAMELGGLSHFNLSLLIQEVLHEATQLKKRERR

SEQ ID NO: 6001 - protein, 472 aa, Eucalyptus grandis
MSKEFVQASSMAPPHFLLVTFPSQGHINPSLQFAKRLVRVGAHVTFATAIHAHHRMAESKSPPVGLSFASFSDGYDDGIDKDDLDGYMDELKRQGSETLSNLIASNLENGRRFLGVFYTTLLPWVADVARSHGIPSTLVWIQPATVLDFYYYYFHGYGDLIQSTSDNPSVPIQLPGLPPLMACDIPSFCNSKNVYNFSLPFLQRHFEILLEEAKPRILTNTFDALEPDAIRAIDKFEVIGIGPLIPSAFLDGQDPSDTSFGGDLFKSSSGYMEWLDTKPKASVIYLSFGSISVLSKPQKEEMARALVEVGRPFLWVIRESGKEERDEDRLSFQEELDKLGMIVLWCSQVEVLSHPSVGCFVTHCGWNSTSESLVCGVPMVAFPQWSDQLTNAKLVADVWRTGVKMTPNELGLVESGEMKRCLELVVGDGEEGEEMRRNARKFRDLAREAVKEGGSSDKNLRAFVDEAREAAE

SEQ ID NO: 6002 - protein, 461 aa, Vigna angularis
MSKPHILVFPYPAQGHILALLDLTHHLALAGITITIVITPKNLPILNPLLSSHPNNIQTLVLPFPPHPEIPAGAEHIREVGNTGNYPFINALSKLQPQIIHWFTTHPKPPAALIHDFFLGWTHQLAAQLNIPRIAFYGVAAFFTTVFRRCWHNPNILTNNSDILFHGIPGQPSFKRGHLPSVFLRYRESEPDSEFVKESFLSNDGAWACVFNTFRRLESPYLDHIRAELGHSRVYAVGPLGSNRSENSSTGSEVLNWLDAFEEEGSVLYVCFGSQKLLKKKQMEALAMGLERSQTRFVWVAPTPNKEQLEQGYGLVPDGFVDRVSGRGMVVTGWAPQVAILRHRVVGGFVSHCGWNSVMEAIVSGVVIMGWPMEADQFLNARLLVEEIGVAVRVCEGADSVPDPNELSRVVKRVMSGESPEKRRAKLMREESVRAVSEGGDSSMEVDQLVQALLQLGENKL

SEQ ID NO: 6003 - protein, 476 aa, Trifolium pratense
MKKAEVVFIPFPAPSHLVSTLEFAKLLINHDNRLRITILIMKFPHFTETDVYIKSLPISDSLNFINLPECSLPPNTNPRSAFGALFEAQKPHVRQAVSDLTTGEQHGPIAALVVDMFCTSMIDIAKEFSLPTLVFFTSGVASLGLNLYFHTLRERDNVGPTQLQQQAELAIPTFANLVPSTSLPGSVLSKESESFFMNNVGGLKNADGIIVNSFEELESHAVHSFSSHPELSSLPIIYPIGPILAPEPKTKSIVEPDDIIKWLDDQPPSSVVFFCFGTRGSFDEDQVKEIAHAIENSGARFVWSLRKPQPKGAMAPPTDYSLSDLSLVLPEGFLDRTRGVGRVIGWAPQTQILAHPATGGFVSHCGWNSTLESIYFGVPIATWPLFAEQQTNAFQLVVELKAAVEIALDYRVEFNEGPNYLLTADKIESGIRSVLDNDEVRKNVKEISEKSKTTLLEGGSSYTYLGRLIDYIMNQV

SEQ ID NO: 6004 - protein, 462 aa, Rosa chinensis
MSDSGDQSFVHVALLPSAGMGHLTPFLRLAALLTAHNVRVTFITPIPTVSLAESQSLSQLSTTFPQITQKHLHLLPLDELSANSEDPFYYHFELIRRSSHLLPPLLSSLSPPLSAMITDMSFSSTVIPITDSLGLPNYIFFTSSAKMLTLYVSFHTMLGPHREIKDGLEVSGLEPIPKAWIPPPLLKDGNNLLKSFFTENGKKMTESTGILINTFESIEHETVAALNEGRVLKGLPSAIAFGPLPPCNSETDHQLAWLDDQPTGSVFYVSFGSRTAMSREQVRELGEGLVRSGCRFLWVVKDKKVDMEDDEKLTEVLGQGLLERVKEKGLAVKKWLNQEQVLRHPAIAGFLSHCGWNSLSEALWNGVPVLAWPQHGDQKINADLVERIGLGVWVKSWGWSEEEMVVKAEDIAARVKEIMGNDSLRLQALHIKEEARLAVGDTGSSTKRLTALIETWKEFRVS

SEQ ID NO: 6005 - protein, 478 aa, Trifolium pratense
MGNENHELHIIFFPFLANGHIIPCVDLARVFSSRGLKVTIVTTHLNVPLISRTIGKAKINIKTIKFPSPEETGLPEGCENSESALAPDKFIKFMKSTLLLREPLEHVLEQEQPDCLVADMFFPWATDSAAKFNIPRIVFHGLGFFPLCVSACTRQYKPQDKVSSYTEPFVVPNLPGEITLTKMQLPQVPQHDKVFTKLLEESNESELKSYGVIANSFYELEPVYADHYRNELGRKAWHLGPVSLCNRDKEEKACRGREASIDEHECLKWLQSKEPNSVIYVCFGSMTVFSDAQLKEIAMGLEASEIPFIWVVKKKAKSDDEKLEWLPEGFEERIEGSGKGLIIRGWAPQVMILDHESVGGFVTHCGWNSTLEGVSAGLPMVTWPMYGEQFYNAKFLSDIIKIGVGVGVQTWIGMGGGEPVKKDVIEKAVRRIMVGDEAEEMRNRAKEFGKMARRALEVGGSSYNDFNNLIEDLKSHKH

SEQ ID NO: 6006 - protein, 1050 aa, Caenorhabditis nigoni
MHCLLTFVFLLSGTTHAKNILIINPIFGYSHVKFISKIADVIADHGHNVTLFQPFHTNMKNLDGLVKNKNIEIINYYPDHYEDLLKSEDQTFTALWDSRLANNPVLFSFMVPKMITGEFEKTDTQLYLDTNLHAELKSRKFDVAIAEAFGASSFFFAHLLDLPCIPVFSAVRFEIVNELFGQPSALGYTTRDGSKGAPDAGFLDRLNDVYRKYFEDLGHSGIFQYQNELFQKTMARPVPSWKNLVTQSPIFITNSNPYLDFAVPTTATIVHAGGITMDLNKVKHVGPLTEEYENILQERESTVLISFGSVYRSFQMPDNFKAGLIKMFESLPDVTFIWKYEEDDAEFKKRLPKNVHLKKWVPQTDLLADKRVKVFMTHGGLGSTMEVAYSAKPALMVPISGDQPQNALMLARHGGAVPYDKFELQDGEKLTRVMKEMVTNPKYQKRAQELFEVLSNQPIDIKMSLMKHLDFAMQFPNLRSQVPEINQVGLIAHYYLDVVMFLALSFAFAFYLLVKLLIKVYFKFIEATTMRLSNIVFMVTLWSSITAMNVVLYINAIGKSHLDFSDSLVDSLVEKGHTVDVIIARMNDQVTGHGKSKADRFYVFGFKNGSNWNKMHHLTNIFGEVKFPINGFRPYYDIGNSLCEIALSDLKLQEFLTYRKYDIGIVGTFDFCGVSILKSIGIPSVTTINAVPIMPIETVTIGLPNAPSQVVPLFQKFDLSTLYGRFWNAISWGFVNYIQIPTLKREQELLLQKRFGQDFSIEETIRKVDLTFINSNEVMEKPRPLHHRIQYIGGINLKSPKPVDQKLDELLSRSRNGTIIFSFGTQVPGKAYPRYAVKNFVKVFKKYSDYTFLWKYQIQPGEEKMFKEAKNVILLDWLPQTDLLYDQRVIGFISHVGMNSFNEASYAGKPIIAIPLFADQPHNAENGVARGTTYLLNKSELTEESIEMGLRAILFDKSYQENAIKLQKMLVEKPDQPKERFVQWMEYAAANPGLHKIFELPGSRMGIIEYYCVDAIVLLISVAVLGLYLMVKVTKMLSSRIRLMKKVKHE

SEQ ID NO: 6007 - protein, 493 aa, Erigeron breviscapus
MTKLMDQNQPHFLLVTFPTQGHINPSLQFAKRLVRLGVKVTFATSVSAYRKMSKNGKIPDGFNFAVFSDGFDDGFNPKLHDTTVYMNQLRSKGTQSLKETILSSAENGTPVSCLVYTLLLPWAGEVAHGLNVTSTLLWIQPASVLRIYYYYFKGYNELIREKCMEPTWSIELPGLPSLKSRDLPSFCLPSNPYDYVLSLFKEQLDLLDLEDKPKVLINSFDALEEDALKEIDGKLKLIGVGPLIPSAFLDGKDPSDKSFGGDMFQKSKDYVEWMNTKPEGSIIYVSFGSLIMLSKKQKEAMAYGLLESRRPFLWVIRDKDSNIKGEKVEDDEGEEEEEELSCMEELEQLGMIVPWCSQLEVLSHPSLGCFVTHCGWNSTLESIVCGVPVVAFPHWTDQATNAKLLEDVWGTGVRVTPNEDGVVEGKEIKECIERVMGGHANGAAMRKNAKRYKDLAREAVKENGSSYTNLKDFVEEVSGSLNEVFKSEFEASV

SEQ ID NO: 6008 - protein, 208 aa, Medicago truncatula
MTPLQLPDWLGTNHSTTAYYKPIFESEKKSYGTLYNSFHELESDYKKLSNTILGIKSWSVGPVSSLANKDDEKKGNRGHMEELAEEEEWLNWLNSKQIESVLYLSFGSVTRLDNAQIVEIAHGLENSDHNFIWVGYIIWNWAPQLLILDHPATGGIVTHCCWNSILESVNSGLPMITWPMSEEQFYNEKLLVDVLKIGVQVGAKENKF

SEQ ID NO: 6009 - protein, 358 aa, Rhodamnia argentea
MRQGDLLYGPIPGLEGLPTTAPRFHAWDVMDVNMPDGKVVDPTWTLPVAASELNISAVVFLTMRAASCSFLTHPIHHTFDEYPFSALTLPESDNLRIAQLMNSSANGYKNKERFWECMERSSNIVLIKTFRVMEAKSLISEKEGGDCWASSSRTCQQGRRWTQDHGDRRQLSSAVLVSSGSEYFLSEEEREEIAYGLELSNVGFIWVLKFHGGGEVTVHEALSQGFLQRIGHRGLVVEGWAPQAKILGHPGIGEFVSHCGWSSTLEAILLGVPIIAMPMHLDQPLNAKLAVEIGAVMEVDRGSGGFRREEVARVIQQVMVEEKGQEAKRNAQELGERMREEQEEMDGAVEKLKQLIEV

SEQ ID NO: 6010 - protein, 468 aa, Cicer arietinum
MEKKRCIAMIPSPGLSHLIPLVEFAKLLLQKHNEFIITFLIPTFGPLSSSMQSILNTLPPNMNFTVLPQLNNIQQDLPIEPATQMKLIVKNSVPFLIEEVKSLISKTHLIALVFSMFSTDAHDVAKQFNLLSYLFFSSGAVLFSFFLTLPNLDQSANTSKFLESCYETVNIPGVEIPFHVKELPDPILCERSSDTYKSLLDLCQKLTLFDGVIINTFTDLEQDVIRVLQEREKLCVYPIGPIIRKESNNETNMEVCLRWLENQPPSSVLFVSFGSGGTLSYQQLHELAFGLEISGCKFLWVVRVPSKNSSSAYFSKQNDDPLEYLPNGFLERTKDKGLVVASWAPQVEILVHESIGGFLSHCGWSSTLESVVNGVPMIAWPLFAEQKMNAKELVDVLKVGVRAKVDDENGIVKRDEVVKAIKGIMEGDESLEIRKRIKELSVGAANALSEHGSSMKALSDLVVKLHDY

SEQ ID NO: 6011 - protein, 256 aa, Dorcoceras hygrometricum
MIKSVEECDAIGIKSCGEMEGLYCDFLEKRFKKPVFLAGPVLPKPPSSTLDEKWAKLLDQFKPKTVVFCALGSEARLKKDQFQELILGIELSGYPFFAALKPPIGTDAIQEALPEGFQERTEKRGVVHGGWVQQQMILAHPSVGCFVTHCGAGSLSEAMVSECQLVLIPQMGDQIMNARFMAADLRVAVEVEKGDDNGMFTKEGVVKAIRSAMDDDCEIGDEIRSNHAKWRDFLMREGLENSYIDQFVVKLRGLLE

SEQ ID NO: 6012 - protein, 491 aa, Drosophila grimshawi
MMTNSIIRQLVKNGHEVTFITPFSLESENLGSNYKEILLESYDFWTEMKEMSNREIILDMADVTTLTFIRMLHVIGIHSTDFAFGQPAVKALINAKDKLGKYDLLLAEQFYNDGALILGHLYQVPVITVSTFGNTNYFTELAGIIAPWSYNPHSFLTYTNRMTFAERLFNFFICGTESLMRNFLFYPGHDAVLRKHFSNVLDVVPTVKQLHRNISAILMNNYMPLESPRPISVNMISVGGLHILPPKPLPQQLQTFLDGATHGAIYFSLGSQVRSADLPPEKLKVFLDAFGGLKQRVLWKFENDSFPNLPANVMIQKWMPQGDILAHPNVQVFIAHGGLFGMQEALQYGVPVLGMPVYCDQHYNINMGKAAGYALGLDYRTISAEELRSSLLALLENPKYRDTMKSASRIFRERPLSPMDTAMFWIDYIIEHRGAPHMVDAGVSLAWYQFYSLDVIAFILGSMLIPILLLCFCVKKSAKKSGTKSKKHKKQ

SEQ ID NO: 6013 - protein, 448 aa, Punica granatum
MRETISILMLPWLAHGHISPFLELAKRLADRNLRIHICSSPMNLESIRSRIPEKYSSSIRLLEIHLPSLPELPPQRHTTNGLPLHLMPVLKRAFDMSAPNFAEILVNLKPDLLIYDFLMPWAPELARSHNVRAVTFLSVGAGMASFVFHLLKNPGVDFPFEGLFSVDDHVSQMFCQILESPSSGITDKDRVLQCIERSSDILLMKTFRELEGKYIDCLSDLTGKRAVPVGPLVHDPLLQADQAGTHIIEWLDKKPISSTVFVSFGTEYFLTDQEREEIAHGLERSNVNFIWVMRFPGGERQDLEDALPKGFLERVAGRGLVVEKWAPQVRILEHESIGGFVSHCGWSSVMESMKFGVPIIAVPMQLDQPFNAKVVERVGVGIEVKRNPSSGRFEGEDIGRVIRGLVKERGGEGVRKRVKEVSESMIRNKGKDEEIDGVVDALVNLCGK

SEQ ID NO: 6014 - protein, 465 aa, Medicago truncatula
MSMSDINKNSELIFIPAPGIGHLASALEFAKLLTNHDKNLYITVFCIKFPGMPFADSYIKSVLASQPQIQLIDLPEVEPPPQELLKSPEFYILTFLESLIPHVKATIKTILSNKVVGLVLDFFCVSMIDVGNEFGIPSYLFLTSNVGFLSLMLSLKNRQIEEVFDDSDRDHQLLNIPGISNQVPSNVLPDACFNKDGGYIAYYKLAERFRDTKGIIVNTFSDLEQSSIDALYDHDEKIPPIYAVGPLLDLKGQPNPKLDQAQHDLILKWLDEQPDKSVVFLCFGSMGVSFGPSQIREIALGLKHSGVRFLWSNSAEKKVFPEGFLEWMELEGKGMICGWAPQVEVLAHKAIGGFVSHCGWNSILESMWFGVPILTWPIYAEQQLNAFRLVKEWGVGLGLRVDYRKGSDVVAAEEIEKGLKDLMDKDSIVHKKVQEMKEMSRNAVVDGGSSLISVGKLIDDITGSN

SEQ ID NO: 6015 - protein, 480 aa, Rosa chinensis
MKRAELVFIPSPGAGHLVAALQFGKRLLQRDDRISITVLAIKSAAPSSLGSYTESLVASESRIQLIDVPQAELPPLEFAKSPAKFFILNIENHVPNVREALTNYVSSLHSKPDSVPIVGVVLDFFCVSMIDVVNELNLPSYLFMTSNAGYLSVMFHFPEQDSRTGAPPKDSDPDWLVPGIVPPVPTTVLPVSMTDGSYSSYLGIAARFREAKGIIANTCVELEAHAFNSFSEDQTTPPVYPVGPVLDLNDGQARSNLNQAQRDRIMSWLDDQPEESVVFLCFGSLGSFSEAQVKEIALGLEQSGQRFMWSLRLTPPKGSKTLTPIDCSNLEEVLPDGFLERTRGKGLICGWAPQVEVLSHKATGGFVSHCGWNSILESLWYGVPIVTWPMYAEQQLNAFRMVKEWGLGLEMRLDYKKGGEVVKADEIGKAVVSVMEDSEVRKKVKEMGVVSRKAVEDVGSSSVSLGRFIEDVMRNHFGSD

SEQ ID NO: 6016 - protein, 816 aa, Theobroma cacao
METTQESPLHVVIVPTPGMGHLIPLIEFAKRLVDLHKFAVTFFVPNDGSPMKLQRQLLLTQPEPISSIFLPPVSFDDLPEDAKIETRIILSLNRSLHFLRDSFQVLAQSTRVVAFVVDVFGIDAFDVAKEFGLEPYIFVTTAVMLLSLIFELPKLDQMFSCEYRDLPEPIKLPGCVPFHGSDVPDPLQHRTNFAYQETLQQCKRYPLAAGIVINSFMDLEKGTLDALMESGRGLPAVYPVGPLIRTSSTSEVEGSNNCLRWLDEQPSGSVLYVCFGSGGTLSHEQLNELALGLEMSGQRFLWVVKEPNEIVANATYFGIENVKNPFAFLPDGFLERTKEVGLVVPSWAPQIQVLSHGSTGGFLTHCGWNSVLESIVHGVPLIAWPLYAEQKMNAVLLKDGLKVAFRVRVNEDGLVGREDIAKYVKELIEGDEGQLLRTRVRKLKDAAKVDCTDMEKPLAILERGTTCSAWNYCGERLAAGSVDGSLSILDSRDSSSSSFICSSKFKANEAGIVKVAWIPPEYGDAVACICEDGTLSIWEELVEGTQPLQWKLCKSFKTSSKVLDVQFGVNQTSLKMVAAYSDGFVKIFELLDPLELKNWQLQVLNSVHLRFPLFLLHFLDIQPFPIAEYQNVIDSVSTFGKASCLTACISWNPQRGEGQESSFILGFNSNTPQLNSPKVWEFDPAHQRWLPVAELALPGDKGDQVYSVAWAPNIGRPYEVIAVASQKGIAIWHVGSTPDLDGRLSVEKAALLSEHNSEKEAIALLACAPILLKVWQMEWDMSGMTLATTESNGPVRLWQSNLNGAWHEQAAFEPTS

SEQ ID NO: 6017 - protein, 489 aa, Arabidopsis thaliana
MEQHGGSSSQKPHAMCIPYPAQGHINPMLKLAKLLHARGFHVTFVNTDYNHRRILQSRGPHALNGLPSFRFETIPDGLPWTDVDAKQDMLKLIDSTINNCLAPFKDLILRLNSGSDIPPVSCIISDASMSFTIDAAEELKIPVVLLWTNSATALILYLHYQKLIEKEIIPLKDSSDLKKHLETEIDWIPSMKKIKLKDFPDFVTTTNPQDPMISFILHVTGRIKRASAIFINTFEKLEHNVLLSLRSLLPQIYSVGPFQILENREIDKNSEIRKLGLNLWEEETESLDWLDTKAEKAVIYVNFGSLTVLTSEQILEFAWGLARSGKEFLWVVRSGMVDGDDSILPAEFLSETKNRGMLIKGWCSQEKVLSHPAIGGFLTHCGWNSTLESLYAGVPMICWPFFADQLTNRKFCCEDWGIGMEIGEEVKRERVETVVKELMDGEKGKRLREKVVEWRRLAEEASAPPLGSSYVNFETVVNKVLTCHTIRST

SEQ ID NO: 6018 - protein, 480 aa, Arabidopsis thaliana
MNKFALVFVPFPILGHLKSTAEMAKLLVEQETRLSISIIILPLLSGDDVSASAYISALSAASNDRLHYEVISDGDQPTVGLHVDNHIPMVKRTVAKLVDDYSRRPDSPRLAGLVVDMFCISVIDVANEVSVPCYLFYTSNVGILALGLHIQMLFDKKEYSVSETDFEDSEVVLDVPSLTCPYPVKCLPYGLATKEWLPMYLNQGRRFREMKGILVNTFAELEPYALESLHSSGDTPRAYPVGPLLHLENHVDGSKDEKGSDILRWLDEQPPKSVVFLCFGSIGGFNEEQAREMAIALERSGHRFLWSLRRASRDIDKELPGEFKNLEEILPEGFFDRTKDKGKVIGWAPQVAVLAKPAIGGFVTHCGWNSILESLWFGVPIAPWPLYAEQKFNAFVMVEELGLAVKIRKYWRGDQLVGTATVIVTAEEIERGIRCLMEQDSDVRNRVKEMSKKCHMALKDGGSSQSALKLFIQDVTKYIA

SEQ ID NO: 6019 - protein, 485 aa, Zea mays
MEKLPSQQQVVLLASPGAGHLIPMVELAQRLAADHGFAVTLVTIPGMSNPATEAVVLSSLPSYVLTAVLPAVPLDDLPSDIGFGALVFEFVRRSLPNLRALMEDASRGSVTALVCDFFGTSALPLAAELGVQGYVFLPNSFAMISIMRHLAGLHGDAAAPGEYRYLPDLLPLPAGGLVLHHADLPEGFQDRKDPVYAYHVEEARRYGRANGFLVNSFEELEVVMVETFKRDAEDGAFPPVYPVGPFVRSSSSEEADESGCLEWLDRQPENSVVYLSFGTGGSLSVEQTAELAAGLEMSGHRFLWVVRMPSLDGNPCAYGSMPGDKDDPLAWLPEGFLERTSGRGLAVVAWAPQVRVLSHSATACFVSHCGWNSTLESVAAGVPMVAWPLYAEQKMNAAILTEVTGVALRPAARGNGHGLVTREEIAASVKELMEGEKGSAVRGRTRELREASKRAWSSEGSSRRALGEVAGKLKAALVNGNGSAP

SEQ ID NO: 6020 - protein, 472 aa, Polygala tenuifolia
MKKLELVFIPFPAIGHLVSTIELAKLLLGRDDRFSITFFLMKPAFGPSHSTQSFSSSYPQIRFIDIPRIDPPPADLFRKSFEKVTSMYIESYKASVKEAVVNHVLPNCDKFAGLVVDIFCTSMIDVANELGVPSYLYFTSGAGFLGFLLHLSTRHDQGVAEFEKSDPDSFIPCYINPVPTDVLPSFAFNKEGGYAAFLNHARRFKETKGILVNTFPELEPHAVSSLSVYNDLPKVYTVGPLISHKSQSPWQSHQEKYDKIMKWLDDQPPSSVVFLCFGSWGCFSESQLKEIAIALEKSGHRFLWSIRAAGKDELGTPVENINYGEILPEGFLERTQDKAFLCGWTPQVEVLAHKAVGCFVSHCGWNSILESVWYGVPIVTWPIYAEQQLNAFQMVKDLRLAVEMKLDYRRGTDTIVKADEIAKAVSCAMEEDGEVKKKVKDVSEKSRETVVEGGSSCASVRMLVEAMVEGST

SEQ ID NO: 6021 - protein, 300 aa, Panicum miliaceum
MATGDRRRRVLFFPLPFQGHINPMFQLAGLLHARGFAVPVFHTRFNAPDASRHPAYDFVPVPVPVPDDDGMPVDTPDTVQVTLERVLAVNRACTAPFWERLAALQAPASVLYVSFGSVASMSASDLAETAWGMAISGRPFLWALQPGLVRGAPPSPEQPPLPAGFRAATRGRGTVVAWAPQEEVLAHPAVGGFWTHCGWNSTLEAVCAGVPMLCRPCFGDQMGNARYVERAWRVGVALDGELERGEVEAAIAAVMGGGEAGAGMRRRPAVLKSRAAECCVAEAGSSCLNVDKLVKHIMAL

SEQ ID NO: 6022 - protein, 478 aa, Nicotiana tabacum
MAETAIVTKSENPHIVILPSPGMGHLIPLVEFSKRLISQHQFSVTLILPTDGPISNSQKSFLNSLPSCMDYHLLPPVNFDDLPLDVKIETRISLTVTRSLSSLREVFKTLVDSKKVVAFVVDLFGTDAFDVAIDFNVSPYIFFPSTAMALSLFLYLPKLDATVSCEYRDLPDPIQIPGCIPIHGKDLLDPVQDRKNEAYRWLLHHSKRYRMAEGVVSNSFKELEGGPIKALQEEEPGKPPVYPVGPLIQMDSGSKVDGSGCLTWLDEQPRGSVLYVSYGSGGTLSHEQLIEVASGLEMSEQRFLWVIRCPNDTVANATYFNVQDSTNPLDFLPKGFLERTKGLGLVVPNWAPQAQILSHGSTGGFLTHCGWNSTLESVVHGVPLIAWPLYAEQKMNAVMLTEDIKVALRPKANENGLVGRLEIAKVVKGLMEGEEGKGVRTRMRDLKDAAAKVLSQDGSSTKALAELATKLKNKVLIN

SEQ ID NO: 6023 - protein, 467 aa, Arabidopsis thaliana
MRNAELIFIPTPTVGHLVPFLEFARRLIEQDDRIRITFLLMKQQGQSHLDSYVKTISSSLPFVRFIDVPELEEKPTLGTQSVEAYVYDFIETNVPLVQNIIMGILSSPAFDGVTVKGFVADFFCLPMIDVAKDASLPFYVFLTSNSGFLAMMQYLAYGHKKDTSVFARNSEEMLSIPGFVNPVPAKVLPSALFIEDGYDADVKLAILFTKANGILVNTSFDIEPTSLNHFLGEENYPSVYAVGPIFNPKAHPHPDQDLACCDESMKWLDAQPEASVVFLCFGSMGSLRGPLVKEIAHGLELCQYRFLWSLRTEEVTNDDLLPEGFMDRVSGRGMICGWSPQVEILAHKAVGGFVSHCGWNSIVESLWFGVPIVTWPMYAEQQLNAFLMVKELKLAVELKLDYSVHSGEIVSANEIETAISCVMNKDNNVVRKRVMDISQMIQRATKNGGSSFAAIEKFIHDVIGTRT

SEQ ID NO: 6024 - protein, 479 aa, Helianthus annuus
MAIKLDLVHVLLVTFPAQGHVNPLLRLGKLLASKGNVLVTFSSTKSIGNKMKKAGCAVSSDPTPVGNRGGMIRFEFFDDGCSEDKDDERNDLDTYLPKLEAYGKKAITRIINQHAENGWPVSCLINNPFIPWVSDLAQELNIPCAMLWVQSCACFSSYYHYQKSLVPFPSEEKPDIDVQLPNMPVLKSDEIPSFLHPSTPYPFLRRAILGQFKNLSNNFCVLMETFEELEGDLIKYMSQICPIRAAGPLFNNPLLETSSNISGDLIKADDCLEWLDSKQPSSVVYISFGSVVSLSQEQVTEMAYGVLNSGVSFLWVIRNNVTSTGASGKLPEGFLEEAGERGMVVQWSPQAQVLSHPAVSCFLTHCGWNSTMEALSSGVPVVAFPHWGDQVTDAKYLADEWKVGIRMCRGEAEHRVIGRKEVEECLREATGGVRAAEMKTNVMKWKKAAAEAVAEGGTSDRNIQEFVDEIRKLSLKKSS

SEQ ID NO: 6025 - protein, 486 aa, Helianthus annuus
MANMVATLVFIPAPGLGHIMSTIEIAKLFVNRDQRFSITVLVIKPPSSDSGSTITTYIESLAKNNTDRISFVELPQQEIAPPSDSKGPLASFNEFIKSHCKYVKNIVADMISQTGSGQVAGFVIDMFCTCMIDVANEFDVPTYVFFTSNAAFLGFKFFIQTLNDEQNQDVVELSHSDTEITVPTLVKPMPTKVFPTVFQTRETVEFVLSAARRMREVKAIIVNSFLEVETHAIESLSADNTIPPVYPVGPILNLEGGTGGRKPLEDDVIKWLDNQPPSSVVFLCFGSMGSFDEVQVKEIARALEQSGVRFVWSLRKPPPDKTSRVTIEYEDFRVVLPEGFLERTVGIGKVIGWATQVAVLGHRAVGGFVSHCGWNSLLESLWFSVPVATWPMYAEQQINAFEMVVELGLSVEIKLDYKRDSFIPMAESVVVPAEEIETGIGRLMEDDLVRAKVKKMSEKSRSTVLEGGSSYAYFGSLIQDLITNIS

SEQ ID NO: 6026 - protein, 318 aa, Helianthus annuus
MKLLVDDNYLTDGTLEKSIDWIPAMSNLRYKDIPSFIRITDPNDIMFNIAMDEAENNLSSPAIIMNTFDALEHKVIEAIASKFDYPNIYTIGPLPLLARYVPDDSPVQSLNSSLWMSDSSCLKWLDQKEEGSVIYVNYGSITTMTDQHFVEFAWGLARSMQPFLWVVRPDVTMGNSAVLPGELLEEIKDRGMLVSWCAQEKVLAHRSVGAFLSHCGWNSTTESILEGVPLICWPFFSDQLTNCRFACTEWGIGMEINHDVKRNEVEVVVREMMQGEKGKEMRRNARDWKRKAKEATEIGGLSYNNFQRFIKEALHYHT

SEQ ID NO: 6027 - protein, 641 aa, Helianthus annuus
MDQQNNTLEPHVLMFPIPFQGPVNCFLKLAELLCLSGIHVTFLNTEHIHRPLLRHTQVLSRFSRYPNFKFETIPDGVEHETPVPRDRFMEVMAGVDAVTKPLFREMMVSGRFSWKSERPVTVMIPDAYFSFAVDVAIEASIPVICFETISPCCLWTSYLNLPTLIEAGDVPFEGPVNCALKLAELLCLSGIRVTFLNTEHIHRPLLRHTQVLSRFSRYPNFRFETIPDGLEHENPVSGDRFMEVMDAVDVVTKPLFREMMFSGRLSRKADRPVTVMIPDACFSFAVDIAIEASIPVICFETIGPGALWTSYLNLPTLIEAGDVPFKGNDLDQLITSVPGTEHIIRKRDLDSFCRFKDLSNPGIEFILKKAHIVPRAQGLILNTFEELDSVVLPHMRKLCPNIYTIGPMHSLHKTKLMANTKLSPQETTVSNSVWKEDKTCLSWLDKHDPKTVIYVSIGSLAIMTVEQLIEIWYGVVNSGKPFLWVRRPGSITSAYDESQVPTELLERTKEIGCIVEWAPQEDVLAHPAIGGFLTHSGWNSTMESIVEGVPMVCWPYFGDQQTNSRFVGEVWKTGIDLKDTCDRLGIEKAVRDIMDSKHKLYTQAANTWENAAKESISMTGSSSIQLARLIDDILAMSLTNL

SEQ ID NO: 6028 - protein, 522 aa, Unknown
  Description of Unknown: Oryza sativa Japonica Group sequence
TCGVSNTTNATTLVGFRGKHTTRAGGNKALRSMEPHVLLVSFPMQGHVNPLLRLGRRLAATGLLVTFTTVRLAAGGGRLRDVPEDGACADVGLGRLRFEYLRDDDDDGDERCQQLAPNDVLSHVTAVGPSALAEFIDGQADAGRPVTFVVNNIFVPWALDVAAGMGIPCAMLWIQPCSVLSIYYHFYESPEAFPTAADPDVPVELPGLPVMAMVELPFMVRPEYAQCLWGDTLRAQVGAIKRTVSWVLVNSFYELERSAVDALRAHTTVKLAPIGPLLEHGHDNGGGDDGAPAPALGAEDNDRCVAWLDAQPPRSVVYVAFGSLVNIGRDETAAVAEGLVATGRPFLWVVRDDSRDLVPEAVLAACRGDKAGKITAWCPQGRVLAHGAVGCFVTHCGWNSIMEALAAGVPVVGYPWWSDQFANAKFLVEDYKVGVRLPAPVTGGELRACVDRVMSGPEAAVIRKRAMHWKREAAAAVADGGSSDRSLQDFVDHVRRSKGPEELARLAQDIQIMNGPVNPVLV

SEQ ID NO: 6029 - protein, 495 aa, Unknown
  Description of Unknown: Oryza sativa Japonica Group sequence
MDPSPRPSPHVVLVASPCAGHVMPMAELARRLVAFHGCAATLVTFSGLAASLDAHSAAVLASLPASSVAAVTLPEVTLDDVPADANFGTLIFELVRRSLPNLRQFLRSIGGGVAALVSDFFCGVVLDLAVELGVPGYVFVPSNTASLAFMRRFVEVHDGAAPGEYRDLPDPLRLAGDVTIRVADMPDGYLDRSNPVFWQLLEEVRRYRRADGFLVNSFAEMESTIVEEFKTAAEQGAFPPVYPVGPFVRPCSDEAGELACLEWLDRQPAGSVVFVSFGSAGMLSVEQTRELAAGLEMSGHGFLWVVRMPSHDGESYDFATDHRNDDEEDRDGGGHDDDPLAWLPDGFLERTSGRGLAVASWAPQVRVLSHPATAAFVSHCGWNSALESVSAGVPMVPWPLYAEQKVNAVILTEVAGVALRPAAARGGVDGVVTREEVAAAVEELMDPGEKGSAARRRAREMQAAAARARSPGGASHRELDEVAGKWKQTNRAPYE

SEQ ID NO: 6030 - protein, 507 aa, Unknown
  Description of Unknown: Oryza sativa Japonica Group sequence
MAIESAPARNERRGQHVVLLASPGAGHLLPVAELARRIVEYDGFTATIVTHTNFSSAEHSSTFSSLPPSISIAALPEVSVDDLPADARVETRILTVVRRALPHLRDLLRSLLDSPAGVAVFLSDLLSPRALAVAAELGIPRYVFCTSNLMCLTSFLHNPVLDRTTTCEFRDLPGPVLLPGCVPLHGSDLVDPVQDRANPVYRLVIEMGLDYLRADGFLVNTFDAMEHDTAVAFKELSDKGVYPPAYAVGPFVRSPSGKAANDACIRWLDDQPDGSVLYVCLGSGGTLSTEQTAEVAAGLEASGQRFLWVVRYPSDKDKTASYFSVSGDGDGEDSPTNYLPEGFLERTKGTGLAVPMWAPQVEILNHRAVGGFVSHCGWNSTLETVAAGVPMVAWPLYAEQRMNAVMLSSSRAGLALRPSNAREDGVVTRDEVAAVARELITGEKGAAARRKARELREAAAKATRAPGGPSRQAFEAVVGGAWKKAAAAARGGRAGEPDDNGTAVTAQ

SEQ ID NO: 6031 - protein, 460 aa, Unknown
  Description of Unknown: Oryza sativa Japonica Group sequence
MAKGHVLVLPMPCQGHVIPFMELSHRLADEGFEVTFVNTEVDHALVVAALPPGGAAELRQRGIHLTAIPDGLAEDEDRKDLNKLIDAYSRHMPGHFERLIGEIEAGGGRPKVRWLVGDVNMGWSFAVARRLGIRVVYFSPASTACIAFMRKIPKLIEDGVLNEKGWPERQETLQLAPGMPPLHTSLLSWNNAGAAEGQHIIFDLVCRNNKFNDDLAEMTICNSFHEAEPAVFKLFPDLLPIGPLVADRELRRPVGHFLPEDAGCLDWLDAQPDGSVVYVAFGSMAIFDARQFQELAVGLELTGRPFLWVVRPDFTPGLSTAWLDAFRCRVAGRGVIVEWCSQQRVLAHAAVACFVSHCGWNSTLEGVRNGVPFLCWPYFCDQFLDRSYITAVWRTGLAVAAGEEDGVVTRDEVRSKVEQVVGDGEIRERARLLRDTARACVSEGGSSHKNFRKFIDLLSE

SEQ ID NO: 6032 - protein, 481 aa, Vigna angularis
MASVETPKPHIVCVPYPAQGHINPMMQLAKILRCKGFYITFVNSEYNHRRFIKSHGPEFVKGLPDFAYETIPDGLPPSDKDATQDIPLLCDSTRKTCYGPFKELVLKLKATEGVPPISCVIADGIMGFAGKVAKDMGIPEVQLWTASVCGYVGYLQFDELVALGMVPFKDQKEIDDALDISLDWIKGMSNMRLRDLPTFCRVTSLDDILYDFLNSESRNTLKSSAVIINTFEDLDEEGLEILRSYNPNIYTIGPLDLLGRHFPEKEKGFMSVGSSLWKNDSNCLTWLNKWEPNSVVYVNFGSIAVMTAHHLKEFAWGLANSKLPFLWIKRADIVADESDSLPQEFFDEIKDRGYITSWCMQEQVLSHPSVGVFLTHCGWNSTLEGIYAGVPMVCWPFFSDQHTNCRYVCANWGVGMEINQDVKRDEISDLVTEMIKGDKGKEIRQKSLEWKKKAIKATDVGGTSYNNIHKLIKEALSGNAA

SEQ ID NO: 6033 - protein, 464 aa, Vigna angularis
MALNEENIPHESKVVVLVIPSPAQSHLNQLLRLSRQIVAHNIPVHYVSTITHIRQVTLRHQNSISDIHFHAFEVPPFVSPPPIPNNPESDFPSHLIPSFVAATQLREPVGKLLQSLSSQAKKVIIIHDALMASVAQDAINLPNVEKYIFHIFPAFVASVYFWEGQGRPPVEDIHFPEVPSDEGCLPAHFTDLLSTHDYNEFLNSNGDIYNTSRAIEGPYVDFMQRLNAGKKVWALGPLNLLAIEKNDSTEFRHPCMEWLDKQEPNSVIYVCFGTTTTFTEEQNHHIATGLEQSKQKFIWVLRDADKGNIFDGSEAKEHELPNGFEERVKGMGLVVRDWAPQSEILSHPSMGGFLSHCGWNSCLESLSMGVPIAAWPIHSDQPKNAALVTEVLKAGLVVRDWSQRRNELVTASHVENCVRRLMQTKEGEEMRERAVRLKNDIHRSTNEGGISRMEMESFISHITQ

SEQ ID NO: 6034 - protein, 468 aa, Populus euphratica
MGVQPHILLVTFPAQGHINPALQFAKRLVAIGAHVTFATSMGAKRRMSKSGTYPKGLYFAAFDDGSEHGFRPSDDIEHYFSELRRVGSKSLADLICQGPKNGGPFTCVVYSNLIPWVAKVARQHNLPSTLLWNQSPALLDIFYYYFNGYGDTIKKSINDPSFSLKLPGLPPLGSRDLPSFLNPRNTHAFALPVNKEHIEVLDEETNPKVLVNTFDALECEALNSIGKFKLVGVGPLIPSAYLDEKDPSDTSFGGDLFQDSKDYVEWLNSKPESSVIYISFGSISVISKPQKEEIARALLDTGRPFLWVIRTDGGEEKEEDKLSCTEELEKQGKIVPWCSQVVVLSHPSIGCFVTHCGWNSTFESLASGVPVVAFPQWTDQLTNAKMVEAVWETGVRVSANKEGIIEGEEIEKCLELVMGGGERGKEMRKNAKKWKDLARESSREGGTSYQNLQDFFNEIGGGAMSLDI

SEQ ID NO: 6035 - protein, 454 aa, Arabidopsis thaliana
MDPNESPPNQFRHVVAMPYPGRGHINPMMNLCKRLVRRYPNLHVTFVVTEEWLGFIGPDPKPDRIHFSTLPNLIPSELVRAKDFIGFIDAVYTRLEEPFEKLLDSLNSPPPSVIFADTYVIWAVRVGRKRNIPVVSLWTMSATILSFFLHSDLLISHGHALFEPSEEVVDYVPGLSPTKLRDLPPIFDGYSDRVFKTAKLCFDELPGARSLLFTTAYELEHKAIDAFTSKLDIPVYAIGPLIPFEELSVQNDNKEPNYIQWLEEQPEGSVLYISQGSFLSVSEAQMEEIVKGLRESGVRFLWVARGGELKLKEALEGSLGVVVSWCDQLRVLCHKAVGGFWTHCGFNSTLEGIYSGVPMLAFPLFWDQILNAKMIVEDWRVGMRIERTKKNELLIGREEIKEVVKRFMDRESEEGKEMRRRACDLSEISRGAVAKSGSSNVNIDEFVRHITNTN

SEQ ID NO: 6036 - protein, 488 aa, Arabidopsis lyrata
MGTSGKVSKLHFLLFPFMAHGHMIPTLDMAKLFATKGAKSTILTTPLNAKLFFEKPIKSFNQDNPGLEDITIQILHFPCTELGLPDGCENTDFIFSTPDLNIGDLNQKFLLAMKYFKEPLEQLLETMRPDCLVGNMFFPWATKVAEKFGVPRLVFHGTGFFSLCASHCIRLPKNVASSSEPFVIPDLPGDIVITGEQVIEKEEESVVGRFMKEIRDSERDSFGVLVNSFYELEPAYSDYFKSFVAKRAWHIGPLSLGNRRFEEKAERGKKASIDEHECLKWLDSKKCDSVIYMAFGTMSSFNNEQLIEIAAALDMSGHAFVWVVNKKGSQVEKEDWLPDGFEEKTKGKGLIIRGWAPQVLILDHQATGGFLTHCGWNSLLEGVASGLPMVTWPVGAEQFYNEKLVTQVLKTGVSVGVKKMMQVVGDFISREKVERAVREVMVGEERRKRAKELAEMAKNAVKEGGSSDLELDRLMEELMLVKLQKEKV

SEQ ID NO: 6037 - protein, 448 aa, Rhodamnia argentea
  MOD_RES (114)..(114): Any amino acid
  MOD_RES (357)..(357): Any amino acid
MSMDNMQRPIKVLMLPWLAHGHISPFLELAKRLSTRNFHIYLCSTPVNLSSIKPKMSEKHSSSIELVELHLPSLPDLPPHYHTTKGLPPHLMKALQAAFDMARPGFSDIVKSIXPDLLLYDFIQPWAPEVAKSHGVPAVVFFSVGAGPLSFMLHVLKNTCNEFPFEAIFLHDYELVKIIKAAEDAGDGRKDRTPKSVERSSNFILLKSFRELEGKYVDYLSSFSGKTGVPVGPLVEEPSNVEDGDNIIEWLDKREKSSAVLVSFGTEYFLTEKEREEIASGLELSNVKFLWVIRFPVGESMELEEALPEGFLERVRGRGLVIVGWAPQGKILEHPSIGGFVSHCGWGSVMESMKSGXPIIAMPMHLDQRMNARIVGEVGVGLEVKRNESGELKRLEIAKVIRDVVVEKDGEGVRKKAREMSDSIRKKGEGELDEVADALVQLCVGYKD

SEQ ID NO: 6038 - protein, 212 aa, Cajanus cajan
MWSVEDSCMEWLDNKPPSSVIYVSFGSMLVTSQTQMDNIATAMRNSNKSFLWVLKPGSNKDNVAEFSNGFSEETKERVLVVKWCPQEKVLMHSSVAGFISHCGWNSTLEAVVAGVPLIAWPSWTDQPTTAMLIENVFRNGVRLRCGEDGNASAEDIERCIRCVTEGPSAEEIKKRAREMKEAAWKTLQDGGTSSKNISQFISDLIAGKPDRA

SEQ ID NO: 6039 - protein, 432 aa, Vigna angularis
MMILSEKLVENGCKVVFVNTEFNHKRMVSCMVEQQDQNSLIKLVSMPDGLEPEHDRKDLSKIFDVGLNTMPHALEKLITEQNIISKSDNRIRYIVADVSMAWSLNVGCKLGIKGAIFCPSSAAIFALLYNIPKLIHDGIINSDGSLLTTKKTIELSPGKVEMDTGSLFWLNLGVTMNVKHMLNYLDTCAKSSNLTELWFCDTTYELEPKVLSFFPKILPIGPLLRNYSNMNASPTRSMGQLWEEDLSCTSWLDQQPHCSVIYAAFGSITCFDQNQFNELALGLDLTNRPFLWVVREDNKMAYPNEFQGNKGKIVQWAPQQKVLNHSAIASFVSHCGWNSTMEGLCNGVPFLCWPYFADQIYNKAYICDELKVGMGLDLDENGVVSRWEIKKKLDQLLSDVNMRTRSLKLKEKVLDKGRSSENLNKLVKWIKG

SEQ ID NO: 6040 - protein, 478 aa, Medicago truncatula
MAQNHHFLIITYPLQGHINPALQFTKRLISLGAKVTFATTIHLYSRLINKPTIPGLSFATFSDGYDDGQKSFGDEDIVSYMSEFTRRGSEFLTNIILSSKQENHPFTCLIYTLILSWAPKVAHELHLPSTLLWIQAATVFDIFYYYFHEHGDYITNKSKDETCLISLPGLSFSLKSRDLPSFLLASNTYTFALPSLKEQIQLLNEEINPRVLVNTVEEFELDALNKVDVGKIKMIPIGPLIPSAFLDGKDPTDNSFGGDVVRVDSKDDYIQWLDSKDEKSVVYVSFGTLAVLSKRQMEEIARALLDSGFSFLWVIRDKKLQQQKEEEVDDDELSCREELENNMNGKIVKWCSQVEVLSHRSLGCFMTHCGWNSTLESLGSGVPMVAFPQWTDQTTNAKLIEDVWKTGLRMEHDEEGMVKVEEIRKCLEVVMGKGEKGEELRRNAKKWKDLARAAVKEGGSSNRNLRSYLNDIACITQI

SEQ ID NO: 6041 - protein, 487 aa, Zostera marina
MERLTKSSNNPIHFVLVPFMSPGHMNPMVDLGKLLAERGMNATIITTPQNALRFKSTADHALQTGLPLKFHELDVFPLIEDGGQQKKCDNLDSLVSAEAMMKFFKIADLLEEPLMEYLKNEKCRLPLCIISDWIFLWASKLATELNIPRFVFYCMPCFTLACTEILTTTWEGDQIVVPEIPHRIELVREQANVFFYGDAELQKLWKKGDSVSDGIIVNTCMGIEPTYVDIYRRRKGKNIWTVGPVGMCNRDMADKATRGLKSSSISATEISTFLDSMDPKSVIYVCFGTLSCTSSEQVIEICLGLMDSAHPFILVIQPKTNSVEIESWMESNRFEERNKDTGLVIRGWAPQVMILSHPSVGGFVTHCGWNSTLEGISAGLPMVTWPSFSDQFLNERFIVDVLEIGVMVGVKDPVWWWEEVVSVKREKFLKAVKELMGDGEEAVMRRRKALKLKKMADESMDIDGSSTNQLNALIQHVVELYEEKKTV

SEQ ID NO: 6042 - protein, 284 aa, Unknown
  Description of Unknown: Oryza sativa Japonica Group sequence
CWLCLVEPIFCVTQLRFRNQKLIGFQLVFPSCWFSWAGSALTQEAFQLSPDMPVMHPAHLAWNCIGNDEGQELLFSCVLAGIRAIDECDYILCNSFRGAEAATFARFPKIIPVGPLLTGERPGKPVGHFWLPEDGACMSWLDAQPVRSVVYVAFGSFTVFDRRQFQELALGLELTGRPFLWVVRPDIVHGDVHEYPDGFLDRVVASGINGGGRGKLVAWAPQQRVLAHPAVACFVSHCGWNSTMEGVRNGVPFVAWPYFADQFVNRAYICDIWRIGLPAVADEK

SEQ ID NO: 6043 - protein, 454 aa, Ricinus communis
MAYILNATRFSPQKKRKEQQDLIMGEPKKLHVALFPWLAFGHIIPYLDLAQLIAQKGHKISFISTSRNIQRLPQVSSKLSSSIKLISLTLPQVENLPHDAESTMDLPYDHVPYLKKAYDLLQDQLLHFLQTSAPDWIIYDFSPHWLPPIAANLGISGAFFSIFGAWSLTFLGSSSSAMINGDDPRTKAEHLTVPPDWVPFSSKVAFRLHEAKRALDHLGMNNSGQLHGKPVLPVGILPPSALDSSDDKDDTWIEISSWLDKHNKGSVVYIAFGSESAPSQEELEELALGLELSGLPFFWTLRKRNNDDSIKLPDGFEERVKGRGLVWMSWAPQVKILAHESVGGFLTHCGYSSIIEALHFGRALIMFPLSLDQGLIARVFEEKKVGVEIKRDEENGWFTKDSVAESLKLVMVKTEGNVYRDKAKEMKKVFGNKELHDRYMGHFVEFLQNHCRNP

SEQ ID NO: 6044 - protein, 469 aa, Pueraria montana
MTRYEVVFIAIPTLGNLVPQVEFANLLTKHDPRFSATILTVSMPQRPLMNTYVQARASSAANIKLLQLPIVDPPAPEQYQTLVGFLSLHMQNHKHHVKHALLNLMKTTESNSSNSVRLAAIFVDMFSTTLIDVAAELAVPCYLFFASPASCLGFTLDLPRFDLAESKSEFTVPCFKNLLPRSVFPNLVLDAKDGTFWLSYHARRYKETKGIVINTLQELETHALQSLHNDSQLQRVYPIGPILDLVGSAQWDPNPAQYKRIMEWLDQQPLSSVVLLCFGSMGSLEANQVEEIAIGLERAGVRFLWALRESPKAQLEYPRDYENHKDVLPDGFLERTNNIGLVCGWVPQAVVLAHKAVGGFVSHCGWNSILESLWHGVPVATWPLYSEQQMNAFQMVRDLGLAVEISVDYRVGADLVRAEEVENGLRSLMKGGDEIRRKVKEMSDTCRGALLENGSSYSNLVSLIQELTS

SEQ ID NO: 6045 - protein, 449 aa, Manihot esculenta
MGHLVSAVETAKLLLSRCHSLSITVLIFNNSVVTSKVHNYVDSQIASSSNRLRFIYLPRDETGISSFSSLIEKQKPHVKESVMKITEFGSSVESPRLVGFIVDMFCTAMIDVANEFGVPSYIFYTSGAAFLNFMLHVQKIHDEENFNPTEFNASDGELQVPGLVNSFPSKAMPTAILSKQWFPPLLENTRRYGEAKGVIINTFFELESHAIESFKDPPIYPVGPILDVRSNGRNTNQEIMQWLDDQPPSSVVFLCFGSNGSFSKDQVKEIACALEDSGHRFLWSLADHRAPGFLESPSDYEDLQEVLPEGFLERTSGIEKVIGWAPQVAVLAHPATGGLVSHSGWNSILESIWFGVPVATWPMYAEQQFNAFQMVIELGLAVEIKMDYRNDSGEIVKCDQIERGIRCLMKHDSDRRKKVKEMSEKSRGALMEGGSSYCWLDNLIKDMIK

SEQ ID NO: 6046 - protein, 470 aa, Nemophila menziesii
MANLKNHKNIKPESFRKEETAIIIVPFPAQGHLNQLLQLSCLISSYGLPVHYVGSETHNRQAKTRSNGLDPVELAKVHFHDLPTPDFHSPSPDPNSLDKFPAQLQPSWNATIFLREPVRDILLDLSSKSKRIVIIHDILTAAVVQDAASIPNAEAYILNCVSVFTLFFIRWESMGKPLLVDAEPPKGLPSVLECMTEDHMKFVASIVGYLNHQVGELHNTSRVLEGIYLDLLAKEEYGGKGKQFAIGPLLPVKKLSLNSQDKCLQWLDKQEPNSVIYVSFGSTTSMSDEEVKELAMGLEESKVKFIWVLRDADKGDIFDKEVRKIPLPEKFEERISEFGIIIRDWAPQPEILAHSSTGGFMSHCGWNSCIESISSGVPIAAWPMHSDQPCNALLITEILKTGLTVREWARREELLNASSIANTLKRLMASQEGEEIRKRAKELGDAVRKSTDEGGVSRLEMDSFIAHITR

SEQ ID NO: 6047 - protein, 496 aa, Ginkgo biloba
MENGNRKELLHHVLMFPWLAHGHISPFLELSMRLAGRGITVSFCSTPSNINSIKRTLQSHDDGETALNSINLVELPLPLVDGLGPSHETTASLPPHLMPLLKKAFDSLETSFGMLLQRLSPDCVIHDFLQPWTSPVASKFGIPSLTFVPCSAVVVAYFLCAVKGKDSEQVTVEDLINPLDFPSSSTVRLHQFEALQTLNMYKRNRETGISDCERLQGCANKCSAIAVKTFPEIEGKFLRLLESLTGKHVVALGPLLTKQPSSNASEQDSKCLAWLDRQKRSSVVFVSFGTEYFLSKDQIEEIALGLEASEQSFMWVLRFPQGPEGNVNDQQRRVSASLSAGFEERMKVKGIVVSGWAPQMKILRHPSTGGFMTHCGWSSVMEGMSAGLPLIALPMQLDQPLNARLVAGDLKVAIEVRKGSDGRLDRNEIERALRIAMVEEEGLQLRMNAKHMGEIMMAKSEEERGLDLLVEEIETLVGKRNNVFRRDSNIISMEAA

SEQ ID NO: 6048 - protein, 289 aa, Cephalotus follicularis
MPKPLLERNDVVYEYILEVSTELTKASAIMVNTFEPLEQRTVKAITDGLCVPGGPTPPVYCIGPLIAEERGDTNGSDAVLDCLTWLKIQPSKSVVFLCFGSLGLFSKEQLHEIAIGLERSGQSFVWVVRNPPLQNQSLATTAPPDPDLASLLPDGFLESTKDRGFVVKSWAPQVTVLSHDSIGGFVTHCGWNSVLEALSEGVPMVAWPIYAEQRYNRWLLVEEMKIALPMNESENGFVSSTEVKKRVRELMDSVDGNLVRERTKNAAKTALSASGSSHIALAKIIESWK

SEQ ID NO: 6049 - protein, 476 aa, Unknown
  Description of Unknown: Oryza sativa Japonica Group sequence
MIPYPAQGHVTPMMKLAKLLHARGFHVTFVNTEFNHRRMLASRGAAALDGGVPGFRFAAIPDGLPPSDADATQDIPALCHSTMTTCLPYVVALLAELNDPTSGVPPVTCVVADAIMSFAYDAARRIGVPCAALCTPSACGFVGYSHYRQLVERGLVPLKDAAQLADGYLDTVVDGARGMCDGVQLRDFPSFIRTTDRGDIMLNFIMREAERLTLPDAVILNTFDDLERPALDAMRAILPPVYTVGPLHLHVRHVVPKGSPLDTAIGSNLWKEQDGRPPRSVVYVNYGSITVMTNEQLLEFAWGLAHSGYPFLWNVRPDLVKGDAAVLSQEFLTAVEGRSMLTTWCPQEQVIEHPAVGVFLTHSGWNSTLESLCAGVPMLSWPFFAEQQTNCRYKRTEWGVGMEIGGEVERSDVAATIREAMEGEKGREMRRRAAEWKEMATRVTLPGGTADINLTRLIDEVLLSGGKKRQALDARD

SEQ ID NO: 6050 - protein, 480 aa, Ricinus communis
MVTESDQLHIFLFPLMASGHTLPFLDLARLFAQRGAKITIITTPANAPRITTIQTTKDSAAQISLKIINFPSKEAGLPEGIESLDMLSDYQLRGKFFAALTLLQEPLEQAIQELNPHAIVADVFFPWATDLAAKYGIPRLIFQISSFFSLCCFANLEEHQPHKNVSSDTELFSLSGFPDQIKFTRSQLPDSFTEENPNAFLRLIISTHEVEKRSYGVIVNSVYELELAYADYYRNTLGRRAWHIGPVSLCNKNFQEKSHRGKKSSIGEDDCMKWLDSKKPNSVLYVSFGTVTKFSDSQLHEIAIGLEASGQDFIWVVRTEGTEKDNEEKWLPDGYEKGMEGKGLIIRGWAPQVLILDHGAIGGFVTHCGWNSTLESICAGLPMVTWPIFADQFFNEKLITDILKIGVGVGVQKSKALVGDYVESEKIEKAVKEIMMGEKTEEFRTRANNFGEIARRAILDGASSYNDLGALIEELRSYQA

SEQ ID NO: 6051 - protein, 498 aa, Oryza sativa
MDDDTAGHASGGYTTTAAAHFVLVPMMAQGHAIPMTDMARLLAEHGAARVSLVVTPVNAARMAGFAAGVEEAGLPVQLVELPFPAAEFGLPDGCENVDMLPSKDLFSNFLLACGALREPFAARLRQQRPPASCIISDMIHSWAGDIARELGVPWLTFNGSCTFSSFARDIIYRKNLLENLTDDEIVKVSGFPTPLELPKARCPGTLCVPGLKQISDKIYEAETRSDGRIMNSFQEMESLYIESFERTIGKKIWTIGPMCLCHRDSNAMAARGNKASMDDAKCLQWLDSKKPGSVIFVSFGSLSSTDPQQLVELGLGLEASKKPFIWVIKAGKKFPEVEEWLADGFEERVKDRGMIIRGWAPQMMILWHQAIGGFMTHCGWNSTLEGISAGVPMITWPHCSEQFVNEKLVVDHLKIGVEVGVKGVTQWGTEQKEVKVTRTAVETAVSMLMDEGEVAQEIRMRAKDFGMKARRALEEGGSSYNNIKLLIQEMGNKQNASG

SEQ ID NO: 6052 - protein, 384 aa, Helianthus annuus
MPEKPDPSFYITYLNEHCADSFRDCLAGLLAEPHEPPVACLITDAEYYVTQEIADSLKVPRVVFWACTIVSVLVYHDLSFFYDKGYFNFTTKDPEYEVPVPKYPLLKVKDVIKTATNPYGMGKYLAKVMKQVKASSGIIWNSFKEPEEAILKILSHDFPIPTFTLGPLLKYLPLSTSGIIFEQDQTFFSWLDTQAPKSVIYVSFGSLAGITKSEFQETAYGLVNMNIPFLWVVRPGMVKGSEWIEWLPEKFLEEVGDRGRIVKWCPQKEVLAHEAIGCFWTHSGWNSTLESICEGVPMICSPCDVGQPIIARYVSDVWKIGILLEDGLEREGIKRELKRLMLDKEGEEIRCRIIALKDEVNISFHEGGSSHRSLQSLVAYIQSF

SEQ ID NO: 6053 - protein, 440 aa, Arabidopsis thaliana
MPWPGRGHINPMLNLCKSLVRRDPNLTVTFVVTEEWLGFIGSDPKPNRIHFATLPNIIPSELVRANDFIAFIDAVLTRLEEPFEQLLDRLNSPPTAIIADTYIIWAVRVGTKRNIPVASFWTTSATILSLFINSDLLASHGHFPIEPSESKLDEIVDYIPGLSPTRLSDLQILHGYSHQVFNIFKKSFGELYKAKYLLFPSAYELEPKAIDFFTSKFDFPVYSTGPLIPLEELSVGNENRELDYFKWLDEQPESSVLYISQGSFLSVSEAQMEEIVVGVREAGVKFFWVARGGELKLKEALEGSLGVVVSWCDQLRVLCHAAIGGFWTHCGYNSTLEGICSGVPLLTFPVFWDQFLNAKMIVEEWRVGMGIERKKQMELLIVSDEIKELVKRFMDGESEEGKEMRRRTCDLSEICRGAVAKGGSSDANIDAFIKDITKIV

SEQ ID NO: 6054 - protein, 491 aa, Arabidopsis thaliana
MASEFRPPLHFVLFPFMAQGHMIPMVDIARLLAQRGVTITIVTTPQNAGRFKNVLSRAIQSGLPINLVQVKFPSQESGSPEGQENLDLLDSLGASLTFFKAFSLLEEPVEKLLKEIQPRPNCIIADMCLPYTNRIAKNLGIPKIIFHGMCCFNLLCTHIMHQNHEFLETIESDKEYFPIPNFPDRVEFTKSQLPMVLVAGDWKDFLDGMTEGDNTSYGVIVNTFEELEPAYVRDYKKVKAGKIWSIGPVSLCNKLGEDQAERGNKADIDQDECIKWLDSKEEGSVLYVCLGSICNLPLSQLKELGLGLEESQRPFIWVIRGWEKYNELLEWISESGYKERIKERGLLITGWSPQMLILTHPAVGGFLTHCGWNSTLEGITSGVPLLTWPLFGDQFCNEKLAVQILKAGVRAGVEESMRWGEEEKIGVLVDKEGVKKAVEELMGDSNDAKERRKRVKELGELAHKAVEEGGSSHSNITFLLQDIMQLEQPKK

SEQ ID NO: 6055 - protein, 491 aa, Citrus unshiu
MKDTIVLYTSPGRGHLNSMVELGKLILTYHPCFSIDIIIPTAPFVTSAGTDDYIASLPPLPSTSSLLRFPAYSDTLRSPADFPALVYELGELNNPNLHETLITIFKRSKPQSLCYRFLLQPRVSRFPQVLLSIPYLLLLHLGGSGLAANLYLPTLHKNTTKSFRELGSTLLNFPGFPPFPARDMALPMHDREGKVYKGLVDTGIQMAKSAGVIVNTFELLEERAIKAMLEGQCTPGETLPPLYCIGPVVGGGNGENRGRDRHECLSWLDSKPSRSVLFLCFGSLGSFSSKQLKEMAIGLERSGVKFLWVVRAPAPDSVENRSSLESLLPEGFLDRTKDRGLVVESWAPQVEVLNHESVGGFVTHCGWNSVLEGVCAGVPMLAWPLYAEQKMIKAVVVEEMKVGLAVTRSEEGDGLVSSAELEQRVSELMDSEKGRAVKERAVAMKEAAAAAMRDGGSSRVALDNLVESFLFRNNNTNPSSNYSSTITSYTY

SEQ ID NO: 6056 - protein, 464 aa, Helianthus annuus
MVRPHVLLLPAPAQGHVIPATELGQRLVKQGAKVTVINTEATHMVITKNWLENEGCEDLMQMVSIPDGLEPWEDRNELGKLMESMEKSMPTKLEQLIETINKQDDNKVTCLIVDFWLAWALQVVKKMEIGRVIFCPASTATLATMLSIPKLIDDGVINNKGIPQNSEMIRLTEAMPPLKPEQLLWLGFIDSTSNEVHFQDHVRLIESTKITEWFICNSSVELEPAAFSLFPELLPVGPLLASNRLADQAGHFWAEDSTCLAWLDQQPACSVLYIAFGSFTTFNQTQFEELALGLELTNRPFLWVVRSGQTKETAITFPGGYTDRVGSRGKIVSWAPQQKVLAHPSVACFMTHCGWNSTLEGVTNGLPFLCWPYFGDQPYNETYICDVWKTGLRLKEDKAGMITQEGIKSKVEQLLSDKTFKSKAVDLKEKVASSVAEGGSSHTNLARLNDWIHGKDAHTDLNVN

SEQ ID NO: 6057 - protein, 466 aa, Vigna angularis
MEELHVLLVAFSAQGHINPLLRLGKTLLTRGLHVTLATTELVYHRVFKSSTADAATVPTSITINGIQVIFFADGFGTGQVKATLDSYMELIGKFGPINLSNLIETHFLNASKKLACIINNPFVPWVADVAANYNIPCACLWIQPCALYAIYYRFYNNLNDFPTLENPSMSVKLPGLPLLQPQDLPSFVLPSNPFGSIPKVLSEMLQHTKKLKWVLANSFHELEKDVIDSMAELCPITAVGPLVPPSLLDQDENEDVGIEMWKPQDSCMEWLNHQPPSSVIYVSFGSLIVFTAQQLESIAKALKNSKKAFLWVIKNKEGEEAVPLPEGFVEESKEQGMVVPWCPQTKVLSHPAIACFLTHCGWNSMLEAITTGTTMIAWPQWTDQPTNAKLISDVFRLGVRLTPGNDGFVATEEVERAIEQVFEAEEFKRNASELKRAAREAVAHGGSSDRNIQSFVDEIIGRKLDT

SEQ ID NO: 6058 - protein, 477 aa, Trifolium pratense
MKKAQLVFIPFPGLSHLVSTLELAKLLINRDNRLRITVLLIEFSRSKETDAYIQSLPISDSLNFIDLPECFVPPNTNPRAVFDALLEAQKPNVRQAVSDLINGEQHGPLAAFVVDMFCTTMIDVAKEFSVPTLIFFTSSIACLGLNLHIHTLREHDNVDPTQLLQQTKLAIPTFANLVPSYSLPSSVISKEWESLFMKYTGGLKKADGIIVNSFEELESYAVHSFSSHPGLAGLPIIYPVGPILTPEPKSKNVVESDDIIKWLDDQPPSSVVFFCFGTSGSFDEDQVKEIAYAIENSGARFVWSLRKPQPKGVMAAPSEYSRSDLSLVLPEGFLDRTTGIGRVIGWAPQTQILAHPATGGFVSHCGWNSTLESIYFGVPIATWPIYAEQQTNAFELVVELKLAVEIALDYKVEFNGGPNYLLTADKIERGIRSVLDKDGEVRKKVKQMSEKSRKTLEESGSSYAYLGLLVDYIMNQI

SEQ ID NO: 6059 - protein, 376 aa, Helianthus annuus
MTDHRKNKIMIVAYPNQGHINPSLRFAKSLVKMGVDVTFSTSVSVIRRIDMQTTHHSLTFAPFSDGHDDGQKSTTTFQQHYSDFATNGVYAVKEIISSAAATGQPFDDLVYTSAVPWAAKVAHAHNLKSTLLWCQPASVLDIYYYYFNGYEELISCNNNNPTFPINLPGLPSLTIADLPSFMWSSCPKEHKFIMDFMKDHVDVLKIFPRILVNTIDELEIDPIRAIEKVVMLPVGPLVPSELFEGSGPSNSPFSCDLFEKPIEDYIKWLNTKPKSSVVYVSFGSMATLSIEQVEEMASGLVESGRPFLWVIRDSGQVGKLSKIEELKKQGMIVSWCSQVEVLNHQAIGCFLMHGGWNSTMEALATGVPTVVYSQWC

SEQ ID NO: 6060 - protein, 352 aa, Cephalotus follicularis
PLCAIIDFLIGWTKGVFWKFNIPVIGLFTIGVCTAAMEWGAWKVNAGDLKPGETLPVPELPEEMSLTHSDMLRKSFGQPRGSSGPKQGGGGPPKLGDHPPWVPKIQGSIGLMFNACDYIDRTFIEYMANQMGMPAWGMGPLLPQQYWNSSGSLIHNRERQSNFTEDEITQWLDSKRKPRKSVSYVAFGSEVGPTMEEHPQLAGALEELDRPFVWVIQPESGGLDKKVDRGLIICGWVPQLLILSHKSMGGFLSHCGWNSTMEAIGRGIPFLAWPVRGDQYFNAKLVVSYHKVGYRVAHDLSLLITKDDILKGVERLMGDIQMKRRVVALSAQFEHGFPATSVTALDAFEDFI

SEQ ID NO: 6061 - protein, 482 aa, Oryza brachyantha
MPIKTEEAAASPARHAGGGDDDGRGRRRVLVFPLPFQGHVTPMLQLADALRSRGGFAVTVFLAPVPSSSSLLHRPAGYRFVTVGAGVAGAAAALIPSGTGGDFAGALMRLDALLRAPFEDCLRQELAADEDAAAGPVGGSNLRGMQEVAERLGVATLALRTRGACCLVAYMAFPELCGKGILPPPTSARRDQHQMDMQLDELPPLRLRDMMFSATTTHATMATCLERLLDSSRCSSGVILNTFNDLENSDLQKIANGLNVPVYAVGPLHKISIGEHNSLLTQDLSCLEWLDKQEAESVIYVSFGSLASMDPEEILETAWGLVDSQMPFLWVIRPNMVQGSLQVGLPDGFEEATRGSGMVVSWAPQQDVLKHQAVGGFWTHNGWNSTLESICDGVPMICRPQFADQMINARYVEEVWKIGFELEGKLERGMIERALRKLMCSEGGNEMRQRAKDLKKKATTCVEKGGSSKTAIDMLVNRIMSF

SEQ ID NO: 6062 - protein, 396 aa, Medicago truncatula
MGNFANRKSHAVFIPYPAQGHINPLFKLAKLIHLRGSHVTYVNTEYNHKRLLKSRGPTALDGFTDFSFETIPDGLTPLEGDGDVSQLPSLCQSIRKNFLKPFCELINRLNHSANVPPVTCLISDCCMSFTMQAAEEFSLPILLYFSSSACSLLNVMHFRSFVERGITPFKDERHLTNGYLETKVEWIPGSNLWKEDTECLEWLESNEPGSVVYVNFGSIIVMTPDQLLEFAWGLADCKKPFLWITRPDLVIGGSVVLSSEFMKEISDRGLISNWCPQEKVLNHPSIGGFLTHCGWNSTTESICAGVPMLCWPFFADQPTNCRFICNEWKIGMEIDTNVKREGLEKLINELMVGENGKKMRQKAMELKKKAEENTRPGGCSYMNLDKVIKEVLLKQN

SEQ ID NO: 6063 - protein, 475 aa, Medicago truncatula
METQPKEKSSPHVLIFPCPAQGHVNSMLKLAELLAIQNIYITFLNTKYIHNRLIQFNDDIQALLECYPKLQFKTISDFHSEEKHPGFGERIGDVITSLSLYGKPLLKDIIVSEKISCIILDGIFGDLATDLAAEFGIQLIHFRTISSCCFWAYFCVPKLLECNELPIRGDEDMDRIITNIPGMENILRCRDLPSFCRENKKDHIRLDDVALRTKQSLKANAFILNTFEDLEASVLSQIRIHFPKLYTIGPLHHLLNTTKKSSFPSSFFSKSNFFKVDRTCMAWLDSQPLKSVIYVSFGSTTPMKREEIIEIWHGLLNSKKQFLWVIRPNMVQEKGLLSELEEGTRKEKGLIVGWVPQEEVLSHKAIGAFLTHNGWNSTLESVVCGVPMICWPYFADQQINSRFVSDVWKLGLDMKDVCDRKVVENMVNDVMVNRKEEFVRSAMDIAKLASKSVSPGGSSYNNFQDLIQYIRSTSP

SEQ ID NO: 6064 - protein, 520 aa, Onthophagus taurus
MKTLTTITIVSIYFSVLLSASESAKILSLFPAPSYSHVIIGETLSEELARRGHQVTLITAYEPKKTIKNLNDIKLNGFKEQFDEEMKDFNFFDYLNINEFISTLTTYSFGYTMTKNFYEHERIQKIMKFNEKFDLIIVEHFFNEAVYGLCYHLKVPCVAVSAVATMIWSNRLTGNVGLASYVPQMTTTYSPKMTFFQRMHNLALYVYEEIVYHTFYIPKHNAIVQEHIPNAPHIYNLITNVSLLLVNSHPALGSPQIITPNVKEVGGIHVEGLKNVTLPDDIQKFLDNNKEVIYFALGSNAQSKDIPKETLNEIINGLKKWGKPVLWKFEDELPEKLDNVKIAKWFPQTAVLAHKNVVGFITHCGRLSSLESLYYGVPMIAIPLFAEQAHNAAEMVHYGFAVPVEFKTLKAEKLYKALVEITSNTKYTKEAQMRSKAIRKRNGMDEAVYWIEHVLEFKGASYLKNAGVDLPWYQFWMVDVVAVLIVSFLGINAFGAYLILKSLSHWGQYNSSQSRVIDIC

SEQ ID NO: 6065 - protein, 474 aa, Arabidopsis lyrata
MAPPHFLLVTFPAQGHVNPSLRFARRLIKTTGTRVTFVACVSVFHNSMIPNHNNVDNLSFLTFSDGFDDGGISTYEDRQKRTANLKVNGDKALSEFIEASRNGDSPVTCVIYTILLNWAPKVARRFQLPSALLWIQPALVFDIYYNHFMGNNSVFKLTNLSSLEIRDLPSFLTPSNTNKAAYDSFQEMMEFLIEETNPKILINTFDSLEPEALTAFPNIDMVAVGPLLPTEIFSGSAKSVEDQSSSYTLWLDSKTESSVIYVSFGTMVELSKKQIEELARALIEGKRPFLWVITDKSNRETKTEGEEETEIEKIAGFRHELEEVGMMVSWCSQIDVLSHRAVGCFVTHCGWSSTLESLVLGVPVVAFPMWSDQPTNAKLLEESWKTGVRVRENEEGLVERGEIRRCLEAVMEDKSVELRESAKKWKRLAIEAGGEGGSLDKNMEAFVEEICGDSHVQRLCEAEDVKVNDKRVGV

SEQ ID NO: 6066 - protein, 480 aa, Unknown
  Description of Unknown: Oryza sativa Japonica Group sequence
MAPAHAVTPHVVLLPSPGAGHVAPAAQLAARLATHHGCTATIVTYTNLSTARNSSALASLPTGVTATALPEVSLDDLPADARIETRIFAVVRRTLPHLRELLLSFLGSSSPAGVTTLLTDMLCPAALAVAAELGIPRYVFFTSNLLCLTTLLYTPELATTTACECRDLPEPVVLPGCVPLHGADLIDPVQNRANPVYQLMVELGLDYLLADGFLINTFDAMEHDTLVAFKELSDKGVYPPAYAVGPLVRSPTSEAANDVCIRWLDEQPDGSVLYVCLGSGGTLSVAQTAELAAGLEASGQRFLWVVRFPSDKDVSASYFGTNDRGDNDDPMSYLPEGFVERTKGAGLAVPLWAPQVEVLNHRAVGGFLSHCGWNSTLEAASAGVPTLAWPLFAEQKMNAVMLSSERVGLAALRVRPDDDRGVVTREEVASAVRELMAGKKGAAAWKKARELRAAAAVASAPGGPQHQALAGMVGEWKGRG

SEQ ID NO: 6067 - protein, 466 aa, Medicago truncatula
METPHVLIFPCPAQGHVNTMLKLAELLLIQNLHITFLNTEYIHNRLISLNIDDVKSISQCYPKLQFKTISDFQNKEKHPGFGENIVDVISSINMYGKPSLRDIIVSEKISCIILDGGFGDLATDLAAEFGIQLIHFRTVAASTVWIYFCMPKLLDCNEIPIRGDEDMDRIIRNVPGMENIIRCRDLPRFGTSNKMDHIILDKVLQLTQASLKGNAVILNTFEDLESPILSQIRLHFPKLYTIGPLHHHLNTMKKTTSSSFNSNFFKVDRTCMTWLESQPLKSVVYVSFGSTTTMTREEILEFWHGLLNSKKAFLWVIRPNMVQEKRLIKELEEGTSKEKGLIVEWAPQEEVLSHKAIGAFLTHSGWNSTLESVVCGVPMICWPYFSDQPLNSRFVSEVWKLGLDMKDVCDRNVVENMVNDIMVNKKEEFSKSATKMADLASKSVNPDGSSYNNLQDLIQYIRSTSP

SEQ ID NO: 6068 - protein, 469 aa, Zea mays
MAEGDGPTPARGARVVLFPLPSQGHLSPMLHLASALHARGLAVTVLHTAYNAPDPAHHPGLAFVAVPDVIPEAVAATTNGIAKILALNAAMEASGHVRGALASLLAEEAGGQRLACLIFDSTLFAAQKAAAGLGLPTLVLHTGSAAGFRLFRSDTYDMLHDRGYLPATESNLHMPVKELPPLQVRDLFDPSKLPNKEIVQKILDRATESTTNSSGAILNTFEDLESRELEMIRDELADRGIPPFAVGPLHKLTAAPSNDGADETSLLSQDRVCMEWLDARGPGSVLYVSFGSVVHVTPDEFVEIAWGLANSGAPFLLVVRRGLVLGVDKQELPDGFMAAVEGRGKVIEWAPQQEVLAHPAVGGFWTHNGWNSTLESIYEGVPMLSRPIFGDQLPTARYVCDVWRIGVLLEGVLERREVEKAIKKLMEEDEGVGIRGRAKDLKEKVRMCLESSGSSQLAVDQLVDHILSF

SEQ ID NO: 6069 - protein, 480 aa, Medicago truncatula
MGSLDITKNLSHVVCIPFPAQGHINPMLKLAKLLHFKGGFHVTFVNTEYNHKRLLKARGPNSLNGLPSFRFETIPDGLPESDVDVTQDIPSLCESTRATCSPHFKKLLSKLNNAIDTPPVTCIVSDGCMSFTLDAAQELNIPEVLFWTTSACGFMCYMQYRKLIEEGLTPLKDSSYITNGYLETTIDWVPGIKEIRLKDIPSFIRTTNPNDIMLDFLRGECQRAQKASAIIFNTFDNLEHDVLEAFSSILPPVYSIGPLHLLIKDVTNKELDSIGSNLWKEEPECLEWLNSKEPNSVVYVNFGSITVMTSEQMIEFAWGLSNSKMPFLWVIRPDLVAGENAVLPLEFLEETKNRGLLSSWCPQEEVLGHSSIGGFLTHNGWNSTLESVCGGVPMICWPFFAEQQTNCRFCCNEWGIGLEIEDAKRDKIEILVKELMEGEKGKEMKEKALQWKKLAHNAASGPHGSSFMNLENLIHDVLLK

SEQ ID NO: 6070 - protein, 236 aa, Rhodamnia argentea
MLKLKTTFDLAGPNLSDIIVDCQPNSLIFDYLLSWAPEVARSHDMPAINFTGVAAASSSYLLHSIKRSGHEYPFKRRKEEIVYELEPSNVDFIWVVKFPVEDHIKLEEALPKEFLERVRDRGLLIDGWAPQARIPTHPSVGGFGSHCGWSLIMEGMKFEVPIIAMSMDLDHPLNVRLVEGVRVGSEVLRNESGELEREDVAKVIKGAVVEEGGKCVRNKVKEVSAATRYKGDGRGK

SEQ ID NO: 6071 - protein, 462 aa, Ricinus communis
MSSCSHQKLAHIVLLPSAGMGHLTPFLRLAALLAIHNVKVTLITPNPTVSLSESQALIHFFTSFPHINQKQLHLLSIERFPTSSEDPFYDHMERICQSSHLLLPLLSSLSPPLSAVITDMTLAFAVIPITQALNLPNYVLFTSSAKMLALYLSFHAMIGSEPTIDLGDTDGIKIPSLEPIPRSWIPPPLLQDTNNLLKTYFIKNGKKMAESSGILVNTFDSIEHEVLEQLNAGKVIENLPPVIAIGSLASCESETKQALAWLDSQQNGSVLFVSFGSRTAISRAQLTELGEGLVRSGIRFLWIVKDKKVDKEDEEDLSQVIGNRLIERLKERGLVVKSWLNQEDVLRHSAIGGFLSHCGWNSVTEAVQHGIPILAWPQHGDQKINADIVERIVLGTWEKSWGWGGEVVVKGNDIAEMIKEMMGNDLLRAHAVQIREEARRAIADTGNSTKGLMGLIETWKKI

SEQ ID NO: 6072 - protein, 471 aa, Ricinus communis
MREETEYKGHVVVLPYPGQGHINPLLQFAKRLASKGVKITFATTHYTVNSICAPNVTVHAISDGFDEGGFAQAQEVDLYLKSFKANGSRTLSHLIQKFQDSNFPVNCIVYDSFLPWALDVARQHGIFGAPFFTNSAAVSSIFCRLHHGFLSLPLDVEGDKPLLLPGLPPLYYSDLPTFLKIPESYPAYLAMKLNQFSNLDMADWIFANTFEELESKVVGGVSKLWPAKLIGPMVPSSYLDGRIDGDKGYGASLWKPLGEECLKWLETKQPQSVVYISFGSMVSLTVKQMEEIAWGLKESNLNFLWVVRESEMDKLPKGFIDSTSDKGLIVRWCNQLEMLAHQAIGCFVSHCGWNSTLEALSLGVSMVAIPQWADQLPNAKFIEEIWKVGVRGKVDERGVVRKQEVIRCLKEVMEGKKSEEIKKHARKWRQVAERTFDEGGSSDKNINDFVEHLAFANKKEEAKAKALSGFH

SEQ ID NO: 6073 - protein, 326 aa, Unknown
  Description of Unknown: Oryza sativa Japonica Group sequence
MSAFATYVAGAVTAHKPHARVGSPSEPFEVDGLPGLRLTRADLNPPIDEPEPTGPLWDLACETKASMDSSEGIIVNSFVELEPLCFDGWSRMSPVKLWPVGPLCLASELGRNMDRDVSDWLDSRLAMDRPVLYVAFGSQADLSRTQLEEIALGLDQSGLDFLWVVRSKWFDSEDHFENRFGDKGKVYQGFIDQVGVLSHKSIKGFFSHCGWNSVLESISMGVPILAFPMAAEQKLNAKFVVDMLRVGLRVWPQKREDDMENGLVAREEVQVMARELIFGEEGKWASTRVSELAVLSKKAMEIGGSSYKKLEEMVHEISELTRDKSM

SEQ ID NO: 6074 - protein, 219 aa, Medicago truncatula
MECLTWLDKQQPCSVLYVSFGSGGALSQEQTDELAIGLELSNHKFLWVVRAPSSSACGAYLSAQNDVDLSQVLPSGFLERTKEQGMVIPSWAPQIEILSHISVGGFLSHCGWSSILESAMHGVPLITWPLFAEQRMNAFVLSEGLKVGVRPRVNENGIVERIEVSKVIKCLMEGEECEKLRNNMKELKEAATNALQEDGSSRKTVSQLAHKWKNLVHEN

SEQ ID NO: 6075 - protein, 480 aa, Barbarea vulgaris
MIELVFIPSPGIGHLKPTVKLAKQLIDNDDRLSITVIIIPPRNGAGDVAAYIASLSTTSHDNRLRYEPITVPAQPSSASIEPSQLYIEKQKPQVREAVTRRIVDSTTRRTRLAGFVVDMFCSSMIDVANEFNVPTYMVYTSNATFLGITLHVQLMYDEKKYDVSELDLDDDSVNELEFPCVTRPYPVKCLPHVLTSKEWSPFFLAQARYFRKMKGILVNTVAELEPQALKMFENSDDDHHLPQAFPIGPVLDIENGDEKESEILRWLDEQPPKSVLFLCFGSMGGFTEEQTREIAVALDRSGHRFLWSLRRASPNILMEPPRDYTNLDEVLPEGFLDRTSDRGKVIGWAPQVAVLAKPAIGGFVTHGGWNSILESLWFGVPMVPWPLYAEQKVNAFEIVEELGLAVELRRYFKGDLLAGEMDTVTAEDIEKAIKDVMEEDSDVRNRVNEMKEKCHVALMDGGSSKTALLKFIQDVIERMS

SEQ ID NO: 6076 - protein, 477 aa, Crocus sativus
MEKPHAICMPFPAQGHINAMLKVAKLLHFRGFHVTFVHTEYNSARIGSSNEMSPLLAADGFRFESIPDSLLPSINPTTKQDLPSLVLAVCNEFLSPFRDLMKRLNDPSGVPPVTCVSDCITGFTLEIAKEFGIPDLFLSSFSASGFMALFHLKELMEKGLVPIKSEDDLTNGYLDTPIDWMPGMKNMRIKDLPSFVRSTDPNDIFFNFSKDEIQSAFRADAIIINTFDDLEEPILDAMSSSLLPPIYCLGPLTQAMLAVDDNQLESINGNMWEEHTNCLAWLDQKSPGSVIYVNFGSITVMTSQHLVEFAWGLVKSGYEFLWIIRPDVVIGESSVLPKELLDETMKRGLVTSWCPQVDVLEHASIGGFLTHCGWNSTMEALSAGVPMICWPFFADQQTNCRYVCANWGVGTEIDVRVKREEVGERIREMMGGGKKGEEMRKMASKWKESASRTISPGGKSLENFEKVVKLLMKEKDG

SEQ ID NO: 6077 - protein, 450 aa, Medicago truncatula
MNFSGDDMCHVVAMPFPGRGHINPMLSLCKFLISRKPNNILITFVVTEEWLTFINADPKPEAIRFTTIPNVVPPEREKTLDSFHRFYEAAMTKMEAPFERLLDQLELPVNVIIGDIELRWPVDVGSRRNIPVAPLWTMSASFYSMLHHLEVFSRHQHLTHDKLENVPGISSLHIEDLRSVVRGNHPRAMQLSLECISKVTKANYLLLTTVQELEAETIDTLKSIFPFPIYPIGPAVPYLDLEGKKTKNTDHTHDYIKWLDSQPTESVLYFSFGSFHSASNAQTDEIIEALNNSDIRYLFVARGETSRLKDKCGDKGMVIPWCDQLKVLSHSSIGGFWSHCGWNSTLDTVFSGVPILTFPLAYDQFPNSTQIVDEWKNGWKVEKSSKLESDVVFAKEDMEELVKRFMDLESQEGKKIRDRARELKIMCRKAIGKGGSSDRNLDAFISDIFS

SEQ ID NO: 6078 - protein, 472 aa, Medicago truncatula
MERKTHIAVVSVPIVSHQIAISEFIKKLLNLHPNKFHITLIIPVLDSLSNASKSIIASLSSLNVDTIVLPPINLPPQTVPTLKLPLSMSLTMPYIIDALKTKTSKLVAIIADYFAYEVFSFAKKLNILSYTYFPSSATVLSLCFHSKVLDETISGEFKDLQEPIKIPGCVPIQGTDLPSSFQDRNSESYNHFLLRSKGINLCDGILVNSFVELESQAVKALIEESINVSHPPVYMVGPIIQQNCDNTQNESQCLSWLDEQKPNSVVFVSFGSGGTISQNQMNELALGLELSSQKFLWVVREPNDIASAIYFDVSNSKKDPLSFLPKGFLERTNKQGFLVSNWAPQVEILSHKAIGGFVTHCGWFSTLECVVNGVPIVAWPLFAEQRMNATILADGIKIAIRPTIDNVSGVVEKVEIVNVLKRLIVDEGIEIRRRMKVLKDAAANAMKVDGSSIITMSQLVTKWTKMEGFDEN

SEQ ID NO: 6079 - protein, 478 aa, Cephalotus follicularis
MTKTELIFIPAPGAGHLVSTLEFSKRLIERDDRISITVLVVKFPIATFLDVYTKSLCASQPRIQLIDVPPVDPPPPTLMQKSIELYVCSFIESCIPNVKNVVKNIVASSDSSSGSVQVAGLVLDFFCVSMIDVANEFGLPSYMFLTSNAGFLDLMLYLPTRHNQICSEFEETDPEILMPGFANPVPPRVLPDALFNKEGGYSSYVKLAQRFKDVKGIIVNTFVELESYTVDSFSHAQIPPVYPIGPVLELKGQPHLDKNQAEYDRIMKWLDDQPQSSVVFLCFGSLGSFEVPQVREIALGLEQSGYRFLWSMRVPPTKPEASLTSHSTNYEDMLPEGFLKRMKGRGMTCGWAPQVEVLAHKSIGGFISHCGWNSILESLWHGVPIVTWPLYAEQQLNAFKMVKELGLAVELRLDYRSKDGQLVMGDDIERAVRCLMDGDEELRKKVTDMSKMGRKALLDGGSSFISIGQLIEDMIGRS

SEQ ID NO: 6080 - protein, 477 aa, Vigna radiata
MAEEEGEAGGHHVLLLPGPMQGNVNSMMKLAQLLALHHFHITFLTTDFIHRRLYRFADIHSLSQTYPNLEFKTISDGLPDDHPRSGNNALADLYSSMNSFAKPLLRDIILSQTAAKSKITCLIGDGFLGGLTADVADEVGIPLIHFRAISASCFWALFCAPNLFESNELPIRGEEDMDRIISNLPGMENILRCRDLPSFYRGTETNLVDPLKSTVFDCHQTLRARGVILNTFEDLDGPLLSQMRLKFLRVFAVGPLHAHAKTTPSTSSFWEEDRSCLTWLDSQPLKSVLYVSFGSIATVTRERLMEFWYGLVNSKKRFLWVIRPDMVAGEDNDERVAAELEEGTKERGFIVGWAPQEEVLAHKAIGGFLTHSGWNSTLESLVAGVPMICWPCFADQQINSRFVSEVWKVGLDMKDLCDRDVVEKMVNDLMVHRREEFLKSAQAMATLAHKSVSPGGSSYSSLHDLVEFIKSASRKIN

SEQ ID NO: 6081 - protein, 477 aa, Gardenia jasminoides
MEKFKLMMMVSPLMGHLTQALELAKLMLARNDQLSITALIMELPIDPDGTAKIQSLIAATNVEGLHFHHLSTPEDTSDWNITHRGLFVLKLLEYQKPRVREIASKTQKLSGFFIDLVTTTMIDVADELGVPTYLFCTSGAAFLGLMLHFQTLEDEQNQDITELVKKESHLTLPSFVKPVPVSVLPTIATKKEFWSNVFLKCTRDYRRAKGIMVNTFTELESTAISSFSLDSYYGKSRLPPIYPVGPILNRSQIQNQSSEDYSALMKWLDCQPENSVVFLCFGSLGSFHLDQVQEIAYGIERIGHRFLWVLRQPPAEKGGFPREYENLELVLPEGFLDRTASIGKVVGWVPQLAVLSHSAVGGFVSHCGWNSTLESIFCGVPIATWPIQAEQHLNAFQLVKELGIAVDIGLDYNKERENQALVRAEQVEKGIREIMDGENEVRMRIKEFTEKSRVAAEEGGSSYLALENIIQDICSRS

SEQ ID NO: 6082 - protein, 485 aa, Helianthus annuus
MATTTVELIFIPLPVIGHMKSTIEIAKLLKNRDQRLSITVLIMQPPSGLRTGSAIATYIESLADKSTQRMRYITLPQPETLPTRDPKAPMTFVNDYINTHCKHVTNVVTEIISQSGSDKLSGFVVDMLCPGMIDVANGFNVPTYVFVTSSAAYLGFELYIQTLCDDQNQDVVELTNSDGVVKVPGFVNPVPTKVFPSGYDTKEGVDYVLLISRKLREAKAIMVNTFLEFETHAIESLTSDKSVPGVYPVGPVLNPVGGDNENSDSDVIKWLDSQPRSSVVFFCFGSLGCFNEVQVKEIAYALERSGHRFLWSLRQPPSPEQASRHSGDYEDPGVVLPEGFLDRIGESGKGKVIGWAPQMAVLAHSAVGGFVSHCGWNSVLESMWFGVPMAAWPIYAEQQMNAFEMVVELGLGVEIKLDYKKDMYNPKNDIVTTEEIESGIRRLMDDDEMREKMKDMGNMSRLTVRKGGSSYASVGLLIQDFIGNA

SEQ ID NO: 6083 - protein, 509 aa, Unknown
  Description of Unknown: Oryza sativa Japonica Group sequence
VDSRRCFFAGGEMGSLPAAAEARPHAVMVPYPAQGHVTPMLTLAKLLYSRGFHVTFVNNEFNHRRLLRARGARALDGAPGFRFAAMDDGLPPSDADATQDVPALCHSVRTTWLPRFMSLLAKLDDEAAAAAAADGAARRVTCVVADSNMAFGIHAARELGLRCATLWTASACGFMGYYHYKHLLDRGLFPLKSEADLSNGHLDTTVDWIPGMTGDLRLRDLPSFVRSTDRDDIMFNFFVHVTASMSLAEAVIINTFDELDAPSSPLMGAMAALLPPIYTVGPLHLAARSNVPADSPVAGVGSNLWKEQGEALRWLDGRPPRSVVYVNFGSITVMSAEHLAEFAWGLAGSGYAFLWNLRPDLVKGDGGAAPALPPEFAAATRERSMLTTWCPQAEVLEHEAVGVFLTHSGWNSTLESIAGGVPMVCWPFFAEQQTNCRYKRTEWGIGAEIPDDVRRGEVEALIREAMDGEKGREMRRRVAELRESAVAAAKPGGRSVHNIDRLIDEVLMA

SEQ ID NO: 6084 - protein, 478 aa, Unknown
  Description of Unknown: Oryza sativa Japonica Group sequence
MQPRAASEMSQESAAAAATGMAPAPAKAQPHVLLVSSPFQSHVNPLLRLGRRLAGKGLSVTFTTALRDGIRVFDDGDGGGGGVRVERLRGGGMWEPDDPRLRIPGDMARHVEAAGPAALEELIRREAEAGRPVACVVANAFVSWAVRVAGDVGLPCAILWIQSCAVLSVYYHYVYSLAAFPSGDEADSSGAVTIPGLPELDMDELRPLRIYTSDQEMWRQMLVGDLGSMTEKAPWVFVNTFDELEHEAVAGLRKHIPLIPVGPLVEPDDGGVDDDDVHGCTAWLDAQPRRSVVFVAFGSLVDIGHDEVVEIAEGLASTGRPFLWVLRDGNRALLPKDALIDACGGDRGKVVPWCEQRRVLAHAAVGCFVTHCGWNSTAEALAAGVPMVASPRWSDQRINTRFVVDVYRVGVRAPATPLTREALRLSVEEVTAGPEAEAMAARAAILGENARAAVGGGGSSDRGVQAFVDRITSGGAEP

SEQ ID NO: 6085 - protein, 256 aa, Cephalotus follicularis
MDLEPGAIKALQEEPGCPPIYPVGPLVRTDSSDTVGDGSHCIRWLVDQPRGSVLFVSFGSGGTLSRDQQIELALGLEMSGQRFLWVVRSPNDESAKAAYFSVSSQNDPLNYLPDGFLERTKGRGLVVPSWAPQAQILSHDSTSGFLTHCGWNSTLESIVNGVPLIAWPLFAEQKMNAVMLTEDIKVALSPKFDENGLVVREEIAKVVNILMEGEEGKQIGIRMQHLKEATVKALKQEGSSAKALSELALNWKNLTV

SEQ ID NO: 6086 - protein, 522 aa, Spodoptera exigua
MEKFKCLLFFVVVSLCSCDAYKILAVFPMPSPTHGILGDNMVKHLLNAGHEVTYITPFASKQKSNPKLHIVDVTDHHNFFNTDLLDITQILAGSMNFKDPNFVFSMMMNIAAMTLEHRDVQKLMKDPQQKFDVIIGEYMFADLYSTFPAVFQCPYIWFSTIEPHWMIVNLVHGPMNPAYNGDYMHANIPPFSFMQRVQELWILLTGLYRHNNEYYKREEEVYQKHIVPILKEQGKPVPDYKVLKYNASLLLGNSQVAIGNAVPLPPSYKHIGGYHIEDEVKPLPEDLKKIMDNAKNGVIYFSLGSNLKSKNLPDELKKGLLEVFGGLKQTVLWKFEENLPNQPKNVHIVQWAPQQSLLAHPNLALFVTHGGLLSLTEAVHFGVPVIAIPVFADQFLNANQAQHKGIGEKVDLTYNLHKDLKIALDKVLADLPRYTARMKELSTAYHDSPMKPKEALNFWVEHVVRTRGAPHLRSVALQVPLYQQAYLDLLVVLLAAAVAILLLVKKILCYFKSQKSIKQKEN

SEQ ID NO: 6087 - protein, 458 aa, Panicum hallii
MAGREQHGDGVRRRRVVLFSLPFQGHLNPMLKLAALLRARGLGVTVLHTGFNAPDPARHPEVDFVPIHETLPDEATSPDSDILRKLLALNAACEAPFRAALASLLRGGGGGHRQDVACAVVDGQCYAAMGAAAQLGVPALALRTDSAAAFRNMLACPRLRDACYIPIKEEQLDEPVPDLEPLRVRDLIRVDGCDTDELCGFVASVADGVRASVSGIVINTFEAIEASELAKIQRELSLPAFAVGPLHLLFQTPPAEQSLHEPDHGCLAWLDAHPPRSVLYVSLGSLACVDHGVFEEMAWGLAGSGVPFLWVVRPGSVSGAGDEAPPLPDGFEEEIRGRGKIVKWARQREVLAHEAICAFWTHCGWNSTLESICEGVPMLVQPCFADQMVTARYVTHEWGVGLEVGEVLERGTVAKAVTEVMAGEDGAQMRERAHRLQMQASAATSSAMDSLIRFILSL

SEQ ID NO: 6088 - protein, 491 aa, Unknown
  Description of Unknown: Oryza sativa Japonica Group sequence
MGSIAADGDKPHAVCMPFPAQGHVTPMLKLAKILHHRGFHITFVNTEFNHRRLLRSRGAAALDGLPGFRFAAIPDGLPPSDADATQDVPPLCRSTRETCLPHFSRLLADLNANASPESPPVTCVVADDVMSFAVDAAREFRVPCALFWTASVCGYMGYRYYRSFLDKGIFPLKEEQLTNGFLDAPVDWTPGMSKHLRLKDFPSFFRATDPDEYMFHFALHVTERLAEADAAVLNTFDELEPEALDAMRAMLPPSVSIHTIGPLGFLAEQVVPKGSPLDALGSNLWKEDDSCFGWLDGKPPRSVVFVNYGSVTVMTNEELVEFAWGLANSGHDFLWIVRPDLIHGDAAVLPPEFMESVGGRGLLASWCPQEAVLRHEAVGVFLTHSGWNSTVESLCGGVPMLCWPFFAEQQTNRRYSCTEWGVAMEIDDDVRRDAVEAKIREAMGGDKGREMRRRAGEWKETGLRATRPGGRAHASLDALVADVLLSGGKAR

SEQ ID NO: 6089 - protein, 635 aa, Trifolium pratense
IHFVLLISRQGKVRLTKWYSPYTQKERSKVIRELSGVILSRAPKLCNFVEWRGHKVVYKRYASLYFCMCIDDTDNELEVLEMIHHFVEILDRYFGSVCELDLIFNFHKAYYILDELLIAGELQESSKKTVARLIAAQDSLVETAKEEASSLSNIIAQATKMTKVEVVFIPSPGLGHLTSTLEFAKLLINRDNRLSITVLVIKFPNTGGETIKTISSSFDSENLHVINLPDCAHVSSTSDVGNSVNTLIETQKSNVKEVVSNITAKGKLAVFVVDMFCTTMIDVANEFGVPSLVYFTSSVAFLGLILHLHTLLEDNSEALRLSLKQDELDIPCFANPVPTNTLPTLVLRKEWESSFFNYGGGLKKANGIIVNSFHELEPHAINSFLEDPGLRGLPVYPVGPVLNLETKPKETVDSDNIIKWLDDQPPSSVVFICFGSVGAFDKDQVREIACAIEKCGTRFLWSLRKPPPNGTMGPASDYPLSDLAAVLPEGFLDRTAEIGKVIGWAPQVQVLAHPATGGFVSHCGWNSTLESIHYGVPIATWPLFADQQTNALELVSELKMGVEIALDYRMEYDVGRDYLLTADKIEKGIRNVLDKNGEVRKKVKDISEQSRKTSLEGGSSYTCLGRLIDYIVNQV

SEQ ID NO: 6090 - protein, 478 aa, Sinningia cardinalis
MGQLHIVFLPFMAHGHMIPMLDMAKLFNSCGVKTTIISTPAFAEPVRRAQESGIDIGLSTIKFPPEGSDLPDNFVSLDQTMATEDLISNFVKALDLLQEPVEKLLEEFNPNCLVSDMFLPWTTDSAAKLGIPRLVFHGVSTFALCAMEQMKRHKPYKNVSSDSEPFILPNLPHQLKFTRTQVSQHELEETENDFSKLLKQMREAEERSYGVVINSFYDLESDYADHYRKALGRRAWLIGPLLFRNSGNVDKTQRGKKSAIDEHECLAWLDSKKPNSVVYMCFGSMARFTAAQLHETAVGLEASGQDFIWVVRKGKNEDENEDWLPEGFEERTKGRGLIIRGWAPQLLILDHPSIGAFVTHCGWNSTLEGVCAGVPMVTWPIFAEQFFNEKLVTEVLKIGVSVGNRQWCRRASEGVPSKAVATAVQAVMVGEKALEMRNRAKSYQELARKAVEQGGSSDNDLNALIQELSAYPLSRKQD

SEQ ID NO: 6091 - protein, 464 aa, Vigna angularis
MEKPHIVVVPSPGFTHLVPILEFSKRLLHLLPHFHITCFIPSLGSPPSSSKAYLQTLPSTITSIFLPPINLEQKTDPSVLALQIELSVNLSLPYIRQELKSLCSRAKVVALVVDVFANGALDLAKELNLLSYIYLPQSAMLLSMYFYSSKLDEILSSESRDPQEPIKIPGCVPVLRKDFPLPFQNLSGIGYKGFLERSKRFHIPDGIFMNTFLGLESEAITTLHEHVKGKPGIYPVGPIIQMGSIDHENGVECLRWLDKQEPKSVLFVSFGSGGTLSQDQLNELAFGLELSGQKFLWVVRVPSFEVSSAYFGAEDKDPLQFLPQGFLERTKQQGLVVPYWAPQIQVLGHSATGGFLSHCGWNSVLESVVKGVPVIAWPLFAEQSLNAAILTDDLKVALRPKVNHSGLREREEISKVVIGLFQEKEGKEIRQRMELLKFSAANAIKEDGSSTRTLSELVASFRDF

SEQ ID NO: 6092 - protein, 494 aa, Unknown
  Description of Unknown: Oryza sativa Japonica Group sequence
MPTASPAHAVFFPYPVQGHVASALHLAKLLHARGGVRVTFVHSERNRRRVIRSHGEGALAAGAPGFCFAAVPDGLPSDDDDDGPSDPRDLLFSIGACVPHLKKILDEAAASGAPATCVVSDVDHVLLAAREMGLPAVAFWTTSACGLMAFLQCKELIDRGIIPLKDAEKLSNGYLDSTVVDWVPGMPADMRLRDFFSFVRTTDTDDPVLAFVVSTMECLRTATSAVILNTFDALEGEVVAAMSRILPPIYTVGPLPQLTAASHVVASGADPPDTPALSAASLCPEDGGCLEWLGRKRPCSVLYVNFGSIVYLTSTQLVELAWGLADSGHDFLWVIRDDQAKVTGGDGPTGVLPAEFVEKTKGKGYLTSWCPQEAVLRHDAIGAFLTHCGWNSVLEGISNGVPMLCYPMAADQQTNCRYACTEWRVGVEVGDDIEREEVARMVREVMEEEIKGKEVRQRATEWKERAAMAVVPSGTSWVNLDRMVNEVFSPGNNM

SEQ ID NO: 6093 - protein, 484 aa, Prunus persica
METKSHEQLHIFFFPYMAQGHSIPLIDIAKIFASHGVKSTLITTPLNAPLFSKAIQSSKELGFKIELIVIRFPTEEVGLPPGCESTNLATTKEMKEKFFRATTLLRPQLEQILDQQRPHCLLADTLFPWATDVAAKFGIPRLIFHGTGFFPLCASLSVILYEPHLKVSSDSEVFTLPNFPVEIKLTGSQIPAFLKKKVETEFTKLFEASKACEERSYGVIVNSFYELEPVYADHYRKVFGRKAWHIGPVSLCNKAALDKAEMRGMEASLDEHECLNWLNSKKPNSVVYICFGSMTNFSDPQLFEIALGLEASGREFIWVVKKEKKEKEEWLPEGFEKRMEGKGLIIRGWAPQVLILEHEAIGGFVTHCGWNSILEGVSSGVPMITWPVSAEQFYNEKLLTEILRIGVAVGVQQWATFVDVKQEASVKSEAIKKAVTEIMVGDEAEEIRSRAKALREMARKAVEEGGSSFSDLTALIEELKSLRA

SEQ ID NO: 6094 - protein, 245 aa, Triticum aestivum
MELTWRAITVGPTLPSFYLDDDRLPSNKSYGFNLFGSDAPCMDWLEKQSISSVVLVSYGTFSNYDATQLDELGNGLCNCGKSFLWVVRSNEAHKLSEELRKSCEKNGLIVSWCPQLEVLAHKAIGCFVTHCGWNSTLEAVVCGIPLVGIPHWADQPTIAKYVESAWGMGVRVQKSESGSLRSAEVERCIRDVMDGERKDDYKRNAMKWMQKAKEAMQEGGSSDKHIAEFAAKYFQQCNLYFKISK

SEQ ID NO: 6095 - protein, 482 aa, Oryza sativa
MAKPTVVVLPVWGAGHFMPMIEAGKRLLRGSGGALSVTVLLMPAPTPDAAVDIAAQVKREEASGADDISFRHLPAVDMPTGHTGVEEWISRILRSHAPNVRAAIAGLDCPVAALVTDIFCTPALEVSRELGVPGYVYFPCSASMLALLLRSPGLDEEVAVEFEEMDGAIRIPGLPPVPPSALPSTMLDRKKSTYDWFVATGRGYMNATGFIVNTAAELEQSVIDAIADGRCTRGVPAPTVYPIGPVLYFPPPPEEQPHECVRWLDAQPPASVLFLCFGSKGLLPPPKVREIAAALGRSGGHRFLWVLRGPPKDSRHGQRVPTDAMLDELLPEGFLERTKGRGLVWPTRAPQKEILAHAAVGGFVTHCGWNSILESLWFGVPVLPWPLDAEQHFNAFTLVAHLGVAVPLGMDRRRDNFVEAAELERAVRSLMDDASEEGRKARAKAAETRVVCRKAVEEGGSSSTAFRRLTDDIVRRGAVQIR

SEQ ID NO: 6096 - protein, 488 aa, Citrus unshiu
MASEASQVHFLLLPYLAPGHLIPMFDIARLLAQHGAIVTIVTTPVNAARFKTVIARAIKSGLQIRLIEIQFPWQEAGIPEGCENCDLLPTTDFARFMKSLHMLQQPFENLFKEKTLKPCCIISDMCFPWTVDTAAKFNVPRIIFHGFSCFCLFCHHLLGVSKVHENVTSDSEYFNIPGLPDHIEFTKVQLLISKRDDDRKELREQILAADKKTYGAIINTFEELESPFIENYKKAKQGKVWCIGPASLCNKEPIDKAERGKTASIDVPECLTWLDSQQPSSVVYVCLGSICNLPSSQLIELGLGLEASNKPFVWVIRGGSKLEALEKWLVQENFEERIKGRGLLIRGWAPQVLILSHPAVGGFLTHCGWNSSLEGISAGVQMLTWPLFADQFCNEKLIVNVLRIGVSVGVEVPMNFGEEEKIGVLVNKENVKTAINILMDDGEERNARRSAREFGELAKRAIDEGGSSYNNVELFMQDIMQQPSSEGI

SEQ ID NO: 6097 - protein, 484 aa, Cephalotus follicularis
MSSLILSEKPHAVCIPFPAQGHINPMLKLAKLLHHKGFHITFVYTEFNHKRLLKSRGANSLNGLSSFRFETIPDGLPPSDVNATQDIPSLCESTSKTCLAPFRKLLSKLNDTSSSNVPPVIFIISDGVMTFTLDAAEELGIPEVLLWTASACGYLAYVHFRQLIDRGYVPLKDTSSLTNGYLDTEIAYIPGMEGIRLKDFPSFIRTIDSNDIMLNFIPVETERAKRASAIIINTFVAMEDQFLSVLSSMLPPIYSIGPLQLLLNDLPDTDLKHFGSNLWKEEPECLEWLDSREPNSVVYVNFGSITVMTPDQLVEFAWGLANSKQVFLWIIRPDLVSGDSAILPPEFLAETKDRGLLAGWCPQEQLLNHPAIGGFLTHCGWNSTIESVCGGVAMICWPFFAEQQTNCRYCCTEWGIGMEINSDVKRDEVEILVRELMEGEKGKEMKKKAMEWKKLAEESTTSPNGSSYKNFEELIHQVLLSTTD

SEQ ID NO: 6098 - protein, 465 aa, Zostera marina
MGSHQPQPPPPLHVAILPNPGMGHLIPLAEFAKLLTTNYGITVTFLTLDDSPRINSFIDALPDTITYIPLLKPSLHDLPPGSKAETYISLIMSRCLPSLREVMVKLKATTNLVALIVDLFGTDAFDVATDLEVSPYIMFPSTATLLNFMFHLEDLDRTIQGEYRDHPQLIRIPGCVPFHGKDLLVPVQDRNDQAYSLFLDISTRYKEAAGIFFNSASSIEPGPIKELMSMDRPPVYPIGPLVHDTNSEDDNSGCVKWLDERRPGSVLFVSFGSTGRLTAEQFTELAVGLEMSGYGFLWIARSPKETGEKGFFNVKSKSDPLLFLPDGFLERTKEIGLVVDSWAPQLAILKHAAIGGFLTHCGWNSSLESIVHSVPMIAWPLYAEQKMNATMLVEELKIAIRPVVDEKRGLIGREEISRVVREVIEGEEGKKLRLNVKRIAENAINENSYKSLDAVVNIWKNSTSI

SEQ ID NO: 6099 - protein, 468 aa, Vitis vinifera
MEETPHIAILTNPGMGHLIPFVELAKRLVLSHNFSVTCIVPTIGSPSKAQETVLKCLPHGISYVFLPAVSFDDLKEDVRAEIKVSLTMSRSLSPLREVLKSIMIRTRLVALIVDPYGTDAFDLAEEFGVPSYIFFMSNAMALSFCLHLPKLDEMISCEYRDLPEPVKIPGCIPVQGRDLMDPVRDRKNEAYKGFLHHVKRFTLAEGIIVNSCMDLEAGAVRALQDGGLVKPPVYPVGPLVRTWSRIGDDDDSECLRWLDGQPDGSVLYVSFGSGGTLSYDQVNELALGLEMSEQRFLWVLRTPNDRSSNAAYLTNQSQNDAFDYLPKGFRDRTRGQGLILPSWAPQIKVLSHSSVSGFLTHCGWNSTLESIMCGVPLIAWPLYSEQKMNAVMLTEGLQVALRPEVNKSGLVQREEIVRVVKDLMTGGHGVRIRAKELKEAATKALCDDGSSSKALLEFVLACKNKIGR

SEQ ID NO: 6100 - protein, 468 aa, Unknown
  Description of Unknown: Petunia x hybrida sequence
MVQPHVILTTFPAQGHINPALQFAKNLVKMGIEVTFSTSIYAQSRMDEKSILNAPKGLNFIPFSDGFDEGFDHSKDPVFYMSQLRKCGSETVKKIILTCSENGQPITCLLYSIFLPWAAEVAREVHIPSALLWSQPATILDIYYFNFHGYEKAMANESNDPNWSIQLPGLPLLETRDLPSFLLPYGAKGSLRVALPPFKELIDTLDAETTPKILVNTFDELEPEALNAIEGYKFYGIGPLIPSAFLGGNDPLDASFGGDLFQNSNDYMEWLNSKPNSSVVYISFGSLMNPSISQMEEISKGLIDIGRPFLWVIKENEKGKEEENKKLGCIEELEKIGKIVPWCSQLEVLKHPSLGCFVSHCGWNSALESLACGVPVVAFPQWTDQMTNAKQVEDVWKSGVRVRINEDGVVESEEIKRCIELVMDGGEKGEELRKNAKKWKELAREAVKEGGSSHKNLKAFIDDVAKGF

SEQ ID NO: 6101 - protein, 469 aa, Citrus unshiu
MSSSNTRTTHILIFPYPAQGHMLPLLDLTHQLSLKDLDITILVTPKNLPILSPLLDAHPAIKTLVLPFPSHPSIPPGIENVRELGNRGNYPIMTALGKLYDPIIDWFRSHDNPPVAILSDFFLGWTLKLAHQLNIVRIAFFSSAWLLASVADYCWHHIGDVKSLDVVEFPDLPRYPVFKRRHLPSMVRSYKESDPESEFVKDGNLANTSSWGCVSNSFDALEGEYSDYLKRKMGHDRVFGVGPLSLVGLESSCGGDPGLGPNDHVTKWLDGCPHGSVVYVCFGSQKALKRDQMEALASGLEKSGIRFLWVVKTGMIGKGDDGYGSMPDGFEERVAGRGLVLKGWAPQVSILSHKAVGGFLSHCGWNSLLEGIVGGVMILAWPMEADQFVNAKLLVEDLGVAVQVCEGADSVPDSDELGKVIAESLSQRDEVKVRAKELRDDALAAVKSDGSSARDLDRLVEELRNLHAK

SEQ ID NO: 6102 - protein, 795 aa, Medicago truncatula
MEKTVHIAVVPGVGYSHLFPILQFSKLLVQLHPYFHVTCFIPSLGSLPTDSKTILETLPSNISCTFLPPVNSNDLPQGVALALQLQLTLTHSLPSIHQALKSLTLRAPFVALVVDALAIDALDFAKEFNLLSYVYYPASVTSLSSYFHLLKLDKETSCEYRDLPEPIQIPGCVPIHGRDFLDLAQDRSSQSYKFFLQCVEKFRLFDGVLINSFLEIEKGPIEAMTDEGSENLLVYAVGPIIQTLTTSGDDANKFECLTWLDKQCPCSVLYVSFGSGGTLSQEQIDELALGLELSNHKFLWVVRAPSSTANAAYLSASDVDPLQFLPSGFLERTKEQGMVVPSWAPQIQILSHSSIGGFLSHCGWNSTLESVVYGVPLITWPLYAEQRTNAVLLCEGLKVGLRPRVNENGIVERVEIAELIKCLMEGEEGGKLRNNMKEFKEAASSVHKEDGSTTKTLSQLALKWSNFGIEKQLFQVLGIYPFSLYSSILNAGFFKQIKNSKEGFSVNAEYFGKAIISKTSNGSISGSSQDYKHFLQHVKSLSFADGVLVNSFLEMEMGPIKAPTEEGSGNPSVYPVGPIIDTVTCSDRDANGLECLSWLDKQQSCSVLYVSFGSGGTLSHEQIVQLALGSSSSAAYLSAQNDGDPLKFLPSGFLERTKEKGFVITSWAPQIQILSHSSIGGFLSHCGWNSTLESVVHGVPLITWPMFAEQGMNAVLVTGGLKVGLRPRVNENGIVERVEVAKVIKCLMEGEECEKLHNNMKELKGVASNALKEDGSSTKTISQLTLKWRNLVQEN

SEQ ID NO: 6103 - protein, 246 aa, Syzygium oleosum
MDRVLESIRRSEGAILIKTCREIEGKCVDYLAELVGKEVIAVGPLIQEPAGGDARDDEGEILGWLEERESGSVVFVSFGSECFLSKEEMEEKVSIVEALPEGFLERTKDRGMVVQGWAPQAKILMHPSTGGFVSHSSWRSTLEAIVFGVPIIAIPMHLDQLLNAKLVADLGVGVDVRREDGRFPVEDVAKVIKQVVVREEGEEVRRRAKELSARIRERQEEETSTVMKKLERLFGGTTFNLGQTVT

SEQ ID NO: 6104 - protein, 482 aa, Solanum tuberosum
MDNGSKQLHVLFLPYFATGHIIPLVNAARLFASRGGVKVTILTTHHNASLFRSSIDNSLISIATLKFPSTEVGLPEGIENFSSASSTEIASKLFGGIYLLQKPMEDKIREIHPDCIFSDMYFPWTVDIALELKIPRLLFNQSSYMYNSILYNLRLYKPHEYSKSSNFSVPGLPDKIEFNLSQLTDDLIKPADERNGFDELLDRTRESEDQSYGIVHDTFYELEPAYADYYQKMKKTKCWQIGPISYFSSKLFRRKDLINSFDESNSSAAVVEWLNKQKHKSVLYVSFGSTVKFPEEQLAEIAKALEASTVPFIWVVKEDQSAKTTWLPESLFDEKKGLIIKGWAPQLTILDHSAVGGFMTHCGWNSVLEAIIAGVPLVTWPVFAEQFYNEKLVEVMELGVKVGAEVHNSDGCVEISSPVLRSEKIKEAIERLMESQKIREKAVSMSKMAKNAVEEGGSSWNNLTALIDDIKNFTSSSLKIMD

SEQ ID NO: 6105 - protein, 482 aa, Theobroma cacao
MEPGKSQAPSPHILIFPLPIQGPVNAMLKLAELCATAGLKVTFLNSEYNHSRLVRFANIPSRFDKYPGFEFRTISDGLPGDHSRSGNRFMEIFEAMNIRTKPLLKDMLVEMIPPVDCIIGDGILEFVLDVANELGIPIINCRTIGACFLWSNYSIPDMIEAGELPIKGSEDMDRPITAVPGMEKFLRCRDLPSFCRASNMSDSTLLRYGTVTRKSFTASGVILNTFEELEGPILSQIRSKCPNVYTIGPLNEHFKTRMSLENGVSSQSSNYFWEVDRSCMSWLDRQPNQSVVYVSFGSIAVMSDEQIMEFWHGLVNSKRRFLWVVRPDSVAGKGFQGEDTPKELVEGTKDRGYIVGWAAQEEVLSHRAVGGFLTHSGWNSTMESIVAGVPMLCWPYFADQQLNSRFVGEVWKLGIDMKDVCDRKVVEKMVNDLMVERKDEFVKSAAAMASLAKDCVSVGGPSYCNFDRLIEDIKTISLKNHD

SEQ ID NO: 6106 - protein, 476 aa, Arabidopsis thaliana
MKAEAEIIFVTYPSPGHLLVSIEFAKSLIKRDDRIHTITILYWALPLAPQAHLFAKSLVASQPRIRLLALPDVQNPPPLELFFKAPEAYILESTKKTVPLVRDALSTLVSSRKESGSVRVVGLVIDFFCVPMIEVANELNLPSYIFLTCNAGFLSMMKYLPERHRITTSELDLSSGNVEHPIPGYVCSVPTKVLPPGLFVRESYEAWVEIAEKFPGAKGILVNSVTCLEQNAFDYFARLDENYPPVYPVGPVLSLKDRPSPNLDASDRDRIMRWLEDQPESSIVYICFGSLGIIGKLQIEEIAEALELTGHRFLWSIRTNPTEKASPYDLLPEGFLDRTASKGLVCDWAPQVEVLAHKALGGFVSHCGWNSVLESLWFGVPIATWPMYAEQQLNAFSMVKELGLAVELRLDYVSAYGEIVKAEEIAGAIRSLMDGEDTPRKRVKEMAEAARNALMDGGSSFVAVKRFLDELIGGDV

SEQ ID NO: 6107 - protein, 475 aa, Ricinus communis
MASASNNHQLHILLFPLMAQGHMLPLLDIARLFSSRGVKITFITTPGNAPRLKRSSQTTQISFKIIKFPSKEAGLPEGLENLDLISDLQTHIKFFNALSLFQEPLEQVLQELHPHGIVSDVFFPWTADAALKYGIPRLIFNGASFFYMCCLANLEEHQPHKKVSSDTEMFSLPGFPDPIKFSRLQLSATLREEQPNLFTEFLASAKEAEKRSFGMIFNSFYDLESGYVDYYRNVLGRRAWHVGPVSLCNRNIEEKSQRGKEASISEDECMKWLDSKKPNSVLYVCFGTVAKFSDCQLLEIALGLEASGQNFIWVVRSEKNEEEKWLPNGYEKKMEGKGLIMRGWAPQVLILEHEAVGGFVTHCGWNSTLEGVSAGMPMVTWPVFADQFFNEKLITDVLKIGVGVGAQKWVAVVGDYVESGKIEKAVKEVMVGEKAVEIRSRAKKIGEMARMATEFGGSSYNDFGALIEELKSYRT

SEQ ID NO: 6108 - protein, 537 aa, Cephalotus follicularis
PSSSPSLPPPHLFPHFSLIFNYFFLPFAASFCCCLADAPLLIESPRMESNDHQIHVMFLPFLAPGHMMPMVDMARLFAANNAKVTIVTTTMNALRFKNTIDRDIESGRQITVESVRFPAAEVGLPEGGENLNSIPTPEMTFKLFHAIDLLQPYIEQLFRERKPDCIASDYLFPWTAEVASELNIPRIAFSGSGFFNLCVSDSIERYQPHRNILTDTETFIVPNLPDQVALTRSQLPDIVKTKTDFSAFFEKVKEAERKSFGVLMNSFYELEPAYIDHFREVIGMKAWHLGPVSLFNRDADDKADRGDTASVSGHNCLNWLDNKKPNSVLYICFGSLTRFSRIQVTEIANALEDSGHSFIWVVGKVLPNKDDDNDLQKEEWLPEGFECKARESSKGLIIRGWAPQILILEHPAIGGFLTHCGWNSILEGVSAGVPMVTWPIFAEQFYNEKLVTQVLKFGVPVGNEVWKLWAMQETPLINRDKIMKAVNAVMSDRGEALVMRKNATRLGELARNAVERGGSSFNDMKTLIEEITAFKYK

SEQ ID NO: 6109 - protein, 467 aa, Genlisea aurea
MKKAELLFIPSPGLSHLVSAVESAKLLLRRDQRLSVVILTMKLAGDSAVDAYKNKIIPPPRRLRFIDLPTQEEIAPPNSSVFQYIESQMNPIKEIISDNASSLSGVVLDMFCTKFMPIADEFNLRSYVFFSSGACCLGMYLHLVALKFDFNQELSEYKRTPEIELSIPCFSNPVPAKVLPAVLIQGGYFSSLFMDYFRRLRDAAGILVNTFQELENAAIESMNSDGKLPKLYPIGPILNLENDEGNNRFGDVKKWLDDQPEKSVVFLCFGTMGSFQTPQVREIAAAQEKTGSRFLWSLRKPPEKGATPFPTEYQDYDEVLPEGFPERTEGIGKIIGWAPQTAILAHRSIGGFVSHCGWNSVLESVWFGVPVATFPLSAEQQANAFELVKELKMAEPIRIDYRHGENPPEIVTAAEIEIAVLRLMGTDGGGGGGGVRENVKEMQRKSRLAMAEGGSSYHAQTLFIQNL

SEQ ID NO: 6110 - protein, 477 aa, Cephalotus follicularis
MESAIVLYPSPGRGHLVSMVELGKLLLSQNPSFNINIVVSIPPFEAGSTGQYVAAVSAANPSITFLHLPTVSLARSYSFPEDFPVLSYDLAELNNSNLSHVLSSLSKSFIIKAFIIDFFNTASFQVSSCFNIPTYYFFTSNASGLAAFLFLPTIHKNTKKSLKDLDILVEVPGVPPIPAKDMPVAILDRTTKAYEYFMGTAIHMAKSAGLIVNSFELLEQRALKAILNGECVLGESVPPIYCIGPVIETSNGSEASEDEHECLSWLNSQPSRSVLFLCFGSLGVFSAKQLQQMAIGLEKSGVRFLWVVRNPPPDQETLNVLTAAEPNLETLLPEGFLQRTKDKGLVVKLWAPQVKVLSHDSVGGFVTHCGWNSVLEALRAGVPMLAWPLYAEQKMNRLFLVEEMKVALWVSESEDGLVSAAELENRVNELMDSKKGKVVRERVMAMRDEAAAAREDGGSSRVALVKLINSLKRGWTC

SEQ ID NO: 6111 - protein, 468 aa, Genlisea aurea
KLHFVFLPMVAYGHMIPAVDMAKLFVSRGLKVTVVTTPAFSELVLKARESGHDIGLRIIGFPPEGSPLKGDVVSMDQVTEDTHGEFLAAVELMRAPFEEFLEELGPDAVVSDMFLPWSAESAGKFGLPRLVFHGTSYMALCCSDQMRVYKPYEAVDSDSEPFILPNLPHRLEFFRSQLPPEEHSDNSFAGLRNQMAEAEKITHGALMNTFDELESDYARHYRNAMKKRAWSIGPLILCGGAGGKEELGSRGKKSAVDEHECMRWLDSKADHSVVYVCFGSMAVFSDAQLRELAAGLRDSSRNFVWVVRKTEGGGGNGWLPEGFEETTSETGMIIRGWAPQVLILNHPSVGAFVTHCGWNSTLEGIAAGVPMVTWPVFAEQFYNEKLIVDVLKIGVSVGSKKWQRVGSEGVAAEAVTAAVERVLFRDSAEEMRRRAKDYQAKAKIAVKGGGSSYNELNDFVEDIRNYKP

SEQ ID NO: 6112 - protein, 486 aa, Arabidopsis thaliana
MAVSSSHHAVLFPYMSKGHTIPLLQFARLLLRHRRIVSVDDEEPTISVTVFTTPKNQPFVSNFLSDVASSIKVISLPFPENIAGIPPGVESTDMLPSISLYVPFTRATKSLQPFFEAELKNLEKVSFMVSDGFLWWTSESAAKFEIPRLAFYGMNSYASAMCSAISVHELFTKPESVKSDTEPVTVPDFPWICVKKCEFDPVLTEPDQSDPAFELLIDHLMSTKKSRGVIVNSFYELESTFVDYRLRDNDEPKPWCVGPLCLVNPPKPESDKPDWIHWLDRKLEERCPVMYVAFGTQAEISNEQLKEIALGLEDSKVNFLWVTRKDLEEVTGGLGFEKRVKEHGMIVRDWVDQWEILSHKSVKGFLSHCGWNSAQESICAGVPLLAWPMMAEQPLNAKLVVEELKIGVRIETEDVSVKGFVTREELSRKGEMGKTTMKNVKEYAKMAKKAMAQGTGSSWKSLDSLLEELCKSREPDGVNKLSSSDA

SEQ ID NO: 6113 - protein, 485 aa, Unknown
  Description of Unknown: Oryza sativa Japonica Group sequence
MCSAATPNSGDVRATPGSSRPHVVLLPSAGMGHLVPFTRLAAALCSGHGCDVSLVAAVPTVSSAEARHLAAHFTAFPAVRRLELDLASLDVSEFAGADPFYVRYEAIRRSASLLAPLLAGGASAAASALVADIALASVVIPVAKDLRLPCYVFFTASATMFSFLAYLPTYLDANAGGGHAIGDVDVPGVCRVPTSSVPQALHDPDDIFTRQFIANARSLANADGLVVNAFDALEPEAVAALRQGTVAAGLPPVFAVGPLSPAPIPAKDSGSYLPWLDAQPARSVVYVSFGSRKALPRDQLSELAAGLEASGHRFLWVVKGAVVDRDDAGELTDLLGEAFLQRIHGRGLVTMAWVRQEEVLNHPSVGLFISHCGWNSVTEAAASGVPVVAWPRFADQRVNAGVVARAGIGVWVDTWSWEGEDDGVVSAEDIAGKVRSAMADEGVRKAAASVREAAARAVAAGGSSYRSLAELVRRCRDGLVITNGM

SEQ ID NO: 6114 - protein, 555 aa, Unknown
  Description of Unknown: Fragaria x ananassa sequence
MGSESLVHVFLVSFIGQGHVNPLLRLGKRLAAKGLLVTFCTAECVGKEMRKSNGITDEPKPVGDGFIRFEFFKDRWAEDEPMRQDLDLYLPQLELVGKEVIPEMIKKNAEQGRPVSCLINNPFIPWVCDVAESLGLPSAMLWVQSAACLAAYYHYYHGLVPFPSESDMFCDVQIPSMPLLKYDEVPSFLYPTSPYPFLRRAILGQYGNLEKPFCILMDTFQELESEIIEYMARLCPIKAVGPLFKNPKAQNAVRGDFMEADDSIIGWLDTKPKSSVVYISFGSVVYLKQEQVDEIAHGLLSSGVSFIWVMKPPHPDSGFELLVLPEGFLEKAGDRGKVVQWSPQEKILEHPSTACFVTHCGWNSTMESLTSGMPVVAFPQWGDQVTDAKYLVDEFKVGVRMCRGEAEDRVIPRDEVEKCLLEATSGSKAAEMKQNALKWKAAAEAAFSEGGSSDRNLQAFVDEVRRISASLNSKSSAVGYVKSKINGVVEYVDSKLNGKAAPVEEANTRTNGIAKVEQPKAANGKVEIAELTPINGKVEIAELKPINGKVELVES

SEQ ID NO: 6115 - protein, 498 aa, Unknown
  Description of Unknown: Oryza sativa Japonica Group sequence
METFTADDQRDADAPRPPRVVLLASPGAGHLIPLAELARWLADHHGVAPTLVTFADLEHPDARSAVLSSLPATVATATLPAVPLDDLPADAGLERTLFEVVHRSLPNLRALLRSAASLAALVPDIFCAAALPVAAELGVPGYVFVPTSLAALSLMRRTVELHDGAAAGEQRALPDPLELPGGVSLRNAEVPRGFRDSTTPVYGQLLATGRLYRRAAGFLANSFYELEPAAVEEFKKAAERGTFPPAYPVGPFVRSSSDEAGESACLEWLDLQPAGSVVFVSFGSAGTLSVEQTRELAAGLEMSGHRFLWVVRMPSFNGESFAFGKGAGDEDDHRVHDDPLAWLPDGFLERTSGRGLAVAAWAPQVRVLSHPATAAFVSHCGWNSTLESVAAGVPMIAWPLHAEQTVNAVVLEESVGVAVRPRSWEEDDVIGGAVVTREEIAAAVKEVMEGEKGRGMRRRARELQQAGGRVWSPEGSSRRALEEVAGKWKAAATATAHK

SEQ ID NO: 6116 - protein, 477 aa, Helianthus annuus
MAQTQPHFLLITYPAQGHLNPALQFAKQLIRLGVKLTFPTTVNAYHRMGKAGKIPESLNYVLFSDGYDDGFNPDTDDATDLLAQFREKGTECLKETILSSAKNGTPVTCLVYTLLIPWAAEVARDCNVPPALLWIQPASVFRVYYYYFKGYDKLIGENCNEPSWSIELPGLPLLKSRDLPSFCLPSNASDPVLNTVLLLIKELLHKLDSIERPKILVNTFNELEEEALKEMDGKVNMVGVGPLIPSAFLDGKDMSDRSFGGDLIEASHEYLEWMNTKPKGSIVYISFGTLIVWSKKQKEAMAHGLLESKRPFLWVIKDKDREEADDEISYMHELKKLGLGLMIPWCNQLEVLSHPSLGCFVTHCGWNSTLESMACGVPLVAVPKWSDQTTNAKLIEDLWGAGVRVTTNEEGVVEGEEMKRCIEMVMGGHERGEVVRGNVKKWKDLARKPIKEGGSSYMNLKAFVEEVGSCTYDKVVS

SEQ ID NO: 6117 - protein, 431 aa, Unknown
  Description of Unknown: Oryza sativa Japonica Group sequence
NGETENGGGGGKLGMGPLIRLVAVPDGMGPDDDRNNLLRLTVFMQEHMAPRDQVRGGGLRCRDVGAGRGEAHRREVRCRLAGVGRRHGVSTQRSGTHSGQNNRRSWQKKTANELSASNWYFHLVCFSWAGSALTQEAFQLSPDMPMMQPAHLAWNCIGNDQGQELLFSCVLAGVRAVDECDYILCNSFRDAEAATFARFPKILPIGPLLTGERPGKPVGHFWRPEDGACMSWLDVQPARSVVYVAFGSFTVFDRRQFQELALGLELTGRPFLWVVRPDIVHGDAHEYPDGFLDRVVASGNDGGRGKVVAWAPQQRVLAHPAVACFVSHCGWNSIMEGVRNGVPFVAWPYFADQFVNRAYICDIWRVGLPAVADKKSGMVTKEHLAGRVEEVMGDASMRERIEAMMVVAHESVQEGGCSHGNFDMFVESIMS

SEQ ID NO: 6118 - protein, 495 aa, Citrus unshiu
MDKATQLHFVLFPFMSQGHMIPMIDIARLLAQRGVIITIFTTPLNAARFHGTLARAIESGLQIHIIETPLPNLEDGLPQGCENMDMLPSLDLALDFFTAADKLLEPVENLFGQLKPQPNCIISDVCLPYTAQIAGKFNVPRIAFHGTCCFSVVCFNNIFASKFLESISSESEYFSVPGLPDKIELTKKQVDSTQGQKFKAFEYKIGAATLAIDGVIINSFEELEPAYVKEYKKISRDKAWCIGPVSLGNKEYSDKAQRGNTSSLDEHKCLKWLDSKDPKSVVYACLGSMCNLIPSQMMELGLGLEASNRPFIWVIREGETSKELKKWVVEDGFEERIKGRGLVIWDWAPQVLILSHPSVGGFLTHCGWNSTLEGVCAGLPLLTWPLFADQFTNEKLAVHLLKIGVKIGVENPMTWGEEQNIGVLVKRDDVKNAVERLMDEGNDGEERRNRALNLAKMAKMAIQEGGSSHLNITLLLQDIMKHVHSKSLANKCQSE

SEQ ID NO: 6119 - protein, 422 aa, Cajanus cajan
MVSYPAQGHINPLLRLAKCLAAKGLFVTFTTSEIAGKHMRSANNITEKSVIPIVIKKHAEENHPISCIINNPFVPWVCDVAAQHAVPSAMLWIQSSAVFTTYYSYFHKLVSFPSDADPYIDVHLPSVVLKYNEVPDFLHPFSPYPIFGTLILEQFKNLSTPFCVLVDSFEELEHDYIEYLSKFLVIRPVGPLFKIPKDPSTRDIRGDFMKSDDCIEWLNSRAPESVVYISFGSIVYLPQEQVSEIAYGLLNSHVSFLWVLKPPPKEFGVSPHVLPSGFLEETREKGKVVQWSPQEEVLGHPSVTCFMTHCGWNSSMEALSYGVPMLTFPAWGDQVTNAKFLVDVYGVGIRVGYGQAEKKVISRDEVKKCILEATIGPKAQELKQNAFNWKKAAEEAVAVGGSSTRNLDAFVKDIKERGAKEI

SEQ ID NO: 6120 - protein, 481 aa, Medicago truncatula
MEETTIVMYPAPSIGHIISMVELAKLLIHHHQHFSITILLTTGFMDHPSIDSYINRVSSSHPSITFHRLPTVAVNHTTTQSIAATAFQFIKSNAVNIETKLRQIIQTSVIKAFIIDLFCTSAMETASAMQIPVYYFFTSGAAVLSLYSYFPKIHSLTKSSFKDMVGVEISAPGNMALNAALMPEPVLDRDDPAYWEMLYFCEHLSKAKGIVVNTFRELEVVAVKVVEDGACFPDVEGSSPPVYCIGPLIADAQQPDEARGIKDCLSWLDKQPSKSVVYLCFGSRGSFSMTQLKEIAEGLERSGHRFLWVVKRPVQEHLGTKKVYDTTGEFDLSSILPSGFIERTKERGLVVRSWAPQVEVLSRESIGGFVSHCGWNSVLEGVVAGVPMIAWPLYAEQHVNRNVMVEDMKVAVAVEQRAGDMFVSGEEVEKRVRELMDSEKGREIRERSLKFKDMARDALGEFGSSTKALANLVQTWNVISH

SEQ ID NO: 6121 - protein, 363 aa, Ricinus communis
MSKVCPVLTIGPTIPSIYLDKRIENDDDYGLDLYALDASISINWMSTKPAGSVVYVAFGSMANLSDKQMEELAWGLNNSNFNFLWVVRACEQSKLPKGFVQELGSKGLIVNWSPQVKVLASEAIGCFFTHSGWNSTIEALSLSVPMVAMPQWTDQPPNAKLVEDVWKVGIRVKVNEDGIVTREEVESCIREVMTGEKGKEMRNNGAKWRELAIEAVSEGGTSDKNIDEFVSKLFITEEVIILGEVHMVVIIEVVGFNTIVVVLVLIPDLLVMVFVVAMVIILYLSPLLDLIISRLLVNRRLIPILCPIFLVLLLYIAKYVMVQTTLLSSALNVMHIARIYLLLLPAYIFMIPLGKLILMLLTT

SEQ ID NO: 6122 - protein, 448 aa, Cephalotus follicularis
MSGAHILVYPYLSAGHIIPLLDLTHRLHTRGLTVTVVVTPNNLSLLNPLLSTHASSSTLQPLVLPSPQPSNFSSNRLIDSMHGLRLLHYPLLLQWFSSHPSPPVAIISDFFLGWTHQLATELGLPRVVFSPSAAFAFAVQHQTWIDSPKNDGPSTVSFPNIPGSPRYPWHQISHIYRSLKEGDPDREFYKSTLLANLVSWGVVFNSFSELEGVYIDHVKKEAGHDRIWAVGPLLPPDDDLMRPANRGGSSSVPCHEVMTWLDARREHSVVYVCFGSRAELTREQTDGLAAGLEKSGVHFIWCVRGVMPAGYEERVAGRGFVINGWAPQVEILRHRAVGVFLTHCGWNSTLEGIAAGVVMLTWPTSADQFSNAQLLVEELGVGVRVGDGTEVIPESGELARILAESLDENRAERVRANKLRDAALTAVKGGSSDKDLDDFVLRLNALSK

SEQ ID NO: 6123 - protein, 453 aa, Genlisea aurea
MAEAHCLIFPFPIQGHINPMLQFAKRLVHKGLRVTLILTRYLAKTSPFHSPTIAVETISNGLDDGEPHGFPVSSYLSLLKEHGMASLREALHRLIRCGRPATCIVYDPFITWVPELAGEYGIKTAAFFTQSCAVDYIYHRLYSGDLKIGEEEEKAIELPGLPPLLPADLPSFVTLPESYPSLRDMVTDQFKHIENVDWVFCNTLYELEKEVIDFMAEHAPVKAIGPTIPSMYLDRKLADDTDYGLSVFRPEARLCMDWLNRQEPGSVIYVSFGSLAKLSEAQTAELAHGLKRSKRPFLWVVRAAEQGKLPEGFAAEEVPGLVISWCPQLDVLAHDAVACFVTHCGWNSTLEALCLGVPMVGMPQWTDQTTNSKFVADVWGTGVRAVGDGGIVGRESIEKCIREVMEGEKGEEIRKNVSKWKELAVAAVSEGGSSDRNIDDFVSTLRRLAVAAV

SEQ ID NO: 6124 - protein, 458 aa, Arabidopsis thaliana
MANNNSNSPTGPHFLFVTFPAQGHINPSLELAKRLAGTISGARVTFAASISAYNRRMFSTENVPETLIFATYSDGHDDGFKSSAYSDKSRQDATGNFMSEMRRRGKETLTELIEDNRKQNRPFTCVVYTILLTWVAELALFSIFYHYFNGYEDAISEMANTPSSSIKLPSLPLLTVRDIPSFIVSSNVYAFLLPAFREQIDSLKEEINPKILINTFQELEPEAMSSVPDNFKIVPVGPLLTLRTDFSSRGEYIEWLDTKADSSVLYVSFGTLAVLSKKQLVELCKALIQSRRPFLWVITDKSYRNKEDEQEKEEDCISSFREELDEIGMVVSWCDQFRVLNHRSIGCFVTHCGWNSTLESLVSGVPVVAFPQWNDQMMNAKLLEDCWKTGVRVMEKKEEEGVVVVDSEEIRRCIEEVMEDKAEEFRGNATRWKDLAAEAVREGGSSFNHLKAFVDEHM

SEQ ID NO: 6125 - protein, 478 aa, Vigna angularis
MEETIVMFPAAGIGHIVGMVELAKLIQTPRFSIIVLLNTGFLDHPSIDDYIRRISAVHSSISFLRLPSTTPATFTTAVSFGVKYFSFLKRNAPHVATTLTQISKTAVVKAFVIDLFCASTMESASSMGIPVYFFFTSGAAILALYSYFPKLHQEWSVSFKDMVGVELRVPGNAPLKAVELPQPILDRDDPSYWDMLDFCTLLPKARGIIVNSFEELEPAAVNAVAQGSCFPDATHAPRLYYIGPLIAEPQQSDAEGSDSKECLRWLEEQPSRSVVFLCFGSRGSFSVSQLKEIAKGLEKSGKRFLWVVKRPLELEEEGAKHDEDAAKRGDQFDLNPVLPDGFLERTKDRGMVVKAWAPQVEVLSRESVGGFVSHCGWNSVLEGVVAGVPMVAWPLYAEQHVNREVMVGEMKVAVGVNQRVEDGFVSAEEVEKRVREVMETKEIRERSFKLKQMAMAAVAQFGSSTTALANLLHSWISF

SEQ ID NO: 6126 - protein, 473 aa, Helianthus annuus
MEKLDLFFIPSPLMGHVGQLVELARLFVKTFDHITATVLVIKLPGDPIGTDYTDSFTDHTRIKFIHFPPMDPDLFQDCPTVGFTADAVINSHKPIIRGLVASQFTGSGPFGPRPVRPLGALVVDMFCTSMIDVAKEFNLPTYVFFPSNAAFLWIMFYFQTLQDELSQDISELSHSATKLLVPSYANPVPPSVVPDVLLDRDQWSKRFLHYARKYREAKGIIVNTFQELEHHALCSYDGNTPPVYTVGPLLKPKKPTPDHEVLQWLKGQPESSVLLLCFGSRGWFGVDQVREIAVAIEQSGCRFIWSLRRPPPEGHNGFPKEYADYNEVLPDGFLERTAGRGKVVGWVPQAEVLADVATGGFVSHCGWNSLLESIWYGVPVATWPIYAEQQLDAFQMVKDLGLAVEISLDYNQMNKDQQLVLAETIEKGIREVMDHNSAVRAKVKEMSAKSRMAMEEGGSSFESLRRLVDDIIM

SEQ ID NO: 6127 - protein, 467 aa, Phoenix dactylifera
MEEPTQQHFLLATYAGQGHINPALRLATQLARTIPGARVTFSTSVSGHRRMFPSAASDGEISDGRLSYLPFSDGCDDGFKGGIPGFSDFMAQSKLHGSRNLSNLLGDLTARGRPVTCLIYTILLPWAADVAREHGIRSFLHWIQPAFVFAIYYHYFHGYEDLVASNRGDPLFQVEFPGLPPLRIRDLPSFLTISADDPFYHVFLILREVFETVDREKTESHKPRILVNTFDALESDALSAVDAMHLLPIGPLLPSPEETPSHGDIFQLDGRRYMAWLDSKPEKSVVYVSFGSLSVMRKQQLEEMLNGLEECGRPYLWVVRKDNREEGVELEKGEKGMVVEWCSQVKVLSHPSVGCFVTHCGWSSMLESLACGVPIVGAPQMSDQGMNAKLAEEAWGTGVRAEANDEGVFEGAELRRCLEVVMGQGEKGAEMRRKATKWRDRVQEAVASGGPSDRNLRAFVEEIGKGA

SEQ ID NO: 6128 - protein, 253 aa, Eurytemora affinis
  MOD_RES (248)..(248): Any amino acid
MQVGFIHCREGEELTPNIQQFLAGNNKNAVLMSLGSIIQTEDFPDDFIGIFEKVFIKLGLKVIWKTNRKVESKNILTGNWFSQQDILAHENIGLFISQCGMMSMQEAIYHHVPILCLPITFEQITNSKMIIQKKLGISLQLQSLTASSLETAILDVLNTPLYFSLTALSLETAILDVLNTPLYFSLTASSLETAILDVLNTPLYFSLTASSLETAILDVLNTPLYFSLTASSLETAILDVLNTPLYFXFFFFQ

SEQ ID NO: 6129 - protein, 466 aa, Medicago truncatula
MTKYEVVFISTPTIGNMVPTVEFANHLTKHHPQLSATILVITIPKLPLVNTYLQSRSSSSTNLHFIHLPTVDPPAPDQYQSFIAYISLLIQKHKTNIKNTLLDLIKTDSVKLAALFVDMFSTTIIDVANEVSVPCYLFFASPASFLGFTLHLPKLESVESETEFEIPSFRNPIPKQVLPNMVLKWKSEEDAYSWILYHAGRYRETKGIVVNTLQELEPYALQSLYDDSQLPPVYTIGPVIDLVGPAEWDPNPVQYNYIMEWLDLQPLASVVFLCFGSLGSLEVKQVEKIAIGLERAGVRFLWALRGPPKAQSADPRDYTSYDNVLPDGFLTRAAGMGIVCGWVPQAKVLAHKAVGGFVSHCGWNSILESLWYGVPIATWPVYAEQQMNAFQMVRELGLAVEIRLDYRVGGDLVQAEEVENGVRTLMNLSDEIRRKVKDMREKCRVALMENGSSYTNLMSLIQELTK

SEQ ID NO: 6130 - protein, 471 aa, Hordeum vulgare
MVANAAAEKAPATASGGTRRVLLFPLPFQGHLNPMLQLADVLHARGFHITVFHAAFNAPDPVAGYRFVPVGAGVPAADLVPTGSDGDFAGALLRINERLQGAFQDCLREEVLLEEEEEEGARPACLVLDSNLRGMQVVAGRLGVPTLVLRTGGAACLAAYMAFPALCDKGLLPPKDHSQLNMPLDDLPPLRLQDMIFSTTTPHETMTTCLERIVESAKCSSGVILNTFTDLEDVDIQKIIDGVGVPVYAIGPLYKISSGAQSSLLSPDQTCLDWLDKQEAESVLFVSLGSLASMGQEELVETAWGLANSRLPFLWVIRPDAVQSSGKVGLPDGFEEETRGRGMVVNWAPQQDVLGHQAVGGFWTHNGWNSTLESICEGVPMICRPHFADQMINARYVEQVWKVGFELEGKLERGNIERGIIKLFRGEEGGEMRRRANDLKDKATLCIKKGGSSQTMVDLLINRIMSSPSSI

SEQ ID NO: 6131 - protein, 480 aa, Sorghum bicolor
MATTAVSSSSTPPASSGGGGGVRRRRVLMFPLPFQGHLSPMLQLAGALHARGGLDITVFHAAFNAPDPARHPPGYRFVPVGEAVAWADLVVSGGDDDIPGALLRINDRLRDPFRDRLRQALALADDGAGAPPPPACLVLDSNLRGMQLVAEELGVPTLVLRTGAAACLVAYMAFPALCDKGLLPPTSKDNSWLDMPLDDLTPLRLRDMVFSSTTAHANMRKCLKCLVDATRSSSGVILNTFQDLENSDLQKIANGIGVPIYPIGPLHKISSGTEDSLLAQDWACLEWLDKQEVDSVLYVSFGSLANIDEKELLEIAWGLANSQMPFLWVIRHNLVKSSNDVSLPDGFKEATHGRGMVVPWVPQQEVLRHHAIGGFWTHNGWNSTLESICEGVPMICRPQFADQMINMRYVQEVWKIGFELDGDLERGKIERAVKKLLCMEEGRHMRQRAKDLRNNAIKCIKEEGSSKSAIELLLNQIMSF

SEQ ID NO: 6132 - protein, 290 aa, Helianthus annuus
MRLRDIPPCIRMINPGDDYMVKFICLQVERAKTSSAIIFNTFDELDRDILDTISATYPPCYGVGPFNLLEKTIVDESLASIQSNLWKEDQGCLKWLDLKTSSSVIYVNFGSIAVMTSQQLIEFAWGLAKSGHSFLWIIRPDLVIGESAVLPCDFATETRERGYFASWCPQEQVLNHPSVGGFLTHSGWNSTIESISSGVPMICWPVFAEQQTNCWSSCNKWGVGMAIDNNVKSDEVAKLVIELLNGEKGKEMRKKAIEWKKKAEESCVVPSGSSIANLNKVIHLLQTSSK

SEQ ID NO: 6133 - protein, 480 aa, Helianthus annuus
MASNQEHKPHALFIPAPAQGHLNPMIKLAKILHSKGFLITFVNTEFTHRRLVKSQGLDALNSVSTFRFEAIPDGLTPPENTEVTQNVYDICRSTQENCLQPFKSLIAKLSVAFSPVTCIVSDLLMGFTLDAAKELGIPEFIFSTGGAGALLCSEQFPILLDKGLMPLKDPSYLVNGYLDTIVDSIHGMEGIPLKYIPPFIRYINPGDEFMVEFTNAQIKKAKTASGIIFNTFDDLEHDVLDSLASIFPPCYGVGPLHLLENKIADKSLASIGSNLWMEEPECIKWLDTKPASSVVYVNFGSITVMTHQQLVEFCWGLANSKHSFLWIMRAGLVDGESDALPLEFFQETSGRGMLAGWCPQEQVINHPSIGGFLTHSGWNSTVESISSGVPMICWPFFSDQFPNCWLSCTKWGVAMEIDSDVKRDEVERLVVELMAGEKGMVMRKNAMNWKNKAIAASSVPDGSAVIDLEKLINELKKVPK

SEQ ID NO: 6134 - protein, 237 aa, Triticum urartu
MGCTRPLGLPCATLWNQSCAVLSLYHHFYDDDTPFPSTADDAPVALPGLPAMSLHELPLMVRPEFAHNLWGQMLRRQLVEPVLAACRGDTGRIVAWCPQGRVLRHGAVGCFVTHCGWNSVTEALAAGVPVVAYPWWSDQFTNAKFLVEEFGVGVRLPAPVTQDGFRACIEEVMSGPEAVAIRRRATAWKEEAAAALADGGSSDRGLEAFVDFVRAPVGSGGVDTISSPAKQGSVSSL

SEQ ID NO: 6135 - protein, 466 aa, Medicago truncatula
MEEKPHIVVVPSAGFTHLVPILEFSKRLVNLHPQFHITCIIPSIGSPPSSSKSYLQTLPPTISSIFLPPINVDQVPDAKILAVQISLSVKHSLPYIEQELKSLCSRSKVVAVVADVFAHDVLDIAKDFNLLCYIYLPQAAMVLSTYFYSSKLDEILSDESRDPNEPIKVPGCVAFDLKDLPLPFRFRSNIGYTKFLERAEKYHLFDGVFVNSFLEFEEDAIKGLKEEKKKPMVYPVGPIIQKVSIGDENEVKCLTWLEKQEPKSVLFVSFGSGGTLSQEQVNELAYGLELSGKKFLWILRSPSGVANATYFVGENEIEDPLRFLPSGFLERTKEQGLVVPCWGPQIQVLEHNSTGGFLSHCGWNSVLESVVYGVPIIAWPLFAEQGMNATMLCDGVKVALRPKANDGGLVERDEIGKVVRELMDGEERVEIRKRIEHLKNAANDAIDEMGSSTKALSQVVAIWNGI

SEQ ID NO: 6136 - protein, 318 aa, Medicago truncatula
MTFLDENFIADGTLDTSLDWISGIKDIRLKDLPSFMRVTDLNDIMFDFFCVEPPNCVRSSAIIINTFEELEGEALDTLRAKNPNIYSIGPLHMLGRHFPEKENGFAASGSSFWKNDSECIKWLSKWEPGSVLYINYGSITVMTDHHLKEFAWGIANSKLPFLWIMRPDVVMGEETSSLPQEFLDEVKDRGYITSWCYQDQVLSHPSVGGFLTHCGWNSTLETISYGVPTICWPFFVEQQTNCRYLCNTWKIGMEINYDVKSEEIIELVMEMMEGEKGKEMRQKSLVWKKKATDATNLGGSSYNNFHKLIKEVLHHKAI

SEQ ID NO: 6137 - protein, 464 aa, Sorghum bicolor
MAGQEEHRDGSSHRRQVVLFSLPFQGHLNPMLKLAAVLHAHGLGVTVLHTDFNAPDPARHPELTFVPIHETLRDEATSPDSDILAKLLSLNAACEAPFRQALASLLLLRRRRGHDVACAVVDGQCYAALRAAGQLGVPVLALRTDSAAALRNMLAYPRLRDAGYLPVKEEQLDEAVPDLEPLRVRDLIRVDGCGVDEMCSFVAGVADATGASVSGIVINTFEAIEASELAKIRRELPLPAFAIGPLHLLSSSQDSAEQSLYTPDLSCLAWLDAQPAARSVLYVSLGSLACVDRGVFEEMAWGLAGSGVPFLWVVRPGSVTGTGGGGGEEVPPLPDGFNEEVRNRGKIVTWAPQREVLAHAAIGAFWTHCGWNSILESVCGGVPMLVQPCFADQMVNARYVTREWGVGMEVGEEIERETVAKVVTKVMVGEDGPLMREKARRLQMQASAATSSAMDGLVQYVLSL

SEQ ID NO: 6138 - protein, 491 aa, Polygala tenuifolia
MANSDRAERGHHSSQKPHAIFIAYPLQGHVIPSVHLAIKLASLGFTITFINTDSIHYQTLKAHGKDATSEDIFTSARNSGLDIRYMTVSDGLPVEFDRSLNHDQFMLSLLHVFSAHVEQVVGKIVKQSNETVTCLIADTFFVWPSKIAKKFGLFHVSFWTEPALIFTLYFHMDLLRKNGHFDCNNVRDDPIDYIPGVHQIHPKDVMSYLQDADTSTVVHQIIFNAFQDVRAADFVLCNTLQDLEPDTIAALRAHLPFYAVGPLFPAGFTKSSVATSLWSESDCTHWLSTKPKSSVLYVSFGSYAHVSKKDLIEIANGLLLSNVNFIWVLRPDIVSSDNVDPLPVGFREAVRECGMIIPWCCQIEVLSDPAVGGFLSHCGWNSILESLWCEVPLLCFPLLTDQFTNRKLVVDDWKVGINLSDHKNITKDDVSRNVNRLMGRKSCLKFVNAIAEVKKLMGGAWTTDGLSQRNMDSFIEGLEHKSRQVKGRITQ

SEQ ID NO: 6139 - protein, 502 aa, Medicago truncatula
MAIQSHEAEAKNLKVIFIPFSATSHIIPLVEMARLFAMHGVDSTIVTTAGNAGIFQKSIDHDFNRGRPIKTHVLEFPAKQVNLSVVTETFNTDTPLTEAAKFQEGFVMLQSLIENYLLGELEVDCIVSDLCHPWTVEVASKLGIPRIVFSPASIFSRCAELLFEKHRAHNEVESDYDKFTIVGFPHKFEMSRSQLPDWMKKPSMYGMIIKALNDSARRSYGAIFNSFSDFEGAYEEHYKNAFGTKCWGIGPVSLWANQDVSDKEERGEAKVEEGNSDLLKWLHSKKENSVIYVSFGSLNKFPPSQLIEIAHALEASSHNFIWVVRKNINEKEGDEGFMEEFEKRMKENNKGYLIWGWAPQMLILENKAIGGIVTHCGWSTIMESIKVGLPMVSWPLFADQFFNEKIIIDVLRIGVSVGAKEWRNWNEFGSEVVKREEIEKAIALVMENGKESEEMRSRSKALSEDAKKAILVGGSSHANLMQLIHELKSLKHQRLNGVLLGQ

SEQ ID NO: 6140 - protein, 471 aa, Medicago truncatula
MAETKPTSHIVVTSIPLFSHESSVIEFCKRLIQVHNHFQITCIFPTIDAPIPATLKLLESLPSTIHCTFLPPIKKQDLPQEVTMQLELGVTKSMPSFRESLSLLCSTSTTPVVAIVVDPFANQALEIAKEFNILSFMYFPVSAMTTSLHLHLPILDEQVSGEYMDHVEPIEIPGCTPIRGQDLPRTFFEDRSSIAYETILRQTKRFSLADGVLINSFSEMEESTVRALMEKEQSNNKQLVYLVGPIIQTGSNELNKSVCVKWLENQRPKSVLYVSFGSRGSLSQEQINELALGLELSGQKFLWVLREPNNSEILGDHSAKNDPLKYLPSGFLGRTKEQGLVVSFWAPQTQILSHTSTGGFLTHCGWNSTLESIASGVPMITWPLFGEQRLNAILLIEGLKVGLKVKLMRVALQKEEEIAKVIRDLMLGEERSEIEQRIEELKYASTCALAEDGSSTRVLSQLAIRMESNAK

SEQ ID NO: 6141 - protein, 360 aa, Cephalotus follicularis
MGFIVDAAEEFGVPNVSFCIFSACSSICFLHYRQLVESNYTAIKGESNIINGSLDTVIDFIPGIEGITMRYIPTFLRMTDPDDIVLKFIAIEVERMKRASGIIIHTYDAFEHDVLFALSSMLPPVYSIGPLSLLANQIQDDDMNLLGSNLNLWLEDSQCLEWLDSKEPNSFVYVSFGSITVMTSDQLVEFSWGLANSKKNFLWVIRPYLLSGDSGSLPAELLADTKERSLLVSWCPQEQVLNHPSIGGFLMQCGWSSMMETLCAGVPMICWPFFAEQATNCWFNCVKWGVGIEIDNNVKRDEVERLVRELMDGAKGKEMKKKAMEWKKLAEEATSSPNGSSCKNLDAIVKLLLSPRDKID

SEQ ID NO: 6142 - protein, 487 aa, Manihot esculenta
MGSTDLNSKPHIVLLSSPGLGHLIPVLELGKRIVTLCNFDVTIFMVGSDTSAAEPQVLRSAMTPKLCEIIQLPPPNISCLIDPEATVCTRLFVLMREIRPAFRAAVSALKFRPAAIIVDLFGTESLEVAKELGIAKYVYIASNAWFLALTIYVPILDKEVEGEFVLQKEPMKIPGCRPVRTEEVVDPMLDRTNQQYSEYFRLGIEIPTADGILMNTWEALEPTTFGALRDVKFLGRVAKVPVFPIGPLRRQAGPCGSNCELLDWLDQQPKESVVYVSFGSGGTLSLEQMIELAWGLERSQQRFIWVVRQPTVKTGDAAFFTQGDGADDMSGYFPEGFLTRIQNVGLVVPQWSPQIHIMSHPSVGVFLSHCGWNSVLESITAGVPIIAWPIYAEQRMNATLLTEELGVAVRPKNLPAKEVVKREEIERMIRRIMVDEEGSEIRKRVRELKDSGEKALNEGGSSFNYMSALGNEWEKSWKTQRSERSLW

SEQ ID NO: 6143 - protein, 478 aa, Medicago truncatula
MESEAPIHIHILLISFPGQGHINPLLRLAKCLAAKGASVIFITTKKAGKDIQTVNNIVEKSVTSIGNGSLTFEFFDDGLQDDDPIRANLCGYIEQLKLFGKPFLSQMIKNHVESNKPISCIINNPFVPWVCDVAHEHGIPSVLLWVQSTAVFAAYYNYFNKLVHFPLEKEPYIDVQLPFQVLKYNEIPDFLHPFSPYPFLGTLILEQFKNLSKVFCVLVETYEELEHDFIDYITKKSIHIRPIGPLFKNPNIKGASNIRGDFVKSDDCNIIEWLNTKPKDSVVYISFGTIVYLPQEQVNEIAYGLLDSQVSFLWVLKPPPKEVGLKEHVLPNGFLEETNERGKVVKWSPQEEVLAHPSLVCFITHCGWNSSIEALSLGVPMLTFPAWGDQVTNAKFLVDVFGVGIRLGYGMIENKFVTRDEVKKCLLEATIGEKAEDLKKNAIKWKKKAEEAVAIGGSSDRNLDEFLEDIKKIKMIAQ

SEQ ID NO: 6144 - protein, 462 aa, Oryza sativa
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLATACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 6145 - protein, 477 aa, Gentiana triflora
MGSLTNNDNLHIFLVCFIGQGVVNPMLRLGKAFASKGLLVTLSAPEIVGTEIRKANNLNDDQPIKVGSGMIRFEFFDDGWESVNGSKPFDVWVYINHLDQTGRQKLPIMLKKHEETGTPVSCLILNPLVPWVADVADSLQIPCATLWVQSCASFSAYYHYHHGLVPFPTESEPEIDVQLPGMPLLKYDEVPDYLHPRTPYPFFGTNILGQFKNLSKNFCILMDTFYELEHEIIDNMCKLCPIKPIGPLFKIPKDPSSNGITGNFMKVDDCKEWLDSRPTSTVVYVSVGSVVYLKQEQVTEMAYGILNSEVSFLWVLRPPSKRIGTEPHVLPEEFWEKAGDRGKVVQWSPQEQVLAHPATVGFLTHCGWNSTQEAISSGVPVITFPQFGDQVTNAKFLVEEFKVGVRLGRGELENRIITRDEVERALREITSGPKAEEVKENALKWKKKAEETVAKGGYSERNLVGFIEEVARKTGTK

SEQ ID NO: 6146 - protein, 515 aa, Jatropha curcas
MSLREEQIHVMFLPYMAPGHMMPMVDMARLFAANGVRVTIVTTKMNAIRFKNSIDKDFRSGRNISLEILSFPSLQAGLPQGCENLSSTTTPEMTIKLFHGIGLLEPQIKIVFQQHRPDCIISDYLFPWTVDVAAELGIPRIAFSGSSFFNLCVANSIECNRPHDLIKSETESFIVPGLPDQVKLTKSQLPDIVKSKTEFSDLFDKLKEAERKSFGVLMNSFYELEPAYADHFTKVTGIKAWHLGPVSLFNRDDDDKVQRGDNTNVCERSCLNWLDSKKPNSVLYACFGSLTRFTKDQTVEIANALENSGFPFAWVVGKIVKCKNNEEDEEECWLPGGFEDRLKESGKGIVIKGWAPQVLILEHASIGGFLTHCGWNSILEGLCAGVPLVTWPIFAEQFYNEKLVTQVLKFGVPIGNEIWKVWANEESPLIRRNNIERVVRLVMGDGDKAMQMRKRARQLQERAKIAVEEGGSSYNNLKSVIEDIRVYKRATEKVKEIEGNHLIELEKPQQEVTAP

SEQ ID NO: 6147 - protein, 472 aa, Medicago truncatula
MASNEAPIQILLVSYPSYGHINSLLKLGKCLAAKGSSVIFTTTQKAGKDMETANNITNKTTTPIGKGFLTFDLFDDGLKDDDPMRTSLGDYTSQLEHVGKLYVSQLIKNHAESKTPISCIINNIFISWVCDVATEHKIPFAILFNESSAVFTCYYNYFHKLVPFPSKTEPCIDVQLPSVVLKHSEIPVLLHPSNTYPFLGPLILGQIKNLSKALCVFVDTYEELEPDFIDYISEKSIIIRPIGPVFNNPNIIGASNIRRDFVKTDDSTIIEWLNSKPKGSVVYVSFGTIVQLPPEQVNEIAYGLLNSQVTFLWAKKKHDDLPHGFLEETSGRGKVVKWSPQEQVLAHPSVACFITHCGWNSTIESLASGVPVLTFPVFGDQPTNAKFLVDVFGVGIRLGYSGAENRLITRDEVKKCLLEATTGEKAEELKKNAIKWKKAAEDAVAVGGSSDRYLDAFIEEVAKQGAVNFQKI

SEQ ID NO: 6148 - protein, 456 aa, Sesamum indicum
MGSPVESNGSLGNNIHIFLISFPAQGHVNPLLRLGKRLASFGLFVTLSAPEFAGLSIRKANTITDDEPTRLGTGMIRFEFFDDGWDFNDPNRDDLDSYLAQLERVGRQKLPQMIRKQAEKGRPVSCLVNNPFIPWVSDVAEILGIPSAMLWVQSCASFSTYYHYYNELAPFPSEHEPEIDVQLPYMPLLTYDEVPSFLHPSTPYPFLRRAILGQFKNLSKPFCILMDTFQELEHEVVEHMSKVCRPIKTIGPLFKELKSPSTGNFTSESNAIRADFYAADSCLEWLDSKTPQSVVYISFGSVVHLKQEQVDEIAHGLLGSEVSFLWVVRPPPKELKVEPHVLPQGFLEKAGDKGKIVKWSPQEQVLAHPSTACFVTHCGWNSTMEALASGVPVVAFPQWGDQVTDAKFLVDVFKVGIRLCRGDSEGRIVPRDEVERCFRAATGGPEAAEMKQNALL

SEQ ID NO: 6149 - protein, 281 aa, Cajanus cajan
DMPSFFFTYEQDPTLFDFAVAQFSNIDKADWILCNTFYDLDKEIIDWFMEIWPKFRSIGPNIPSMFLDKRYEDDQDYGVTQFKNDECMEWLDDKPKGSVVYISFGSMATIGEKQMEEVACCLKECSSHFLWVVRASEENKLPKDFEKISKKGLVVTWCSQLKALAHEAIGCFVTHAGWNSTLETLCLGVPTIAIPYWSDQSTNARLIKDVWKIGIKAPVDDNKIVQREDLKHCIEELMESEKGKEMKNNVLQWKSLAIKAISEGESSYNNILEFTNKLFRS

SEQ ID NO: 6150 - protein, 481 aa, Crocus sativus
MGSEDRSLSILFFPFMAQGHMLPMLDMAKLFALYGVKSIVVTTPANVPIVNSVIDQPDVSTLHPIQLRLIPFPSDTGLPEGCENVSSIPPRDMPTVHVTFFSATAKLREPFGKVLEDLRPDCIVTDMFFPWTYDVAAELGIPRIVFHGTNFFSLCVTDSLERYKPVENLRSDAESVIIPGLPHRIEVLRSQIPEYEKSKADFVREVTESESKSYGAVVNSFFELEPDYARHYREVVGRRAWHIGPLALANDSTTDKSSRGYKTAIDRNDCLKWLDSKSLRSVVYVCFGSMSDFSDAQLREMASGLEASNHPFIWVVRKSGKEWLPEGFEERVQERGLIIRGWAPQILILNHRAVGGFMTHCGWNSSLEAVSAGLPLVTWPLFAEQFYNERFIVDVLRIGVSVGAKRHGMSAEEREVVEAEMVKKAVDGVMGDGEEAEGRRRRARELGEKARKAVEKGGSSYEDMRNLVEELKSDSKLTVGC

SEQ ID NO: 6151 - protein, 321 aa, Helianthus annuus
MAEPLQDKKNPTYIRMVEAAKKFSMPKGILVNSFLELEPRPFKAMEEGEWCKPKVYPVGPLIRSGSKNQTGEGFECLKWLDKHPVGLVLFVSFGSGGTLSQQQLNELAFGLEKSGQRFIWVVKSPHGKSDASYFNAQSHLDTFEFLPEGFLGRVEDRGLVVSVWAPQVKILSHGSTGGFLTHCEWNLILECLVCGVPMIAWPLFVEQKMNAVLGTDGLGVTRRVKVDENGVVGRDEVENCVRSLIEGEEGRKMRLKVSELKGLAANALSRDGLSTRSLFDATQMWWKKHRNENEEFETRDVFIPGAIKFVILPVYWSGQRV

SEQ ID NO: 6152 - protein, 482 aa, Citrus unshiu
MEQTLQAQAAPHIVLLPSPGMGHLIPLIEFAKRLVHRHHFLVTFFIPSDGPPSEAQKSTLESLPSSINSVFLPVSLNDVAEDARAETVISLTVLRSLPCLRQELTSLVAKATVAALVVDLFGTDAFDVAQEFNISPYIFYPSTAMCLSLFLHLEKLDQMVPRDCEYRDMSEPVQIPGCIPVHGRYLLDPVQDRKNEAYRWVLHHAKRYKLAEGIIVNSFTDLEGGALKALQHQDEPGKPPVYPVGPLVKTGSTAESKNEGCLKWLDDQPLGSVLFVSFGSGGTLSCEQLNELALGLEMSEQRFLWVVRSPNNAANSTFFSVNSHKDPYDFLPKGFLDRTKGRGMLVPSWAPQAQVLSHGSTGGFLCHCGWNSVLESVVNGVPLIAWPLYAEQKMNAVILTEDVKLALRPKANENGIVGRDEIAKVVKALMEGEQGKEVRNKMKDLKDAAAAVLSENGSSTKALSQLASKWNNNEGKPCSLQI

SEQ ID NO: 6153 - protein, 505 aa, Eucalyptus grandis
MEATYEVMGSDNVRQLRIFFFPFMAYGHILPTIDMAKLFASRGLKATIITTPLNAPIFAQTIQRTQKLGAKIDVQTVNFPSVEAGLSPGCENLDLVASQEMFLKFIKATEMLKQPLEELLSEDPPDCLVADMFFPWATDVAQRLGVPRMVFHGTSFFALCATECVRLHEPHKNVPSDSDPFAIPNFPHEIKLTRKQLPEHLRSGVENDFTRFNREAKESEVRSFGVIVNSFYELEPDYADYYRNVLGRRAWHIGPVSLCNRDIEDKATRGKKATIDEHECLKWLDSKDPNSVIYICFGSVAKFSPNQLREIALALEASGQQFIWVVRKADKGGGDKDEAGGDEEWLPRGFEERMKSENKGLIIRDWAPQVLILDHKAIGAFVTHCGWNSTLEGICAGVPMMTWPVFAEQFYNEKLVTQVLRVGVGVGAQQWVGIVADKEIVSKDRIEKALRQVMVGDEAEAMRDRAKLLADKARRAIEDGGSSYSDMNALIRELALHRIARDAKS

SEQ ID NO: 6154 - protein, 493 aa, Populus alba
MAPPMSSQLHFVLIPLMAQGHTIPMIDMARLISERGVTVSLVTTPHNASRFASIIERARESSLPVRLVQIPFPCEEVGLPIGYENLDTLPSRDLLKKFYIAVARLQQPLERILEHAKPRPSCIISDKCLSWTAKTAQRFNIPRIVFHGMCCFSLLSSNNIRLHKAHLTVSSDSEPFVVPGMPKSFEITKTQLPGAFVSLPDLDDVRNKMQEAESTAYGVVVNSFDELEHGCAQEYGKALKKKVWCIGPVSLINKQNLDMFERGNKASIGKTQCLEWLDSMEPGSVIYACLGSLCRLVPSQLIELGLGLEASNKPFIWVVKTGERGSELEEWFVKERFEERIKGRGLLIKGWAPQVLILSHRSVGGFLTHCGWNSTVEGICSGVPMISWPQFSEQFFNEKLIVEILRIGVRIGVEVPVRWGEEEKVGVLVKKDEVRKAVITLMDAGGEEGKNRRKRAIELGKTARKAMELGGSSNLNLSFLIQDIMNLQISKQG

SEQ ID NO: 6155 - protein, 444 aa, Helianthus annuus
MERAPHIAIVPSPGMGHLIPLVEFAKRLKNNHNISATFIIPNDGPLSISQKAFLDSLPMGLNHIILPPLREVFKSLVADNNMVALFIDLFGTDAFDVAIEFGVSPYAFFPSTAMGLSFFLYLPKLDQMTSCEYRDLPEPVQIPGCLPVRGQDLLDPVQDRKNDAYKWVLHNAKRYMMAEGIAVNSFKELEGGAFKALLEAEPGKPKIYPVGPLIQTGSSSDVDGSGCLKWLDGQPCGSVLYISFGSGGTLSSNQLNELAMGLELSEQRFIWVVRSPSDQANATYFNSHGHKDPLGFLPNGFLERTKGNGFVVSSWAPQAQILSHSSTGGFLTHCCWNSILETVVHGVPVIAWPLYAEQKMNAVSLTEGIKVALRPNVGENGIISRVEIARVVNSLLEGEEGKAIRSRIRDLKDAAANVISKDGCSTKTLDKLASMLKNKNKLSL

SEQ ID NO: 6156 - protein, 490 aa, Arachis hypogaea
MGSLNITKNNKPHAVFMPYPAQGHINPMLKLAKLLHHKGFHITFVYTDYNRNRLLKSRGSDSLRNLPSFRFETIPDGLPVDPNPVDATQDVPLLCDSTSKRCLPHFKKLISELNGGDSGVPPVTCIVSDGTMSFGIEAAEELEIPVVVFWTASGCGTMCYMHYRQLVDKDFTPLKDMNDITNGYLETTINWVPGMKEIRLRDMPSFIRTTDPNDIMLNFFIRESKRAQRAHAIIVNTFDALDHDILEAFSTINNLPPVYSVGPLNLLLNHITDKDLKSIASNLWKEDPKCIEWLDKQEPNSVVYINFGSITTMTNENLIEFAWGIANSNKKFLWVIRPDLVAGENAVLPPEFVEVTKIRGMLANWCPQEQVLAHPSIGVFLTHSGWNSTLESVCGGVPMICWPFFAEQQTNCRFCCTEWGIGLEIEDVRRDKIESLVRESMDGEKGVDMKQKALKLKKLAKEAASAPNGSSFQNLDKLIHQVLLSKFAKN

SEQ ID NO: 6157 - protein, 465 aa, Vigna angularis
MAKTVHIAVVSSPGFSHLVPIVEFAKRLVKLHPNFHVTCFVPSLGSPPESSIAYLKTLPSNIDSVFLPPISKEQFPQGQYVGLQIQLTVTLSLPSIHEVLKSLSSKVRLTALVADVFAFQVLEFAKEFHALSYFYFPGSAMALSLLLHMPKLDEEVSGELKDLVEPIRLPGCVPLLGVDLPAPTQNRSSEAYKSFLERAKAMVIAGGIIFNTFLEMEPGAVRALEESVNGKIKLYPVGPITQKESNSEADECLRWLDKQPPCSVLYISFGSGGTMSQHQIDELALGLEMSGQRFLWVLRAPSNLPSAAYLESAEEEPLQFLPKGFLERTKEKGFVVALWAPQVQILGHSSVGGFLSHCGWNSVLESVQEGVPLITWPLFAEQRMNAVMLAEGLKVALRPRFKEDGIVEKEEIAKVIKCLMEEEIGKAMRQRMMIFKGFAAHALKDGSSRQTLIELTSEWENLSEN

SEQ ID NO: 6158 - protein, 387 aa, Citrus unshiu
MAQRKENIVMFPLMAQGHTIPFLALALHLENTNRYTITFVNTPSNLKKLKSSLPQNSSIHLREIPFDGIAHDLPPCTENSDSLPFHLFPNFFESTLSFKPHFRKLINGLIDEQNGHKPVCIIADMFFAWSAEIAQECGIFNALFVGGGSFGFACFYSLWLNLPHRDSDEFLLPDFPEASRIHVTQMTKFLRLADGSDSLSVFFQKVLPQWMNADGILFNTVEELDKIGLMYFSRKLGRPVWPVGSLLLSTGSRAGAGKEYGISTELCKNWLDTKPCNSVIYVSFGSQNTIAASQMMQLAMALEACGKNFIWVVKPPLGFDMNSEFRANEWLPEGFEERIKDSGQGLVVQKWAPQVEILSHKSISAFLSHCGWNSVLEALSHRVPIIG

SEQ ID NO: 6159 - protein, 516 aa, Selaginella moellendorffii
METILREEEDYGGGARGAAKDPSRKPHVVALAYPMQGHINPMIHLCKRLASLGLSVSLVNTQTNHDRLARSRGAALEQGLDIAMLALADDEEDTSAHQGGAGAGGDDALQRSLVAADAMERPFVALLQGLLDRGRGVDCILSDAFLGWSQDVADRFGIPRAALWASSTEYCLLNFHLLELRTRGYAPIRDASVLDDDSHTIAFIDGVAPLHPKDLPSILQRYSSHDPGFEKRYARTRRLCDAYWILGNTFQDLEPDALDAIQQAINGDPTSAAKKKRRNFSPVGPLLPSAFLGLGGDDLGSGNGLWIEDERCVNWLDKQSPSSVLYVSFGSLAVMSSAEMLELAAGIESSRQPFLWVIRPGSHLGSFDLEGFVERTRQLGLVVQWAPQLQVLFHPSVGGFLSHCGWNSTIESIAMGVPIIGLPCIAEQNLNCKRAVKDWGVGCKLQQRGDGDGDAIVGREEIERVVTRFMTGEDGMELRIRARELREAARRCVMDGGSSHKNLEAFVEAVRINGLR

SEQ ID NO: 6160 - protein, 492 aa, Cephalotus follicularis
MSNMEPQLLSLPPPPRVLIFPFPCQGHVNSMLNLAQLLCLSGLHVTFLNSDHNHDRLVLHTDIQARFACYPGFQFNTITDGLPVEHPREGESIMELCFSLNSITRPLFREMLVSGQFGLVNCIIADGIMGYTIDIANELGIPIFHFRTISACSFWAFFSIPQLIESGEIPIKGNEDMDALVKSVPGMETFLRSRDLPSFCRCSDVSNPVLQLMKNETQQSPRARALILNTFEDLEGPILSQIRTRCPTTYTIGPLHAHRKTRLAKHATNTLQSSSNSSSLWEVDRSCMTWLDQQPLQSVVYISFGSLAVLTRDQLIEFWFGVVNSKKNFLWVRRLDSTPGNKEGESEDIPVELVEGTKERGYMVGWAPQEEVLAHKAVGGFFTHSGWNSTLESIVAGVPMVCWPYFADQQVNSRFVSEVWKLGVDMNDLCDRTIVEQMLNDLMVERREDFVKSTAEMVGLSRRSVSEGGSSYCNFDRLIEDIKLMSMESPQC

SEQ ID NO: 6161 - protein, 490 aa, Unknown
  Description of Unknown: Oryza sativa Japonica Group sequence
MGGGRGGAPATASARARRPHQPRVLLLCSPCLGHLIPFAELARRLVADHGLAATLLFASARSPPSEQYLAVAASVLAEGVDLVALPAPAPADALPGDASVRERAAHAVARSVPRVRDVARSLAATAPLAALVVDMIGAPARAVAEELGVPFYMFFTSPWMLLSLFLHLPSLDADAARAGGEHRDATEPIRLPGCVPIHAHDLPSSMLADRSSATYAGLLAMARDAARADGVLVNTFRELEPAIGDGADGVKLPPVHAVGPLIWTRPVAMERDHECLSWLNQQPRGSVVYVSFGSGGTLTWQQTAELALGLELSQHRFIWAIKRPDQDTSSGAFFGTANSRGEEEGMDFLPEGFIERTRGVGLLVPSWAPQTSILGHASIGCFLTHCGWNSTLESVSNGVPMIAWPLYAEQKMNAAMMEVQAKVAIRINVGNERFIMNEEIANTIKRVMKGEEAEMLKMRIGELNDKAVYALSRGCSILAQVTHVWKSTVG

SEQ ID NO: 6162 - protein, 329 aa, Glycine max
MNSNVHSIYYVPKLADSSYMTNGYLETAIDWLPGIKEILLRDFPSFFRTIDPHDIMLQVLQEECGRAKHASAIILNTFEALEHDVLEALSSMLPPVYPIGPLTLLLNHVTDEDLKTIGSNLWKEDRECLKWLDTNEPKSVIYVNFGSITVMTNHQLIEFAWGLANSGKTFLWVIRPDLVDENTILPYEFVLETKDRGQLSGWCPQEEVLAHPAIGGFLTHSGWNSTIESLCNGVPMICWPFFAEQPTNCRFCCKEWGVGMQIEGDVTRDRVERLVRELMEGQKGKELTMKALEWKKLAEDATILKEGSSFLNYDNMVRQVLLSDNLKST

SEQ ID NO: 6163 - protein, 457 aa, Unknown
  Description of Unknown: Vitis labrusca x Vitis vinifera sequence
MEKQGGHVMVLTYPAQGHINPLLQFSKRLASKGLKATLATTHYTVNFIQSDAVGVEAISDGFDEGGFKQAPSLEAYLESFQAVGSRTLGELILKFNESASPVDCLVYDSIFPWGLSVARQFGIYGAAFWTTSASVCSMYWQLRQGLLSLPVKQETVPVSMPGLPPLRLSDLPDFLAQPGHLSAYMSAVMEQISSLEQNDWVFMNSFDALESELVKAMSGLWSVAMIGPMVPSAYLDQQIEGDTVYGASLWKPTNDECLGWLETKPPKSVVYISFGSMAEIPVKQVEEIAWGLKESDYHFIWVVKESESGKLPINFLKSMNETGLVVTWCNQLEVLAHKAVGCFVTHCGWNSILEGLSLGVPMVGMPQRVDQPTNAKFVEDVWRAGVRAQKDEEGIVTRKELEKCIKEIMVGERSEEIKRNACMWRESAKSAVSKGGSSDKNTDEFVGVLLKRGKKKT

SEQ ID NO: 6164 - protein, 440 aa, Cephalotus follicularis
VPCPFQGHINPMFQLGTILHSKGFSITIAHTLFNFPNPSDHPDFDFLPISDGVSKEEFTENFAAFVSSLNVHCEIPFQQALLRMIQNQDSHDDLPCIIYDGLMYFAEAVAHHLKLPSINLRAFSATYFLLYHIYPRLKEEGYIPVKDYMREDKTPVLQSLKLKNVFESMPQSARDAMLEHRAALTDSLKRSSAIIVNTMDFLEQEILTNIQKLFSAPIFTIGPFHKLAPTISSTSIFQEDATCISWLNKQVPKSVIYVSFGSMASMNENELHETAWGLANSEQPFLWVIRPGLVQGVDWLKLLPEGFKERIGERGCIVKWAPQKEVLAHVAVGGFWSHCGWNSTLESICEGIPMLCRPFFGDQLLNVRYVCDVWKVGLELDSELDRGKIEIAVRKLMVDTEGEDIRQRAMEFKKKVDHCLGESGSSLECLNELTEKILSV

SEQ ID NO: 6165 - protein, 457 aa, Helianthus annuus
MGHLIPLTELAHRLLLHRRLFITFIIPTATGSPVKPQNDILNAMPENISSIFLPPVDLNDIPEDAALETRIILTLTRSLPALRQTLTELTGESIRKRPSALVVDLFGPPSFEIAKELNIPAYLFCTVSAMSLVSIFHIPIFDQMYDCEYKDLPEPVRLPGCVPVHGANMPEPLQDKKNDAYVGVVESSKMFSLAKGVLVNSFLELEPGPFKAMEEGDWCKPKIYPVGPLIRSGSENQTGEGFECLKWLDEHPVGSVLFVSFGSGGTLSQQQLDELAFGLEQSGQRFIWVVKSPHGHGKSHTSYFSVESHLDPFGFLPEGFLGRVEGRGLVVSSWAPQVEILSHGSTGGFLTHCGWNSILESVVCGVPMIAWPLYAEQKMNAVLLTNGLGVAHRVEVDENGVVGRDEIDKCVRSLIEGEDGRKSRLKISELKALAAEALSPDGSSTSSLLDVAQIWCN

SEQ ID NO: 6166 - protein, 493 aa, Helianthus annuus
MDQSHEQINSKHTIEPHVLMFPIPFQGPVNCFLKLAELLCLSGIHVTFLNTQHIHRPLLRHTEVLSRFSRYPNFRFETIPDGVEHETPVSVDRFLEVMAGVDVVTKPLFREMMVSGRFSWESERPVTVMIPDAYFSFAVDVAKEASVPVICFETVSPCCLWTSYLNLPTLIEAGDVPFKGNDLDELITSIPGTEQIIRRRDLASQCRSTDMSSQSIELIVKEAHAVPEAQGLILNTFEELDSLILKHMRKLCPNIYTIGPLHTLHKAQLTANTNPLQENNFSNSVWKEDRTCMSWLDEHDPKTVLYISIGSLATMTIDQLVEIWYGVINSGTPFLWVRRPGSIIGGYDESQVPDELLARTKEIGCIVEWAPQEDVLAHPAIGGFLTHSGWNSTMESITQGIPMVCWPNFVDQQVNSRFVEEVWKVGVDIKDTCDRLQVEKAVRDIMDSKRNVYTQSANTWANLAKESITKTGSSSIHLARLIDDILAMSLTQP

SEQ ID NO: 6167 - protein, 385 aa, Helianthus annuus
MMRETIPSIRTTISAMDSHPHVLVGDIFAYESWAIAEELGIPKYLFVTGTAWFTALFTYSPLLDKQVVGQYVDKKEPLEIPGCTPVRPDEVVDPMLNRDDENYAVYLSQAIGVTLADGMLINTWEDLEPQTLNALRTNEILRSVVKYKPVYTVGPVNKRYEPDGLKGEVVEWLGKQPDRSVIYVSFGSEGTISAEQINELAWGLELSRQRFVWVVRPPNGHVSDGSFFKPGQSDTTRDYLPEGFLTRTQKVGLVVSSWAPQVEILNHTSVAVFLTHCGWNSTLESVTNGVPMIAWPLYAEQKMNAAMLTEELKVAVRPEVLPTKKVVGREEVARMVMNLVEGEEGKVMKIKVDMLKEGAENAIRENGSSYISICKFIEDCWSQIK

SEQ ID NO: 6168 - protein, 281 aa, Hibiscus syriacus
MEIKANGSVKLEPVFDDLGADSVMEKSIDDYLGRLEAVVTLRLPQIMARLGMSKSENAASCLVYDSVLPWALDIAKQQGVYGAEFFTFSCAVSSIYYNLHQGLLKVPIVEACLSMAGLPLLRPHDFPSLVSDIKAYPTLTDLFTNQFSSFKKADWVFFNTFTSLENELGGPRRGSNGGVSNGLKRSGRNLLWVVRVSEQRKIPANFMEETSEKGLVVSWSPQLEVLSHKSVGCFMSHCGWNSTMEALSLGVPMVALPQWSDQMTNAKFIVGCTASGDQSRG

SEQ ID NO: 6169 - protein, 453 aa, Medicago truncatula
MSGKKLHAVLIPLPIQGNINLLIKLAKILHLRGFYITFVNTEYNHKRLLKSRGPNSRNGFTDFSFETIPDGLTPIDGDGDVTQDINSLCKSIRNNFLQPFRELLARLYDYDWNMSFTIQVAEELSLPIVLFSPSNACTFLTCLHLPTLFEKCLIPLKDDSRLTNGYLETKVDCIPGLQNFRLKDLPDFIGITDPNYSIVEFINEAMNRNDVLNVLSSMFPCIYAIGPLSSFLNQSQQKHLASLGTNLWKEDTKCLDWLESNEPRSVVYVNFGSITVMTAEKLLDFAWGLANSKKPFLWIIRPDLVIGGSVVLSSEFVNEISDRGLVASWCLQEQVLNHPSIGGFLTHCGWNSTTESICAGVPMLCCPFFADQQANCRYICNEWEIGIKIETNVKREEVEKLVNELMSGDKGKKMRQKTIDLKMKAEEETRLGGCSYMNLEKVIKEVFLKQNQT

SEQ ID NO: 6170 - protein, 504 aa, Citrus unshiu
MTRGDSLVYATSAMISEASQFHFLLLPFLAQGHLIPMIDIARLLAQHGAIVTIVTTPVNAARFKTVLARATQSGLQIRLTEIQFPWKEAGLPEGCENIDMLPSIDLASKFFNSLSMLQLPFENLFKEQTPKPCCIISDMGHPWTVDTAAKFNVPRIIFHGFSCFCLLCMNLLRDSKVHENVASDSEYFKIPGLPDHIEFTRVQIPIPTHKRDDKKELREKIWAAEKKTYGAIINTFEEIESAFVEGCKKGKQGNVWCIGPVSLCNKESIDKVERGNKAAIDVPECLTWLDSQQPSSVVYVCLGSICNLKSSQLIELGLGLEASKKPFIWVTRVGSKLEELEKWLVEENFEERIKGTGLLIRGWAPQVMILSHPAVGGFLTHCGWNSSLEGISAGVQMLTWPLFADQFCNEKLIVKVLRIGVGVGVEVPMKFGEEEKIGVLVKKEDVETAINILMDDGEERDARRRRAKEFGELAQRALEEGGSSYNNIKLFIQDIMQQPSSEVI

SEQ ID NO: 6171 - protein, 362 aa, Cephalotus follicularis
MKKAELIFIPAPGIGHLVSTLEFSKRLIERDDRISITVLVMKFPTATFVDAYTKSLTASQPQIQLIGLPPVDPPPPTLMQKSVASYVCTFIESYIPHVKNVVKDIVTSSDSSSGSVRVAGLVLDFCCVSMIDVANEFGLPSYMFLTSNAGFLDLMLYLPTRHNQIGFEFEKTDPEILLPGFANPVPPCVLLDGLFNKQGGYSSCIKLAQRFKDVKGIIVNTFVELETYTVNSFSNAQIPPVYPVGPVLEDKRQPHPDLNQAEYDKIMKWLDDQPQSSVVFLCFGSRGSFEVPQVREIALGLEQSGCRFLWSIRVPPTKAEASVTSPYTNYKDMLPEGFLERIKGRGKTCGWAPQVEVLAHKS

SEQ ID NO: 6172 - protein, 394 aa, Unknown
  Description of Unknown: Oryza sativa Japonica Group sequence
MSTNDGVPSRRRPHALVVPLPSRGHLLPLLDFAHRLSTRHGVALTVAVTASDLPLLSAFLASTPLAAALPIHLPDASLHENSHHALLAVHLSAPRRRPPCPPLPGSPSFPYEHVPSVVRSYVAGDPDWELVREGFLLNSRAWGAVVNSFDEIEGEFLEYLNRFFGHGRVWSVGPVADSGCRGEERSSEAEQLFSWLDTCPSRSVVYVCFGSMYKPPPAQAAALGAALEASGARFVWEVGADAAVVPEGLEERTAARGRVVRGWAPQMEILRHAAVGAFLTHCGWNSTLEGVAAGVPLLAWPMKADQFIDARLVVDLHGAGVRAADGAGAVPYPGALARVFADAADAGKLADVRAKTSELAAAAAAAVEEGGSSWIAMEKMANELETAYLESVDR

SEQ ID NO: 6173 - protein, 490 aa, Hordeum vulgare
MAVHDEPLHILFFPFLASGHLIPIADMAALFAGRGVRCTILTTPVNAAIIRSAVHRANDSFAGTGSPAIDIAVVPFPDVGLPPGVENGTALASQDDRDKFFRAAQLLREPFDRFLADHRIDAVVSDSFFDWSADAAAERGVPRIAFLGSSMFARSCSDSMLRHNPLENAPDDPDALVLLPGLPHRVELRRSQMMDPAKMAWQWEYFKGVNAADQRSFGEVFNSFHDLEPDYVEHFQKTLGRRVWLVGPVALASKDMAVRGTDAPSPDADSCLRWLDAKPAGSVVYVSFGTLTKFAPAELHQLARALDLSGVNFVWVIGAAAGQDSAEWMPEGFAELIARGDRGFMVRGWAPQMLILSHAALGGFVTHCGWNSVLEAVSAGVPMVTWPRYADQFNNEKLVVELLKVGVSIGAKDYASGVEAHEVIAGEVIAESIQRLMESDGIQKKAKDLGVKARRAVEKVGSSYDDVGRLMDVLTARRSSVEVGEDIQAS

SEQ ID NO: 6174 - protein, 490 aa, Arachis duranensis
MGSLSTTEKPHAVCIPYPAQGHINPMLKLAKLLHFKGFHITFVNTEYNHKRLLKSRGPNSLNGLPSFRFETIPDGLPEPDVDATQDIPSLCESTRKTCLPHFKNLISKLNRNSEGADAQKAPPVTCIVSDGCMSFTVDAAEEFGIPEVLFWTTSACGFMCYMQYRHLVAKGITPLKDSSYITDGYLENTIDWIPGIKDIRLRDVPSFVRTTDPNDLMLDFLLGETKRASRGSAIVVNTFDALEHDVMEALSTILPPVYSIGPLNLLLNNVTDKDLKKIGSNLWKEEPECLEWLDNQEPNSVVYVNFGSITVMTSDQLIEFAWGLANSKKTFLWVIRPDLVAGDNAVLPSEFIEETKNRGLLSSWCPQEQVLAHPSIKGFLTHSGWNSTLESICGGVPMICWPFFAEQQTNCRFCCKEWGIGMEIEDVRRDRIENLVRELMDGKKGQEMKNKALEWKNLAVDAASSPNGSSLKNLDSMVNQILLSSKVAKK

SEQ ID NO: 6175 - protein, 494 aa, Beta vulgaris
MGAEPQRLHVVFFPLMAAGHLIPTLDIAKLFAAHHVKTTIITTPLNAPCFTKPLESYKNLGHRIDIEIIPFPSKEAGLPEGLENFDQFTSDQMAVKFLKATELLQESFEKFLEKHKPNCIVTDMLMPFTNNVAAKFNIPRIVFHGCSYFALCMMHTLLKYQPHKSLLSDDEEFLVPNLPHEINLTRSRLPDMMRGQGDKELNDAWMKIFIHAMEAEENSFGVIMNSFYELEPEYVEYYRNVMGRKAWHIGPVSLCNRENEAKFQRGKDSSINEHECLKWLDSKKPKSVVYICFGSLAEVPTLQLREIAMGLEASEQDFIWVVRRGKENVEEEKIEEWLPYDFEDRMEGKGLIIRGWAPQVLILDHEAIGAFVTHCGWNSTLEGISCGVPMVTWPVFAEQFYNEKLVTEVLKTGVAVGAKKWSRILEVNLKSEDIKNAIRRVMVGEEALVLRSKAKKLKELARKAVEIGGSSYSDMHSLIQDLSSYNANGYKQYL

SEQ ID NO: 6176 - protein, 477 aa, Oryza sativa
MEPNSKQSQTVVLHTILGAGHLAPMVELAKLFLGRGFAVIIAVPTPPASTADVAASSAPAVARIAAANPSISFHNLPPPDYPEPDPDGFQQLLDVIRLTVPILLTFLRSLPPVAAVVLDLFCVDALDAAAAVGVPAYFYFTSSAGVLAAFLHLPHYFATTEGDLKDMGKALLHFPGVPPIPASDMPHNVLDCADVIGASLVYHYRRMPEARGMLINTYEWLEAKAVTALGDGACVPDRPTPPVYCIGPLIVKGEDAAKGERHACLAWLDAQPERSVVFVSFGSMGAVSAEQLKEIARGLENSGHRFLWVVRSPPPEDPAKFSLPRSEPDLGALLPEKFLERTRERGMVVMSWAPQVEVLRHAATAAFVTHCGWNSILEAATAGVPMLCWPQYAEQRLNKVLVVDGMQLGVVMDGYDEELVKAEEVEKKVRLVMDSDEGKKLRGRLAMAKEMAAEALADGGPSCTAFSDFVDDLQRCK

SEQ ID NO: 6177 - protein, 484 aa, Zostera marina
MGEETNRTDKIVLYPSPGMGHLLPMVELAKVLIARNRLLEVTILVLRSPFSTGTTETLISSVMAANPLISFHFLPSLDLTDFLTSSFSHHESIQLELIRLSDPNVQLFMSSLHPMAFVVDFFCADSADIANGLGIPTYIFFTCCAATLAVLLYLPTMHSHTNQSFKDMGSTLVRFPEKTGIPAIPADHMPLPLLDREDHGYKTFIHLYERMAEVDGMIINTFDSLEGKTIQSLGTSGAFTRPIYPIGPLIISDRGQTQGESDFYCFKWLDKQPKGSVVFLCFGSLGTFSTEQLKEIADGIERSQERFLWVVKNPPNPSKKYVTNDPPNPDLDFLLPKGFLDRTQDRGLVVKSWAPQVKVLQHEAVGCFVTHLGWNSVLEAICAGVGMIGWPVYAEQRMNRVFVVDDMKLAMAVEGYDKDLVTAAAVEKSVREMMNKTGESGMGVGVKERCLAMKQAVEACLGDGGTSTLALDKLLRDWKVGKES

SEQ ID NO: 6178 - protein, 458 aa, Vitis vinifera
MTATASSMDRHVAVLGFPPHAATLLKLLRRLASAAPTTIFSFFNTAKANNSIFSPQSPHGLHNLRVYDVADGVPEGHVLSANPLERIDLFFKATPGNFYDAIQVAEAEIGRKISCLVSDAFLWFTADMAEEMRVPWLAIWTSALCSLSVHIYTDAIREAVKVVGRVQDQTLDFIPGFSAIKVEDLPEGIVFGDIESPFACMLHKMGLTLPRATAVATNSFEELEPIVTNDPKSKLQKVLAVGPFDLSSPPQLILDASGCLPWLDNKKEASVAYVSFGSIATPPPNEIVALAEALEATGIPFLWSLREHAMDNLPKGFLERTTAHGKVVSWAPQPQILAHASVGVFITHSGWNSVIESIVGGVPMICRPFFGDQCIDKRMVEDVWGIGVGVEGGVLTKSGVMSALGLILSHEGNKMREKIRVLKELARRAVEPNGSSTQNLSNLLEVITTSKLHLDTNK

SEQ ID NO: 6179 - protein, 389 aa, Coffea canephora
SEVPPVSCVISDAGMSFGIKAAEDLGIPEVQFWTASACSFIGYLHYRELIRRGIFPFKNDDYLTDGTLDKPVDWICGMSNIKFRDLPSFFRTTDPNDIMFDFLGEVAQSCLKAPAIIFNTFDELEREALEAVISKFDFPNIYTIGPLHILARHIVTESQVNSLNSSLWKPDSKVFEWLDQRAPNSVFYVNYGSITTMTDHHFKEFAWGLANSQQQFLWIVRPDVVQGGESAMLPEDFLEEIQDRGLLTSWCAQDKVLEHPAVGAFLTHCGWNSTLESISAGVPLICWPFFGDQQTNCHYSCKKWGIGMEINHDVKRNEVAELVRKMIIGEEGGEMRFKAKEWKKKAEEATEVGGSSYINFDKFIIEALHYNGCAAQNVSPVAKKKNGLY

SEQ ID NO: 6180 - protein, 469 aa, Scutellaria baicalensis
MGQLHIVLVPMIAHGHMIPMLDMAKLFSSRGVKTTIIATPAFAEPIRKARESGHDIGLTTTKFPPKGSSLPDNIWSLDQVTDDLLPHFFRALELLQEPVEEIMEDLKPNCLVSDMFLPWTTDSAAKFGIPRLLFHGTSLFARCFAEQMSLQKPYKNVSSDSEPFVLRGLPHEVSFVRTQIPGYELQEGGDDAFSKMAKQMRDADKKSYGDVINNFEELESEYVDHYKNVFGKKAWHIGPLSLCNNRAEQKSPIDDHECLAWLNSKKPNSVVYMCFGSMATFTPAQLHETAVGLESSGQDFIWVVRNGGENEDWLPQGFEERIKGKGLMIRGWAPQVMILDHPSTGAFVTHCGWNSTLEGICAGLPMVTWPVFAEQFYNEKLVTEVLKTGVSVGNKKWQRVGEGVGSEAVKEAVERVMVGDGAAEMRSRAIYYKEMARKAVEEGGSSYNNLNALIEELSAYVPPMKQGLN

SEQ ID NO: 6181 - protein, 477 aa, Cajanus cajan
MGNDVVHVLLVSFPGQGHVNPLLRLGKWLASKGLLVTFCTPQTWGKQMREGSDISEEAVGEGFLRFECFEDGWSDDDPRRQDLEQYLPQLEKAGKQALPSMIRRHAQKGPPVACLINNPFIPWVTDVAESLSLPSAMLWVQSCASFSAYYHYHHKLIPFPSQAQPHLDVQLPCMPLLTHHQVPTFLHPSTPEPFLGRAILQQLSNLEKTSCILMDTFQELEADVLDYMSKICHVPIKTVGPLFKASESVHGESECMIKWLDSKEASSVVYVSFGSVVHLKQEQVDEIAHGLLESGLCFLWVMKPPQKHSGKEAHVVPHGFLEKAGNKGKVVQWCRQEQVLGHPSISCFLTHCGWNSSVEALTFGVPLVAFPQWGDQVTNAKYLVDVFQVGVRMCWGEAANELIKRDEVMRCLFEATLGPMKQNALNFKAAAEAAVAQPAGSSHRNMDAFVDQLSKRSLQILKNYANAASLNSPSLPI

SEQ ID NO: 6182 - protein, 482 aa, Catharanthus roseus
MGSQETNLPPHVLIFPLPIQGHVNSMLRLAELLCLAELDITFIVSEFSHSRLIKHTNVASRFARYPGFQFQPISDGLPDDHPRAGERVMDILPSTKNVTGPLFKQMMVENKCFSSATRRPITCIIADGVLSFAGDFAQEKGIPLIYFRTVSACSFWACFCMPELIESGDIPIKGNGMDLIVKSVPGMETFLRRRDLPGFCRVNDINEPKLQILKTETRQTTRAQAAILNTFEDLEGPILSQIRKHMPRLFTIGPSHSHLTSRLETKNIKTLISSGSFWEEDRSCVDWLDAQPPRSVLYVSFGSITVVTRDQLLEFWYGLVNSGQRFLWVMRPDSIMGKDGQSQIPADLEEGTKARGYMVGWAPQEEVLNHPAIGGFLTHSGWNSTLESIVAGVPMICWPYFADQMINSRFVSEIWKIGLDMKDTCDRETIVKMVRELMEIRKDEFLQRADHMAKLAKEAVSEGGSSYSNLDGLVDYIKSLII

SEQ ID NO: 6183 - protein, 455 aa, Theobroma cacao
MEKKAYRAHVLALPYPSQGHVNPMLQFSKRLASKGIKATFATTLFISHTMKPESLGSVEFDTISHGCDQGGFSEAESIHDYLKRLEAAGSKTLADLIIKYKNSPHPFDCVIYDSFLPWALDVAKQFGLVGAAFFTQACAVNYIYYYAHHGLLSLPVSSEPVSIPGLPLLQLRDMPSFIYVAGSYPFYFELVLSQFSNSDKADFVLVNTFYKLEHEAVESMSKVSPLLTIGPTIPSMYLDQRVETDEDYDLNLFKLDSSSSTEWLSTKPPGSVVFVSFGSMANLSVKQMEELAWGIKQSNFYFLWVVRSSEEAKIPNKFVQEMGDKGVIANWIPQMQVLANESVGCFFTHCGWNSTIEALCLGVPMVAMPQWTDQTTDAKFVEDVWKVGVRVEVDENGIVNRDEIEYCIRQVMEGETGKVMKENAKKWKQLAIEAVSEGGSSDKNINEFVSKLTRT

SEQ ID NO: 6184 - protein, 477 aa, Populus tomentosa
MEEALVLYPSPPIGHLVSMVELGKLILTHRPSLSIHILIAASPYVAGKADKYMATVSADIPSIDFHHLPIVTPVSTNITHHEELTLEVLHLSKPHVHEELLNISKRYKIHGLVMDFFCTSGLSVATELDIPSYFFLTSGACFLAFFLHLPTLHQKTSKSFKDMKDHYLDIPGLPPRLATDLPNPFLDRDNQAYQHFLDFATQFPRASGIMINTFELLESRAVKAISDGLCVPNNRTPPISCIGPLIVADDKRGGSGKISPEDVHECLSWLDSQPSQSVVFLCFGSLGLFTKEQLWEIATGLENSGPRFLWVVRNPPSHNLKVAIKEQGDPDLDSLLPEGFLERTKERGYVVKSWAPQVEIVNHSSVGGFVTHRGWNSTLEAVYAGLPMVAWPLYAEQRLNRVALVEEMKLALSMNESADGFERADEVEKKVRGLMESKEGKMIRERALAMKNEAKAALSEGGSSHVALSKLLESWKH

SEQ ID NO: 6185 - protein, 449 aa, Barbarea vulgaris
MRSKFHAFMYPTFAFGHMIPYLHLANKLAEKGHTVTFLLPNKAQQQLQPLNLFPDRIVFHPLTLPPVDGLPVGAETLSDLQNTTGRVISDAMDLLRGQIEAKVRALKPDLIFFDFVYWVPEMAKEFGFKSVSYQIVSAACVAMFLAPGAELGLPTPDYPSSKVTLRGHDANVCSLFTNSSQRMFGRITTGLKNCDVISIRTCAELEGELCGFIERQCQRKVLLTGPMLPEPQEKSGKPLEGRWNHWLNGFEPDSVVFCAFGTQFFFEKDQFQELCLGMELTGLPFLVAVMPPRGSSTIQEALPEGFEERVKGRGIVWGGWVEQPLILSHPSVGCFVNHCGFGSMWESLLSDCQIVFIPQLADQVLITRLLTEELEVSVKVQREDSGWFSKENLRDTIKSVMDKESEIGNLVKRNHLKLKETLASPGLLTGYADSFVEALENEVNNTKPF

SEQ ID NO: 6186 - protein, 470 aa, Hevea brasiliensis
MNKAQAQLVFVPIPVMGHLVSTVEVAKLLLTRDHRLSITVLVLELPLTNSKVQNYVESVQDSSSTLSNRLRFIDLPKDGSELFDLSSFFERQKPNVKDAVLKITQSESSVDSPRLAGFVLDMFCTPMIDVANEFGVPSYFFCTSGAAFLGFVLYEQKIHDEAEFDAIQFKDSDTELLVPCLINPFPARSTPSAMLNKERLPYLRNAARRFREAKGIIVNTFLELESHAIESFETPPLYPVGPILNVELDGRNSHQEIMQWLDDQPVASVVFLCFGSMGSFGEDQLKEIACALEHSGHRFLWSIRRPPPPGKQAFPTDYEDPQEVLPEGFLERTAAVGKVIGWAPQVAILAHPAVGGFVSHCGWNSVLESIWFGVPIATWPMYAEQQFNAFEMVTELGLAVEIKMDYRNDSGVIVNCNEIERGIRSLMEHDSKKMKKVKEMSEKSRRALMDGGSSYCCLGRLIKNFMDDLT

SEQ ID NO: 6187 - protein, 471 aa, Oryza sativa
MPSSGDAAGRRPHVVLIPSAGMGHLVPFGRLAVALSSGHGCDVSLVTVLPTVSTAESKHLDALFDAFPAVRRLDFELAPFDASEFPSADPFFLRFEAMRRSAPLLGPLLTGAGASALATDIALTSVVIPVAKEQGLPCHILFTASAAMLSLCAYFPTYLDANAGDGGGVGDVDIPGVYRIPKASIPQALHDPNHLFTRQFVANGRSLTSAAGILVNTFDALEPEAVAALQQGKVASGFPPVFAVGPLLPASNQAKDPQANYMEWLDAQPARSVVYVSFGSRKAISGEQLRELAAGLETSGHRFLWVVKSTVVDRDDAAELGELLGEGFLKRVEKRGLVTKAWVDQEEVLKHESVALFVSHCGWNSVTEAAASGVPVLALPRFGDQRVNSGVVARAGLGVWADTWSWEGEAGVIGAEEISEKVKAAMADEALRRKAASLAKAAAKAVAGGGSSHRCLVEFARLCQGGTCRTN

SEQ ID NO: 6188 - protein, 524 aa, Spodoptera exigua
MEKLKCLLFCIVVSLCSCDGYKILVVFSTPNPSHGILGDNMVRHLLNAGHEVTYLTPYIETQNNKTNNLHLIDVSNTQNISEETKDILDFKQIIKGTVDLPDFKLMFELVSKIGDMILGNPNVQKLLKDPQQKFDVIISEYMFHGLFSTFSAVFQCPYIWFSTIEPHWIALNLVSGPMNPAYNGDYLQGRIPPFSFMGRVQELWTQMKGLYYYKYDFHYTEEAIYQKQIVPILKDQGKPVPDYNLLKYDASLMLGNSHVAIGNAVPLPPIYKHIGGYHINEEVKPLPESLKKIMDSAKNGVIYFSMGSNLKSKELPDDLKQGLLEVFRGLKQTVIWKFEENLPDQPKNVHIVQWAPQQSILAHPNLKLFVTHGGLLSLTEAVYFGVPIIVIPVFADQFLNANQARNKGFAERVDPSHHLHKDLKVALDKVLGDFNRYSGRAKEVSAAYHDNPIKPGVALNFWVEHVVRTRGAPHLRLVALQVPLYQQAYLDLLAVLLAAAIAILLVVRRILSLLTSKRTKLKKN

SEQ ID NO: 6189 - protein, 479 aa, Arabidopsis thaliana
MKIELVFIPSPAISHLMATVEMAEQLVDKNDNLSITVIIISFSSKNTSMITSLTSNNRLRYEIISGGDQQPTELKATDSHIQSLKPLVRDAVAKLVDSTLPDAPRLAGFVVDMYCTSMIDVANEFGVPSYLFYTSNAGFLGLLLHIQFMYDAEDIYDMSELEDSDVELVVPSLTSPYPLKCLPYIFKSKEWLTFFVTQARRFRETKGILVNTVPDLEPQALTFLSNGNIPRAYPVGPLLHLKNVNCDYVDKKQSEILRWLDEQPPRSVVFLCFGSMGGFSEEQVRETALALDRSGHRFLWSLRRASPNILREPPGEFTNLEEILPEGFFDRTANRGKVIGWAEQVAILAKPAIGGFVSHGGWNSTLESLWFGVPMAIWPLYAEQKFNAFEMVEELGLAVEIKKHWRGDLLLGRSEIVTAEEIEKGIICLMEQDSDVRKRVNEISEKCHVALMDGGSSETALKRFIQDVTENIAWSETES

SEQ ID NO: 6190 - protein, 561 aa, Citrus unshiu
MYILYAHQGHIIPMIDTTRLLAQHGAAITIVTTPANAARFKTVVARAMQFGLPLQLIEIQFPYQEAGVPEGCENFDMLHSTDLVSNFFKSLRLLQLPLENLLKELTPKPSCIVSATCYPWTVDTAARFNIPRISFHGFSCFCLLCLYNLPTSTVQENVTSNSDYLVVPGLPDQIEMTKVREKWKDFGEMVLAADMKSYGIIINTFEELESEYVKECTKTKGRKVWCLGPVSLCNKQDIDKAERGKKAAVDISECLNWLDSWPPNSVVYVCLGSICNLTSSQMIELGLGLEASKKPFIWVIRGGNNTSKEIQEWLLEEKFEERVKGRGILILGWAPQVLILSHPSIGGFLTHCGWNSSLEGISAGVPLITWPLYGDQFWNEKLIVQVLNIGVRIGVEVPLDFGEEEEIGVLVKKEDVVKAINILMDEGGETDDRRKRAREFQIMAKRTTEETGSSSLMIKLLIQDIMQQRHVLNIGERIGVEVPLDFGKEEEIGVLVKKEDVVKAINILMDEGGERNDRRKRGREFQIMAKRATEETGSSSLMIKLLIQDIMQPPHGDDQHI

SEQ ID NO: 6191 - protein, 213 aa, Cephalotus follicularis
CLTWLDSQPSQSVVYLSFGSMGRFSLKQLSETAIALDASGVRFLWVVRNPLPDNGSQPLLGAEEPSLEEFLPEGFLDRTKDRGFVVKSWAPQVKVLNHDSVGGFVTHCGWNSTLEAVSAGVPMLAWPLFAEQKITRTFLVEEIKVALSVAESRDGFVNADDLKIRLTELMDSEEVKAMRERILAMKDRAVRATSDGGSSRVALAKLAATLQTR

SEQ ID NO: 6192 - protein, 478 aa, Nicotiana tabacum
MKTTELVFIPAPGMGHLVPTVEVAKQLVDRDEQLSITVLIMTLPLETNIPSYTKSLSSDYSSRITLLQLSQPETSVSMSSFNAINFFEYISSYKDRVKDAVNETFSSSSSVKLKGFVIDMFCTAMIDVANEFGIPSYVFYTSNAAMLGLQLHFQSLSIEYSPKVHNYLDPESEVAISTYINPIPVKCLPGIILDNDKSGTMFVNHARRFRETKGIMVNTFAELESHALKALSDDEKIPPIYPVGPILNLGDGNEDHNQEYDMIMKWLDEQPHSSVVFLCFGSKGSFEEDQVKEIANALERSGNRFLWSLRRPPPKDTLQFPSEFENPEEVLPVGFFQRTKGRGKVIGWAPQLAILSHPAVGGFVSHCGWNSTLESVRSGVPIATWPLYAEQQSNAFQLVKDLGMAVEIKMDYREDFNKTNPPLVKAEEIEDGIRKLMDSENKIRAKVMEMKDKSRAALLEGGSSYVALGHFVETVMKN

SEQ ID NO: 6193 - protein, 484 aa, Polygala tenuifolia
MDFDRSNSKPHVAILASPGLGHLIPVIELGKRFVTQHNFNVTLFVAPSPTSKAEAQQLQSATTPKIFDIVELPPIDISNIIEPGAAVVRVLRVIMREIRQSLRSAISNMQSLPNALIVDLFGTESMSIAEEFNMLKYIFLPANASFLALTIYTPFLDKQVEGEYEEQKEVLRIPGCSPVRPEDVVDPMLDRSNLQYHEYVQMGVEMAQGHVDGFLLNTWEDLQPKEMKAFRDDNQLGRIVKAPVYPVGPLVRPSGSSGRSSARKLFDWLDIQPSKSVIYVSFGSGGTLSYQQVTEIAWGLELSQKRFVWVVRPPSSDSTDAAFFHGGGDNRDPCTYLPEGFTKRTQHVGIVIPMWAPQMDILSHPSIGGFLSHCGWNSTLESLLNGVRMIAWPLYAEQRLNARLLTDGLGVAVQPKELPVKREVGREEIEEMVRKVMEDGKDGIRSRVNELKNGAQKALCKGGSSYDALYLIVKQCEQKLQIVE

SEQ ID NO: 6194 - protein, 453 aa, Cephalotus follicularis
MRESPRHVAVLAFPFATHAAPLLALVRRISKAAPAVKFSFFSTAQSNAANFARSHDDENEAIKPYNVHDGLPEVYVFKGNPHEPVSYFLEATPGNFRSAMEAAVAETGLEITCLMTDAFYWFAAEMAEAMGVPWVPLWTAGPRALFVHVDAPVIRQHMGINVEHGLFAAPEDRTLDFLEDFATTRVADLPDGIISGCTETPMLQMLDRVGVMIPRATAVAMNSFEELDPTVINILKSRFKKLLNVGPFILTSPSSAAIPDEHGCLQWLDKQKPASVAYISFGSVITPPPNEVEALADAMEASGFPFLWSFRGNAEEKLPKGFIERNRAKAKVVPWAPQLQVLLHSSVGVFVTHCGWNSILESMNGGVPMICRSFFGEQPLNKRTVEVVWKTGLGVDQFTKDGTMKALKVILSSEEGKKMRERIGVQRELAVNAVQSDGSSTENFKTLVQTVTN

SEQ ID NO: 6195 - protein, 320 aa, Helianthus annuus
MDLRTGDTHDHLKRGFEGLQQEVTWFLEEESPDWIIYDFAPYWLPSVADGLGISHAHFSIVTPWFIAFWGALTDDLINGSDERMLAEDLMTPPKWVPFPSKLCYREHKANLIMCHYSSNASEVSDAYRLWMILKGSDCMFMRYCYELEPQWLTLLEKLHELPVVPVGLLPPTNIGDEKDETWVMVKKWLNGQQKGHVVYVAIRSEIMVSKSELVELDLGLKLSGLPFFWTLRKPAGSTESDSMELPDRFLERTRDRVVVWTSWVPQLQVLSHESVGGFLIHCGWSSNVEGLMSGHPLIMLPFLVDLGLIARIPVDKQVEV

SEQ ID NO: 6196 - protein, 456 aa, Withania somnifera
MTTHKAHCLILPYPGQGHVNPMLQFSKRLQSKSVKITIATTKSFLKKMQKLPTSISIEAISDGYDDDGLDQARSYAAYLTRFKEVGSDTLSQLIEKLANSGSPVNCIVYDPFLPWVVEVAKNFGLAIAAFFTQSCAVDNIYYHVHKGVLKLPPTQVDEEILIPGLSYAIESSDVPSFESTSEPDLLVELLANQFSNLEKTDWVLINSFYELEKHVIDWMSKIYPIKAIGPTIPSMYLDKRLPDDKEYGLSMFKPITDACINWLNHQPINSVLYVSFGSLAKLEAEQMEELAWGLKNSNKNFLWVVRSAEEPKLPKNFIEELPSEKGLVVSWCPQLQVLEHESIGCFMTHCGWNSTLEAISLGVPMVTLPQWSDQPTNTKLVKDVWEMGVRAKQDDKGLVRREVIEECIKLVMEEEKGKVIRENAKKWKELARNAVDEGGSSDKNIEEFVSKLVTIS

SEQ ID NO: 6197 - protein, 476 aa, Helianthus annuus
MATTETDSLHGRKQLHVAMFPWLAFGHILPFLELSKFIAQNGHKVSFLSTTRNIQRLPTLPSHLSPLINLVKLTLPHVQELPQNAEATMDLRTGETHDHLKRAFDGLQPEVTRFLEEESPDWIIYDFAPYWLPSVAAGLGISRAHFSIVTPWFIAFLGASADDLINGSDDRTTAEDLMAPPKWVPFPSKLCYRKHEANLVMCHYSSNASEVSDAYRLGMILNGSDCMFMRYCYELEPQWLTLLEKLHQLPVVPVGLLPPTNIGDEKDETWVTVKKWLDSQQKGHVVYVALGSEFMVSKSELDELALGLELSGLPFFWALRKPVGSTELNSVELPNGFLERTRDRGVVWTSWVPQLQVLSHESVGGFLTHCGWSSTVEGLMFGHPLIMLPFLVDQGLIARILVDKQVGVEVPRNEEDGSFAKESVARSVRSVVVDDEGKIYKANAMAWSNVFGDTKLQKKYIDDFIDYLEKKRRVVA

SEQ ID NO: 6198 - protein, 286 aa, Dichanthelium oligosanthes
MPVVELPPYRVRDLMHVGKDGHELMREMMARAVAAVKASSGLILNTFDALERRELEGLRRDLAMPVFDIGPLHKFSPAGDSSLVRPDRSCLEWLDAWPPASVLYVSFGSLACISPQDLVETAWGIADSGVPFLWVVRPGMVGGSAHQELPEGFEAATRGRGMVVAWAPQEEVLRHRAVGGFWTHNGWNSTMESICEGVPMLCRPSFGDQMGNARYVEHVWRVGFEVDGELERGSVEAAIRRLMTDKDGGEMRARAGELKKAAAECTGKGGSSCLAIDKLVTYLLSL

SEQ ID NO: 6199 - protein, 474 aa, Medicago truncatula
MAKTIHIAAISIPAFSHQASIIEFCKKLIHHHNHFHITIIFPTIDSPLQATLTLLKSLPSNITYTFLPPINKKSLPQNLSPAVQIQLAVSQSMPSFHTTISSLCSSSTTPPLVALITDPFANESLEVLKEFNLLSYIYFPPSAMTLSLFIHFPKLHEEISCEFRDHNEAIQIPGCVPIHGIDLPEHFQDRSSLAYDLILQRCKRFNLADGFLVNSFLKMEENTMKALEEHNDSVFLVGPIIQNGTSNETKVSDSDLECLKWLKNQSTNSVLFVSFGSGGTLSQEQVNELAFGLELSGQKFLWVLRVPSDSSNEAYLGAKNDDDPLNFLPKGFLERTKGQGLVVPNWAPQTQILSHGSIGAFLTHCGWNSVLESVVLGVPMIAWPLFAEQKINAVLLCDGVKVAMRLKFNEDGLVGRDEIAKVVKELMLDDEGNVIRERIEELRDAAIDALKEDGSSTLAICQFGNRLESNGTNL

SEQ ID NO: 6200 - protein, 476 aa, Glycine max
MDLQQRPLKLHFIPYLSPGHVIPLCGIATLFASRGQHVTVITTPYYAQILRKSSPSLQLHVVDFPAKDVGLPDGVEIKSAVTDLADTAKFYQAAMLLRGPIAHFMDQHPPDCIVADTMYSWADDVANKLRIPRLAFNSYPLFAVSAMKSVISHPELHSDTGPFVIPDFPHRVTMPSRPPKMATAFMDHLLKIELKSHGLIVNSFAELDGEECIQHYEKSTGHKAWHLGPACLVGKRDQERGEKSVVSQNECLTWLDPKPTNSVVYVSFGSVCHFPDKQLYEIACALEQSGKPFIWIVPEKKGKEYENESEEEKEKWLPKGFEERNREKGMIVKGWAPQLLILAHPAVGGFLSHCGWNSSLEAVTAGVPMITWPVMADQFYNEKLITEVRGIGVEVGATEWRLVGYGEREKLVTRDTIETAIKRLMGGGDEAQNIRRRSEELAEKAKQSLQEGGSSHNRLTTLIADLMRLRDSKSAT

SEQ ID NO: 6201 - protein, 486 aa, Medicago truncatula
MSSSDESFVAHVAFLPSSGLGHLNPCLRTAELFLRYGCKITLITPKPTISLAESDLITQFCSSFPSSQLTQIDLNLIPLDPSINVNTVDPFWLQFETIRQSLHRLLPSILTKLSSSPSSSSPLSALIYDVSLISPLVSIMESFTFPSYIYFIAPARMFSFFAYLSVLSEKSNDGKHFSCIGDAVEIPGIAPIPKSSLPPLILQPNSLFEKILMEDSPKLRKLHGIFMNSFEDLEAEALAALNDGKVVPGLPPVHAIGPLVPCEFEKVRCSTNNCTDSVLKWLDEHPKGSVVYVCLGNKTSTRRDQIKDMANGLMSCGYKFLWVVKLKVVDKEEEEELENVLGNEMMKKVNEKGMVINKWVNQMEILGHPAIGGFVNHGGWNSIVEAIWHGKPILSWAHDGDQKIASEVVQISGVGVWPEEWGWGKQNLVKGEEISKVIKEMMSSESLRIKAGKMMEVARKAASVGGSIEVVIKKQIEEWKMNFQSI

SEQ ID NO: 6202 - protein, 482 aa, Brassica napus
MEESKAPHVAIIPSPGMGHLIPLVQFAKRLVHRHGVTITFVVVGDGPPTKAQRTVLDSLPPSISSVFLAPADLTDLPPTTRIETRISLTVTRSNPELRRVFDSFAAEGRLPTALFVDLFGTDAFDVAAEFNVLPYIFFPTTANVLSFFLHFPKLNETMSCPFSELTELVNLPGCVPVSGKDVLDPAQDRNDDAYKWLLHNTKRYKEAEGILVNTFLELEPNAIKALQEPGLDKPPVYPIGPLVNVGKQESSNGIEEESECLKWLDNQPLGSVLYGSFGSGGALTCEQFDELAHGLADSEQRFLWVIRSPSQIADASFFNPHSQNDPLTFLPPGFLERTKGRGFVIPSWAPQAQILAHPSTGGFLTHCGWNSTLESIVSGVPLIAWPLYAEQRMNAVLLAEDIHVALRAHAGEDGMVRREEVARVVKGLMEGEEGKGVRNKMKEMKEGASRVLNDTGTSTKALNLVTFKWKAHQRELKQNGKH

SEQ ID NO: 6203 - protein, 490 aa, Unknown
  Description of Unknown: Oryza sativa Japonica Group sequence
MGATGDKPPHAVCVPYPSQGDITPTLHLAKLLHARGFHVTLVNTEFNHRRLLASRGAAALDGVPGFVFAAIPDGLPAMSGEHEDATQDIPALCQSTMTNCLGHLLALLSRLNEPASGSPPVTCLVADGLMSFAYDAASACGFVGCRLYRELIDRGLVPLRDAAQLTDGYLDTVVDGAAARGMCDGVQLRDYPSFIRTTDLGDVMLNFIMREAERLSLPDAVILNTFDDLERPALDAMRAVLPPPVYAVGPLHLHVRRAVPTGSPLHGVGSNLWKEQDGLLEWLDGHRPSSVVYVSYGSIAVMTSEQLLEFAWGLADSGYAFVWVVRPDLVKGGEGDAAALPPEFHAAVEGRGVLPAWCPQEKVLEHDAVGVFLTHSGWNSTLESLAAGVPMLSWPFFAEQQTNCRYKRTEWGIGMEIGGNARRGEVAAMIREAMEGKKGREIRRRAQEWKEKAVRVTLPGGPGDTNLDRVIHDVLLSCKDKISRVNGESV

SEQ ID NO: 6204 - protein, 464 aa, Helianthus annuus
MPKPHVLVIPYPAQGHVIPIMELAQRLAKHRVRVTCINTEVNHKLVTGNCLDKDGLGDVVQMVSIPDGLEPWEDRSDIRKLTLSILQTMPRKLEELIETINKEDSSKVTCIIADGFMGWAIRVAKKMGISSAAFWPASVATLASFLSFQKLIDDGIINKNGIPLSDEMIQLSETMPPIKPQNLTWACFEDSALVEVIFKMVLQAEEASRLTEWFICNSCPELEAAAFSLYPQLLLIGPLLASNRLAVQAGHFWQEDSTCLAWLDQQPVSSVIYVAFGSFTMFNQTQFEELAHGLELSNRPFLWVVRPGMTKETTTDYPEGYIERIGSRGKILSWAPQQKVLSHPSVACFMSHCGWNSTLEGVTNGVPFLCWPYFADQFHNETYICDIWKNGLGLEKDEVGIITRGEIMSKVEKLLSDKTLKVKASDIKEKVASKGGCSHKNLNNFIEWIQKNNDAHTKDEPESM

SEQ ID NO: 6205 - protein, 495 aa, Helianthus annuus
MALEQSQELIQLHFLVIPMGSPGHYIPTIDMAKLLAQHGVQVTIVATPVNALRFGSILDQAIQSGLPICFLEFQLPYKEFGLPEGCESLDDLPNMGMTGALMQAYRSLQTQVEQYIEKLDPRPNCILADTFLLWTGETAKKFQIPRIIFDGMNCLTQMCNHVLYFSKVYESVGESESFVLPGLPDHIELKRSQLPFAFSSSHEAVIDFHEKLRASESEAYGVVVNSFEELEQGYVDEYQKVKGDKVWCIGPLSLCHKDESEKVQRGNKSSVNKDECLKWLDSQENGSVIYACLGSISRVEPAQLIELALALESSKRPFIWVVRAGHKTEKIEKWIDEEGFGERTKDRALLIHGWAPQLLVLSHPAVGGFLTHCGWNSILEGVSAGVPLVTWPQFQEQFYNEKLVVQVLRTGVSVGAQKISELWVDEDKSGELVKSEAFLNAIEMVMEEGKEGEERRKRAKELGKIADKAIEDGGSSHRNMTRLIEDIKNQANIGK

SEQ ID NO: 6206 - protein, 223 aa, Citrus unshiu
MSMPNPDLDEAQYQKIFQWLDDLAESSVVFLCFGSSGSFDVAQVKEIAIGLERSGYNFLWSLRVSSPKDEVSAHRYVTNNGVFPEGFLERIKGRGMICGWVPQVEILAHKAIGGFVSHCGWNSILESLWYGVPIATWPIYAEQQLNAFRMVKELGLALDLRLDYRVGSDLVMAGDIESAVRCLMDGENKIRKKVKEMAEISRKSLMEGGSSFNSIGQFISLNF

SEQ ID NO: 6207 - protein, 490 aa, Centella asiatica
MVRAELIFIPAPGVGHLLSTVEVAKLLVSRDSRLSISILIMKLPMDTGINAFIQSLEKDTTDGIVFRELPALDEIVISALMPKPGISFLPSFVESQRTNVRDAVAAILNGSESSRLAGFVIDMFCTPMVDVADEFGVPSYVFFTSGAAFLGLMFYAQSLKDDDNHDICEYKDSEVELSIPSYFNPVPAKVLPTVMLSKEGSAVVTSIARMFRRTKAIISNTVLELEAHAIKSLADDGKIPRIYHVGPIISFKRGDDGSKSLNQNSEEAIISWLDKQPPSSVVFLCFGSMGSFEKDQVTEIACALELSGHRFLWSLRRPSKVKEKIEMPKEYENFDEVLPEGFLERTTEIGKVIGWAPQVAILSHPSVGGFVSHCGWNSTLESIWSGVPMATWPLSAEQQINAFELVKELGVAVEIKMDYRKEPFVDCEPTLVPAEVIESGIRCLMDGEGEKVREKMKEMKNNCRKATLEGGSSHISLGNFIDDIMDNIHE

SEQ ID NO: 6208 - protein, 1103 aa, Citrus unshiu
MHPMRICIPSPFQSHIKAMLQSAKLLHHKGFHITCVNTEFNHRCFLKSRGHHSLDGLPNFRFEAIPDDGLPASSYESSTTQDMYSLCENIINDVLLQPFLDLLAKLSDSSNNVNPAVSCIISDDFMAFTITAAQRLGLPSALFFTISACSFKGLKQFQTLKEKGLFPLKDESCLKKEGLEREEIKMESKPKACSKVHAVCIPSPFQSHIKAMLKLAKLLHHKGFHITFVNTEFNHRRLLKARGQHSLDGLPSFRFEAIPDGLPASSDESPTAQDAYSLDGFLPFTITAAQQLGLPIVLFFTISACSFMGFKQFQTFKEKGLFPVKDKSCLTKEYLNSLIDWIPGMKDIRIRDLPSFIQSTDPKDMMFNLCVEATENASKASAIIIHTFDALEQQVLNALSFMFPHHLFTIGPLQLLLNQTEEQDGMLNSIGYNLLKEETECLQWLDCKEPKSVIYVNFGSFIFMNKQQLIEVAMGLVNSNHLFLWIIRPDLVTGETADLPAEFEVKAKEKGFVASWCPQEEVLKHPSIGGFLTHCGWNSIVESLCNGVPMICWPFTGDQPTNGRYVCNEWRVGMEINGDDEDVIRNEVEKLVREMMEGEKGKQMRNKAMEWKGLAEEAAAPHGSSSLNLDKLEVKMEGCDYTYRGHAVCIPCPFQSHIKGMLKFARLLHLKGFHITFVNTEFNHRRYLKSRSSPRHNSNLENALLNFQYETIPDGLPDPSNENANQDANSLFESITNNVMLQPFLDLLQKLKSSSNSVNCIISDGFMPFTVTAAQQLGIPIALFFTIAARSFKGCMQLRTLEENTTLTSLIDLNSYATRVAIEAAKNAAKASAVVIHTFDALERQVLDALSAVFPNLFTIGPLQLLLNQINEQVGNSLSSTGYKYNLWKEETECLQWLDSKELPNSVVYVNFGSSVYLTKQQLTEVAMGLVNSNRPFLWIIRPDLVTGETADMPSEFEVKAKETGFIARWCPQEEVLNHPAVGGFFTHSGWNSTIESLCAGVPMICWPFLGDQTTNCRYTCNEWGVGMDITNSGDDNQVGRNEVEKLVGELMEGEKGMQMRNKASEWKRFAEEAAAPDGSSATNLEKLVNQVLLSKGLIPSKN

SEQ ID NO: 6209 - protein, 480 aa, Helianthus annuus
MAHKQLHVAMLASPGAGHLLPILLLGHRLATHHNLRVTVLAVTATASHSLSQLITSLTTHNHLSVIQIPAADVSGVAPPDAQVILQLCVMMRETIPAIRTTISALDSRPHVLVGDIFAIESCVIAEELGIPKYVFVTGNAWFTALFTYSPVLDKLVVGEYVDQKEPLEIPGCKPVRPEDVTDPLPNRYDETYNVYLDYAVRVTLADGLLINTWEDLEPQSLDALRTNEILRSVVKYKPVYTVGPVNKRYEPELVVLKDGVIEWLDKQPNRSVIYVSFGSGGTMSAEQIKELAWGLELSRQRFVWVVRPPTGHRPDGSFFSDGQSDATFDYLPEGFLTRNKHVGFVVPSWAPQMEILNHTSVAGFLTHCGWNSVLESLTSGVPMIAWPLYAEQKMNAAMLTEELKVAMRPEVSPTEKVVDREQIARMVMNLVEGEEGKAMKMKVDILKDGTDKAISENGSSYLSIYNGNRWIRGIITHGTT

SEQ ID NO: 6210 - protein, 460 aa, Panicum hallii
MANSHTSSIHVLLLSYPAQGHINPLLQLGKRLAAHRGVRCTLAVTRYVLGQSKPQTGAVHVAAYSDGCDTGGYDEAGDAEAYLSRLESAGSASLDELLRAESAGGRPVRAVVYDSFLMWVPRMARRHGAACAVFFTQACVVNVAYAHAWAGQMDLPVAPGKALPELPGLPAGLGPADFPTFLTEPDGGCLAYLDLVLQQCQGFEVADHVLVNSFYELEIKEAEYMASRWGAKTVGPTVPSAYLDNRLTDDVSYGFHLHTPMTEESKAWLDARLPRSVVYVSFGSLAAPSAGQMAEVAEGLDNSGKDFLWVVRASETSKIPGGFVDKVKGRGLLVTWSPQLEVLAHPAVGCFVTHCGWNSTMEALGIGVPMVAMPQWSDQPTNAKYIEHVWQVGVKLQPDAEGVVTKEEVERCVRQVMEGERSDEYKKNAAGWSEKAQKAMSEGGSSDSNIVEFLSKIRFK

SEQ ID NO: 6211 - protein, 464 aa, Medicago truncatula
MHNVDVTIITTPANAAIFQTSIDHDSSRGRSIRTHIVKFPQVPGLPQGMESFNADTPKDIISKIYQGLAILQEQFTQLFRDMKPDFIVTDMFYPWSVDVADELGIPRLICIGGSYFAHSAMNSIEQFEPHAKVKSNSVSFLLPGLPHNVEMTRLQLPDWLRAPNGYTYLMKMIKDSEKKSYGSLFDSYYEIEGTYEDYYKIAMGSKSWSVGPVSLWMNKDDSDKAGRGHGKEEDEEEGVLKWLDSKKYDSVLYVSFGSMNKFPTPQLVEIAHALEDSGHDFIWVVRKIEDAEDGDDGFLSEFEKRMKERNKGYLIWGWAPQLLILEHGAVGAVVTHCGWNTIMESVNAGLPLATWPLFAEQFFNERLLVDVLKIGVAVGAKEWRNWNEFGDDVVKREDIGKAIGLLMGGGEECLEMRKRVKALSGAAKKAIEVGGSSYTKLKELIEELKSFKLEKINKKLVSVT

SEQ ID NO: 6212 - protein, 387 aa, Ricinus communis
  MOD_RES (372)..(373): Any amino acid
MDSQPYQLHIAFFPYMAHGHMIPTMDMARLFARHGVKATIITTPFNASLISKTIERDRQKGFEIGIQLINFASAETGLPEGCENASSIRTQEMAAKFFKAISLLQQPLEHVLKECHPNCLVADMMFPWATEVASKFGIPRLVFHGISTFSLCVYNSLRHYEPHKGLASDFEPFMVPGLPDQIKITRLQVPDYIKEKNKQTELTHRMSQSELTSYGVLLNSFYELEPAYLEHYRKVMGRKAWSIGPLSLCNNDREDKMQRGDTASISGHECLRWLDSKKPNSVLYICFGSMFKFSTPQLIELAMALESSGQNFIWVVKKQENGSTQEEWLPEGLEKRMEGKGLIIRGWAPQVLILDHEAIGGFMTHCGWNSTXXERRHRKGSNPIDDW

SEQ ID NO: 6213 - protein, 484 aa, Nelumbo nucifera
MKMVHVLVVSFPGQGHVNPLLRLAKLLASEGLLVTFSTTESIGHMMKKATNIPGTCSATPIGQGQLRFEFFSDGWPADDNSKRQDIDGLLHRLETVGKESFTCLVKKQAEEGRPVSCLVNNAFVPWALDVATDFGIPCAVLWVQSCAVFSTYYYYFHRLARFPSVDEPHLSVHLPGLPILNSHEVPSFLHPSTIYHMLGNLILGQFQNLSKSFYVLVDSFEELEHEVIEAMSHLSLPPLRTIGPLFRSLKGSSSNSSNGVRGDFWTAAEGCIQWLDSQPLSSVVYISFGSIAFLPKDQMEEMAWGLLKTGLPFLWVVKPPAKEIATDTGLPAGFMDKAQGKGMVVEWCPQEQVLAHPSVACFVTHCGWNSSMECLTSGVPVVAFPQWGDQVTNAKFLVDKYGVGSLMGRSDRDSQLISRETVERCILEVARGPKTEEAKKNALKWKKAAEKAVANGGSSHRNIQAFVDEVRRLALTATSFEINT

SEQ ID NO: 6214 - protein, 495 aa, Brassica napus
MGTSDEAAASKLHIFFFPYMAHGHMIPTLDMAKLFATKGAKSTILTTPLNSKLFEKPINSFNDENPELEDIKLQILNFPCTELGLPEGCENTDFIFSNHDLTKGNLNMKFLLAMEYFKEQLEELLETVKPDCLVGNMFFPWATKVAEKFNVPRLVFHGTGYFSLCASHCLRLHKPYKNVASSSEPFVIPELPGDVVITDEQVIEKEEESVMGKFMKDIRDSERDSFGVLVNSFYDLEPAYADFFKTHVAKRSWDIGPLSLGNREFKEKAERGKKASIDEHECLKWLDTKRCESVIYLSFGTMSSFDDEQLMEIAAGLEMSGHDFVWVVNRSGSQGEKVEWLPEGYEERTKGQGLIIRGWAPQVLILDHQAIGGFLTHCGWNSLLEGAASGLPMVTWPIGAEQFYNEKLVTQVLKTGVSVGVKKMVKGSGDFISREKVDIAVREVMVGDEMRKRAKQLAVMAKDAVREGGSSDLEVNRLMDELKLVRMQKEQGTRT

SEQ ID NO: 6215 - protein, 509 aa, Onthophagus taurus
MKFLLLVLIVCGVFNVYKTAKILAVLPAPSYSHYVTGSVLATELARRGHEVTVVSTFKPKTVPFGNYKFVEVKGIKDFLKKEENILHYFEFDNYNKPFISYVVHKFAYNVIEFFFNDENVKEFIKSGGHYDVVFVDEFFNEALYGFCNLFKAACVNLCSVSPTIWCNRPTGNIGMASYSSGMGTNYSPKMSFFQRLHNLFLFIAEEFIYHGYHIPKMEKLLHKSFPNSPPLYDLIYNISMVFVNSHPAMNAPLPLTPNMIELAGMHLDGMKNEKIPDDIQSFLDKHNEGVVYFALGSNAKSKDFPKRVLKELMNGFKKWGKPILWKFEDELPEKLENVKIASWLPQTSVLAHKNVIAFITHGGRLSIIESLYYGVPMIGIPIFAEQPHNIAEMVYYKYGIGLDLNTFTAEDLYNSLHEITTNSKFSEEAEMRSKIMQKKNALDEAVYWIEHLVEFKGGSYLRTAGVDLPWYQFWMVDVIGFCVVCGFVLITIVIFSILKCLKCIDKKKK

SEQ ID NO: 6216 - protein, 457 aa, Setaria italica
MAGEEQLRDGGLHRRRVVVLFSLPFHGHLNPTLKLAALLRARGLAVTVLHTDFNAPDPARHPGLAFVPIHETPLQDTAVSPDSDILAKLLALNAAIAAPFRQALASLQDAVACAVVDGQCYAAMDAAGELGVPVLALRTDSAAALRNMLAIPRLRDAGYLPFKEEQLDEPAPGLEPLRVRDLIRVDGCDTDELCGFVTSVADAVRASVSGIVFNTFEAIEAPELAKIQRELSLPAFAVGPLHLLSQTPPPAEQSLHAPDRGCLAWLDARTPRSVLYVSLGSLACVNRAVFEEMAWGLAGSGVPFLWVVRPGMVTGGAAGEEAPPPLPDGLEEKMRGRGKIVTWAPQREVLAHDAIGAFWTHCGWNSILESICEGVPMLVQPCFADQMVNARYVTHEWGVGMEVGEVIERERVAKAVTKLMVGEDGAWMRERARRLQVQASAATSLALDSLVQYILSL

SEQ ID NO: 6217 - protein, 479 aa, Ricinus communis
MDSDAKRHPELYFFFFPFMAQGHSIPLIDMAKLFASRGQKVSIITTPVNAPDISKAIERSRVLGHEIDILIIKFPCVEAGLPEGCEHLELVTSPEMGLNFFMATDILAKPLEHLLKQYRPDCLVADTFFPWSNEAASKSGIPRIVFSGTCFFSSCASQCVNKYQPYKNISSDTDLFVIPEFPGEIKLTRNQLPEFVIQQTGFSEFYQKVKEAEAKCYGVIVNSFYELEPDYVDHFKKVLGIKAWNIGPISLCNSNIQDKAKRGREASIDENECLEWLNSKKPNSVIYICFGSVANFVSSQLLEIAMGLEDSGQQFIWVVKKSKNNQEEWLPEGFEKRMEGKGLIIHGWAPQVTILEHEAIGGFVTHCGWNSTLEAIAAGVPMVTWPVAAEQFYNEKLITEILRIGVAVGTKKWSRVVGDSVKKEAIKKAVTQVMVDKEAEEMRCRAKNIGEMARKAVSEGGSSYSDFNAFIEELRRKKV

SEQ ID NO: 6218 - protein, 482 aa, Brachypodium distachyon
MADTASEHSSGGGGIHILLLPYPSQGHINPILQFGKRLAATHPGVRCTLAVTRFLLAETRGAASPGAVHLAEISDGFDRGGFTEAAGDVAAYLARLESAGSRTVGELLRAEAEAGEEHGRQPVRAVVYDAFLQPWAPAVGRRHGAACAAFFTQAPAVDLAYAHAQAGRMHVPVLGIGEETLELPGLPAGLKRADLPTFLTDPSDCPAYLDLLLKQFVGLDSVDHVLVNSFHELQPQESEYMAATWGARTVGPTVPSAYLDHRIPEDVSYGFHLHTPTTAATKAWLDARPPRSVAYVAFGSIAAPSAAQVAEVAEGLLNSGAPFLWVVRASETSKIPEGFADRASEIGMVVTWTAQLEVLSHGAVGCFVTHCGWNSTTEALGAGVPMVGVPQWSDQTTNAKYIQDVWRVGVRALPDGEGVVRKEEVERCVREVMGGEEYRRNAAQWKEKARMSMSEGGSSDRNIVEFLRDLGLGKSQQSTEAL

SEQ ID NO: 6219 - protein, 488 aa, Vigna angularis
MSSQEQGPHFVLFPLMAQGHMIPMMDIAKLLVHRGVTVTVVTTPGNAARFTPIFDRYVGSGLPIRLAQLPFPCEEVGLPEGCENIDMIPSLGTARTFFEATNLLHQPAEKLFGEFWPPPSCIISDMCLPYTSHIAKKFNIPRISFVGVSCFCLLCHHTILVNNVRENIASDSEYFVLPGIPDKIEMTMKQSGVSMNETWVQFREEVMAAEMATYGVIMNSFEELEPAYAREYKKVKDDKVWCIGPVSLINKDHLDKAQRGRASVDESEHIKWLDCQKAGSVIYACLGSLCNLTAPQLIELGLALEASERPFIWVIREGKHSESLEKWIEENGFEERTSCRSLVIRGWAPQLLILSHPAIGGFITHCGWNSTLEAICAGVPMITWPLFADQFLNESLVVKVLKVGVKVGVESPMTWGKEEEVGVEVKKEDIERAIAEIMNETSESEERRERVRELGEMAKRAVEKGGSSHSNVSFLIQDIMQRNKGDTP

SEQ ID NO: 6220 - protein, 475 aa, Sinningia cardinalis
MEDTIVLYPAPGIGHLLSTVELGKLILRHHHFSTIHVLITTGFDDSPHTATYIDQISKTNPSITFHRFPFFQMNPSPNASFGSILFEFIRLNATNVHHALQEIMQTSKIRALIVDFFCSSAFPVSESLGIPVFYFFTSGLAALAAYLYFPTLHMQVDQSFKDLVNTNFHIPGLPPLPARQMPQPVWDRNDPAYHDVLYFSHHLAKSSGILMNTFDGLEPIALKALRHGLCVPDAPTPPIYNIGPLIAYAESESADQNLKHDCLPWLDTQPNQSVVFLCFGSRGIFSADQLREIAKGLERSGHRFLWVVKKPPFDENNKEDKELGELNVMGIMPEGFLDRTKDRGMVVESWVPQMKVLEHRAVGGFVTHCGWNSVLEAVIAGVPMVAWPLYAEQHLNKAALVENMKMAIPMQPREEDEFVFAEEVEKRISEVLDGEKSKELREQCRKMKNMSVDAWGKLGSSTAALEKVVQIWLGN

SEQ ID NO: 6221 - protein, 469 aa, Phytolacca americana
MEMEAPLIVIVPSPGMGHLIPLVEFAKVLVSRFHFSVSLLLPTTAQPTKAQTTLLNSLPSSVSHNFLPTVDPAHLPDGVAHEVTISLTHAHSLSSIRAALGSLAQQAQVVALITDLFGTGLYTVARDLGIPPYLYFTSTAMCLLFLFHLPKLDETVSCEYRDMPEPLVLPGCVPLHGKDFVDPAQDRQDQAYHVLLDHVKRYVLAEGIFVYTFVDLEPGAIKTLQTEDPNVPPVYPVGPIIQSGLDDDSHGSDCLKWLDRQPSGSVLFVSFGSGGTLSNEQLNELAIGLEISGHRFLWVVRSPNDHSSFGSFFSTQSQDDPFGFLPTGFVDRIKDRGLLVPSWAPQIKVLSHGSTGGFLTHCGWNSTLESIVNGVPLIVWPLYAEQRMNAVMLNQGLKVALRPNASQRGLVEADEIARVVKELMDGDEGKKARYKMRELSDSAKRVTSENGESTKLLSEVASKWSQCKS

SEQ ID NO: 6222 - protein, 536 aa, Citrus unshiu
MGHIVRPPDHNNAPNTDKVLSPIYLVTNLDFPEENISELHHYFKRNPTKMETQNSKQIPRAHVAMVPTPGIGHLIPQVELAKRLVHQHNFLVTIFIPTIDDGTGSSMEPQRQVLESLPTSISTIFLPPVSFDDLPDDVRMETRITLTLARSLSSLRDALKVLAESTRLVALVVDIFGSAAFDVANEFGVPVYIFFTTTAMVLSLIFHLPELDVKFSCEYRDVPEPVQLPGCVPINGRDFADPFQQRKNEAYRIFLSFSKQYLVAAGIMVNSFMDLETGAFKALMEGDSSFKPPPVYPVGPLVQTGSTNETNNDRRHECLKWLDEQPSESVLFVCFGSGGTLSPEQLNELALGLEMSGQRFLWVVRSPHERAANATYFGIQSMKDPFDFLPKGFLDRTKGVGLVVPSWSPQVQVLSHGSTGGFLSHCGWNSILESIVHGVPIIAWPLYAEQKMNAVLLIDDLKVSFRVKVNENGLVGREDIANYAKGLIQGEEGKLLRSKMRALKDAAANALSPDGSSTKSLAQVAQKWKNLESETK

SEQ ID NO: 6223 - protein, 449 aa, Unknown
  Description of Unknown: Oryza sativa Japonica Group sequence
MAAELHFLVVPLIAQGHIIPMVEVARLLAARGARATVVTTPVNAARNGAAVEAARRDGLAVDLAEVAFPGPEFGVPEGLENMDQLADADPGMYLSLQRAIWAMAARLERLVRALPRRPDCLVADYCNPWTAPVCDRLGIARVVMHCPSAYFLLATHNLSKHGVYGRLALAAGDGELEPFEVPDFPVRAVVYTATFRRFFQWPGLEEEERDAVEAERTADGFVINTFRDIEGAFVDGYAAALGRRAWAIGPTFGSISHLAAKQVIELARGVEASGRPFVWTIKEAKAAAAAVREWLDGEGYEERVKDRGVLVRGWAPQVSILSHPATGGFLTHCGWNAALEAIARGVPALTWPTILDQFSSERLLVDVLGVGVRSGVTAPPMYLPAEAEGVQVTGAGVEKAVAELMDGGADGVARRARARELAATARAAVEEGGSSHADLTDMIRHVGAQ

SEQ ID NO: 6224 - protein, 473 aa, Vigna angularis
MAKATHIAVIPSVGFSHFAPIINFSKLLVDLHPHIHLTCIIPILGSLPAAAKPILQTLPPRISTVFLPPVSHRDLPQGVPVVLQIQLAMNLSMPSIHHTLSSITSNNPHVAMVVDTFAYGALDFAQEFNMLSYVYFPSAATTLCTHFYLPTLHKETFCEYRDLPHPITVPGCVPFHGRDLYAQAQDRKSQFYKMSLKRYESYRFLDGIFINSFLELETGPIRAFKDEERGYPPLYPVGPIVQTGTATAGCTTTLECLTWLDKQQDGSVLYVCFGSGGTLSQEQTNELAHGLELSKHKFLWVVRAPSDEANAGYLGGEKDADPLEFLPSGFLERTKEQGMVVPSWAPQIEILGHGSVGGFLTHCGWNSTLESVVHGVPLITWPLFAEQRMNAVVMSEGAKVGVRPRVSENGLVERVEIVKVIRCLMEEEEGREMRRRMKELKEASANALKEDGASTTNLSQVAHRWKMLAHERS

SEQ ID NO: 6225 - protein, 488 aa, Arabidopsis thaliana
MAEAKPRNLRIVMFPFMGQGHIIPFVALALRLEKIMIMNRANKTTISMINTPSNIPKIRSNLPPESSISLIELPFNSSDHGLPHDGENFDSLPYSLVISLLEASRSLREPFRDFMTKILKEEGQSSVIVIGDFFLGWIGKVCKEVGVYSVIFSASGAFGLGCYRSIWLNLPHKETKQDQFLLDDFPEAGEIEKTQLNSFMLEADGTDDWSVFMKKIIPGWSDFDGFLFNTVAEIDQMGLSYFRRITGVPVWPVGPVLKSPDKKVGSRSTEEAVKSWLDSKPDHSVVYVCFGSMNSILQTHMLELAMALESSEKNFIWVVRPPIGVEVKSEFDVKGYLPEGFEERITRSERGLLVKKWAPQVDILSHKATCVFLSHCGWNSILESLSHGVPLLGWPMAAEQFFNSILMEKHIGVSVEVARGKRCEIKCDDIVSKIKLVMEETEVGKEIRKKAREVKELVRRAMVDGVKGSSVIGLEEFLDQAMVKKVEN

SEQ ID NO: 6226 - protein, 478 aa, Cephalotus follicularis
MGSEVGQLHLFFFPFMAHGHMIPTLDMANLFASRGVKATIITTPLNEPFIFLFFFLEKNSGIEIDIRILEFPAVEAGLPEGCENLDFITSDEKNLEMNIKFFTATTILKEPVEQLLQECRPDCLVADMFFPWATDAATKFGIPTLVFHGMIFFALCATECVRLYEPHKKVSSDSEPFIVPNLPGNIVLTRKQLPDFERENVGDDFSKLLKQCRESELRSYGVVFNSFYELEPTYADHYRKELGWKAWHIGPLSLCNRGIEDEALRGKNAECLKWLEAKKPNSVIYVCFGSLSNFSAAQLMEIAMGLEASGQQFIWVVRRDKTNDLEKEDWLPEGFEKIMEGKGLIIRGWAPQVLILDHVAIGGFVSHCGWNSTLEGVCGVPMVTWPVFAEQFYNEKLVTQVLRIGIGVGVQQWAIVEGDFVKKESIEKAVKEMMIGDRAEEMRGIAKALKEMARRAIENGGSSYSDFNTIIEKLRLKR

SEQ ID NO: 6227 - protein, 448 aa, Citrus unshiu
METQNSKQIPRAYVAMVPTPGIGHLIPLVELAKRLVHQYNFLVTIFIPTIDDGTGSSIQTIRQVLESLPTSISTIFLPPVSFDDLPDDFRIETRITLTLVRSLSSLRDALKVLAESTRLVALVVDPFGSAAFDVANEFSCEYRDMPEPVQLPGCVPVHGRDFADGFQQRKNEAYRFLLSFSKQYLLAAGIMVNSFMELETGPFKALMEGESSFKPPPVYPVGPLIQTGSNNETNNDRSLECLKWLDEQPSESVLFVCFGSGGTLSQEQLNELALGLEMSGQRFLWIAKSPHEEAANATYFSVQSMKDPLDFFYRKGFLDRTKGVGLVVPSWAPQAQVLSHGSTGGFLMHGVPIIAWPLYSEQKMNAVLLTEDFKVSFRVKVNENGLVGREDIANYAKGLIQGEEGKLLRKKMRALKDAAANALSPDGSSTKSLAQLARIWKNPEFETK

SEQ ID NO: 6228 - protein, 463 aa, Eustoma exaltatum
MSTPHILLVVFPAQGHISPALQLAMKLVAQGIQLTFLTSSFAEARMSKPTNISGLNFVYFPEVTKGKDYMFELRKHGSQTLKDIILSSINVGLPISRILYTTLLPWAADIARESHIPSILLWTQPVTTLVTFHYYFNGYEDVIKNICNHENSTLQLPRLPLLSRRDLHSFLLPSNPYKGVLRTFKDHLDALDMDENPTVLVNSFNALEEEALKAITKYKMVGVGPLVPSSIFNTKNNSEDSLSSNLWQKSIDCTGWLDSKPHGSIIYVSFGSHVKQSMTQMKEIAKGLLASGKAFLWVITSNNDETVKNQEDGIEILNNMMEELEEKGMIVPWCAQLEVLKHPSIGCFLTHCGWNSTLESMVCGVPMVCFPKMFDQGTISKLVVDVWKVGVRVDENEDGIVCQEEIKKCIDHVMDGGKFAQELGENARKWMSLGKEAVLEGGSSYYNLKAFVEEIKGGSSAFD

SEQ ID NO: 6229 - protein, 495 aa, Vigna angularis
MRVPLRGYKYCVEESKIVVFHFIQQEQKQKMVQQSLSNVHVLVLPYPAQGHINPLLQFAKRLASKGVKATVATTHYTANSIAAPNITVEPISDGFDRAGFAEANNDVQLFLSSFRSNGSRTLSQLIKKYHQTPSPVTCIVYDSFFPWALEVAKEHGVYGAAFFTNSAAVCSIFCRIQRGLIEVPVGAEDLPLRVPGLPALDSRALPSFVRFPQSYPAYMAMKLNQFSNLDKADWMFVNTFETLESEVVEGLKELFPAKMIGPMVPSAYLDGRIKGDKGYGASLWKPLNEECSNWLEEKGPRSVVYISFGSMVSLTAEQVEEVAWGLKESGVNFLWVLRESEQGKLPCGYRDLVKDKGLIVTWCNQLELLAHQATGCFVTHCGWNSTLESLSLGVPVLCLPQWADQLPDAKFLDEIWEVGLWPKEDDNGIVRKQEFVSSLKVVMEGERSEEIRRNASKWKKLAREAVGEGGSSDKHINQFVKYLMSADKNGSLNVH

SEQ ID NO: 6230 - protein, 488 aa, Brachypodium distachyon
MAIEAASATPAPERSTTHVVLLACPGAGHVLPVAELARRIVAHNDGFTATLVTHTNFSSGDHYASTFASLPPSVSTAQLPEMSIDDLPADARAETRIITIVKRALPHLRDLLLRLLDSPAGVAAFVPDLFCPWALEVSGELGIPGYIFCPSNLMGLSSLLYTPELDRTTTCEFRDLPDLVRLPGCVPLHGADLVDTIQDRGDPAYPLMVELGEHYLLAQGFLVNTFDAMEHETILAFQELSDKGVYAPAYAVGPFVRSCSNESNKHSSLQWLDAQPDGSVLYVCFGSGGTLSTAQTAELAAGLEASGQRFLWVTQFPSDKDRCASFFGGGRDGDSPVNYLPEGFVERTRGTGLAVPLWAPQVEVLNHPAVAGFVSHCGWNSTLEAVAAGVPTMAWPLYAEQRMNAVMLSERVGLALRPRAREEDGVVPRDEVARVARELMVGEKGAAARKKARELREAAQKGLAPGGKSREALEAIAGKWKKAVGNGN

SEQ ID NO: 6231 - protein, 476 aa, Solanum lycopersicum
MTIPEKIKKPHVAFLPSPGMGHITPLFEFAKRLVIHHGFHVSFFVITTAASAAQNELFRPENLPADFTAVEIPPVENISSFLTDDMKVVTQLCIMVRESLKHLPSLLMKNRPKALIIDLFCTDAFEICEKLSIPVYSFFTASTILMAFSLYLPTLDSEVEGEFVDLPETIQTPGCSPIHPHDILDQVKDRKNEEYNWYLLNVSRLPLAVGIFVNSWDDLEPVSLKALRENLFFQNIPLPPVYTIGPLIKQDEVVTEQDAEILAWLDDQPPDSVLFVVFGSGGTLTSEQLTELAWGLELSQQRFILVARKPSDASASAAFFNVGSDENDPLLYLPEGFVRRTEGRGLVVPSWAPQTLILNHRSTGAFLSHCGWNSTLESITNGVPITAWPLYAEQRMNATFLAEEAGVALKFSKNPGEELVDRNEIEKNVRIVMEGEKGKDMRRRAKELKESAKIALNSGGSSYESLCSVVEFWKSQ

SEQ ID NO: 6232 - protein, 487 aa, Unknown
  Description of Unknown: Oryza sativa Japonica Group sequence
MHTTNGAPACCDANADTPPLHLIFVPFLSRSHFGPVTAMAAEADACHRGGRTAATIVTTRHFAAMAPASVPVRVAQFGFPGGHNDFSLLPGEVSAAAFFAAAEEALAPALGAAVRGLLREGGSTATVTVVSDAVLHWAPRVARECGVLHVTFHTIGAFAAAAMVAIHGHLHLREAMPDPFGVDEGFPLPVKLRGVQVNEEALVHLPLFRAAEAESFAVVFNSFAALEADFAEYYRSLDGSPKKVFLVGPARAAVSKLSKGIAADGVDRDPILQWLDGQPAGSVLYACFGSTCGMGASQLTELAAGLRASGRPFLWVIPTTAAEVTEQEERASNHGMVVAGRWAPQADILAHRAVGGFLSHCGWNSILDAISAGVPLATWPLRAEQFLNEVFLVDVLRVGVRVREAAGNAAMEAVVPAEAVARAVGRLMGDDDAAARRARVDELGVAARTAVSDGGSSCGDWAELINQLKALQLTSSRDRRTDAVTRD

SEQ ID NO: 6233 - protein, 477 aa, Ziziphus jujuba
MVNPPRFLIVCYQEQGHLNPTLQLAKRLTSIGVHVTFLTSLSAYLRMAKASNSNLNTVDGLSFSHFSDGYDDGYKPGVDGDHYFSEIRRCGSQALSDLIISGANEGRPFSCVVCNIMLPWAAQVADEFNIPSVLLWIQAATVFDIYYYYFHGYGDMISEIISSSTTIDDPLNLLELPGLPLKLTGRDLPSFIGSTNAYSFVTTVLKELFEKLLVKEGKSIVLVNTFDAIEHEALKAIEKVDLVGIGPLVPSAFLDRKDPSDTSFGVDLYKGSRDYNEWLNSKPKESVIYISFGSLIVLSKLQMEEIESALLGCGRPFLWVITEKQNPEEKKEENGGLSCKEELEKLGKIVPWCSQVEVLSNPSLGCFVTHCGWNSTLESLVCGVPLVAFPQWTDQGTNAKLIEDSWKNGLRVRTNKEGIVESHEIKKCLELVMGDEEIRMNTKKWKDLSIQAAMEGGSSDKNLKAFLEDIIQDKTTS

SEQ ID NO: 6234 - protein, 482 aa, Sinningia cardinalis
MKIAELVIIPAPGLTHLMSTVEAAKLLLERDDRLSITLLVMKYPNDTAVDNYTQKISSNSDLTSSLRFLNLPDQDQIVASDTLLFDLIDIQIVNVRDILCNLVRQSSPRIAGIVTDMFCTKFIDVANEFHLPTYIFFTSGTCSLSLFCHLASLKFEYNQDLNQYKNSDAALSVPCLSIPVPVKVFPAILVNGWPIGEIALNCFKRFEETRGIMVNTFYELESYAIQSLSDGKTPKIYPIGPVLNFGHRVESSKGQSYDEEIKKWLDDQPDSSVVFLCFGSKGSFEVPQLKEIASALEKCGHRFLWSIRKPGPKGIMQFPTEYENFQDILPDGFLERTKGTGKLIGWAPQLAVLSHPAVGGFVSHCGWNSTLESIWCGVPVATFPLHAEQQLNAFELVKELGMAEAIRLDYNRHFLGESDEEEIVGSEEIEAAIRRLMAADGSSGIRQKVKEMQKKSRMALLEGGSSYNSQNIFIDDVIKNIS

SEQ ID NO: 6235 - protein, 455 aa, Medicago truncatula
MNISDSGNAVCHVVAMPFPGRGHINPMLSFCKILTSQKPNNLLITFVLTEEWLTFIGADPKPESIRFATIPNVIPPEREKAGDFPGFYEAVMTKMEAPFEKLLDQLELPVDVIVGDVELRWPVNVGNRRNVPVAAFWTMSASFYSMLHHLDVFSRKHHLTVDKLDEQAENIPGISSFHIEDVQTVLCKNDHQVLQLALGCISKVPKANYLLLTTVQELEAETIDSLKSIFPFPIYPIGPSIPYLDIEEKNPANTDHSQDYIKWLDSQPSESVLYISLGSFLSVSNAQMDEIVEALNNSGIRYLYVARGETSRLKDKCGDKGMVIPWCDQLKVLSHSSIGGFWSHCGWNSTLETVFAGVPILTFPLFLDQVPNSTQIVDEWKNGWKVEIQSKLESDVILAKEDIEELVKRFMDLENQEGKKIRDRARELKVMFRKAIGKGGSSDRNLDAFISDISS

SEQ ID NO: 6236 - protein, 490 aa, Arabis alpina
METSEKISKLHFLLFPFMAHGHMIPTLDMAKLFATKGAKSTILTTPLNSILFEKPIKSFNNENPKLENITIKILNFPCTELCLPQGCENTDFIFSSPDLSKGELNLKFLLAMSYFEEQLEHVLETMKPDCLVANMFFPWATKVAEKFNVPRLVFHGTGYFSLCASHCLRLHKPYKNVASSCEPFVIPDLPGDIVITEEQIIEKEEESVMGKFMKEMRETERNSFGVLVNSFYELEPAYSDFFKSSVAKRAWNIGPLSLGNREFKEKAERGKKASIDEHECLKWLDSKRCDSVIYLSFGTMTSFNNEQLIEIAAGLEMSGHDFVWVVNKNGIKGEKEEWLPEGFEERTKGKGLIIRGWAPQVLILDHQAIGGFLTHCGWNSTLEGVASGLPMVTWPVGAEQFYNEKLVTQVLKTGVSVGVKKMMKVVGDFISREKVDKAVREVMVGKERRRRAKELAEMAKDAVKEGGSSDIELNKLMEELKMVKLQNEKK

SEQ ID NO: 6237 - protein, 478 aa, Arabidopsis thaliana
MKIELVFIPLPGIGHLRPTVKLAKQLIGSENRLSITIIIIPSRFDAGDASACIASLTTLSQDDRLHYESISVAKQPPTSDPDPVPAQVYIEKQKTKVRDAVAARIVDPTRKLAGFVVDMFCSSMIDVANEFGVPCYMVYTSNATFLGTMLHVQQMYDQKKYDVSELENSVTELEFPSLTRPYPVKCLPHILTSKEWLPLSLAQARCFRKMKGILVNTVAELEPHALKMFNINGDDLPQVYPVGPVLHLENGNDDDEKQSEILRWLDEQPSKSVVFLCFGSLGGFTEEQTRETAVALDRSGQRFLWCLRHASPNIKTDRPRDYTNLEEVLPEGFLERTLDRGKVIGWAPQVAVLEKPAIGGFVTHCGWNSILESLWFGVPMVTWPLYAEQKVNAFEMVEELGLAVEIRKYLKGDLFAGEMETVTAEDIERAIRRVMEQDSDVRNNVKEMAEKCHFALMDGGSSKAALEKFIQDVIENMD

SEQ ID NO: 6238 - protein, 473 aa, Zostera marina
MMRHAVCIPFPAQGHLKPMLKLALILHSKGFHITYVHSDYNRRRILKSRGPTSLDGLPHFRYETFSDGLPLSDVFDCTQDTLSLCQSIKENGPQHFRNLIAKLNQTSLSDVPPVTCIISDGCMAFTLDVAEEMGIPELLFWTNSPCGVRCFLEYNHLVEKGILSLKDESYLVDGHLETTVDCINGMSDIRLKDMPSHINNPFMVKYVISETNRASKARSIILNTFYDLDHSILDSMKLFFPPIYEIGPLDLLYNQMIQKDKQNDVGCSMGSNLWKEDSKCSEWLDTKPVGSILYVNFGSVTVMTTQQMIEFAWGLCNSNKEFLWIIRPDVVRGETAVLPEDFLEMTKGTSMMTSWCSQEDVLSHPAIGGFLTHCGWNSTLESIYCGVPMLCWPFFAEQPTNCRYSCKEWGVGLEIDKDVKRAQVTSLIIELMDGEKGNRMRREAQRWKAKAIKATQKGGTSFIKMEKLLNVIC

SEQ ID NO: 6239 - protein, 443 aa, Citrus unshiu
MSNTQRNYSVLMFPWLAHGHAFPFLELAKKLAKRSNFHICFCSTPSILNSIKQSDKFSLSIQLIELHLPSSPELPPQYHTTKGLPPHLMPTLKKAFDMASSSFFNILKNLSPDILIYDLIQPWAPALASSLNIPAVYFLVSSAATSAFMVHAIKKNSSGDAYNDDEEFSFSSIFMHYYYMKSYFSNMVESPSTKRLLQCFERSCNIVLIKSFRELEGKYIDYLSDLIKKKVVPVGPLVQDPIEQSDHEKGVTEIIQWLDKKERSSTVFVSFGSEYFLSKEEMEDIALGLELSGVSLGVKVKVDEELPESFLERTKERAMVIEGWAPQMKILGHPSIGGFVSHSGWSSVMESMKLGVPIIAMPMHVDQPLNARLVEDVGIGLEVRRNKCGRIQREEMARVIKEVVMEREGEKWERKTREMGEKIKEKGEEEIEWVADELIHICG

SEQ ID NO: 6240 - protein, 471 aa, Rosa chinensis
MSDLTDSQALPLLPHIALFPCAGMGHLTPFLRLASMLSSSQNCLVTLITASPAVSAAESTHISLFLSQHPKVNHLEFQLIPSNPTTTTMDDPFFLQWQSTNRSLHLLYPSLASSSPPLSAIFSDFVVASSMGTIAAQLNIPNYIFSPTSCKFFSLAAYLPTLLSNTSDISSLTQVNIQGLTPLPMTSIPPPFRNQNHIFTSLILQNSRALSSAKGILMNTFHDFESDTLAAINDGRALTNINLPPILPIGPLQAFELKNDQDKYYLSWLDNQPKQSVVYVSFGSRTTMSNSQIRELSKGLETSGYRFLWVLKTSKVDKDDIQEVKDMVGESFLERTKNKGIVLKAWVSQQEILEHPAIGGFVNHCGWNSVMEAAQEGIPVLAWPQHSDQSVNAEIVEKAGLGIWERKWGWGLEGLVSGEEIGNKIVELMENQKVREFSRNVGEKARKASGIDGKSEKVVMEIMESLMQKRN

SEQ ID NO: 6241 - protein, 462 aa, Triticum aestivum
MESTGHGGGEGASVLLLPFPGAQGHTNPLLELGRRLARHGLHPTLVATRHVLSSTPPPGAPFRVAAISDGFDAGGAASDYTEYFSRLEAVGSETLRELLLSEARAGRPVRVLVYDSHLPWAGRVARAAGVPAAAFFSQPCSVNIVYGELWAGRLALPVMDGAGPELLARGALGVELGPEDVPPFAAAPESQPSFLKMAIGQFDGLEDTDDVLVNSFNDIEPTEGEFMELTWRKKTIGPTLPSFYLDDHRLPSNKSYGFNLFDSDAPCMDWLENQSISSVVLVSYGTFSNYDATQLEELGNGICNSGKSFLWVVRSNEAHKLSEELRKKCEKNGLIVSWCPQLEVLAHKAIGCFVTHCGWNSTLEAVVCGVPLVGIPHWADQPTIAKYVESGWGMGVRVQKSESESLRSAEVERCIREVMDGERKGEYKRNAIKWMQKAKEAMQEGGSSDKHIAEFAAKYSSI

SEQ ID NO: 6242 - protein, 470 aa, Arabidopsis thaliana
MTNFKDNDGDGTKLHVVMFPWLAFGHMVPYLELSKLIAQKGHKVSFISTPRNIDRLLPRLPENLSSVINFVKLSLPVGDNKLPEDGEATTDVPFELIPYLKIAYDGLKVPVTEFLESSKPDWVLQDFAGFWLPPISRRLGIKTGFFSAFNGATLGILKPPGFEEYRTSPADFMKPPKWVPFETSVAFKLFECRFIFKGFMAETTEGNVPDIHRVGGVIDGCDVIFVRSCYEYEAEWLGLTQELHRKPVIPVGVLPPKPDEKFEDTDTWLSVKKWLDSRKSKSIVYVAFGSEAKPSQTELNEIALGLELSGLPFFWVLKTRRGPWDTEPVELPEGFEERTADRGMVWRGWVEQLRTLSHDSIGLVLTHPGWGTIIEAIRFAKPMAMLVFVYDQGLNARVIEEKKIGYMIPRDETEGFFTKESVANSLRLVMVEEEGKVYRENVKEMKGVFGDMDRQDRYVDSFLEYLVTNR

SEQ ID NO: 6243 - protein, 528 aa, Helianthus annuus
MACERDYRLYHTLPCFDEYEDEQWYSWACDGDSGGTSSVLTIRHDHNKESTIMGACDDESSFKSHSVKGDGPTMVTGGPAATFGTQPVSMGGLQKNFMSKAMKSKALRNTIDFGASQIYFCTILKGNFPTNSFEEIILDDENHGIQNSHAVKIWYEVLFENLVDGQIVEVGEAMSSKDAPHIDQNEEKVVKLDGYVVKKYNEVHGLRLYGYLVVTILIERVKTIVNKKWSYAPFDPGGTGSESNEITREVELLGRALIIIEKNRIDVPFDPGGFSLGQNSRSSFSKGGENDAGISRILGVGKNYTGIRRINVFDLRFRITRYIITPDETSLSWLDKHPPNSVIYVSFGSLVKIEESRFLELAWGLANSKQPFLWVVRPGSIEGSEWLEPLPDEFLERIVEGRGYIVKWAPQQDVLAHRATGCFWTHNGWNSTLESICEGVPMICSPSFGDQLPNARYVSDVWKIWVELENGFEREEIESVIKRVLVGEEGLEFRNRINNIKGKVDICLKKGGSSYSSLEDLVNFILSF

SEQ ID NO: 6244 - protein, 462 aa, Helianthus annuus
MEMAHVIVIPYPAQGHVIPLMELSQRLVNQGVRVTFVNTEINHELVTSTWVEKDSFKELMHMVSIPDGLESWEDRSDLGKLTESILKTMPGKLEELIETINNQGTHKVTCVIADGCAAWAIRVAKKIGTKRAVFWPSSVASLAPALSIKKLTDDGIIDNKGIPIKDQTIQLSPNMPPIKPSNLPWSFVGDLATTKSVFKISVDVAEAATMTEWITCNSANELEPEEFSIYSKILPIGPLLASNRLADQAGHFWHEDFSCLKWLDQNPVCSVIYIAFGSFTIFDQRQFEELALGLELSNRPFLWVVRPGMTKETTVSYPDGYTERTHTRGRIVSWAPQQKVLAHPSVGCFLSHCGWNSTLEGVTNGVPFLCWPYISDQFSNQTYICDVWKNGLGFDRDEAGYITREEIKSKLKHLLSDKTFKEIAMNLKEKIMSNVEEGGNSHKNLSIFIDWIQDKDTYRCLE

SEQ ID NO: 6245 - protein, 233 aa, Arabidopsis thaliana
MKIQLVFIPSPGIGHLRSTVELAKRLVRSDDRLWITVIIIPYPSISDDDVETTYIASLTTASQDRLNYEAISVANQPTDYQEPTQVYIEKQKPQVRDVVARIFHSTGVDSPRVAGFVVDMFCSSMIDVVNEFGVPCYMVYTSNATCLGITLHIQRMFDEKKYDVSELEDSVNELEFPFLTRPYPVKCLPDFFTSKDWLAFFLAQARCFRKMKEDKRLCDGGGVGIGGSDTEVL

SEQ ID NO: 6246 - protein, 417 aa, Cephalotus follicularis
MGSAILSEKPHAVCIPFPAQGHINPMLKLAKLLHYKGFHITFVYTEFNHKRLLKSRGANSLNSLSSFRFETIPDGLPPSDANATQDVPSVCESTSKTCLAPFRKLLSKLNDTSSSNVPPVTCIISDGIMTFTLDAAEELGIPEVIIWTASACGFLAYLHFRQLIDRGYVPLKDYIPGMKGIRLKDFPSFIRTTDWDDIMLNFFIVETERAKSASAIIINTFVAMEDQFLSVLSSILPPIYTVGPLQLLLNDVPDTDSKQFGSNLWKEEPECLEWLDSREPNSVVYVNYGSITVMTPDQLVEFAWGLANSKHTFLWIIRPDLVSGDSAILPPFLVETKDRALLASWCPQEQVLNHPAIGSFLTHSGWNSTIESVCGGVPMISWPFFAEQQTNCRYCCTEWGIGMEINNDVRRDEVERL

SEQ ID NO: 6247 - protein, 493 aa, Vigna angularis
MNTSFLCEQEREKKHCVKLLRAMNNEQSPLNIYFIPFLASGHLIPLCNIATLFASRGHRVTVITTPSYVQILQKSNPSLLLHVVDFPAQEAGFPGGVQLMSAANDDESARKFYHANMLLRVPISRFLEQHPPDCVIADYIHSWVHEVASNLRIARLAFNGFSLFTVAAMESVRSNPALVPEAGPFLIPDFPHRITLCSTPPKGVTGFVQRLLETEMKSDGLIVNSFVELDGEEYIPYYEKGKAHKAWHLGPAFLAAKVGEERGEKSVVSEEECVSWLNSKQAKSVVYVSFGSVCRFPDKQLFEMACGLEEAAHNFIWVVPEKKGKEDESEEEKAKWLPKGFEERNAEKGLIIRGWAPQLVILAHNAVGAFLTHCGWNSTLEAVTAGVPMLTWPVLGDQFYNERLVTEVRGVAVEVGATEWRETGYGEREKLVTRDCIEKAVRRLMDGGDEAEEIRRRAKELSDKAKEALGDGGSSHNNLTALIAHLTHLRDTR

SEQ ID NO: 6248 - protein, 303 aa, Oryza sativa
MAQPAWIPFPSTVTYRRHEAEWIAAGFRPNASGVSDADRFWDSERPSCRLIIYRSCPEAEPRLFPLLTKLYTKPAIPSGLLVPPALDDNDIGVYNRSDRSFVAVMQWLDKQPNKSVIYVSLGTEAPITADHMHELAFGLELAGVRFLWALRRPSGINCHDDMLLPSGFETRVAARGLVCTEWVPQVRMLAHGAVGVFLTHCGWGSTVESFHYGQPLVMLPFIADQGLIAQAVAATGVGVEVARNYDDGSFYRDDVAAAIQRVMVEEEGKELAHKAIELCGILGDRVQQEMYLYELIGYLQCYK

SEQ ID NO: 6249 - protein, 469 aa, Vitis vinifera
MAEKPPHIAILPTPGMGHLIPLIELAKRLVTHHGFTVTFIIPNDNSSLKAQKAVLQSLPPSIDSIFLPPVSFDDLPAETKIETMISLTVVRSLSHLRSSLELLVSKTRVAALVVDLFGTDAFDVAVEFGVAPYIFFPSTAMALSLFLFLPKLDEMVACEFRDMNEPVAIPGCVPVHGSQLLDPVQDRRNDAYKWVLHHTKRYRLAEGIMVNSFMELEPGPLKALQTPEPGKPPVYPVGPLIKRESEMGSGENECLKWLDDQPLGSVLFVAFGSGGTLPSEQLDELALGLEMSEQRFLWVVRSPSRVADSSFFSVHSQNDPFSFLPQGFVDRTKGRGLLVSSWAPQAQIISHASTGGFLSHCGWNSTLESVACGVPMIAWPLYAEQKMNAITLTDDLKVALRPKVNENGLIDRNEIARIVKGLMEGEEGKDVRSRMKDLKDASAKVLSHDGSSTKALATVAQKWKAHKNY

SEQ ID NO: 6250 - protein, 506 aa, Anopheles darlingi
MCRILVLSLLVFIVPSDDAYRILGLFPHPGLSHFKVFYPVMRGLAEVGHNVTVVSYFPDKEPLPNYQDLPFEGQEILTNSFSLQHFNGRRFIDNFVEFFELAAWGVGSCQAALNSPALDKVLQSHQTDPYDLVIMEMFATDCMAGVSWIMRVPFVGLSSCALMPWHYDRVGLPDNPAYIPSEFSRFSESMTLWERMENWFVTRTVKLLYRMVEYSDNHKLRAKFPDSAIPSVREIVRNTSLILVNQHYTLSGARPLVPAVVEVGGIHIRSPSDIPASLKTTLDSATEGVIVVSFGSVLRAASLPESKRKAMVEAFKHFPHKVLWKWEETLQDQPENVIVQKWLPQREVLCHPNVRLFVSHGGLLGVSEAVHCGVPVVVMPIYGDQFLNAAALVNRGMGVQMDYEHLDDTNYIQRCLTEGLSSEKRFRAQAVSKAFRNRAQSPLSLALWSILNVIEHGDMRLEKSYGSEISWFVDSSLDVLAVITISLIAIIWPTCFFCRKIFSKKD

SEQ ID NO: 6251 - protein, 465 aa, Zea mays
MSSQPPHVLLVSFPLQGHVNPLLRLGARLAAKGLLVTFTTFRHAGIRALREDGACVAAAGRGRLRFDYLRDDGCGPRSPVPGDPSDMLRHVADAGPSALAGLLRRQADAGRPVACVVNNPFVPWALDVAGAAGIPCATLWIQSCAVLSLYYHFYRCPEGFPTEADTAAPVAVVPGLPTLAADELPLMVRPEHAGNLWGQTLRAQLAGFRKNNTVAWVLVNTFEGLERPVVEALRSHAPVTPVGPLLDHDHDHDGGGDDGCMAWLDAQPPGSVVYVAFGSLVTVGCGEMLALAEGLAATGRPFLWVVRDDSRRLLPDGALAACGGRGRVVAWCPQGRVLRHGAVGCFVTHCGWNSVAEALAAGVPMVGYPWWSDQFTNAKLLAEEYGVGVRLPAPATRDAVRACVHEVMGGPRAAVFRMAAKAWKDEAAAAVADGGSSDRNLHAFVQEIRRFHETRAGGSMINSNI

SEQ ID NO: 6252 - protein, 526 aa, Citrus unshiu
MASLIDTQHPRRPHAVCVPHPAQGHINPMFQLAKLLHHKGFHITFVNTEFNQRRLLKSQGPDSLNAVPTFRFETIPDGLPPSDADATQDIPSLCDSTRRTCSAPFQELLTRLNNSALSNVNPPVTCIVSDWSMGFTLKASKQLNIPNVLFFTASACGFMGYVHYRHLVEKCIFPLKDLSYLTNGYMDSVIDWIPGMEGIQLKYLPSFIRSTDRDDFMVNFVITEIENTHNASALIFNTFDDLEPEVLKELSSIYPNIFTIGPLNQLVLNNEVSAHDSALSLIGSNLWREQPGCLEWLDSKEQNSVVYVNFGSITALTENQLVEFAFDAFVPNSSITALTENQLVEFAWGLANSKRPFLWVIRPDIVNEATAVITQEFVEETKDRGMLASWCPQEQILRHPAVGGFLTHCGWNSTVESLCSGVAMLCWPFFAEQQTNCWFCQTKWGVGIEVNPRADRVEIEKRVRELMEGDSGKLMKEKALEWKLLAEKAAAGPNGSSYVNLDKLINDVLLTYLLSSYDNDREKMHN

SEQ ID NO: 6253 - protein, 490 aa, Arachis duranensis
MHRHHVLLITYPAQGHINPSLQLAKRLINLGARVTVSTTVHMHRRMSDKPSIRGLSFVPFSDGFDDGFTLSDDSNYDHYMTEYQRRSTEFVTDLINSAAEKGQHPFTCVVYTFLQNWVAEAARAFHLPSVVLWPQPAVLLDIHYFYFHGYRDYINEKITKEPSTCSLELPGLPPLKPSCDLPSFYLESNNSTSKYRNSFIASLIEKQFRHLDQEVKPRILANTFEALEPDALRAVDDKLDVIPIGPLIPSAFLDIEKDGDGDSSYGGNIFKHSNDYVEWLDLQAERSVVYVSFGSFWVLAKKQMEEMARALLDSRHPFLWVIRKKEKKEKEKEKEEEEDEELSCREELEARGKIVEWCSQVEVLSHGSLGCFVTHCGWNSTMESLASGVPMVAFPQWVDQKTNAKLIEDVWKTGVRVDREEEEEEGVVEAGEIKRCLDVVMGSGEKAKELRENADKWKRLAREAVKEGGSSEQNLRTFLHQVHDLLPQSR

SEQ ID NO: 6254 - protein, 472 aa, Medicago truncatula
MAKATHIAVISSPGFSHIAPIVEFSKRLVTNHQNFHVTCIIPTLGSLPDSSKSYLETIPPNINLVFLPPINKQDLPQGVYPGILIQLTVTLSLPSIHQALKSINSKAPLVAIIADKFALEALDFAKEFNSSSYVYFPCSAFVLSFYLHWPKLDEEVSCKYKDLQEPIKLQGCVPINGIDLHTVTKDRSGQAYKMYLQRAKGMYSVDGILFNSFFALESSAIKALEQKGDGKIGFFPVGPITQIGSSNNDVVGDEHECLKWLKNQPQNSVLYVSFGSGGTLSQRQMNELAFGLELSGQRFIWVVRAPSDSVSAAYLEDANEDPLKFLPKGFLERTKEKGFILPSWAPQVEILKQNSVGGFLSHCGWNSTLESIQEGVPIVAWPLFAEQAMNAVMLCDGLKVALRLKFEDDEIVEKEKIAKMIKCVMEGEEGIAMRDRMKSLRESAAMALKAKDGSSIQTMSHLATQLENIGRI

SEQ ID NO: 6255 - protein, 469 aa, Helianthus annuus
MVAHKNKVVVVMVPLPLQGHINQLLHLSRLISTHNVPVHFIGTAIHASRAKLRLQGWNPNTISTIFFHDLPIPPFSSPPPNPNSTNKFPSHLQPLCEAATHLRSPITSLLRKLSPTTHRLVIIHDSLMGSVVQDFVSLPNAESYTFHSVSAFSIALYTSEEVREQIRNLVEPNELTEDELGFEGCFTSEFKKFIAAQHGYAKLSSGRIYNTCRVVEQPILDMLETEARKRNKLLWALGPFNPVNFQSGSKFSGKDSGPVERCLNWLDKQPSNSVIFISFGTTTSFSEKQISEIATGLEKSEQKFVWVVRDADRGDSSKDNTIPVELPEGFENGVKDRGLVVREWAPQLDILAHPSIGGFVSHCGWNSCIESMSMGVPIAAWPMHSDQPNNAVLVTKILKVGIVVKDWCQREEVVAAEVVEKAVKRLIGSKEGEEIRKRAVEIGHRIRKSVRDGGVTQMELESFIAHISR

SEQ ID NO: 6256 - protein, 467 aa, Eucalyptus grandis
MAPLNYLVVAFPAQGLINPALQLAKRLLHTGAHVTFATAGSAYHRMAKSDPPEGLSFASFSDGSEEGLRPGIDLEQYMADIVRLGSETLRDLVVTSLNEGCKFACIFYTTIIPWVAQVAHSLQIPSTLVWVQPATLLDIYYYYFDSYGDIIRNLGKDDPSASLHLPGLPPLTSRDVPSFFTPENQYAFSLPLMRVQFKVFKEEKNPRVLVNTFDALEPRPLKVIGNVTMFGIGPLVPSAFLDGQDPLDKSFGADLFRGSKDYIQWLDTKPEGSVIYVSFGSISVLSNAQKEEMARGLLSTSHPFLWVIRKDKEEEVGGQEDQLSCMEELEQKGMIVPWCSQVEVLSHASVGCFVTHSGWNSTFESLTCGVPMVAFPQWGDQQTNAMLVENEWKVGVRVNTNERGIVEGDEIKRCLELVVGDGEEGEEIRRNAKKWKGLAREAAKEGGSSDRNLNAFLEEIQMEANGY

SEQ ID NO: 6257 - protein, 447 aa, Vitis vinifera
MDKHHFLLLSCPAQGHINPTLHLAMLLLRLGVRVTFATFVSGLRRIATLPTIPGLHFASFSDGYDDGNNSNYSMEEMKRVGSQSLSNLLLSLSNERGPVTYLIYGFLLPWAATVAREHGIPSAFLSTQSATVIAVYHRYLKAHDGLFNTELGSSLNISLELPGLPPLKYEDLPSILLPTSPHASVVPSFQEHVQNLEQDPNTCLLINTFNALEEDVIKALGDFMNVVAIGPLMQLDSSISCDLFERSKDYLPWLNSKPEGSVIYVSFGSLATLQKNQMEEIFHGLMESHRPFLWVIRSIESELEEKMNSSLSEEQGLIVQWCSQVEVLCHQAVGCFLTHCGWNSTMESLVAGVPVVACPQFSDQTTNAKLVEVWGTGVKARANEEGVVEREEIKKCLEMVMEGGEKGDEMRRNANKWKGLAVESMEYGSSGETNLKHFVESLEIRTH

SEQ ID NO: 6258 - protein, 467 aa, Zea mays
MAVDTMESVAVVAVPFPAQGHLNQLLHLSLLLASRGLSVHYAAPPPHVRQARARVHGWDPRALGSIRFHDLDVPPYDSPAPDLAAPSPFPNHLMPMFEAFAAAARAPLAALLQRLSTSYRRVAVVFDRLNPFAATEAARLANADAFGLQCVAISYNVGWLDPGHRLLSDYGLQFLPPDACMSREFVDLVFRMEEEEQGAPVAGLVMNTCRALEGEFLDVVAAQPPFQGQRFFAVGPLNPLLLDADAPTTPPGQARHECLEWLDRQPPESVLYVSFGTTSCLHADQVAELAAALKGSKQRFVWVLRDADRADIYAESGESRHAMFLSEFTRETEGTGLVITGWAPQLEILAHGATAAFMSHCGWNSTIESLSHGKPVLAWPMHSDQPWDSELLCKYFKAGLLVRPWEKHAEIVPAQAIQKVIEEAMLSDSGMAVRQRAKELGEAVRASVADGGNSRKDLDDFIGYITR

SEQ ID NO: 6259 - protein, 490 aa, Citrus clementina
MVSENQKLHVMFLPYIAPGHMVPMVDMARLFAANGIQVTIILTTMNARRFQNAIDRDSRLGREISLRILRFPSQEAGLPEGCENLMSTSTPETTKKLFPALELLRPEIEKLFREQNPNCIVSDNLFPWTVSIAEELGIPRLAFTGSGFFNNCVSHSLEHHQPFKNIVSETQKFTVPGLPDQVKLSRSQLPDIVKCKSTGFSAMFDELNNAERRSFGVLMNSFYELEPAYADHFRRVTGKKAWHLGPVSLYNRDVDDKAERGDKSCVSKHSCLSWLNSRKPNSVLYICFGSLTRFSKEQTLEIAAALKESGHSFIWVVGKILKTDDDQEEESWLPDGFEDEVRRNDRGFIIKGWAPQVLILEHQAIGGFLTHCGWNSILEGVSAGVPMVTWPVFAEQFNNEKLVTQVLKFGLPVGNEIWKIWATQDSPVINRGNIKNAICAVMDNDDQEAVKMRKKANHLKELAKKAVEEGGSSCNDLKALIEDIRLYKHK

SEQ ID NO: 6260 - protein, 474 aa, Unknown
  Description of Unknown: Oryza sativa Japonica Group sequence
MAQAERERLRVLMFPWLAHGHINPYLELATRLTTTSSSQIDVVVHLVSTPVNLAAVAHRRTDRISLVELHLPELPGLPPALHTTKHLPPRLMPALKRACDLAAPAFGALLDELSPDVVLYDFIQPWAPLEAAARGVPAVHFSTCSAAATAFFLHFLDGGGGGGGRGAFPFEAISLGGAEEDARYTMLTCRDDGTALLPKGERLPLSFARSSEFVAVKTCVEIESKYMDYLSKLVGKEIIPCGPLLVDSGDVSAGSEADGVMRWLDGQEPGSVVLVSFGSEYFMTEKQLAEMARGLELSGAAFVWVVRFPQQSPDGDEDDHGAAAARAMPPGFAPARGLVVEGWAPQRRVLSHRSCGAFLTHCGWSSVMESMSAGVPMVALPLHIDQPVGANLAAELGVAARVRQERFGEFEAEEVARAVRAVMRGGEALRRRATELREVVARRDAECDEQIGALLHRMARLCGKGTGRAAQLGH

SEQ ID NO: 6261 - protein, 511 aa, Medicago truncatula
MNSTPKCYNDLHFIFIPLMAPGHLLPMVDMAKLLARRKVKVTILTTPLNSIRFQSTIDREIQLGSQIQIVHIKFPSVESGIPEGCESVDTLPSMDLMSNFYIALCKMQNSLENVFEKLRPIPSCVISDKHISCVAEIAMKFKVPRIIFDGTNCFHLLCNHNLRNFNNIPNEGKFIVPGMPDQIELRKCQLPGLFNPGENKKLNGFREEVREIEEKYSYGVVVNSFEELEEKYVEEYKRVTGYKVWCVGPVSLSNNDELDKFERGKKLNSNDESQYDKILKWLDSWPSNSVIYVCLGSLNRATPQQLKEVGLGLEATKRPFIWVLRGAYGREEMEKWLYEEGFEGRVKNRGFLIKGWAPQVLILSHKAIGIFLTHCGWNSTLEGISCGVPLVTFPMFAEQFYNEKVVVQVVKNGVSVGAQSAVHLGEEEKCCVVVKRENVRDAIENVMGEGEEKEKIRGRARKYADMAREAIEEGGSSYRNMTLLIEDIMSSDRCTTIGGTTPYTTLMWHHK

SEQ ID NO: 6262 - protein, 465 aa, Setaria italica
MAGDGRSPTTGRRVVMFPFPFASHTTPMLQLAGLLRARGLGVTMLHADFNAPDPARHPELAFVSIRESIPDEVATSADLVQQMIGLNDACEAPFHAALAAELARGGGGQSGQREVACVVVDGQWYKMPGAAGRVGVPALALRTDGAAAFLTLLSTPRLRADGYFPINGDRLDEVVLGLEPLRVRDLIRVDGSDDETMLHFIACVTDAMRASSSGVVLNTFDAIEAPELAKIRQELSRPAFAVGPLHLLAPAAQQEEQHAPDRGCLAWLDERSPRSVLYVSLGSVATIDLTAFEEMAWGLAGSGVPFLWVIRPGSVRGAGDDDAPPPFPEELIETVRRRGKIVAWSPQREVLAHPAVGGFWTHCGWNSTLEAVCEGVPMLVHPCFGDQTVSARYVTHRWGTGLDVGRVFERTAMARTIRRLMARELGPQAPRERARLLMRQARHCVEEGGPASSALDDLVEYMWGL

SEQ ID NO: 6263 - protein, 468 aa, Ipomoea nil
MKEGVELFFFPALGMGHLLSAVEIAELLIHRDHHISITIFILKPPFDLKITSFIQSQTSQTRLKFVTLPIDEPIDSTNIPTPSMIPIDPFKPRVRECVQETIRTVRLGGFVIDMFSTAMIDVANEFGVPTYVFYTSGAAVLGFLLHMPSITVDEGMEDLRGYKRDLNIPAYVNPYPPNQFPSALLDQHGFAMFLAMSKLISSTKGVLVNSFLELESHAIKALSHYPNSPPVYPVGPILNLAGAGKDSQQILEWLDDQPEGSVVFLCFGSEGYFPEEQVKEIAIALERSGKRFLWTLRCMPEKGSLIPGEYSDPGEVLPNGFLERTQGVGKVIGWAPQVAILSHPGVGGFVSHCGWNSTLESIWFGKPMAAWPIAAEQQANAFQIVKEIGIGVDLKMDYKRDFKDATKFSEMVRAEEIERGIRSVMDPLNPIRLKAKEMSEKSRSAIVEGGSSYTNVGRFIQDVFSNIN

SEQ ID NO: 6264 - protein, 420 aa, Hordeum vulgare
MRKEEFGEQELVVAAVLADLLSPSGRDLAGLCGGLLRRRPYLHAPAAGSSALSVRQAGRGAEVTTRRGEGGEDSEQAQVPPPETVAATMEHILAVNTSCEAPFRERLAALLDAPGARDEVACLVADAHLLALVRVARRLGVPTLVLRTGSAACFRNFLANPVLCEKGYLPVGAESKLDAPVRELPLYRVRDLMGANSRSRHGHELMCELLSRAVEAVRSSAGFVLNRFDALEADDLARPRRRARAPASVLYISFGSLASMSGADLAEAAWGVANSGQPFLWALRPGIARGAALPDGFATATGGRGLVVGWAPQEEVLAHGAVGGFWTHGGWNSAMEGACGGVPMLCRPCFGDQMGNARHVEHVWRAGSALDGGVLERGAVEAAVRRLMRGEEGEGMRGRARELQSRAAVADGGSSGSAST

SEQ ID NO: 6265 - protein, 528 aa, Oryza sativa
MAAASAAKELHFLLVPLVAQGHIIPMVDLARLLAGRGARVTVVTTPVNAARNRAAVEGARRGGLAVELAEIAFTGPEFGLPEGVQNMDQLVDIAMYLAFFKAVWNMEAALEAYVRALPRRPDCVVADACNPWTAAVCEHLAIPRLVLHCPSVYFLLAIHCLAKHGVYDRVADQLEPFEVPGFPVRAVVNTATCRGFFQWPGAEKLARDVVDGEATADGLLLNTFRDVEGVFVDAYASALGLRAWAIGPTCAARLDDADSSASRGNRAVVDAARIVSWLDARPPASVLYVSFGSLTHLRATQAIELARGLEESGWPFVWAIKEATAAAVSEWLDGEGYEERVSDRGLLVRGWAPQVTILSHPAAGGFLTHCGWNATLEAISHGVPALTWPNFSDQFSSEQLLVDVLRVGVRSGVTVPPMFLPAEAEGVQLTSDGVVKAVTELMDGGDEGTARRARAKELAAKARAAMEEGGSSHADLTDVIGYVSELSAKKRQERDAGETAQQPPPSPAELGDISGDKVEADPALSVQS

SEQ ID NO: 6266 - protein, 485 aa, Cephalotus follicularis
MESKALTKKPHAVCVPYPETGHINPMLKLAKLLYHKGFHITFVNTEYNHKRLLKSRGIDSFDGLPNFRFETIPHDFPRLSLKTIEDVAIIHAYMKNCQDPFKDLLLKLNGSSSSSSVPPVTCIVSDTLMNFTVDAAVEFSIPVVSFWTSSACCLICHFYTRQLNESSYTALKDESNITNGYLDTIIDFIPGLEGIPIRYIPSLLRIIDPDKIFLKLTVNEIERIKKAAGFIIHTYDALEKDVLSALSSMLPPVYSIGPLPYFTNQIQDDDLNLLGSNLNLWHEDSQCLEWLDSKEPDSVLYVSFGSTTVMTSDQLVEFAWSLANSKKNFLWVIRPDLVSGDSASLPAELLEETKERSRLVGWCPQEQVLNHPSIGGFLTHCGWNSMMETLCAGVPTICWPFFADQATNCWFNCVKCGVGIEIDNNVKRDEVERLVRELMDGAKGKEMKKKAMEWKKLAEEATTSPNGSSWKNLDAIVKLLLSPNK

SEQ ID NO: 6267 - protein, 447 aa, Glycine max
MDHQNKHVAVFAFPFGSHLMPLLNLVLKLAHSLPNCSFSFIDTHKSNAILFPKPHIPNNIKAYSISDGIPEGHVLGKNPTEKLNLFLQTGPENLHKGIELAEAETKKRVTCIIADALVTSSLLVAQTLNVPWIALWLPNSCSLSLYFYTDLIRQHCASRAGNKTLDFIPGLSKLRVEDMPQDLLDVGEKETVFSRELNSLGKVLPQAKVVVMNFFEELEPPLFVQDMRNKLQSLLYVVPLPSTLLPPSDTDSSGCLSWLGMKNSKSVAYVCFGTVVAPPPHELVAVAEALEESGFPFLWSLKEGLMSLLPNGFVERTKERGKIVSWAPQTHVLAHDSVGVFVTHCGANSVIESVSSGVPMICRPFFGDQGVAARVIEDVWEIGMMIEGKMFTKNGLVKSLNLILVHEEGKKIRDNALRVKKTVEDAGRPEGQATQDFNTLVEVISRS

SEQ ID NO: 6268 - protein, 448 aa, Vitis amurensis
MDKHHFLLLSWPAQGHISPTFHLVKLLLRLGVRVTFTTFASGFRQIATLPTLPGLHFASVSDGYDDGNRSNFSMDEMKRVGSQSLSNLLLSLSNERGPVTFLIYGLVLPWAATVAREHGIPSAFLSTQSATVIAVYHRYFKAHDGLFNTELGNPLNISLELPGLPPLKYEDLPSILLPGNPYASVLPCFQEHIQNLEQDPNPCVLVNTFDALEEDVIKALGHYMNVVAIGPLMQLDSSISCDLFERSEDYLPWLNSKPDGSVIYVSFGSLAVLQKKQMEEIFHGLMESHRPFLWVTRSTESEVEEMTNNSLSEEQGLIVQWCSQVEVLCHQAVGCFLTHCGWNSIMESLVAGVPVVACPQFSDQTTNAMLVEVWGTGVKARTNEEGVVEREEIKKCLEMAMEGGGKGEEMRRNAEKWKGLAVECMRECGSSANINLKHFVESLEVRTH

SEQ ID NO: 6269 - protein, 386 aa, Helianthus annuus
MREARNGIWSAISGMTCRPHVLVADLFSSESLPIADEFHMRKYVYVPCLACFLALTTYLHVLDKEVRGQYVDQMEPLRIPGCVPVQGQDVPDRMLDRDNRQYNEYVRMGINFTTLSNGILVNTWRDLDSASLDALKYNEILKSVVKVPVYDIGPLTRVVDPTGSEGNNVIEWLDMQPVESVIFVSFGSGGTLSAEQIAELAWGLELSQQKFVWVLRPPAGNTKDGAFFTSGSSVPCGPLDFLPEGFMNRTGTRGLIIPLWAPQASILNHESVGGFLTHCGLNSIYESILAGVPMIAWPLYAEQRLNATLLTDELQVAVRPAVLPVVEEVGREEIQKMVRSLMEGEEGKMMREKVKLLKESANHALMVNGSSYKSMCEFITGCQNNG

SEQ ID NO: 6270 - protein, 455 aa, Arabidopsis thaliana
MAQPHFLLVTFPAQGHVNPSLRFARRLIKTTGARVTFATCLSVIHRSMIPNHNNVENLSFLTFSDGFDDGVISNTDDVQNRLVHFERNGDKALSDFIEANQNGDSPVSCLIYTILPNWVPKVARRFHLPSVHLWIQPAFAFDIYYNYSTGNNSVFEFPNLPSLEIRDLPSFLSPSNTNKAAQAVYQELMDFLKEESNPKILVNTFDSLEPEFLTAIPNIEMVAVGPLLPAEIFTGSESGKDLSRDHQSSSYTLWLDSKTESSVIYVSFGTMVELSKKQIEELARALIEGGRPFLWVITDKLNREAKIEGEEETEIEKIAGFRHELEEVGMIVSWCSQIEVLRHRAIGCFLTHCGWSSSLESLVLGVPVVAFPMWSDQPANAKLLEEIWKTGVRVRENSEGLVERGEIMRCLEAVMEAKSVELRENAEKWKRLATEAGREGGSSDKNVEAFVKSLF

SEQ ID NO: 6271 - protein, 477 aa, Morus notabilis
MEKSSTFRSQDQKPPHVAIFPSPGMGHLIPVVELAKRLVVHHNINVTFIVPNDGSTMEPQKKLLQALPKPMISSIFLPQMSFDDLPADSVNETRIALSVTRSVPALRQSLKALTESTRLVALVVDMFCLDAFDVAKEFNVLPYMFTFYNALVLSLAFHLPKLDETTTCEYKDLPKPVKLPGCVPVHGRDLGDPAQDRKHTIYKVLLNISKRSYEAAGIIVNSFLDLEPGALKALKEGFYNNPPVYPVGPVVQTGSSSSDPCLSWLDKQPKGSVLFVSFGSGGTLSQDQMTELALGLEMSGARFFWVAKSPHEKTAARFFSVESNEDPFDYLPKGFLERTKDVGLVVSTWAPQVQVLSHGSTGGFLSHCGWNSALESIVHGVPLIAWPSYAEQRTNAVLLADDVKVAIRVKVNDKGLVGREEISGRVRELMEGELEGKLIRARVKELKDKACLALSKEGSSTKSLAEIAQVWVNNCQP

SEQ ID NO: 6272 - protein, 482 aa, Vigna radiata
MAEAHVLIFPLPLSAHVLSMLKLAELLVLQNLRVTFLTTDTIHSRLARFGEIKVLSESYPTLHFKTFSDCNDEGDHPGFGDRIWDFISSVTLHAKPFLRDILLSHTPQIPKPSCVIQDGIFGSLSSGVATELNISIPIIHFRTVSSCCFWAYISATKLLQFQELPIRGDDDMDRIIKHLPGMENLLRCRDLPSFFRPNKEGNSTFESYADRSRQSLAADALILNSFEDLEGPVLSQIRHNFSKVYTVGPLHHHLNMRKAESNKGKEIPRFKNSVFQVDRSCMTWLDAQPEGSVMYVSFGSTTIVNKEDLMEIWHGLVNSKKGFLWVIRPDIVAGKHNEDRIPNEVKEGTKERGCIVEWAPQEEVLTHKAIGGFLTHSGWNSTLESLVAGVPMICWPYFADQQINSRFVSEVWKVGLDMKDICDRDVVEKMVNDVMVHRREEFLKSAQAMAMLAHKSVSPGGSSYTSLHDLIEYIISASREND

SEQ ID NO: 6273 - protein, 551 aa, Helianthus annuus
MHGYGCDAWTNTVHIHNKRCMLKHALHKISIYNTPLKPHKEPTKLPPSEYPMASLHTDLHFVLFPLMAQGHMIPMVDIARLLAECGSTVTIVTTPVNANRFKPVIARAVEDKLKIQFLELQFPSTEVGLPEGCENFDLIPSAQLFPKLFIAANMLEEPAENKLRGLTPAPSCIISDNLFPWTNEIARKLNIPRLVFHGPGCFTFLCIHIAMNTNVLDEIVSDSEYFVLPSLPDRVELTKVQASSWGRKDKETAAYFETIRKAEEAANGIVVNSFQELEPYYAEELAKVKDKKVWCIGPVSLCNKNLLDIAERGSKGAISEHDCLKWLDSREPESVIFVCLGSLARLSTEQNIELGLGLESSKKPFLWCIRHATEELERWLIEEEYEERVKDRGLIIRGWAPQVLILSHRAVGGFVTHCGWNSTLEGISAGVPMVTWPHFADQFINERFIVDVLKTGVKIGAEVPVMVGEQDKFGVVVNKEDIKRSVEDLLDKGEEGEARRKRSRELGEMAKKAMEDGGSSHLNMRSMIQDVVEMLGKNITPPNQDSIVQES

SEQ ID NO: 6274 - protein, 479 aa, Amborella trichopoda
MGSTMADKPHALCLPFPGQGHINPMMKLAMLIHSRGFHITFVNTHFTHERIAESCGPSALTGLHDFRLETISDGLPQDHGRILKLPELCEAALKNFPAPLKQLIVEINESGDVPPVSCIVSSGFLNFTQEIADEVGVPRVALWTTSACGYWGYFHVPDLIQKGYTPLKDEKCLSNGYLNTRLDWVPEMPDICLKDMPSFIRTTDPNEYMLHFTKDETQKAFKSSALILNTFDEFETEILDAMKAKLPCPIYTMSPLLTFASHACKDQVNQIPTNLWKEDSYCLEWLDNKEIGSVIYVNFGSIAVLTTHQLNEFAWGLAKSQKPFIWIIRKDLVMGESAILSQEFTNEIKERGLITGWCNQAQVLSHPSVGGFLTHAGWNSTLESICNGVPMICWPFFAEQPMNCRYACSKWGIGMEISSGLKREEVEGLVRELMEGEKGRELRSRVKIWKETSKAAIKFGGSSYCNLDRLIKEVLMKQQ

SEQ ID NO: 6275 - protein, 491 aa, Solanum aculeatissimum
MDNGSNQLHVLFLPYFATGHIIPLVNAARLFVFHAGVKVTILTTHHNASLFRSTIDNDVEDGHSVISIHTLRFPSTEVGLPEGIENFSSASSPELAGKVFYAIYLLQKPMEDKIREIHPDCIFSDMYLPWTVNIALELKIPRLLFNQSSYMYNSILYNLRLYKPHKSKTITSTDSISVPGLPDKIEFKLSQLTDDLIKPEDEKNAFDELLDRTRESEDRSYGIVHDTFYELEPAYADYYQKVKKTKCWQIGPISHFSSKLFRRKELINAVDESNSCAIVEWLNEQEHKSVLYVSFGSVVRFPEAQLTEIAKALEASSIPFIWVVKKDQSAETTCLLEEEKLKNKGLIIRGWAPQLTILDHSAVGGFMTHCGWNSILEAIIAGVPLVTWPVFAEQFYNEKLVEVMGLGVKVGAEVHESNGGVEISSLVIESEKIKEAIEKLMDDSKESQKIREKVIGMSEMAKNAVEEGGSSWNNLTALIDDIKNFTSTTNV

SEQ ID NO: 6276 - protein, 464 aa, Citrus unshiu
MESKPKACCKVHAVCIPIPFQSHIKAMLKLAKLLHHKGFHITFVNTEFNHRRFLKSRGEHSLDGLPNFRFESIPDGLPASSDESSTTQDMYSLYGFLPFTVTAAQQLGLPIVLLFTISACSFMGFKQFRTFKEKGLFPVNDKSCLTKEYLSRLIDWIPGMKDIRIRDLPSFVRSTDSKDIMFNLCVEATENASKASAIIIHTFDALEQQVLNALSFIFPLQLFTIGPLQLLLNQIEEKDGMLNSIGYNLLKEETECLKWLDSKEPNSVIYVNFGSLIIMNKQQLIEVAMGLANSNHPFLWIIRPDLVTGETADLPAEFEVKAKEKGFIASWCPQEEVLNHPAIGGFFTHSGWNSTIESLCAGVPMICWPFLGDQPTNCRYTCNEWGVGLEIINGGDDNRVSRNEVEKQVRELMGGEKGKQMRNKASKWKRFAEEATAPDGSSATNLEKLMNQVLLSEGLIPSKN

SEQ ID NO: 6277 - protein, 457 aa, Phalaenopsis equestris
MSPDQIQPVTIVAVPSPGQSHLNQLLHFSLILSSRNLPVHFAAPSSSIHQAQSRLHGWPSASLLNIHFHELPLPPPTPLSPSSPPHLAHALRLFETPLLLRPSLSSLLHSLSLSSRRLILLHDTFMSVAALEAASLSNAESYTFQCVSAFQALFELQPNLRPKTRTNPFVAAHFEDWVPAPILERVKLLEHHRPVEVGIIANSCRPLDGEFVDLLADEYWPKNIFAVSPLHLIGPKLAVGSEKRHQCLMWLDKQPPASVVYVSFGSTTTMCGAQVQQLAIGLRRSGQRFIWVIREADEGAIGSEGENGNGSLPAGFEEEMQGVGMLVRGWAPQVEILAHPSTAAFVSHCGWNSTMESLSSGVPIIAWPMQIDQPRNAMVLTEYWKVGVIVREWDHRKEVVSAERVEEVVRMVVVEEEGKGIRDRARKIGEEIRRAVTEDGTSIADLKAFVAHITRNG

SEQ ID NO: 6278 - protein, 299 aa, Unknown
  Description of Unknown: Citrus x paradisi sequence
MSNIRLRDLPSFIRTTDPNEIMFDFMGSEAQNCFRSSAIIFNTFDEFEHEALEVIASKFPNIYTVGPLPLLCKQVDETKFRSFGSSLWKEDTDCLKWLDKRDANSVVYVNYGSVTVMSEQHLTEFAWGLANSKRPFLWILRPDVVMGDSVVLPDEYFEEIKDRGLIVSWCNQEQVLSHPSVGAFLTHCGWNSTMESICGGVPVICWPFFAEQQTNCRYACTTWGIGMEVNHDVKRGDIEALVKEMMEGDEGKKMRQKAWEWKKKAEAATAVGGQSYNNFDRLVKMVLHQGNWTGNETLH

SEQ ID NO: 6279 - protein, 925 aa, Cinnamomum micranthum
MAERELQLQLPHVAILSSPGMGFLIPLAQLAKRLVLHHHFSVTFITHTIDSLQKTQDTILNALPKTIKTISLPPISPQEMPPDAKAETLISITQNLSLPSLRHVLNALASTHCLTALVVDLFGTDAFDVAGEVGVPPYLLHTSNLLDLSVDIRLPTLDGMFSSEPVKLPGCRPIPREDLVEATQDRSNEAYAWLLHHGSRFIQAKGILVNSFAELEPETLIALRNEPSHPPIYPVGPLVQSGSTGKTNGPKPDWLRWLDDQPHGSVLFVNFGSGGALSFEQMKELALGLEMSKQRFLWVVRSPNDKEACATYFGVKSDQDPLDFLPEGFLDRTKGVGHVVPLWVPQIEVLSHESTGGFLSHCGWNSTLESMVHGVPMIAWPLYAEQRTNALMLVEDLKVALRPSANDSGVVEREAIAKVVKDLMDGEDERKIIKKRMMKLKEASIKALTPEEGSSYRAMSELELKLLPHVAILSSPGMGLLIPLAQLAKLLVLHDHHFSVTFITHSHTIDSLQKTQNTILNTLPNSVQTIALPPLAPQKIPQGAKSATLISITHKCSIPFLRHVLKNLASTHRLVALVVDLFGTDAFDVAGEVGVPPYLLYTSNFLSLSVDIHLPTVDSTFSSEPLKLPGCRPIPREDLVDAAQDRSNQAYTWFLHHGSRFKQAKGILVNSIAELEPETLMGLREEPSHPPIYSVGPLVQSSSTGMADGPKPNWLRWLDDQPRGSVLFVSFGSRGSLSFEQTKELALGLEMSQQRFLWVVRSPNDKEASASNQEPLDFLPDGFLERTKGVGHVVPSWVIQIEVLSHESTGGFLSHCGWNSTLESMVHGVPMIAWPLYAEQRTNALLLVEDLKVAVRPSADESGVVKREEIARVVRDLMDGRDEGKRVNRRMIEVKEASIKAMATEEGSSYGALSEVLSKWNGYML

SEQ ID NO: 6280 - protein, 493 aa, Citrus unshiu
MAQSKENIVMFPFMAQGHIIPFLALALHIEQRHKNYSITFVSTPLNIKKLKSSLPPNSSIDLHEIPFNSSSHGLPPNSENCDVLPYNLVIHLLRASTSLKPAFKEVISSLINQGRPPLCIIADIFFGWTCGVAKELNVFHAIFSGSGSYGLACYYSFWTNLPHNKVTSDEFVLPDFEEASRIHKSQLALNMLEADGTDSWSLFQGENFPAWVNSNGILCNTIEEFDQIGFIYLKRKLGLSVWPVGPILLSLENRANAGKEGGTSIKFCKEWLDSKDENSVLYISFGSMNTISASQMMQLAMALEASGKNFIWVVRPPIGFDINSEFRASEWLPEGFEERIRDSKRGLLMKNWAPQLEVLSHRATCAFLSHCGWNSVLEALIHGVPIIGWPMAAEQFFNAKFLEQEMGVCVEVARGKTCEVKHEDVVAKIELVMNETDKGKEIRRKVSEVREMIKNAMKDEEGCRGSSVKAMDDFLSAAISMKNKINGRVNNGA

SEQ ID NO: 6281 - protein, 446 aa, Punica granatum
VAVLAFPFSSHAASLLTVIRHLASAAPASTAVFSFFSTHKSNRSLFSSSSSSAFNMIKAYDVTDGVPEGYVFHGKPQEDIGLFMRAAPEGFRKAMEAAAVDSGKRITCVVADAFFWFAEEIAAELRVPWVAFWTSGPSSLAAHLYTDLLRNKLHITDGIAGLGDERLNDFIPGMSNKMRLKDLPEGVLFGNLESPFSHMLLRMGRSFPRATAVALNSFEELDLSLTQHLKSHHIPTLLSIGPLNLLHLQLHGTHNLVAGAPRGSDEYGCLPWLDNQKPAPASVAYISFGSVTVPPRSELVAIAEALEASGVPFIWSLKEEVWDHGLPDGFLGRTREQGMLVPWAPQVDILSHGAVGAFVTHCGWSSLLEGIAGGVPMICRPFFGDQRLNGRMIGDVLGIGLTVEGGAITKEGLVRSLGMILNGDEGKRMREIVRHLRLQAGKALSP

SEQ ID NO: 6282 - protein, 481 aa, Arabidopsis thaliana
MHITKPHAAMFSSPGMGHVLPVIELAKRLSANHGFHVTVFVLETDAASVQSKLLNSTGVDIVNLPSPDISGLVDPNAHVVTKIGVIMREAVPTLRSKIVAMHQNPTALIIDLFGTDALCLAAELNMLTYVFIASNARYLGVSIYYPTLDEVIKEEHTVQRKPLTIPGCEPVRFEDIMDAYLVPDEPVYHDLVRHCLAYPKADGILVNTWEEMEPKSLKSLQDPKLLGRVARVPVYPVGPLCRPIQSSTTDHPVFDWLNKQPNESVLYISFGSGGSLTAQQLTELAWGLEESQQRFIWVVRPPVDGSSCSDYFSAKGGVTKDNTPEYLPEGFVTRTCDRGFMIPSWAPQAEILAHQAVGGFLTHCGWSSTLESVLCGVPMIAWPLFAEQNMNAALLSDELGISVRVDDPKEAISRSKIEAMVRKVMAEDEGEEMRRKVKKLRDTAEMSLSIHGGGSAHESLCRVTKECQRFLECVGDLGRGA

SEQ ID NO: 6283 - protein, 479 aa, Glycine max
MEQEDTVVLYPAPGIGHIVSMVELAKLLQLHAHSITILLTTGLLDHPSIDTYIHRISISHPSIFFHRLPHTSLSTTTTVSMAAKAFNFININTPNVATTLTQITKSTNIKAFIIDLFCTSAMEPASSLGIPVYYFFTSGAAVLSLFSYFPKLHQETHVSFKDMVGVELRVPGNAPLRAVNMPEPMLKRDDPAYWDMLEFCTRLPEARGIIVNSFEELEPVAVDAVADGACFPDAKRVPGVYYIGPLIAEPQQSDVTTESKQCLSWLDQQPSRSVVYLCFGSRGSFSVSQLREIANGLEKSGHSFLWVVKRPTQDEKTKQIHDTTTTTTTMDFDLSSVLPSGFIERTKDRGLVVSSWAPQVEVLSRGSVAAFVSHCGWNSVLEGVVAGVPMVAWPLYAEQHVNMHVMVGEMKVAVAVEQREEDGFVSGEEVEKRVREVMESEEIRERSLKLKEMALAAVGEFGSSKTALANLVQSWTTHV

SEQ ID NO: 6284 - protein, 220 aa, Genlisea aurea
NRCMKWLDQREANSVIYACLGSLGRISPLQFRELASGLELSGRPFVVVVKGVELMPEIEEWIESDGVEERTKDRGLFIRGWAPQVLILSHPSIAGFVTHCGWNSTLEGICAGVPMATWPLFGEQFLNEKLVVQILRIGVPVGAKEVVHLGEVEKSKTNVNREMIKDAIEKVMEEGGEGKERRRRVEELKRAAKIAVEAGGSSHRNVSLLIQEIEDLMKTK

SEQ ID NO: 6285 - protein, 447 aa, Helianthus annuus
MASPPTNLHFVLFPWPAQGHLIPMVDIARMLAERDVMVTVITTPVNTNRIKTVIDRAIEANLKIQVLDIQLPFAKAGLPEGCESFDMIPSVSYVANMFLAMKLLEEPAEEMLRVLYPPPSCIISDGGFHWTSDVAKRLIASSWGKGNTKETRETFERTQEAEKAAFGIVVNSFDALEPKYVEEFAKATGKKVWCIGPVSLCNKSLEDIAERGNKAANGEHDCLKWLDSREPRSVVYVCFGSFSSTLTHQAIELALGLESSNIPFVWFVSRTSDEFEKWTSEGQYEERIKGRGLMVRGWAPQILVLSHQAIGGFITHCGWNSTLEAICAGIPMVTWPHFADQFLNERFIVNVLKIGLKIGVEVPITYRGKEKFEVMVKREAIKLAVEGLMNDEDEDEAQTRRNRAKEVAQMAKKAMEDEGSSHLNLTMMIAAITEELALKNKSIKDIV

SEQ ID NO: 6286 - protein, 457 aa, Ipomoea nil
MGSSECHVAVLAFPFATHAAPLLSLVEQLSAAFPSARFSFFNNHDSNSGLFRGRNPAAGKVKAYDVWDGTVAGEALVTHEEFIMAMPGNYVKAIAEAEAETGTKFGCFLTDAFLWFGGDLAAERGGVPWIALWTAGACSISAHLYTDFVRSLAAATPTANGKHRLDQKLKVIPGMSELSIGEMPGEILAKDLQAPFPGMIYNMALKLPGANAVVLNSFQNLEPTVTDDLRSKLQKVFNIGPMILRQAAATPKPPIISDDHNCLPWLDSLPPASPPAVYLSFGSGLTPPPDEIVALAEALEAKRAPFLWSLKPHGVKHLPEGFLERTKEFGKIVPWAPQVQVLSHPGVGAFVTHCGWNSTLEAISFGVCLICRPFYGDQQINSRFVESVWEIGVKVEGGKFTKDETLKALNVVLDSDRGKLLKENVVKLKGEAMEAVKPNGSSTKDFQELVHLLNGYF

SEQ ID NO: 6287 - protein, 467 aa, Medicago truncatula
MSNSKTHIFIFPYPAQGHMLPLLDLTHQLALQSTFTITIIVTPKNLPILTPLLSTHPNTIKTLIFPFPSHPKIPSDVENLREIGNPGNYPFINALSNLQNPIIQWFNIHHNPPVALISDFFLGWTQQLATQLNIPRIAFYSSGAFLTAVINRCWRNPLFFQSQEVVEFNEIHGTPSFKRDHLPSLFRRYVESDPESEFVKESFISNDESWGFVINTFSALEGGYLDNIEGQFGNRRLFAVGPLGYDRVGSDLEDGSDVLRWLDRWDEDGSVLYVCFGSQKLMRRDQMEALAFGLERSGIRFVWVVKVPSTVEQIEEGYGLVPEGFEDWVSGRGIVVKGWVPQIAILGHRVVGGFLSHCGWNSVLEAVVAGVGILGWPMEADQFVNAKLLVEDMGVAVRVCEGMDTVPDPNKLGRVISSIMSGDSPQKKRAKLMKEEALRAVSKDGVSSKELNELVHALQQLGVKERS

SEQ ID NO: 6288 - protein, 466 aa, Aegilops tauschii
MAPGEANTATAGGPCRRRRRVLLFPLPYQGHINPMFQLAGLLHARGFAVTVFHASFNAPDPSHHPAYDFVPVPEGLPAAGPGTVVETLEHILALNGSLEAPFRERLAALLEAPGAGDEVACLVADAHLLTLVDVAREQGVPTLVLRTGSAACFRNFVANPMLCDRGYLPVSGESELDAPVRELPPYRVRDLMGADSSGRHGHDLMCKLLSRAVEAVRASAGFLLNTFDALEAADLAATRRDLAGVPVFDVGPLHKLSPASSSSLLQQDRSCLDWLDAQAPASVLYISFGSLASMSGADLAEAAWGVADSGQPFLWALRPGLARGAALPDGFAAATEGRGLVVGWAPQEEVLAHGAVGGFWTHGGWNSALEGACGGVPMLCRPCFGDQMGNARHVEHVWRAGIALDGGGVLERGAVEAAVRRLMRGEEGDGMRGRARELRSRAAAAVADGGSSRLSVDKLVNHILSL

SEQ ID NO: 6289 - protein, 470 aa, Medicago truncatula
MEKTIHIAVVPGVGYSHLVSILQFSKRLVQLHPNFHVTCFIPSLGSPSTTTKSILQTLPSNINHTFLPPVNPNDLPQGTTMESQMHLTLNNSLPYLHQALKSLAKEIPLVALVVDCFAFEALSIGKEFNMLSYIYYPTAATTLAWIFYLPKLDEETSCEYGDIPVPIKIPGCVPIHGRDLMSPTQDRSSQAYKQFLALLKLLSFADGVLVNSFLEMEMGPISAMKDEGSENPPVYPVGPIIPTIESSGDANHGLECLTWLDKQQPCSVLYVSFGSGGTLSQEQIVELALGLELSNKIFLWVLRAPSSSSSSAGYFSAQNDADTWQFLPSGFLERTKEKGFVITSWVPQIQILSHNSVGGFLTHCGWNSTLESVVHGVPLITWPLFAEQKMNAVLLSEGLKVGLRASVNENGIVERVEVAKVIKCLMEGEEGEKLRNNMKELKESASNAVKEDGSSTNTISQLALKWRNLV

SEQ ID NO: 6290 - protein, 470 aa, Medicago truncatula; identical to SEQ ID NO: 6289

SEQ ID NO: 6291 - protein, 514 aa, Dendroctonus ponderosae
MWLSSVFLFGVLCTATHAAKILGVFMMPSYSHQITFQPIWKELSLRGHEVTVYTPSPLNDPSLTNLTEYDLSFSYKIMETLGKAGFDVSKLFDLFTQVSEAQLKHPYMQDLIHNANNNTFDILLVEFLWLPYFAFKDIYNVPFVGITSLPLTLMASESLGMWKHPILEPEFLLGFSQAETFKQRVTSWAFNIAYRLIGQLKMTPTFEAQLKKYFKTVSKSARDLAKEVDLVLGNYNSVLQNVKPMVPKFVPLGGIHLHPQQPLPLDLEEFLANLQNDVIYFSLGTNVNPTSISKMQLAKIYKVLGELPYTVLFKHQLENLPEDLPKNFYVKEWFPQQDVLGHPKVKLFVTQGGIQSLDEAISRKVPMVIIPFLGDQQSNAARCAKLGIAEVINFQKYTEEEFKEKVNLVLSDITYQQNIEKQNFIFEDQPISSLDKAIFWIEYVLRHNGTSHLNYAGVDVPFYQFYHLDIFGFLAAVIWVFIFVARKIFIVAALSIKAPKKLVLKRNEKRTKFL

SEQ ID NO: 6292 - protein, 694 aa, Mustela putorius
MLNKNILLFSLKISLLGITLCGNVLIWPMEGSHWLNIKIIIDELIKKEHNVTVLVASGALFISPASKPSLMFEIYKVPFGKERIEGIIKDFVLTWMENRPSPSTIWRFYQEIARVLKDFHILSREICDGVLKNQNLMDKLKKSKFEVLISDPVFPCGDIVALKLGIPFMFSLRFSPASTVEKHCGKVPFPPSYVPAILSELSDQMSFTDRVRNFISYHLQDYMFDSLWKSWDSYYSEALDGSHWLNIEIILEELIQRNHNVTVLASSTTLLINSNPDSPVNFEVIPVSYTNSNIDSLIEHMIMLWMDHRPTPLTLWTFYKELGNLLDTFFRINIQICDGVLNNPKLMARLQKGSFDVLVADPVTICGDLVALKLGIPFVYTLRFSPASTVERHCGKIPAPASYVPAALSELTDQMTFGERVKNTISYPLQDYIFQSYWGEWNAYYSKVLGRPTTLCEIMGKAEIWLIRTYWDFEFPRPYLPNFEFVGGLHCKPAKPLPKVLWRYKGKKPATLGDNTRLYDWIPQNDLLGHPKTKAFITHGGTNGIYEAIYHGIPMVGVPMFADQPDNIAHMKAKGAAVEVDISTMTSEDLLNALRTVINEPSYKENATRLSRIHHDQPVKPLDRAVFWIEFVMRHKGAKHLRPAAHNLTWFQYHSLDVIGFLLACVAAAIFLVTKCCLFSYQKFGKTGKKKKRE

SEQ ID NO: 6293 - protein, 518 aa, Helicoverpa armigera
MNNWTLFLLSSICLSHVCAYKILVVFPYPGTSHSILGEGYVRHLLRAGHQVTYLTAIPYKKPHPNLKQVVVASVVEKFEFFKTLDFEKFISKEVDLTDMQVMYETMITVANRSLTHENIQKFLMDTNEKYDLVVAEWLYHHLYSGFAAIYNCPYVWSSSMEPHTAVLSLIDEPGNPAYFPDHMSPVSPPLTFSQRAYELYYLFYLRRVLWSIRGLEQKTYEEVFGPAAAKRGITLPTLEEVKYNSSLMFGNSHISSGDPQRLPINHIPIAGYHIQDVVPALPENLQKIMDEAPYGVIYFSMGSMMKSSTMPTKLKRDFLDVFGTLKETVIWKLEEELTDVPKNVIMVKWAPQPSILAHPNCKLFVTHGGLLSTTETIHYGVPIIGIPLFADQFINVMRAVRKGFALQVDLGYDTPANLKVAIEEIVSNPKYTQKVKDLSFIYHHRETKPGHTLVHWIEHVIETNGAPHLRSPALHMPFYQKMYLDLLGIVLLGLIVLIKAVQILLRLAKKSDVKKKRS

SEQ ID NO: 6294 - protein, 516 aa, Ostrinia furnacalis
MHHLYKFVLSALLCLTACEAYKILVVFPMASKSHGILGEGVVRHLLNAGHEVTFITPFPKDNPDPKLRQIKVSDKIDHDVNYIKQILDNELEPFNPFKVVELFMEFSRRTMQNPQVQEMLNDPKETFDVVVAEWMFSEIYAGFAAVYGCPLIWLSSVEPHTMILQLVDESLHPAYNPGLMSSSAPPFTFMERVKELFFLGASLLLKNVFLMSYEREAYEEMFVPVIKMKGRPVPTFDEIKYNVSLILGNSHVSLGQATRLPQNYKAVAGYHIDTNFKPLPEDLKNILDNAKHGVIYFSMGSNLKSKDMPEKLKMSLLKMFGGLKQTVLWKFEDTIEDLPKNVHILHWAPQPAILSHPNCILFITHGGLLSFAEAVHFGKPTIGIPVFADQFTNVERAVKKGFMKRVDLSYTMADELEVAIKEVTTNPSYTTRAKELSLIFHDRPTHPGSELAHWVSHVIKTGGAPHLRSPALHTPFYQKMYLDLVALVLVVVVALRLIVKRICCRRSRLSREKKNQ

SEQ ID NO: 6295 - protein, 550 aa, Drosophila obscura
MLIMEKRLAICLLVILLLAMGTRTIEGANILGVFSSYSPSHVIVHMAVVKTLADRGHNITVVTQMEPKFQPHENVTVIVALPTPEQEALTRAYMERVSSEKESFWSFLANLLLQPSPVLHGQYEWTLHPKVKSLYENPQTKYDLVILGLMLNDFQMGIAAKLRCPVIITWVGVPMPFTDSQVGNIDDPSYVPSVNVALEPGHLTMGFGMRFVNFFKNSFLKIVNVLIRHKMNEFYNQAFANDSDPDFPSYNEMKRRISLLFYNYHAPSEGPIRPTVPQSIEIGGIQVKEKPDPLAKDLAEFLDNSTNGAIFFSLGTNVKFSGIRPQIVEILYKVLSKLPQRVVWKWEDMESTPGNSSNIYFSNWLPQDDILAHPKTRLFITHAGKGGIAEAQFHGVPMLAFPIFADQPGNAEIMAKSGFGLHLDILTLTEQALEETIRELLENPSYRASVGRFSALYRDRPLTARQSVVYWTEYVLRHQGAYHLQSPLLHMDIIARHNLDVYGTLLLFGLVTLLLLRLVFRYVFRKVLSVVRGHSYRPKASNSKLKDKIF

SEQ ID NO: 6296 - protein, 241 aa, Papilio machaon
DLQQYLDASDNGVIYFSFGTNVQLSLLPQNKIEMFENVLSQLPYNVIWKRDTVVMKSKNVEVYKWLPQADLLRHPNIKLFITQGGLQSTDEAITAAVPLLGIPMLGDQWYNVEKYVYHEIGQRLYFEELTEEKLKNAILEVAEDKRYKDNIIRLRSLMVDQPQTPLERAMWWVDYVLRHGGAKHLRAPAANISWTEYLELDLLLFITCTLFILFGSIFLIMKVLVRIVASKIKHDKKLKNE

SEQ ID NO: 6297 - protein, 527 aa, Danio rerio
MNDRIVRMAASALVLCLFCLVSAEAGNLLVIPALGSHWTGTRPLVEELGRRGNRVVVVFPEENVNMVPAKHTTTLTYPVPYTKAQIQKGTDAAISKLFSADVSSDVGRFQNFFTTMDMLKVIISRNAEGLLLNKDLLKKLQDYNFDAILTDPFETVGVIASEYLSIPAIYMQTSHPCGADVLASQCPAPPSYVPKGLTHFTDRMNLWQRSVNFVRTLVQPVACSRMFAHADEIASKVLQKKTSVMEIMSRAALWFMHFDFAFEFPRPVMPNMVVIGGVDTKKPEPLSQELEEFVNGSGEHGFVVFTLGSMVSQLPEAKAREFFEAFRQIPQRVLWRYTGPVPENAPKNVKLMKWLPQNDLLGHPKVRAFVTHGGSHGIYEGICNGVPMVMLPLFGDQGDNAQRLVSRGVAESLTIYDVTSEKLLVALKKVINDKSYKEKMMKLSAIHRDRPIEPLDLAVFWTEFVMRHKGAEHLRPAAHDLNWIQYHSLDVIGFLLLILLTVIFVTVKSCMFCFRKCFKKSQKKKKA

SEQ ID NO: 6298 - protein, 515 aa, Halyomorpha halys
MISWLCFLVTVAMAESARILAFFPQETPSHQFIFRPVIEGLAKNGHDVVYVSAYPYKEIPMNITQIDLSKYDVNDYEFEDIDLMAIAETNLMVYTSEMYSYGEIMARYYVGNKEVQELIHSDQKFDAVMFESYFYQEYLSALIHKFNAIPIEVMTLGDCAWINEMSGIQDNPAYQVDCKSGLSGNMNFWQKLYNVYVTTFTILSSYYYLHYTQQSLMDLYFNYTGWESRPSIDILSRNRSLILTNFDHVFADPYPMAPHRKDIGGINIKPPKPLPEDLQKIMDESKHGVIYMSMGSHIDPSQFKDQISAFLEVFRELPQRVILKYDPEKAGEIPANVKVSKWIPQQDVLAHKNCVLFITHGGLLSLSEAIYNGVPLIGIPVFADQGKNMAMMESQGIGRVLNLRNITRDSVSWTVREILSNNRYREASLRRSKMLRDMRHSPVEEAVYWIEHTLKYPFALTPKSTNLSAIEFHLIDVKIFITLALILILYILYFVFKIAKNIALKAIRKPKQKVN

SEQ ID NO: 6299 - protein, 694 aa, Miniopterus natalensis
MLEKIILVLSLQISLLGITLGGNVLIWPMEGSHWLNIKIIIDELIKKQHNVTVIVYSGALFIDPTYNPSLTFEIYKVPFGKERMEEMIRNFILTWMGNRPSPSTIWRFYQEIGIVLQDFHALCREICDGVLKNQKLMEKLKKSKFEVLVSDPVFPCGDIVALKLGIPFMFSLRFSPASTVEKHCGKTPYPPSYVPAILSELNDQMSFTDRIRNFISYHLQDYIFHTLWKSWDSYYSEALDGSHWLNIKIILEELTQRNHNVTVLASSATLFINSNPDSLVNFEVIPVSFKKSNIDSLIEHMIMLWIDHRPTPLTLWTFYKELGKLLDTFFQINLQICDGVLNNPKLMSRLQKGGFDVLVADPVTICGDLVALKLGIPFMYTLRFSPASTVERHCGKIPTPASYVPAALSELTDQMTFAERVKNIISYPLQDYIFQSYWGEWNLYYSKVLGRPTTLCETMGKAEIWLMRTYWDFEFPRPYLPNFEFVGGLHCKPAKPLPKVLWRYKGKKPATLGANTRLYDWIPQNDLLGHPKAKAFITHGGTNGIYEGIYHGVPMVGVPMFADQHDNIAHMKAKGAAVEVNINTMTSADLHDALKTVINEPSYKENAMRLSRIHHDQPIKPLDRAVFWIEFVMRHKGAKHLRPAAHNLTWFQYHSLDVIGFLLACAASAIILVTNCCLFSCRKFGKTGKKKKRE

SEQ ID NO: 6300 - protein, 530 aa, Neodiprion lecontei
MTGKIIALAALIFFMSILHRGNASRILCVFPSASVSHQVVFRGLTLALRERGHDLVVVTPNPVRDPNLKNYTEIDVSFLYEENYETDYIELRRNARWIDWFWNVTPILHLYGEKTFDHPEFKKIYAPDSGEEFDLMLTETLYWPAFLALGKRFDVPIIGMTSLGLALNLQYSVGNPILTSHQSNWDLAMKEVSDSPTLFERLKNFYDVWKFIYNYNTEFMPAQHAIAKKYLGNEIPELGEIERNLSLIFTNQQGPISYLRPNVPNVIEIGNFHVSKKIKPLSKDLQKTLDESKQGFIYMSLGSNVKSTMLDKKSRSEFIAAFSKLPYTVIWKFEDEFLPGKPDNVIIIKWAPQQAILAHPNLKAFVYQGGLQSTEEAISHGVPVIGFPVMADQDMNVNKMVSLGVGKKLEITDVKRDDLIEAIQSVATDGSYKQRMLNLRELLKDRPYNSLKNAVWWTEHVIRHRGVPHLRSSTADEPWYQRGDMDVIFLIAAVFVISVMTASAVLYQLLVYSMKIFGNQQSVNRKEKLK

SEQ ID NO: 6301 - protein, 493 aa, Strigamia maritima
MLLTILLLALINPTTSGRIVFVTSVATQSHVLFLSPLIEELIERGHQITFINNKHPMKKSIVDNMTTIHIDVNPQFISNLTRLIFEEYRNDPFPALLHLERRNAIATCRTFVANDGVQHLIRNNTRFDLAIATSFVEECPFVVAKLLAPRVIYVNFMRHILSPYAHAMSVPTPYSFVSHLTLFTSPMRLIQRFTNAVVSFYHSVSFRDFDSTDEILENLVHDAPRIRQVRDKLSAILYGGDPVLSEAVPQMPYTVAVGGLHCRAARALVGELKSLVEASGENGFIYFSLGTVLETSSVNNATVRAFLDAFSRLRQTVIWRSAEEIDGLPPNVKIVRWAPQQDLLGHPKIRLFLTQGGLFGLQEAVYHQVPVVGFPAFFDQFANLKRLSDLGCGLRLDLFNLTAELIHSSIDRVINEPRFKACMVKKSLVFRDQEQSPLHRAVYWVEYFMRHRQMISAENPTGHLNWIAYFCIDVVLFFPLCFLGVFILAKRIK

SEQ ID NO: 6302 - protein, 519 aa, Plutella xylostella
MVSIKVLSLTLLLFLVNCSDCYHVLLVFNLPGKSLSILGESFVRHLLNAGHEVTYVTPFPMKNKPKNNFHEVDVSEGVDKLFAEICNITFLLENTHFESDEEEIMHLGVEVAEMTLTNPNMLKLLNDKTQKFDVVVGDYLASELVAGIAYYYDCPMIWSYSMGVDSAILKLVHEPTNPSYIPDYISLNIPPMSFKQRVGELWTLIRNTWVKRHSVMPRELAFYKKFYKPLLEKKGKPLPAYEDVMYNASLVLVNSHQASGGLAAIPQSVKLIGGHHINGPVAPLPDDLKEIMDSSTNGVIYFSMGSIWKSASMPITLRDNLVRMFGSLKQTVLWKFEEDIPNLPKNIHTLKWAPQHSILAHENCMLFITHGGLGSSTEALHFGVPIVGVPISFDQFLNINRAVSKGYALSVKLSYNLHNDLKVAIDTIATDPSFKSNAKALSEIYHDRPVKPGVEIPHWVRHVVRTRGAPHLRSPALMVPWYQKTYLDLVALVLLVVLSLFLLVKKLMFTVKSAKVKSN

SEQ ID NO: 6303 - protein, 530 aa, Laodelphax striatellus
MTSTSVILCLFLLSLFKCTTNAANILSIIPFPMKSHDRIYKPLLFELARKGHNITEITQFKTATLPKENYHQIVVETRHKDLYEILDFHEIRQKTTIWNVGFQDLKLFWDMDYAVIEDILKSNRVSSMINSKTTSFDLIICEGFFGYEALFAFGHRYSAPVIAVSSLGSTIYMNPHIGNPILSASYPNFLLPYTHDMGLMGRFHNSLLNLVTLLAITIYQLPYQQELVERFFTESFKQNSIKPIGINKLVKEVDLVFINRHPVLGFPRPLTPNVIDIAGLHLHKFDNNSNVDKELMKIMDDAIMGNVYFSFGSNVNMAKMPQQQKTAFMKAFSRIPQSVLVRWDDTTMPDRPKNVHFRKWFPQNEILGHRNCRAFITHGGMLSIEEAVYNAVPILGVPFFGDQPMNVLRAEQLGLGLRLEFDNITETSLNWALNEIITSKSYSETAKKLSTIFRDSPQAPLDRAVYWVEYVLKHKGADHLKCYARHLNWFQYTSLDVIAVGLLIAYFVFYCVHKIYSLFVRNMSKKLKRQ

SEQ ID NO: 6304 - protein, 529 aa, Caenorhabditis elegans
MIRMSVVSISLVLCTLSLVSSLNILVHSPAYAASHTNFMARLADTLTEAGHNVTFLVPIALEERRDKLGVKLTKDVIIVEQDEEMKSKLVPHSGSIEFLWIIEMDSSSIDAMFSWYNEIMILTCENFMRNKQVMSELKSRHFDVAIAEPFTICGLGLFEELNIKKTILVSSCAHYDFMLPHIGEPEDFSSVPTLSSKVGEEMSMTEKWENYRLVAETKASLAKLFDAETRIYRESFGSDIPDWKELMSSASLYFTNSNPFIDYPRASIQKTISIGGITVDFQQIKSEKLNKEWEEVLNKRQKSMLISFGSNVPSDKMPAAWKAGIFETIKSMPNVTFIWKYESDDVSFADGISNIHFSKWVPQTALLNDPRLSAFLTHGGLGSTNELAYCAKPAVMVPIYGDQTRNANMLARHGSVIVLHKKELANVQRVKKAVHDILYNKQYTESAERIAEMIKNQPKTPKETVVRYTEFVAKYGPFPQMAPHGRKLTYFQKTFLDIYSLFALGVVSVLTVAFLVIRYVLSCFKLKKD

SEQ ID NO: 6305 - protein, 527 aa, Aedes aegypti
MASGTRPLISKLLLAAAIITFSCNSLFVGETEAANILGILPTWAKSHYIIGAEYLRVLALAGHNVTVVTPFRLGDSPPNYHEIVMDGILDASAGLEKNYFKYKDGSFLMILSMLYNDLADTTCRFVLKHPKVVTLMKSDQQFDVVIVETFMTESIYGLAQHFNAPLVVFSTLGSNLWTNGLVGAPSPYSHMAHLMLGFTDHMNFYERMINTVVGVGEQVYYELVYLPRQKRFYDEAFSHASMSFDQQLKNTSLVLLNQHFALSSPRSYPPNMVEVGGTHIRDVRPLPEDLQQYLDEAPDGVIYFCMGSHIQSKHFPSDKRDAFLKVFSQLKQRVLWKFEDTSIPDIPSNVLIRSWMPQNDILAHRNVKLFITHGGLLGTTEALYHGKPIVGIPIFGDQLMNVQKAVRSGYGLKLDYELINEASVREVIETVLMNESFTERAREISGWYHDKPMTAAETAIFWTEYVIRHRGAAQLRSPAVELKSWQYYLLDVGAVLVGLCLFVFAMIYKCLGAIRTILDKVNKYKRD

SEQ ID NO: 6306 - protein, 402 aa, Paracoccus salipaludis
MARIAFCLPALSSHAAVHAALARALAARGHDCRMVGGEGLGPLAAREGIAFESLGTREPDLHNAGLLRTLAATAATTRAFVRQGPDALARLSPDLVVADQAEPGASLAAEAAGLPRATLASALPLDRDEAIPPPFVDWPWADGDEGRRRNRGGWRVADALMVLQSRALARGCRDHGLPMRRRLDDWISPDLDLRQMVPSLDFPHASGSGARAVGPLRDGGTGEFDIHTDGRPLVFASLGTLQGGRLALLAAIARAAEDLGVCLALAHCGGLTDAQAQALPGGAVVRDFFPQRAVLARAAACVTHAGLNTVLDCAAAQVPMVAIPLAFEQPATAARLAFHGAARVLSPRRATRATIREALGAVLSDPSYRAALAAPAAEIAVAGGVSRAADLIETRLVRRAAA

SEQ ID NO: 6307 - protein, 520 aa, Papilio xuthus
MRLMLILITTICLLNYSEANNLLVVFPIPGKSHSILGHAFVRHLLNAGHKVTYITPIPMKDVNPALRQINVESNKNCFAPEEVLDIQKLMRKEVDMKDMPTLFTMMFNIANATIQHENVQNLIQDPTEKFDAVIAEWMYSELYSGFSAVFNCPLMFFLSVSPHNMALSLIDGIPNPAYTADHIKSNTIPPFTLWSRVQELVTLLDWKIYTWWVNDRNVNSYDKAFKSAVVRRGRILPTLDEMKYNASLMFGNSHISTSDGIPLPRNFIEIGGYHIDGNIEPLSKDLKKILDEAKHGFIFFSMGSMLQSSKMPEAIKSGLAKIFGQLKQKVIWKFEGLLPDKPNNIFMLDWAPQQSILAHPNCVLFITHGGLLSTTEALHHRVPIIGIPMFADQFININRAAAKGIGKRVDLNYDTPKNLKLAIEEILGNSSYGDRINELNYIYHDRTTSPGAEITRWVQHVIKTKGAPHLRSPALLVPWYQKLYLDLIFLIIIIIVIFSIVIKRLIGYKKLNINVSKKRS

SEQ ID NO: 6308 - protein, 528 aa, Apis mellifera
MKRNIAGLSFLLHVLIIANELECYKILSVIPTPSYSHQIPYRQLWLELHARGHEIVVITTNPMPNISLPNFTQIDISQSYSCLKELNFIENRFEHLSWLTFLQNYVMSLYTCFLTEVFNSSEVKKLYAPDNPVKFDVLLAEFFYGPAMCAFAHRFNVPLIGLSSLGMITLNEFILGGLVLPSHEYTWEMEANTGTNLPFFKRLSNFVTMWSFLYNVNFNIFFFQQKLAEKYLGPLPPLTDIMRNTSLIFINEIDILSPARPKLPNMISFNFFHVSDNPTPLSKDLEEFLDDAEEGFIYFSLGTNVRSSYLPKEIIRMFCNIFSKMPYKIVWKYEQDLPEKSGNIYIKNWLPQQSILAHPKIKLFIYQGGQQSTEEAINFGVPVIAFPILGDQDYLVRRIEALGIGKYFDIRTIIPDQMKFKNAIDEIITNEKYKNRVLDIRTQIRETSQDVKKIAWWTEYVIRTKGALHLRSTLAWEPWYQRYDMDIIIFLTIVIFIIFLIVISIIVNILMYFYKMMDTSTHRKHKIH

SEQ ID NO: 6309 - protein, 542 aa, Strongylocentrotus purpuratus
MAHLSSNIIHFSCVLLIFMNMPSNIFSSKILISAIYGEGSHFLAGASLGEGLARKGHDVTMLISNAYEHRLEDPRYANLSFEVFKHPVPPEEVREAFAFASTLVFRDDNIEFFSLMKNMSKRTVDDCEAVVTDKELMLRLEKNDAIIVDITWPCARYIQVVLEEKMKSQRHRTMISLSATNPWSGYLKLGGAPVNYAYFPEISTGFNNRMTFSQKILNIIQTNLIAVVGEQLTPPLYREMGKRLGLRPNIHPIFDMQDFDLHLLNINFASDFVTPLSPSIIPVGGLTVRPLQTLNEELEEFVQSSGEHGVIVFTLGTYLASITTIRPEIVTMFAEAFRRLPQKVIWQLKELPDWELPSNVKAMPWLPQNDLLGHPKTRAFMYQGGNNGFQEACYHGVPIVVIPLQGDQYDVAARIEARGLGKKIEKLELNAEIIYETLTEVIKNPSYKKVADQVSAIYKDQPMSAPDRAAFWIEHVIKFGGAYMRSPANDLTFIQYHLLDVYAFLTAVIVIFLAVVYYTLKFCLTRCCRMIGLGSSRKSKTE

SEQ ID NO: 6310 - protein, 534 aa, Zeugodacus cucurbitae
MQWPIVYVGVFALVAIASMVPAGDAARILGFFPSPSQSHLIIHCALTETLARAGHNVTVIATKPNPYPNAAYKYIYIETPLLSATFMDKFINDPPPFYIKYPHLVTEASQMNNRTLWHPEMQQFLREHRVGSFDLLLLGYFINDFHVGLGAHFDCPVIISFMVQPIFSLNEMIGNPSEHAYVPTLLSGLKQPMDIWARLQTYLLYLYEYFVMGPLLESAQQTHYSYNFPVSSGYPNFLEARRNVALIFTNHWFAQGPIRPNVPNLIEIGGIQIKEQPDPLPTDIAEVLNGSPEGVIYFSLGTNVRGDLLKADKARIIFNVLSKLPYKVLWKWDENDCPGNASNIIIKNWLPQDDILGHPNVKLFITHGGKGSVVESEYHGVPMVGIPFYADQHANLKELQQLGFGLYLEYPELTEDSFRRAIEDVINNPKYTKAIRAFSKVYRDRPMTPRQSVVWWVDYVLRHKGAKHMQSPAVYLTRWQRMSLDVLSLLLAIAAVVVGFGVVMVRFCISRIRARVVKRKGSVTNGVSKKKKLK

SEQ ID NO: 6311 - protein, 527 aa, Macaca nemestrina
MLNNLLLFSLQISLIGTTLGGNVLIWSMEGSHWLNVKIIIDELIKKEHNVTVLVASGALFITPTSNSSLTFEIYKVPFGKERIEGVINDFVLTWLENRPSPSTIWRFYQKMAKAIKNFHIVSREICDGVLKNQQLMEKLKKSKFEVLVSDPVFPCGDIVALKLGIPFMYSLRFSPASTVEKHCGKVPYPPSYVPAVLSELTDRMSFTDRIRNFISYHLQDYMFETLWKSWDSYYSKALGRPTTLCETMGKAEIWLIRTYWDFEFPRPYLPNFEFVGGLHCKPAKSLPKEMEEFIQSSGKDGVVVFSLGSMVKNLTEEKANLIASALAQIPQKVLWRYVGKKPATLGNNTQLYDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQLVKPLDRAVFWIEFVMRHKGAKHLRPAAHNLTWFQYHSLDVIGFLLVCVTMAIFLVIQCCLFSCQKFGKIGKKKKRE

SEQ ID NO: 6312 - protein, 505 aa, Drosophila erecta
MKRSPVSWSLLWMGCTGLFLLADSPAPVKSHHILGVFVNVHRSQLMVHLAVCRALLQRGHHLTLVTTLPLEEQEVRGNVSHILIPWEQPTVEGSSSSDLLLRLQRMFRRLEHSGDLLDLPEWKRFLSNPPNTPFDLLLLGYHFNDHLLGVAAHFNCPVAIVSTQQPTGFVNSLMGNPEERSYVPQPYDGHQRSGISARVFGIWEKFIEILARRVLARIYSLHFPEPRYPSFETMRRSVVLALSNHHMISEGPIAPLLPSMVDVGGIVLEQQRKKTPLEISAGNRSLIIFSLGTRFTWRKSTAELVQTFTKAFSRFPDYDIYWTYDGPNGSAISLDYPHLKVAKWWPQSQLLQSGRTRLFITHGGKGSLSEALFYGVPMLGLPLIGDQRANLQRMHSKNWGLTLSTYSRNLTHLELAKAISRMISNSSYGETILKASQMYRDRPMNSSDLATYWIEYIVRHKGAKNLYNPARQLNMIEYHCIDIYLIVYGFLILTIAILRKVNRLL

SEQ ID NO: 6313 - protein, 519 aa, Strigamia maritima
MKLDTHLGLTLVFLFSTQLSEAYKILYLSPLASQSHKNVFDPVISELGTKGHEVTVVSPYKLAQPVTNVKEIIVDVPMNPEILKLMSEVMKHTDNHPLRSTFIFKPFTLAACEAYFGNPQVKLLLKAGQQFDIVIVNAFLNECALATAPLLGQYVIMHSPATLFPWTPVFVPQPPSYVPNIFLPYTSKMNFFQRLNNVLTNIGYDLMYNYHLVPAVQATVASHVAGNPSVHQAHKQVSFTLTNADPVLISARPSMPNVVDVGGLHCRKAKPLPTDLEDFVQKSGNDGFIYFSLGSNAQIKHLGKETKAHLLNAFSKLKQKVIFKSEEDLKDLPSNVKLVKWAPQQDLLGHPKIRAFITHGGLLSLQESVYHEVPVVAVPLFGDQPSNVARVEELEIGAKLAFNDISSDTLLAAVNKVLSKSYKENMKKYSAVFRDHLQHPLQRAVFWIEYVARHEGAKHLRSPGEDLNFFQYFLLDVIALILVAALAVFWVLFTVGKYAKRKFSPCKVKKSEKQEKKQQ

SEQ ID NO: 6314 - protein, 466 aa, Branchiostoma floridae
MEGRPKLHCSILILVILCLMLNRKSSAEKVLMVPRPQYDSHWMVEASIGQAFVDRGHTVTVVVGEDIVAKRRAERPDFTFETFPDDGEVMRLIKQASKQTEKTWDWKYCEHLLGKDGQDSDLMGRLKTAQYGVVISDSLLRCGTIVAANLGTPHVVNSPDGGKFIDKLATGVPLPLAYVATAESPFTDKMTYLQRVENACFYFGFVSIFKSWSFANEFDDLVHKYVSEKETIHSLRSRTDLWLYHTDTVLGFPRPSMPNMVQVGGLMADRPVVPLSVILGGCPNHTKTGWRADGRPPRRPSLRAHPKTRAFVTHVGKNGMYEALYHGVPMVCFPLFGNAARVVDRGLGVSLDFRTVTSDQLYHALLRVLTNNSYHETAARLSRLHRDQPQSPMERAVWWIEHVIKHGGLPHLRARAVELPWYQYYLLDVAAFLLGICSAVLGTLWYSCSFVCRKVCCKRGGKLKSQ

SEQ ID NO: 6315 - protein, 289 aa, Drosophila persimilis
MRRNASLVLINQHVSLSFPRPYAPNLIEVGGMHIDGKLSPLPAKIEKFLNESEHGAIYFSMGSNLKSKDLPPEKVQEILKAFRGLKQRVLWKFELEDLPNKPDNLFISDWFPQTDILAHPKVLAFVTHGGMLSTTESIYHGKPVIGLPIFSDQFFNMAHAEQTGYGIMLDFKSLKAADLKAAIERITSVPSYTEVIRGMSFRYRDQQQTPLKNAVYWVEHVTRHQGAAYLQSAAQRLNWWQYHNVDVLLIIFGVVILLLVALPLAIWRLLRGVFGGGKTQPQGEKRKRN

SEQ ID NO: 6316 - protein, 531 aa, Drosophila willistoni
MAPNPCQILLLALSGAVLIGGSQCANILGIFTSVSPSHLIIQMSTIRVLAEKGHNVTVITTLKPTVTHPNINLIQVPLTREEENILNEILAEMTRADNKNFVLNMISMFHQTGFIFDKLESVMFDQKIKNLYENTDNKFDLVLLGYFMNGYQLGLARKLKAPVIIVETILPSVMLSDIIGNPNELPYVPEFTLSVDKGKPMTFSQRLENVFSNLAFKVALFLQESRNEKVYKSLYGDDPAMPSYEQMKKNVSLIFFTSHGISEGPIRPNVPGAVEIGGIQIKDDPDTLPKNMENFLNEAKHGAILLSLGSNMKSSFLRPDLVQKMFYVLSKLKQNVIWKWEDLEKTPGKSANILYSKWVPQDDILAHPNLKLFITHAGKGGITEAQYHGKSMLALPIFGDQPANAESMVKAGFGITLNLVTLEEESFNESLLELLENPKYAQAVGTFSSLYRDRPLSARESVLYWSEYVIRHRGAPHLQSPVVHMGFIASNNLDIYLLVVIILLISLLLLKILIKFIYKKLINKSQKGKKE

SEQ ID NO: 6317 - protein, 539 aa, Drosophila simulans
MIEYTKIGFLIVLLLGTKTQSSDGANILGVFGTHSPSHVIVHMAVMKALADRGHNITVVTQMKPKMAAHENITVIIAPPTEERHKFIKEYMAEVSNEKPSFWETMVKAIVQSSNQLEGQYEFMMHPNFKEIYENPKTKFDLVILGLMANNYQLGIAAKLKCPVIISWVGIPLPFMDSIVGNVNDPSYVPTVNVALKAGQNTMDFGLRFVNFLKYGVMCVFETVLDYKMNQFYERAFANELEFPDYQEMKRRVSLLFYNYHSPSEGPIRPTVPQSIEIGGIQVKEQADPLPKELAKFLDNADEGAIFFSLGTNVNTNTFRPDTVDILYKVLSKLPQRVIWKWEDLKNKPGNASNIFFGNWLPQDDILAHPNTKLFITHAGKGGVAEAQYHGVPMVALPIFGDQQGNAEIMTKSGFGRWLDILTMTENELKETIHEVLENPTYRETIGKFSTLYRDRPLTARQSVIYWTEYVLRYQGALHLQSPIIHTDFVARNNLDVYGVVLLVSILLIVIIRFLFRKILNVASGYSNRRESLAKKLKSN

SEQ ID NO: 6318 - protein, 512 aa, Drosophila pseudoobscura
MRLASLLLLLIGQVYGYSYLMVLHTGSKSHHTVGVALARGLIAVGHEVTLISPFPQTKPLQNLIDVNTPNIISVMANHKARILENAKLPVLHRYPRIHGMGLDLTEALLAAPAVQQLLKEQRTFDGVIVEAFMNDAHYGFAEHFGAPLIVLSTLGATGWTSDLVGTPSPPSYVPHNLLQFSDRMDFTQRAQNLGFQVFEYFYQRWFNLPRQEALYRKYFANNTQDFYEMRRSTSLVLLNNHVSMSAPRPYSPNMIEVGGMHINRQARQPLPKDIEEFIEGARHGVIFFSLGSNLNSQDLPLEKRRAIVETLRGLKQRILWKFEDENFPDKPENVFISSWFPQDDILAHNKVIAFITHGGLLSTTESIYHGKPVVGIPFFGDQFMNMANAEIAGFGITVKYHQLEAPLLRSAIERITSDARYAEKAREMSNRFRDQLAAPLDRAVYWMEHVTRQKGARYLRSACQDLSLVEYHNIDVLATFFGGLSLVIVLLWVLIRFVLVKLRGSSKKEKAN

SEQ ID NO: 6319 - protein, 519 aa, Drosophila erecta
MRIFTLILGLLSGLEYSSGYNYLMVLNSAGRSHFNVGHALAKGLVKAGHTITVVSVYPVKKPISGYTDINVPNVINVMGGDIAALWASIQKPVTQKLIDHYQMGFRITRGLFEDSNFQEFLKSNQSFDAIICETFYNDAHYGLAEHFNAPLIGLSTGGGLTFITDMVGSPAPASFVPHIMLPFNDHMSLYERLLNVAFLGYERLLLDYYYLPNQEKLYKEFFPGNKRCFYEMRRNASLVLINQHVSLSFPRPYSPNMIEVGGMHIDGKLSPLPEKIERFINESEHAAIYFSMGSNLKSKDLPPEKVQEILSALRGLKQRVLWKFELDKLPNKPDNVYISDWFPQTDILAHPKVLAFVTHGGMLSTTESIYHGKPVIGLPIFSDQFFNMAHAEQTGYGIMLDFKTLNAVDFRKAIERITSDPSYTKVVQGMSFRYRDQQHTPLENAVYWVEHVTRHQGAAYLQSASQRLNWWQYHNVDVLLIIFGAAFLLVIVLPFTIFKLLNKKLSRGEITQSTKAKRN

SEQ ID NO: 6320 - protein, 525 aa, Spodoptera frugiperda
MNGCFGVLILFFAICGSSVVKSARILAVFPTPSFSHHSVYKVYIQALVEKGHEVVVVKSTNNVNYKDINDNYADDYEATRYNVTEIDATLSQDYFKKLMKRAQVFRKRGLVADSYSVTADNYMGIVRMMSDQFKLPAVQKFLNNKKQKFDLLITEAFIDYTLVYSHLFNDIPVIQISSGYAVAENFETMGAVGRHPVYYPNLWRDKFYNLNVWDLINELYVELRLYNEFYKLADQQNRLLKEQFGQDTPTIQDLRNRVELLFVNTHPVFDNNRPVPPSVQYLGSLHLTHKHPKPIYGTIGELLDNATNGAIYVSFGSGIDTEEMESEFIEMLLKTFEALPYLVLWKYDGYLNRMPENVYIQSWFEQYDLLHHKNIRAFVTQGGVQSTDEAVEALVPVVGMPMMGDQAFNTNKYMELGIGRVVNTVSVNSKELIDAITDVVENPNYRKKINELRHVIRHQAMTPLHKAIWYTEHVINSKNRRGETMLKTKASNVNYSDYVMSYIFVPLASYTIMNHLRQLLRLNFV

SEQ ID NO: 6321 - protein, 425 aa, Dendroctonus ponderosae
MSKELTVQSKIRKIFAMYNEFAEAILGNQQFREIYTDENQKFDLIIAQIYVSPIMFGLSEKLKAPVIGVSSMGGWSGTHVAAGNHNPPSLYSEMFLHYNGDLTFVERIKSTLYYIWSRLYVYFIAMPKWDAIMRKYLGQDLPYLADIERNVSALFLNINPILYTPRPMVPTVVPLSFMHIQPPKELPEDIATELESPQNGVVYFSLGSNVKSVNIPEKIRSLLMKAFAELPYKVLWKFENEELLGKPKNVVIRKWLPQQDILAHPNVKVFISQCGLQSTEEAIDREIPMVGIPFIADQEMNSKRLAAWGVLRHIDYLNTTKEELVETIIDVAENPSYREKMQGLRRLMQDEPWTGIQKAVWWAEYVIRHKGTKHLKSPTVDIEWYKYLLFDVFAVLIGAPIAVLIIIIKLARNTTGKTKNKSKTQ

SEQ ID NO: 6322 - protein, 528 aa, Drosophila ananassae
MLVARPVILLLAILIASSNGANILGLFSSHSPSHLIIHMSVAKTLAEAGHNVTVVSMLPPKVTHKDIHVIVIPVTDEQEKVIENQMSEMASQRNSIISTLNRLMNGMDVMINSQADLLSHPQFQQIYDTKFDLMIMGYFLNEFQLGVAAKLKVPVIIDWMNAPMLAIDEFTGNPTEVSYVPNIGTTATPPMGFLKRAENLAKHLFLKYMMSALLSKSERIYEEKFGNDKSLPSLSEAKKNISLAFVNAHLISEGPIRPLVPAMVEIGGIQVKDKPSPLPKDIDEFLSKSTQGAILLSLGSNVKSSSIKPEIVQSIFKVLSGLKLNVIWKWEDPKNTPGSSPNILYKKWLPQDDILAHPNTKLFITHAGKGGITEAQYHGVPMVALPIFGDQISNAQAMEKSGYGLALDLLSITEESLSKALNEVLENKKYEEAVGKFSALYRDRPFSAKQAVVYWTEYVLRHKGARHLQSPVVHMNFIELNNIDVHALIIAILVLVILLLRLVVKFVWNKLCSKSKCTSNKSKKQKKP

SEQ ID NO: 6323 - protein, 859 aa, Eumeta japonica
MNIEWDFAETAFNTIVDSYYDTPYMEADYKNLFEPLARARGVSLPSYQEALHNVSILFENSHHAIGTPKSLPLNIVEIGGYHIPEGVPKLPEDMQSILDRSTNGVVYFSMGSVLKSAHFSEDTRKGLLRIFGSLPYTVLWKFEEELKGVPANVHVRPWMPQPSILAHPNTKVFITHGGLLSTLEAVHFGVPLIAIPVFGDQPMNAARAARSGYALKVDYGDRMVEELRRALDSMLEDDSYYRQAKRLSGLFRRRPVSPQKLIVHYTELAIETGGAGHLRTRSALYPWYQRLFLDQLAFVVGLVVGVVFVVKRLFRGRPESETKPSSESGGAQGGGAVRHVGLRLLSEAGHAFPRIADEPAGPQYPPTRPVGFAKRCGLPVLVPRVCQVQDYSTLFLLPDPVVVPLAGNAPIAILMQHSRSALASTHALSAERAADTNEPCQARAVSSRQSATRGHSASACGRSDLDPDPDLELRPDIHFGSILVFSRSPSPTIGPPCVQSADNWMKLAPLRKNTGGGILPLGGGLMPVWWGALSVVTCEEVVTGTWADGGVDSGVWVGADSVRAPDRDLADLSVVEVAELAESDSDSPSEPTRLLSEHVSSSYSIVPLKMALHWYSLATRGKKGIPMLRKLRHITDRDILKIVYYSICRSRINYCIPLGGGAAETYLIEAERAQRAILKVAAFLPFRYPTTDVCAPGMSSRMRYLLLLLLAAAVADGYRILVLFPVPSKSHSNLGFGLVRPLLDAGHEIIQNDPGARRRRSSRGIKLHVPSGRGAEQRLGSLRVLSSDSGYLYAYKFKLYGTDACPARITVIKCGRYRSYVRRVAWEEMDTGNLNCMQKTNTATWRIHHLQNQDLLPWL

SEQ ID NO: 6324 - protein, 529 aa, Ursus maritimus
MVAKEWISAIVLLQLCYTGCGLCGKVLVWPCDMSHWLNLKIILEELTERGHEVTVLVSPESFIIDYSKASTLKFEVVPMPPNREKAEKTLNDFLDVATNVMPTLSAWQSAMKLQEFLLRETGNLKLLCESVVYNRSFMKKLQETHYDVMVIDPVLPCGELIAELLTVPFVYTLRVSIGETLEKYCGKLPAPLSYVPVAMVGLTDRMTFLQRVKNVMFFIFSNFWIQQLDTQVWNQFYSEALGRPTTLCEIMGKAEIWLIRTYWDFEFPRPYLPNFEFVGGLHCKPAKPLPKEMEEFVQSSGEDGVVVFSLGSMVKNLTDEKANLIASALAQIPQKVLWRYKGKKPATLGANTRLYDWIPQNDLGHPKTKAFITHGGTNGIYEAIYHGVPMVGVPMFADQPDNIAHMKAKGAAVEVNINTMTSEDLLTALRTVINEPSYKENATRLSRIHHDQPVKPLDRAVFWIEFVMRHKGAKHLRPAAHNLTWFQYHSLDVIGFLLACVATAIFLVTKCCLFSCRKFGKTGKKKKRE

SEQ ID NO: 6325 - protein, 857 aa, Leptinotarsa decemlineata
MLLILLCVAQNVLQIQSSKILTIIPTASYSHHSPFQPLWRELALRGHHVTVLTTDPQKDESLTNLREIDMSYTYEIYKKHNVSDLLSDDSKSFMEMGKKLGIVFREAQHAQLSSAEVQELIHNKNYSFDLLIVEAQTPGMLSFAWRFQCPIIGVASLDSAMQYHDSMGNPIHPVLNPDYNLEVGEADEMTFLERFLSFIYIAAYKNLIYHKTFPAQYEIAKQYFGEDLPPLIDIQNNMSLLFVGTHPLFHNLRPLNLNTITLGGGMHIKQQKPLPEGLKQFLDGADNGVIYFSLGSNVKSKTMSNEFKKAIIGAFAEIPYKVLMKIDGELEDHCRICITMLFKLLCVVLQILGIHSARILTIIPTAFSSHHSPFQPLWRELALRGHQLTVLTTDPQKNTSLINLKEIDMSYTYDIYRKYNFTELLSSTDSIMELGSKAAVMFDEVQHTQLSSPEVQELIHNKNIHFDLLMIEAQSPELLGFAWRFQCPTIAITTLDCAMQYHDSLGNPIHPVINPDFNLEVGHPEEMGFADRLRSFLFIPLYKYFMYHMTYPRIHNAARKFFGDDLPPLKEIQDNISMLFISTHPLFHNIRPLNPNTITIGGGMHIRQPKPLPEDLKKFLDGAENGAIYFALGGNVNCESMSNEFRKTLVDAFAQIPYKVLIKIDCQLGDISSNVLVQKWVPQQDILRHRNVKLFITHGGILSLQEAVINNIPVIGIPFFGDQKTNLNKIVKWGSGIKLDRRKLSKNVLLYAINEVINNPKYREKAREMGDIYRDEEIPSLQRAIYWTEYVIRNKGARHLRSLAVKMPAWKYYMLDVIAFLTSIVLLITFVCYLALKFFFRSISRLSINKFSEKKYN

SEQ ID NO: 6326 - protein, 534 aa, Caenorhabditis remanei
MKFSIFILLILAELCTTYKVLVFNPAFGASHSNFLGKISDILIDAGHEVTMLIPVFVDGKKDLIGSKKVKNIIRLGQDPRIYQMQKEGATEELMRKKIWTMGAEITSMLGFIGNFSKTSAYQTDYMFAQTELIEQLREEKFDLGITESLFLGAFSFFDEIGIKTIINADSTLYMNGVKDALGEPAAVSYYPGLFSPIDDKMDFFGRVKNLLGYQFGMWFSTVKYDAEIGALPKSYKGSRDWRKILSSVAFNFVNSNQYIDYASPSLPKTVFVGGMQVNTKKSGKATLSKEWDEVLSKRKTNVLVSFGSNAFSCDMPDEFKNAFLEVFASMPETTFIWKYEEANSTLANHLPNVKLTTWMPQNDILADDRLTLFITHGGLGSSVELAYQGKPAVVIPLMADQPRNAHMLTRHGGALQLDKTLLDKPSEIKKAIETVLNDSNYKKNAQRLAKILEDQPNKPKDVVLKHCDFAVEYGPLETLNSEGRHLNTFQYYSLDIAFAVLVVFLIVLFILHLIIKFVFRLLKRTLLSPKKKVD

SEQ ID NO: 6327 - protein, 503 aa, Caenorhabditis brenneri
MRSFLLLFCLTTVYFIVDAAKILVYCPSISKSHVLLCAKYADLLHNASHDTVLFIPSYSSLLNDYDGAKHAKVWRLHNVTDAYDKKFDSFADVMENSHIGFIDRMTYDVDFWMDMCEDVVKQFDRLQPLIDYQFDLAIFNDIDPCNPAIVRSLNIPKTALLSRLPTLPSYVPSMEENPNHDRMSFFERMSNAYKYFQSIVVHYLQDRRVLHIFRKHISPDFPSITGIIRNVSLIMVNTDEIFDISRSYSPKFVYVGMIGAEKHANVTLSEDLDKIFSKGKLGSVFVSFGTVTPFRVLPKRIQSSIFNAIQKLPDYHFILKTVPGDTTTAEMFAGVPNVDFVNWVPQNTILKHEHLKLFVSHGGMNSVLETMYNGVPMVIMPVFTDQFRNGKNVERRGAGKMILRQTVTTETFYDVIHEVLKNNNYETAAKRISRMMKSRPFTPEERVTKWVNFILDHDTFDHFHLESNNLSFFEHNHLDVFFVFIVLPFVTYFVFRRVLKSSS

SEQ ID NO: 6328 - protein, 385 aa, Daphnia pulex
SKERYDLIILDGFSNDCTLLLAEVFDVPFIYLNCFPPTPWLLYAIGSPLAMDHFPNPSGTRDKMDLWQRTFNVVTQVVTGLGGLFIYNWHILPTIDRVASRVLGKHNLTPILDIQSRRLSLLMTNTHFSINFQLPTSPAVVEVGGLHLGGKLKRLPKDLVSFLDGSGDAGFIIVSFGSMLRGDGLPKDFRRLFLSVFARLPQRVVWKWENQSKLGESEELIPSNVKTISWLPQKELLSHRNARLFISHGGLLSKQETIFNGVPAIFLPVWADQPINAQKAEDDGYAIRLCWDELTEEILYNAIQAILTNPRYAKRMQQVSALMQDQIDKPMGRAIYWIEYVIRHQGAPHLRNASRDLMLPQRALLDVMCIFFIFTFSMIYVIYRL

SEQ ID NO: 6329 - protein, 385 aa, Helobdella robusta
MCTLILPKYLNVPFVSLANSYFAFDVRSPALPSFSFRYFQAEDNQKEMSFFVRFKQLMIFLFFSSSLSPLNRNLTLLHKYSPEYDTWEDLLRESLLFFHEVDHHFGNFLPVFPNHISTAGLTGIPAKNLPENILNFVNGRIVDGKELGLILMTFGSNVNYMSRSTMKKFLNAFGLLNETVIAKFSIDKKDLELISSIPPNVMVLKWLPQNDILGHPSTKLFITHCGNNGQHEALYHGVPMLGFPLFAEQHMNCKRMTVGGFGLSLNILSFTEDELLQTILDLLQNPKYENSIQHMSEAFRDQPMTAQERIVFWIEHVIKHGGSHLRSSAMDLPLYQFLCLDSVGCLLMIIISTLFFFAQLLILLWKKVAKHYKVKSSRNQLKKRS

SEQ ID NO: 6330 - protein, 519 aa, Saccoglossus kowalevskii
MQKLKKAAGIKNEDGNFTLGDLRCDKDTKKQYTKNIKPFERMGKHKILLAVLYVLILGFHVVHCANILIYGMHAAGSHTQNIAYVGEALIRHGHSVDVLTVSSDKFIHLYTELGVPTLEPVIINYENEDILPHFFDNKLTYGEAFEKMVGTNAAQCDAVLQHKKHLRDTLKPYDIAVTDAVCHCCAMLLKYIGIPYVLLHTMKDVGYATDVTAPLSYYPIEETTMMLTNKMTFTDRLQNTLASLLLPSYKDINMAFLRLYHKHNITPGIYSFQQASLHLLVKDFTIDYVHPLIPNVVPIGLLTTRPANGLPSELEEFMHSSGNEGVIVVSLGTLDQLLQVFSDNIKIVKWVNQNDILGHPKTRLFLTHGGTSSYREAIYHGVPMVCIPLMFDQYDTAAKIISKGVGSYVKMKSLNNENLYEAMVEVLSNKKYSEKAKQLSAIVKDVPMNATDTAVFWIEHVLQHGVTHLTFHEKQLSVIEYYLLDVLTVIAGTICIIFWSLRWFVVVLKRSVTNTTKYK

SEQ ID NO: 6331 - protein, 454 aa, Haemonchus contortus
MAHSHVRFMGNIADALFESGHNVTILSGIMDSRVNMVGHTNSIRQIPFHSKYLDQDGFGDLDLGNAAFWTSPVIEGRSMSTEDVRKVSERFRLLCKGLIENRELLDRLRNSRFDVALHELYELTAVGVLELIGVKKAIVVSAAGMTLHMKEITGIPPNPSFVPGLFTTYSDEMTFWERLDNFKLDIELNYRHLQWEKDLWKMFNDVSPGFSDLRELLKQKTGVILINSNEFTETPRPRGNIVRYIGGLAIPEPKPLNQKLNAILDKRHANVLFSMGSFAKASTMPLHMKKDILNAFAAFSNTTFIFKYDGEEDLELFKPYPNVHVMKWVPQVDLLSDRRLSLFITHAGLNSITEATYFGKPMITIPLFGDQFINAKNVRRMGLAVLIERNNLNKDTLIAAIREVLSPNANYAHKASTVARILRGRRAAARAEVSQWVELVAEEGLTAVWLFTAD

SEQ ID NO: 6332 - protein, 502 aa, Chelonia mydas
MIPLDGSHWFSMRSVVWRLWQRGHEIVAVVPEASVQIQPSEHYTVKTYSVPYTKEYLEAEFKRLGHHIFAPQPFLEKITKTFARIGNITAHLLSSCKQLLSNKELITHLKDSAFDAVLMDPMFLCGQIVAEYLSLPSVYFSRGIPCGFEFQATQCPNPASYVPKFFTSYTDHMAFPQRVWNVLVSSAEFLSCSLLYSSHEDLIREFLQQDLTVPELLSHASIWLLRYDFVFEYPRPVMPNMVLIGGINCGQEKPLSQEFESIVNASGEHGFVVFSLGSMVSEIPMKKAKQIAEAFGTIPQTVLWRYTGEAPPNLANNTKLIKWLPQNDLLAHPKARAFITHGGSHGIYEGICNGVPMVLMPLFGDQMDNAKRIESRGAGVTLNVLEMTSKDLSDALNAVINDKSYKENIMHLSALHLDRPIHPLDLAVYWVEFVMRHKGAPHLRPAAHDLNWIQYHSLDVIAFLLAAVLITMFISLKCCQCCCRKCFCKKGRVSKSRKSKAE

SEQ ID NO: 6333 - protein, 521 aa, Heliothis virescens
MAYKFTAGLFLLTLLVSSEALRILVCFPMTSKSHSILGHGYANRLLEAGHEVVHLTSYPSRKVVQNLTEIDVSYLQDFFKEATEKDDAFKLKNMIGKKNFEESLLFFYFVFTMHKNIITDPNVIKLLSDRKEKFDAVILEWFFTEITAGIPALFECPLIWACSTEPHWQALRLIDEIPNPAYTLDLFSSNRIPLTFWQRVEELWKVVKRNVQLAIYYPFEKWAYNSIYSEIAAKRGVTLPSYDEARYNGSFMFLNAHPSIGGSMKLPQNVVNIAGYHIEKTKPLPKDLQKLMDEAKHGVIYFSMGSIVKSDGMSEEMKRSLLDMFSKYEQTVIWKFESDLTDLPPNVHLVKWAPQPSILAHPNLKLFITHGGQLSTSEAIHYGVPLVGLPVMADQHYNMRSVETKGFGIKVTLAEDMAPELDAAVRKILTDQMYTNRAKELSTLFHDRVMPPGAALAHWVEFVVRNRGAPHLRSPAIAVPLYQKLYLDLGVVLAIFIGFIWKLVKYVLSRRSHKNNKKKRS

SEQ ID NO: 6334 - protein, 528 aa, Papilio machaon
MLINRKTFFISLLVLIANSEGLRVLVFFPMMSKSHSILGQGVVSRLLEAGHEVVHITSYPRSKPEPRLKELNVSTIGERLRDEMKNSASDNPFALRNLVGKGNVGDSVLFLYFTYDLHRRVLEDKLVVDLLSDTNEHFDAVVIEWFFNDVVAGIAPLFKCPLIWFGSTEAHWQVLQIMDEIPNPSYNVDIFSKSRSPLTFWERIMELWMIFKKSMMMNLVVVPFERSLYNRVFPSIASKRGVTVPSYDEAIYNGSFLFLNSHPSIGTPFKLPQNAKYIAGYHISKEMNPLPKDLQILMDSAKHGVIYFSMGSNLQSSDMSETMKDSLLKVFGQLKQTVIWKFEQDLPNVPSNVHLVKWAPQASILSHPNLKVFITHGGQLSTTEAIHFAVPVVGIPVMADQHVNMRSVELKGSGLVVTLAEDMAPKVKIAVEEILQNPYHKKKAKEGSEIFHDRILPPGEELVHWVEYVVRTRGASHLRSPALGVPLYQKLYLDFIIVLITIVYLMVKFINVLRRKCSDYKSKKLKKN

SEQ ID NO: 6335 - protein, 693 aa, Tupaia chinensis
MLNNILLLSLQLSLLGNALGGKVLIWPMEGSHWLNVKIIIDELIKKDHNVTVLLYSGALFIAPTVNPSLTFEIYNVPFGKERIEGVIKDFVLTWLENRPSPSTIWRFYQEMAKVIEDFHMVCREICDGVLKNQKLLEKLKKDEFEVLVSDPVFPCGDIIALKLGIPFMYSLRFSPASTVEKHCGKVPFPPSYVPAILSELTDQMSFADRVRNFISYHLQDHMFETLWKSWDSYYSQALDGSHWLNIKSILEELIQRNHNVTVLASSATLFINSTPDSTVNFEEIPVSYKKSHIDSLIEHMIMLWIDHRPTPLTLWTFYKELGKLLETFFRINVQICDGILNNPKLMAKLQKASFDVLVADPVTICGDLVAVKLGIPFVYTLRFSPASTVERHCGQIPAPVAYVPAALSELTDQMTFGERVKNTISYPLQDYIFQSYWGEWDSYYSKVLGRPTTLCEIMGKAEIWLIRTYWDFEFPRPYLPNFEFVGGLHCNHSKPLPKVLWRYKGNKPAALGANTRLYDWIPQNDLLGHPKTKAFITHGGTNGIYEAIYHGVPMVGIPMFADQPDNIAHMKAKGAAVDVNMNTMTSADLLNALKTVINEPSYKENAMRLSSIHHDQPVKPLDRAVFWIEFVMRHKGAKHLRVAAHDLTWFQYHSLDVIGFLLACIISAMFLVTKCCLFFYKKFHKTEKKKKRE

SEQ ID NO: 6336 - protein, 438 aa, Anopheles sinensis
MEHSLSKVVTVIVILVVLTVINVCGYQSYNILYISSVASPSHFLWSEQLSKIIARAGHNVTLLNIFKEGRQENLHFMKLNEVDEYLALDDPIDYLELHRLSQFELQASFLDLEITVCHLALTSNQFVRLMGYPKKFKFDLIIHDHAAGPCLLLLMERFNHPPLIMASASDVLQSTEHFFGSPMFPGLIPNQFTDLSITMGYIERVYNFIITFLESMSRKYHINPRIDQIVKNYYPNMSSVSHLEMDTAVVLLNSIAILSPPEPKLWRVINVGGLHIETPRPRQGKSYLMGLSRNASFEKCVYVSFGSNIQIMSVENPFAQSLIAVARQLPSVMFLWKINQLDGVVPENVFIADWFPQNDILGSGKIDAFVTHGGLLSVQEAAWYGVPMLGIPNYGDQYQNVRRIVRLGAGKRLNLEDVSPEVFKEHLMELIHEERLVH

SEQ ID NO: 6337 - protein, 509 aa, Papilio polytes
MKFCVILIIMTIVGFVKPANILSVYPCPSISHQVVFRPLTLELLKRGHRMTVITPDPMYPKGGHKNLTEIDVHDISYSVIKKYLASHVTGSKSDLINQVKGIMDLISISFEEQMKTEEVQNVINNNNETYDLILIEAIYVQALAISHVIKAPTILISSFGMYLGIHELMGIPTHPILYHSMFRQRLYNLTLLEKAKEVYNQIVINYEVKIREEKENEVLKNIFGPDTPPISVLKNYVDLLFVNLHPIWEGNHPVPPNVVYMGGLQVQARTPKTLPQDLQQLLDSSENGVIYFSFGTNVNLQTLLPPEKIQIFENVFSQLPYNVIWRRDNDRVVIKSDNIKVYQWVPQADLLRHRNVKLFITQGGLQSTDEAIIAGVPLLGVPLLADQWYNVEKYIKHGIGQKVDFEDITEYMLKNAILEVAEGEKYKKNIVRLRSLMADQPEAPLQRAIWWIDYVLRHGGAKHLRAPIANITWTEFLQLDLIMFIAFVTVSIPMHRGKIIAYFYLIGYT

SEQ ID NO: 6338 - protein, 520 aa, Danio rerio
MAAFVLLLYLFCLATAEAGNILVVPSDGSHWTGMKPLVEELGRRGNQVVVVIPEASLSMGPSQHTTTLSYPVSYTKAQIQEIVKAGVTTLISTYVSTDLPRFQSFINRMNSLSNIIIRSAEGFLSNKDLIKKLQDYNFDVILTDPFELVGVIAAEYLSVPAIYIQTSHPCNVDTLASQCPSPPSYVPHILTHFSDRMNLWQRSVNFIRTLIQPMACRRMFTRADEIASRVLQRKTSIMDIMSHAALWFVHSDFALEFPHPLMPNMIIVGGMDNTKAEPLSQELEEFVNGSGEHGFVVFTLGSMVSQLPEAKAREFFEAFRQIPQRVLWRYTGPVPENAPKNVKLMKWLPQNDLLGHPKVRAFVTHGGSHGIYEGICNGVPMVMLPLFGDQGDNAQRLVSRGVAESLTIYDVTSEKLLVALKKVINDKSYKEKMMKLSAIHRDRPIEPLDLAVFWTEFVMRHKGAEHLRPAAHDLNWIQYHSLDVIGFLLLILLTVIFVTVKSCMFCFRKCFKKSQKKKKA

SEQ ID NO: 6339 - protein, 534 aa, Nilaparvata lugens
MSNSTSVIFCLALLSLLNCTANAANILSIIPFPMKSHDRIYKPLLFELAKKGHNITEITQFKTGSLPKQNYHQIVVETRHKDLYEILDFHEIRQKTTMWNVGFQDLKLFWDMDYAVIEDILKSNSVNSMINSKDAHFDLLICEGFFGYEALFAFGHRYNASIIAVSSLGSTIYMNPHIGNPILTASYPNFLLPYTHNMALHERFHNSLLNFVTLLATTAYQLPNQQELVDRYFTESFKQNSIEPISLNQLVKEVDLVFINRHPVLGFPRPHIPNVIDIAGLHLHKFDNNSNVDKELMKIMDDAISGFVYFSFGSNVNMAKMPEQQKSAFMKAFSRIPQTVLVRWDEVTIPDRPKNVYFRKWFPQQEILGHKNCKAFITHGGMLSIEEAVYNAVPIIGVAFFGDQPMNVLRAEQLGFGLRLEYDNVTETSLYWALNEIITSTSYTEVAEKVSSIFRDSPQSPLDRAVYWVEYVLKHNGAAHLKCHARHLNWIQYTSIDVVALAIFIIYLIFYCIRKIYSILLSSNSSKRSKHKQQ

SEQ ID NO: 6340 - protein, 547 aa, Harpegnathos saltator
MQMIIHAICIVLYLWLLPTNNIADGKRILAISISPWYSHQAVFRTLFTALNKRGHELVVVTSRPMRDPTLKNYTEIQVSAVIEVLPEFNEFIQSKSLSLFEKNMYLMRFLNNIDQRAFKEPGMIKLYRHDNNEKFDTVIIEALTGPAFYAMAQRFNVPVIEVSSVGMYNCQRYFRGYPIAASHPSNWENYVKEASSMWQKLQNFFHTWMFIYTWANKFMIMEQEITNKYFGNDAPNVMDAMKNISLTMINDNPILRYARPEQPNVISFSGFHINKIPPTLPGDLRRFLDNATEGFIYVSLGTTASWSNLSKELLGKFVEVFSKLPYKIVWKYDSDEWSSRKLDNVFISKWFPQQGVLAHPNIKLFIYQGGLQSTEEAVHYAVPLLGFPIIYDQHSRLQRLASLGIAIYLKIEELTAENLDEGIRRILSDKSYKENMIRMSVLAKDQPYDSMENAIWWIEYVMKHKSRMHYLRVNGIDKPWYQLCDIDIIALLSTTLFVIACAAALIILQILHFLFRHFCAPRTSLQKFLSVRSSAKRDALKSKPSRK

SEQ ID NO: 6341 - protein, 534 aa, Salmo salar
MFNLLPRMVSVRLLLLSVALLLCGCLGTQGGNVLVFPGEYSHWLNMRVILEELVERNHSVTVLVSTASPSINFSRPESFGFKVYDVPFEKQDWQALKEDLINWWLNESQKVSMLQLGLWIRDFLQKMNVLTVNMCKSMFNNEELLESLRQSKFDALLSDPMFPCSDLIADALDLPLIFSLRFSFGMVIERQCAQVPTPSSYVPSPELPYTDKMSFFERVHNFVTYTFCYVFMNVHLLTTMDTLYSEIKGSPTRFCELMGKADIWLIRTYWDIEYPRPFLPNFKFVGGLHCKPAKPLSEDMEEFVQSSGDDGIVVFSLGSMVKNLTTERGNAVATALGRIPQKVLWRYSGEKPETLAPNTRVYEWIPQNDLLGHLKTKAFISHGGINGLYEAIYHGVPMVGIPLFADQLANVMHMKTKGAAVMMDFNKMTSDDLTEGLNSVIKDPSYKENMMRLSSLHHDQPMKPLDTAVFWIEFVMRNKGAKHLRVESHNLTWYQYHCLDVTAALLSVVALFIIVSVKTCTFCFRKTKARQKTE

SEQ ID NO: 6342 - protein, 513 aa, Aedes aegypti
MLHSTVKCFSAIVLILLSATIQCENILFLQTTPSRSHHIWNKQIFNRLYENGHNLTILTFEQEQSIPGKSFFYVPRLYARTMAEFAAENNAESVMGPIGNIINMYSFYEKASRLLAQEPVIQHLMNYPRTFKFDLIIHDFTMGQFLLGFVERFGNPPLVSVSAFNIPSYTMHLADIPVRFTTLPNYACEYGQPMNFLERISNMFYWMLDFYHRQFKFMVAEDGRVGELFGSNSTSVKIIEKRSSIVLVNSDFTMDYHQALPPNVIPVGGLHISRPEKVPQIISDFMDMPSKGVVLLSFGTNVQSEGLGKHINEAILKTFTNLPEYNFIWKHGDPESLGTVSPNILVQKWIPQGAILSDPRTKLLIGHGGLLGLQEATWYGVPTIGIPFFADQLQNVDKLVRGGGGLRLFLDELDENTLKQAIDSILLDKNYQQNMAARSRLFRKQPQPPLERAIFWIEKVLNIKGLPYLASPTQDIPFYQLYGIDLIGATILIIVTIHILCKLALSFSFNKQI

SEQ ID NO: 6343 - protein, 413 aa, Loxodonta africana
MSMKWISLLLIQLSCYFTCGTCGKVLVWPTEYSHWINIKTILDELIQRGHEVTVLTSSASILIDPNTPSAIKFEVYPTALTKDDFEFLFMKWIRKSDDLPKDTFWTYFSTFNEKKWDLFYSEVLGRPTTLYETMGKAEIWLIRTYWDFEFPRPVLPHFDFVGGLHCKHAHPLPKEIEEFVQSSGEYGAVVFTLGSMVSNITEERAHTIASALAQIPQKVLWRFDGKKPDNLGPNTRLYKWIPQNDLLGHPKTKAFITHGGTNGIYEAIYHGIPMVGIPLFADQPDNIARMKAKGAAVSLDMNTMTSTDLLSALKTVITDPSYKENAMRLSTIPHDQPVKPLDRAVFWIEFVIRHKGAKHLRPAALSLTWYQYHSLDVIGFLLACVAIVTCLVIKCSLFGYQKFFKTEKKKKKK

SEQ ID NO: 6344 - protein, 485 aa, Loxodonta africana
MSKKWISVLLIQLSCYISCGTCGKVLVWPTEYSHWINIKIILHELIQRGHEVTVLTSSASILIDPSTPSAIKFEVYPTSLTKDDFEIFFMKFTRKWTYDLPKDTFWTYFSQIQEMEWEYSDFIENLCKEAVFNKKLMMKLQKSRFDVVLADIIAPCGELLAELLKIPFVYSVRFTYGYTVEKYSGGLLTPPSYVPIVLSELRDRMTFLERVKNMIYVLYFDFWFQALNEKKWDQFYSDVLGRPTTLYETMGKADIWLIRTYWDIEFPRPFLPHFDFVGGLHCKPASPLPKVLWRFDGKKPDNLGHNTRLYKWIPQNDLLGHPKTKAFITHGGTNGIYEAIYHGIPMVGIPLFADQPENIDRMKAKGAAVSLDMNTMTSTDLLNALKTVINDPSYKENAMRLSAIHHDQPVKPLDRAVFWIEFVMRHKGAKHLRPASLSLTWYQYHSLDVIGFLLACVAIVTFLVIKCCLFGYQKFFKTEKKKKRE

SEQ ID NO: 6345 - protein, 587 aa, Nylanderia fulva
MLKSIIIVSILWIIADAARILVVLLEPSYSHQVAYRPIMIELAQRGHELTVFTPIPMNDSSLQNYTEVKLEYSSYKVDEKMDVFAYGKLGVQSILDDFYHRNEEMTDSALSNPVMQQLISPNYTEKFDLVIVEFLFYDAFYALSYRFNAPLIGISSASLLTVHHYAFGNPILWSHLPDLLVNDLDDEMNFIHRFYNAYYSLFQIYWHKYKIIPVQEKMVRKYFGDSVPPAHKLVSNMALLLSNYHPFLSPNPYAQEIIPIRGSRPIITQKNHSLPQDLQKELDDATKGFIYFSLGSNIRGVFLSDERRNMFRKTFEKLPYKIVWKFESDFPDKPNNVIIRNWLPQHEILSHPNIRLFIYQGGLQSTEEAIENGIPMIGFPVVADQYYNIKQLVKYGSGKSFSITDVTEDELRETIYEVITNSSYKENMLKLRNLLHDRPYDELNYAVWWIEHVIRHKGAPHLRNKLRDMPWYKTQLWDIIGFTLLVLLVSVYSLYHFITRGQLWNIIIILTLVYLFPFIVYIFIIIKLFTYICSLYHFIRVSYYLRRLYYLSTKLRTYTYVIFSKNSKCVSIEKKKQECDNIKLKTL

SEQ ID NO: 6346 - protein, 511 aa, Anopheles sinensis
MKLQILLLAGLLVASCCSAADILMITMGGTKSHKIPFWELAKGLVPRGHNITFLNGFPADFTLHGLQEVTPSGLVEYIRNYTNWDLLGARMRGDLPLSVWDVFRYPWQICDATLEDKETMDLLGRKFDLLILDGAFPECALGLVYRLGVPFMYINTVGFYTGTMALAGNPTPYSTTPAFYRPLTDDMNFLERVSNTICRMFTETLIVPTMMMVQHMVRRHLGSDVPSVWELGRNVSFILQNGQASVTYPRPLLPNVAEIACIHCKPAVALPKDLEDFIAGAGESGFIYVSMGSSVKAANMPDHLRKLLTQTFARLPYRVLWKYEASPALLTDLPANVKIGRWLPQQDILGHRKLRAFVTHGGLLSMFETVYHGVPVVTMPVFCDHDANAAKASTDGYALKLDLETLTTEKLVRAIHKVIHDPKYRKEAKRRQILLKDQRSTPLETAIYWTEYVIRHNGAYHLQSPARNLNFLQYYCIDQILFFIAVVYLMRALTRLYLSPKIVQLTKEKLH

SEQ ID NO: 6347 - protein, 532 aa, Caenorhabditis nigoni
MHCLLTFVFLLSGTTHAKNILIINPIFGYSHVKFISKIADVIADHGHNVTLFQPFHTNMKNLDGLVKNKNIEIINYYPDHYEDLLKSEDQTFTALWDSRLANNPVLFSFMVPKMITGEFEKTDTQLYLDTNLHAELKSRKFDVAIAEAFGASSFFFAHLLDLPCIPVFSAVRFEIVNELFGQPSALGYTTRDGSKGAPDAGFLDRLNDVYRKYFEDLGHSGIFQYQNELFQKTMARPVPSWKNLVTQSPIFITNSNPYLDFAVPTTATIVHAGGITMDLNKVKHVGPLTEEYENILQERESTVLISFGSVYRSFQMPDNFKAGLIKMFESLPDVTFIWKYEEDDAEFKKRLPKNVHLKKWVPQTDLLADKRVKVFMTHGGLGSTMEVAYSAKPALMVPISGDQPQNALMLARHGGAVPYDKFELQDGEKLTRVMKEMVTNPKYQKRAQELFEVLSNQPIDIKMSLMKHLDFAMQFPNLRSQVPEINQVGLIAHYYLDVVMFLALSFAFAFYLLVKLLIKVYFKFIGKKTKTA

SEQ ID NO: 6348 - protein, 282 aa, Drosophila busckii
MLLNSHRGVDVPRPSMPGLINVGGAHIQPAKKLPEEMQGFLDNATHGAVYFSLGSYMKSTDMPPEKLAQLLQAFGRLKQLVLWKYENATLGQLPPNVMISKWLPQNDILAHPNVKVFITHGGMFSTQEGIHWGVPMLFIPLFGDQHRNAIRSVRGGNARLLSYSKLNADQLVEHLEALIYEPQYKRNALEMSQRFRDNAIHPLEEASYWLEYIVKHRGAAHLKSHGAFMPLYQYLMLDVLGCVLLALALVWYLLGKLYRWWIAGVAAAASASSQARQVKKQL

SEQ ID NO: 6349 - protein, 648 aa, Trichinella zimbabwensis
LDFSDQQNVLQLVNFICLTSYSCAFFSGSAQEKQRKTELCQCASQTNQQAEMFARNHAFKAYIVWILLNVFLIYFVQSLKIVIFTPDSPNAGREALNKLAQELAFRNHDVFTFRTLLLPEQPYLVVQRPHKVTEFKLQIDLPSEWIVHLRAFGNASIWTTEYGDQKYLHSLWKAQVEACSTTLNSDFLDRLRHITPDVCVIPSDDPCALGIVHALKLPFIYYDSDGLQDETILSVRPQLFLQGLPPSSYSTLPRRMSLFQTILNLFLFSSAHIRDTYIPLLHCFFASEKFKLLEWPILKLFKNNSQLSVEFAQLWSLKQIRAQALAVFVNTDWLLEDAHGLFPPKIIPVGGFHMDLPRPLFRPYNESVDKASDGVIVVSFGNRVNSSAMPLSVARIFLQTFQKLPKCRIFWRIDSTTIDGILPEQVPSNVNLTQYLPQVDFLGARKMRMLISHGGAQSIMEAVHAGVPVLGIPLMIPTYQTLRKLEARGMALILDKSNLTAQNLLTAVLALLHNKKYTLAAKQISKMFKDRPISPIDSTIHWVEFVGRYKRGSFFTYEKDILFSMNSLTYAMFFSVVLAGFSLAYYYWMFGRKHCTTLAAEDCNSKASSTDSEIDSSDGKHISDEKIPARRETRSTSKKVNSLSDVAK

SEQ ID NO: 6350 - protein, 521 aa, Trichoplusia ni
MKMDSLKWIIFSCLLCLYGTEAYKILAVFPLPSKSHGILGDNMVKHLLDAGHEVTYITPYYKETKTHPNLKQIDVSANKEVINENTMDIKLVMAGIINLEDPDLVFDMMFTIASKTLENPNVQEMMRNQKFDVVVAEYMFVDLYSSFATVFQCPLVWFSTVNPHWMIMNLIDGPLNPAYNADYTHNRVTPFTFYDRVMELWHQVVEQYKLTHKYYYHEVGAYEKSIVPMLKEKGIPVPEYNEVRYNGSLVLGNSQVAISDAIALPPNYKHIGGYHIDDEVKPLPENLKKIMESNKNGIIYFSLGSNIKSKDLPVEIKEGILDVFKGLKQTVIWKFEEVLANAPKNVHIVQWAPQQSILAHPNLVLFVTHGGLLSITETIHHGVPVVSIPVFADQFQNAKRAEIQGYGRNVRLTPNLPKDLKKAMDDVLGNPSYASVAKELSKAYHHRQTKPKDEINFWIDHVVQTRGAPHLRSVAISLPYYQRYFLDVLAIILISLLTIIYAVAKLWCSLTSKSNGKYKTN

SEQ ID NO: 6351 - protein, 531 aa, Chilo suppressalis
MKSCTVIKKARKEKMWMVFFFVCVLHCTVAYKVLVCFPFPAKSMNNLGEGIVRHLLDAGHEVTFITVYPKQVTHPKFRQIDVSGNAALIENDEHVNITYILENSAEVSSDKEFLQELTWKIAVNTFQDANMRRLVEDTQGKFDVVIADLLETELYAGLAVLYDAPLIWSYSMGAHWLAIRMIDDPTNPAYSTDYYASVSPPYSVGQRFQILWQQIMWRYAKYFKYMPKEKNSFKSIFGPLIAKRGRKLPKYEELIYNASLVLSNEHHATGKIPKTPQNWKLVGGYHIQDPPVSLPKDLQVMMDNAKHGVIYFSMGSMWKSEMIPKRLTDELLKMFGGLKETILWKYEADLPHRPKNVHTIKWAPQQSILAHPNCKIFISHGGLLSSTEAIHFGVPIIGIPISYDQYINIEKSVTKGYALKVSLSYNLAKDLKPAIESLIQDTKYKENVKFLSSIYHDRPIPPGKELVHWIEHVVRSRGALHLRSIALDVPFYQKAYLDIIAITIITFTLITCLIKQLFRRKPTKQIKKKVN

SEQ ID NO: 6352 - protein, 530 aa, Equus caballus
MASEKWVLATLLLQLCFTGHGFCGKVLVWPCDMSHWLNLKVILEELTERGHEVTVLVSPYNFIIDYSKPSALNFEVIPVPQEGETAANSLNDFLDLATNVIPTLSLWQSARKLQEFFLQITGHLKLLCESVVYNQTFMKKLQETNYNVVVIDPVMPCGELIAELLEVPFVYTLRFSLGGIIERYCGKIPAPPSYVPVAMGKLADKMTFLQRVKNLLFSILFDFFLHQYDFQLWDQFYSEVLGRPTTLCEIMGKAEIWLIRTYWDFEFPRPYLPNFEFVGGLHCKPAKPLPKEMEEFVQSSGEDGVVVFSLGSMVKNLTEEKANLIASALAQIPQKVLWRYAGKKPATLGANTRLYDWMPQNDLLGHPKAKAFITHGGTNGIYEAIYHGVPMVGVPMFADQPDNIAHMKAKGAAVEVDINTMTSEDLLNALRTVTNDPSYKENAMRLSRIHHDQPMKPLDRAVFWIEFVMRHKGAKHLRPAAHDLTWFQYHSLDVIGFLLVCAAAAIFLVAKCLLFSCRKLGKTGKKKKKE

SEQ ID NO: 6353 - protein, 419 aa, Ancylostoma ceylanicum
MTKNLSSILEWQCETLINDEDLLRKLRDENFDVGISEAYYICGLGLFEALNIKATIAAVSNPHLDAVAYAIGEPAFPSYVPGSLSTTGDRMTFIEKLQNVVALVIGRAVVDYLYNKEIAVFRRKYGSFKEYTELIAQASFVFTNGNPYLDFPHPTLHKTVTIGGFAVSQAASEKHTLSKEWDAILNARRRTVLVSFGSVTKSIDMPENFKRTLLEVFATMPEVTFIWKYEDPSSKIAESLPNVHLSAWVPQIPLLEDERLSAFVTHGGMGSSNELAMMGKPAIVIPIFGDQMRNSRMLARHGGALVLEKSDLSNFEKLKSALEEVLNDPSYARNAERLSQMLRDQPVSSQELLLKHAEFAARFGKLPNLDPYGRHLSIIEYYLLDIVAAVVTTLLLILFIIVVLVRKCFCSRHPKLKPE

SEQ ID NO: 6354 - protein, 486 aa, Haplochromis burtoni
MELRLSACVLMVLCATSCANGGNILVWYADASHWINMKPVLETLVDRGHKVTVLIPSSSVYMNTNEPTRFHYEPFNVSFSLEAYKKLLEDFLQFSIYEMDYMNYWKIYIRYINISKTNLQYNIRYLDGVVKSEAIMKKLKEGNYDLLLADPWKAGSDLVADILGIPLIFSLRFSLANNWERHCGQMPAPPSFVPGAMSKLTDKMDFSERVWNFLFYALQDIMIDHTFWNVLDRYYSDVKGTPTSACELMSKADIWLIRTYWDFEFPRPFPPNFKYVGGIHCRPAKPLPGVVWRYIGEKPETLSANTRIYDWIPQNDLLGHPKARAFITHGGTNGIYEAIYHGVPMVGIPMFLDQPDNMIHMKEKGAAVILNLNYVTAEDLRDAVNTVIDDKSYKENAMRLASIHHDRPMSALEEAVFWIEFTLKNKGAKHLRVQAHELTWYQYHSLDVLDFILTIALLLIFIFIKTCSFCLHRCCVRRGKTKRKAE

SEQ ID NO: 6355 - protein, 511 aa, Tribolium castaneum
MKLFLAIFQVIFVCNAKGAKILGVFPTPVRSHHILGHSLLSALAEKGHEVTLISPYEEKNGPGNKNYKHISLTGFDRKPIYINLKDSAFDIFLKLPLIKMIKFELAEDTLNHTNVQLLMDSDETFDVVIVEEFTEEALKALAVHFKAHLVVLSTVCSNPSVETSVGNPQPFSYVPYHLSSYSKSMTFHERVVNTLLHIYDQLLNHFYIYPKHEQVIKKYLPNAPPLKSIIYNSSIVLVNSHLSLNQPLPRVPNMIDIGGFHIKAPQKLPQDLEEFLDSAKDGAIYFSLGTFLQSSKLPAEKRNIFLKVFSKLKEKVLWKWEDDTLPGRPPNVKVAKWLPQQDILAHPNVKLFITHAGILSTTEAIYSGKPLLAIPVFGDQKTNAQNIHSNGFGLFLPYNNISEDDLTVKLNELLKNPKYARSARKRSEIFHDRLVKPMDTAIYWVEYVVRHGGAPHLRVAAVEFPWFKYFLVDVFVFIFVFIVLLFYMFYTSFKIFISYRTIRVAITFTFI

SEQ ID NO: 6356 - protein, 525 aa, Aethina tumida
MCRLVILAALVAVTIPVAHSARIIGIFMTPSYSHQVVFQPIWKELSLQGHEVTVITPNPLNDPTLTNLTEIDIGEISYESWKKSSLSTLGMSAHSTMEELKAITKAYIDVSHVQLSHPVFQKLIHEKSKEKYDLFLVEYLWPTMYPFKDIFDCPMVGIVSLPLLSSAYVNLGIPRHPVLDPDYVLPFSTDLTFKERITSTLFTLLNTIGGPLTLKPKINAVTKQYFGDDVRDYREIAKEVSLVIANSNLATQNVKLGVPQLVEISGIHIKPKKPLPKDLQKILDDATEGVIYFSLGSNVKSSQLPKEKIEEFMNAFVGLPYKVLWKFETDDIPNLPKNVVVRKWLPQQDVLGHPNVKLFITQGGLQSIDEALANKVPVLTIPFFGDQRFNSDRMFRNGGGLMINFHSFTSEEMREKILTLLTDKRYQEKINQLSEIAFDHPMSPVDKAVWHINYVLRHKGADHLRHKAVNMPWYQFQMLDVYAVLVISLAIILTIISKITFKVFKGVKSVVRSLGIMTPTKKKVL

SEQ ID NO: 6357 - protein, 445 aa, Tribolium castaneum
MEGAYEKVRDQFDLMAMKDMSDWETIKNLWSFAEVTCLLDQKTKGLRQITNYPNDFKFDLIIVDVNYGHCLYPLIEKFGNPPVIGVNPFINQPNLFRNIWQSYIPFMTHSFGAQINLWQKIKSFFFMLLLEVSRLTHYIPRQQELAYDYFGPMKSSILEIEKNMSLMLINYNPVFNYVEALPPNMIPVGGLHIQPKRLPDDLKKILDNAKFGAILFSLGSNVRSKELGPERIQAIIKTFSKLKQTVIWKFENDKLEGIPANVHIRKWVPQNDILGHPNTILFISHGGLLSSHEIMYNGVPVIGIPFFLDQLQNVDTFIAKGVGEKLSFFEITEHNLFQVIQKVLNNNTYMENAKKWSALYKHQMNKPLDVAIFWIEYILKFKTAEHLNLATRNMNFIESANLDLVFVSLLSLVSILFIVYCAIYLIYKCIRRKSISKKLDIKKKL

SEQ ID NO: 6358 - protein, 522 aa, Bactrocera oleae
MGPGTYIALTLTVVGFAPIFTESAKILAIFPFTGPSQYMCVQPYLKTLAARGHEVTSISVFPQKTPLKNFRDITLSHEYKDHDEFIIAAIEDMCETKLNQLRALLEYSIMGSLPVLQNEEFQHLLRSDEHFDLIIIEAFSLNSLYALGRHFNAPMIGISTISADIVNDQLVDNVSPIAYVPTPIGMNLDRMNFWQRLDNLYENTMELLYTHLVIIPEQQRDYEKYFPNATLRLTDVRRDFSLLLLNQHYSFSWPRPLVPNAIEVAGMHIDHKPNKIPTDMEDFINASSRGAIYFSLGSNIKCVNLPKHKLQELMNAFASLPVNVLWKFEKTDLAGKPKNVFINKWFPQSDILAHPKVKLFVTHGGMHSLIEAVHHAKPVVGTPVFYDQHLNVEKAVSKGFGVAINFRNFTSTELRNAILEVLNNPTYTEKAREISASFHDRPMKPLDAAIFWTEYVLRHKGAPQMRVAARHLNFLQRHSVDTMAVLFGIPLLLAIFITHRIYKFLLVIFLSKDHVNIKRKNE

SEQ ID NO: 6359 - protein, 532 aa, Daphnia pulex
MTYVATISLTVCLLVGLLVIPELSAYNLLFLSPITSPSHSNFFKPVVKAMVDRGHFVTYYSGLNHNNQKMATNNQTINFRPLSSSPALHKISTDHQVDFNIRDKPLLFLSQLPQKMENYCTAIYNDPVFQQLINTTEKFDIIVIEGYLNDCVLPLVAMFNVPFIYMSGVAPMPWLLNAFGSPLATDHVPNVVHSYTDEMNFWQRTVNSVSSISGVYLRHWFVMPVVDRMAQKMLGKNLPAIEEIERHYMSLLIVNTHSSINYQLPLSPAIIQAGGLHCVPPKPLPKDLESFVDGSGDAGFIIVSFGSVLKGVDMPNNFRRIFLSAFARLPQRVLWKWEDQPGENDSIPSNVKLLPWMPQQDLLGHPKIRLFITHGGLFSNQEAVYHGVPFIVMPIFADQPINAQKAHDDGYAIRVDMDSMSEEILFDAIQRILTDPKYAEKMNQVSALARDQMESPLDRAVYWIEYVIRHQGAPHLRIASRKLSLFQRYLYDVLLFVLFSALSFLFLVFYLCRHIICSNGRVKINGQKKKKN

SEQ ID NO: 6360 - protein, 1040 aa, Drosophila willistoni
MLLPPSNGANILGLYSGHSPSHLILHMSVAKTLAEAGHNVTVVSMLEPKVKCKDIHLIVIPVSDEQELLIENKLKQIAMKKNTLYDTFYHLMNDMKVMIDTQYELLSHPKFQQIYETKFDLMILGWFVNDFQLGVAAKLKVPVIVDWVMGPTPGTDALVGNPAEISYVPNMMNPVSKGKIMSFGKRLNNLATHWFYKYLNGLFDKCFDEYYYEHFGMEKNLPTIKQLKQNVSLAFVNCHLISEGPIKPLVPATVQIGGIQIKDTPDPLPKDIEEFLSSSKHGAILLSLGSNIKSSSVKPELTKIIFKVLSSLKQNVIWKWEDLDNVPGNSTNVLYKKWLPQDDILAHPKLKLFITHAGKGSITEAQYHAVPMVALPVFADQPRNAAIMQNSGYGFSLDLLTLTEDTFEAALREVLENKKYAKAIGEFSTLYRDRPLTARQEVVYWTEYILRHRGAPHLQSPLVHMDTIAAYNLDIYVLLIVILAISLLITHFLLKYFVHKVFSKAVPSEGANILGLYSGYTPFHLILHMSVAKTLAEAGHNVTVVSMLEPKVRCKDIHLIVIPVSEEHQRIIENKLKEYATQENTIYNAFDNLLNGLKVMVDSQSELLSHPKFQQIYETKFDLMILGWFFNEFQLGVAAKLKVPVIVDSVMGPTASTFQLVGNPFEVSYVGNPLNVIQKDEDTSFGKRLKNYATHWVYAYLMRQFDKLYNGFYNDHFGMERDFPTFDQMKRNISLVFTSCHFISEERIRPLVPATIQIGGIQIKDTPHPLPKDIEEFLSSSKHGAILFSMGSSIKSSSLKPKVVQKIFNVLSKLKQNVIWKWEDLDKLPGNSPNIIYRKWLPQADIFAHTKTKLFITHAGKGGVTEAQYHGVPMVALPVFVDQPGNAAIMQSSGYGLSLDLLTLTKETFEAALREVLENKKYAKAIGEFSTLYRDRPRTARQEVVYWTEYILRHRGAPHLQSPLAHMAAIAAYNLDVYALLLVILAISLLITRFVVKFVLLEIYKRFALSWLKYSQKKKIMSKKKTKKKNMFITISSKIF

SEQ ID NO: 6361 - protein, 535 aa, Caenorhabditis brenneri
MNVIYYCLLFSLYISSSLSYKVLVFNPAYGASHSNFLGKISDILIDAGNEVTMLIPTYMKSKKGQVGSKKVKNIIEIGQDERAEKMFEENKVEEIVKTKVWRMDPEMMSVFGIVGKMNVALGYQCEYIFKQTEILEKLRQENFDLAITESLFICPFAVFDHLGIKTIINAESNLFKDAVKYAHGEPAAISYYPGLFSPNNDKMSFLTRVKNLITMLFTKYLFGSRYEQELKIIEPYYNNTKSWTELLSSVAFYFINSNKYLDYASPTLPKTVFIGGMQVNTNKKKTKLSEEWDNLLSIRDQNVLISFGSNAHSCDMPDEFKTAFLEVFESMPETTFIWKYEDANATLAHHLSNVKLTTWMPQNDILADDRLTLFVTHGGLGSTMELAYQGKPALIIPLLADQPRNAHMLTRHGGSLQFDKRKLGSSEHLREAIQTVLNDQKYTDNARRLARILNEQPFSPKEAVLNHCDFAVEHGPLETLSSEGKYLNTFQFYSFDIALAVVAVFLIVFVFISFVFVRLLRLLSRVVLYQKKKME

SEQ ID NO: 6362 - protein, 524 aa, Musca domestica
MSTTSPRYALLFITFVALAFTSCHASRILCVFPSPSLSHLLIHASIAETLALDGHNVTVIATVAPSKIKIRQVNYIHIEGPMFNDAFAKEMLNKPAHVYQKFGSTVNHVLNMANATMNNPKMLQFLQIHKAGDYDTLILGYFMNDFMLGLGAHFQCPIILSFMVQPIFSINTMIGNPAESSYVPSLFMGFKQPMDFWQRVKNFVANAFEYHFFAALMGQREQEMYGYNFPADRYPPLEEVYKNVSLVLTNHHFSQGPIRPNVPALIEIGGIQIKEKPDPLPKEIADIMDSAENGVIYFSLGTNVQGSNLSPEKAKMIFNVLSQLPYTVLMKWGDKAFPGQAKNIIYKSWLPQDDILAHPKVKLFITHGGQGSVVESQYHGVPMVGIPFFGDQHSNMANVRSSGFGLSLKYATLTEEELRSTVLEVLNNPKYRENVQTFSKLYRDRPMTPRQLVRYWVDYVIRHNGAKHMQSPAVHMTWWQIQSLDVIGFLLVVVLGVVGVFVGLCKFLCCKGKKKSVNLKKKNK

SEQ ID NO: 6363 - protein, 529 aa, Athalia rosae
MSMMFATDAIVYSFAICFLSLLQFGNGYRILSICSRASFSHQIVFRGLTLALNKRGHEIVAITTDPMNDPKLKNYTEIDVSHLYKSNLKVNIAEFTDWSALFPDISEGVNLQTVEIFEHPEFKKLYAANANEKFDLILLELLYWPAFYPLAKRFDAPIIGMTPMAGLTINIKYSLGDPMLPSHPSNWEIYTADQPQSFWCRLITFFSFWKFLYYYKTLHTKSQEAIAKKYLGPDIPDLSELETNVSLVFVNRRTSATFAEPNVPKIINIGSYHLDTRTDKLPQRLGEFLNDSENGFIYMSLGTNMKSTMLSSKVREALLSVFSRLPFKVLWKFEDESLPGLPPNVFIMKWVPQQAVLAHPNLKAFIYQGGVQSTEEAISNAVPLIGIPTWADQKMQIDKLVSLGVARKLEVAKLDEKSLVDAITAVTLDSSYKEKMVNLRKRWIDNSQDLLENGIWWTEHIIRHRGGSHLHCIIADTPWYQRQDMDLIAFISSGCTLVSIFLLFLLHRLLSCVSAIRRYNSAETKRKTS

SEQ ID NO: 6364 - protein, 519 aa, Tribolium castaneum
MKLTLSLLVFVLISTVNSAKILGVFPVPGRSHYILASSLMRALAEKGHDVTVISCFGEKIPPKNGTYRDIVATGVFDEMQKEMNSKNMSMFEIGGASPLLNAFFMAVLLPEMTEKALKHENVQKFINSDEKFDVVIVEQFANDAQKALSTHFGAPLITFSTLGANYWVNPLVGNPSPPSYIPDLMSDYSVPMTFVERLENSLVYVMNELLYNFYIFPKQNELMKKYIPRAPAHINDVLYNSSIILMNAHPSINQPVPYVPNMVDIGGFHVKPPKKLPQDLQEFLDGAKDGVIYFSMGSNLKSADLPNDKRDAILKTFAKLKQKILWKWEDENLPGKPPNVKTAKWLPQQDILAHPNVKLFITHGGLLSTTETIYHGVPILAVPIFGDQKLNARSAVKGGYGVHLPYEELNEETLTNSINEVLSNKKYKENVQKRSKLFHDRLVSPIDTLTYWVEYVVRHRGAPHLRVAALDLPWYKYLLLDVIAVIALVLLTLLLIFCYVVKLVCKKLCSKKSKKTKKE

SEQ ID NO: 6365 - protein, 427 aa, Ceratina calcarata
MKLVSILFVCAVFATSDGYRILGMFPYNGKSHFIMFEHLMKALARKGHQVDVISTFPLKKPYPNYNDLIVLPTARDFMNNMTYDEMHNMIRASSAFAVATMTGNDICENLKYPKFQELIRNPPKDPPYDVVIMEVFGAHCYAILGDILKVPLIGASSSKLYPWHHDYIGNPPNYAYQPNNLISYPNNMNFWQRTYNFLSAVQSQYQFNSASSLQTDMLRKYVSPDAPDIRELEKKFTMILVNSHISTNGIRDMTPAYIEVGGLHVQEEGVEITPSLEKWMNESTQGFVYFTFGSMVKIESMPRHYLEIFYKSLANIAPIRVLLKIAKPDELPPGLSSNVHVLTWLPQIKVLKHPNLKAFITHGGLMGTQEAIHYGVPLLGIPLFADQFTNIETYVRLNIAIQLDLDTLTVEKMDEALNAIVHDPKYR

SEQ ID NO: 6366 - protein, 524 aa, Aedes aegypti
MDRIVKCVVLVCLVGVPLCKGINILCLMGVPSPSHHIWNRVLMEALASRGYNLTIVSPDVEKVQKPNLTYIHLEEVYHTIHDGDTAIDFYEMAQQNLVTSMFTFYEYAYSLCEGVMRSKGLDTILNYPDNFKFDLVLYDFTCGPCLMGLYDKFGQPPLIGVTAFNIPPYTVDFIGGHKYPAYIPYYTLTYDTDMTFFQRLENLFIYTVDYFYRNYYYIPKTDEMLRRMPVFRDGPYLGDLDRKMKLMLVNSHHSVDFPEPIPQNMIQVGGLQIIPPKPLSAEIEEFIKNSKKGAILFSLGTNVLSSDLGEERIEMFLEAIEKFPDYNFLWKFEADQTKYKIPKNLMMRKFLPQNDILANPRTKLFITHAGLLSTHEATWHGVPMVGIPFIADQYRNLEKSLRAGVAERLIVWTLTTDKIVQTVRKVLENPSYRTKMREKSALFRDQPEKPLERALWWIDWCLRHPEAETIQSPTLRLGLWKSELYDVKIFVILAAVAVFLGVKRVFSVLTGTNKSHIKHKKKVN

SEQ ID NO: 6367 - protein, 514 aa, Papilio machaon
MKFFLIILVITFVDFVKSANILAVYPCPSISHQVVFRPLTLELLKREHRLTVITPDPIYPKGGGHENLTEVDVHNVSYSVIKKYLASHVTGSKSDLINQVKGIMDLISFSFEEQMKLKEVQNVINNNQEAFDLILIEAIYVQALAISHIIKAPTILISSFGMYLGIHELMGIPTHPILYHSMFRQRLYNLTLLEKAREVYNQIVINYEYKIREEKENEVLKSLFGPDTPPISVLKNYVDLLLVNLHPVWEGNHPVSPNVVYMGGLQVQTRTPKSLPQDLQQFLDSSNNGVIYFSFGTNVNLTFLPLEKIHIFEKVFSQLPYNVIWRRDNDSIVVKSDNIKVLEWVPQADLLRHKNVKLFITQGSLQSTDEAITAGVPLLGIPLLADQWYNVEKYVYHGIGQKLDFEDITEDILKNAILEVAEDNRYKNNIARLRSLMADQPQAPLERAMWWIDYVLRHGGAKHLRAPTANISWTEFIHLDLIIFIACYCFIILISTVLVVKLLVYFILCTYNYK

SEQ ID NO: 6368 - protein, 516 aa, Eumeta japonica
MLKECAVLCIISSMIWTIEAFKVLLMFPLPAPSHGILGNGYVEHLLNAGHEVTYITPFPREDPPPNLHQVVLNYPDEVLPSKILNIENILSDKQNINLNRMMHFFFNVHEHALRHENVQKLMTAQNENFDVAVIEWLYGEVSAGFAALFQCPLIWSSSVDPHWLILQLVDEAANPSYVPDILSNNLPPFTFSQRVQELWTQISTSMTMKSFDKKYTALYNEVFVPAGNRKGILMPPYEEVKYNASLVISNSHVSLGEPVRLPQNFIPVGGYHIDTKPKPLPKDLQKLMDDARNGVIYFSMGSNLKSKDLPDKMKRDFLETFGQLNQTVIWKFEDALSGLPKNVHILKWAPQQSILAHPNCILFITHGGLLSTTETVHFGVPIVGIPVFADQFINVDKSVSRGFAKRVDLSHETPKRLKVAIHEVIGDPSYREMVKYLSMVYHDRPVPPGRLLVHCGARGQNPRRAASELARASTPWYHKTYLDLAALIAAVTFGLYITAKCLFNSIFLTYDNKKNQ

SEQ ID NO: 6369 - protein, 429 aa, Pogonomyrmex barbatus
MKPIVKMTFWMTCFLYIVTTIDTARILAIIPIPSYSHQIPYRTIWTTLSRRGHEVVLITSDPIDDPGLINLTEINFHSNYKILRKIDFVEMMSHSWMSTQYTQLWDLCLEISENIYKHPEIRKMYELDSNQKFDVVIAETTLTPSLYALAYRFNAPLIGVSTLKLYNHNHFLLGAPVLSSHISTWEMEDDTGFNLSLWQRIKNFIRQWYHIYCVLNHYYPKHQAIAEKYLGNDIPDISDMERNISIVLENQQEVLSFSRPKAPNVISFGNLHISKKLMALPKDLMEFITNAPNGFIYMSLGTNVMMTSFPNNIQQIFRDVFANMPCKVLWKYEGELINKPDNVYIAKWFPQQSVLAHSNIKLFIYQGGLQSTEEAIYYKVPVLGLPVLADQYAQLNRLEYLGIGKHLNIMNISKGYLNETIMDMLNNKR

SEQ ID NO: 6370 - protein, 522 aa, Spodoptera exigua
MALPICLFLGLLLSSSCEAYKALVVFGMPSNSHFNLGNGVVRNLLKDGHEVTYVTPIEYKNPPPNLRQIDVSSNFNALPSDKINIKILMEAPTPSGHRKFVKMLMINLVRRTLEHENIQRLLNDTNEHFDVVIVEHMFSDLSAGYATIFNCPLIWVSPVEVNSLSMGLVDVLPNPAYTSDALSLYMPPFNFLERLEELWIRITDEYNDYMVYEPLEAAEYERLIVPQIQKRGRQAPPYSKVRYNASLVLGNSHVSIGLPLGLPQNYKSIGGYHIEEEVKPLPEDLEKIMMSAKNGVIYFSMGSNLKSKDWPEEIKRDLLKLFGELKQTVLWKFEEELPNVPKNVHILKWAPQPSILAHPKCVLFITHGGLLSTTETIHYGVPTIAIPVFGDQFINVKKAVTRGFALQVKLSYSLATDLKVAIQEMLHNPKYRQRVKELSYIYHDRPVKPGAELRHWVQHVVNTRGAPHLRSPALLVPLYQRLYLDLIALLLVILRVLYVLLRNLYRRIKSKKIVSNKKDKKN

SEQ ID NO: 6371 - protein, 526 aa, Aedes aegypti
MAARSTVVSAAILLLLVTFSEGAKILGVLPTGGKSHFYIGAGYLKTLAEAGHDVTVISPFPLKNAPKNYRDIELTGFLEEFEKEYDQNLFNFKSSGGFIGPLFMIYMMYETFGGMMCKAVLQHPNVINLLNSKEKFDVVLVETFITESLYGFAQHFDAPLITFSTFGSSMWSNDLVGTPAPPSHVAHFMLSYTDKMSFWQRFHNTAMTIVDRLYYELRYLPNQKRMYDAAFPNAKMSFEQQMKNVSLVFLNQHFSLSSPRPYPPNMIEAGGIQIEEGKPLPKDLQKYLDEAKEGVVYFCMGSNIKSIHFPEEKRNAFLKVFSKLKQRVLWKFEDENMANQPSNLMIKAWMPQNDILAHPNVKLFITHGGLLGTTEALFHGKPMIGIPIFGDQPMNVQKAVRSGYAVLLDYDDINEENVDKALSAVLNDPSYARNAKLVSERFRDKPMTPKETAVFWTEYVIRHRGAPHLRSSAMDLSLIQYHLLDVYAVMLVMALAVVALNICIAMKILRKVFGRKPSVDKKKKRS

SEQ ID NO: 6372 - protein, 1273 aa, Operophtera brumata
MLRLIIAHCAVLYITEAAKILAVIPTPSISHQVPFRLFTQELARRGHEVVIITADPAFQKGETPPNLREIDVHDISYDLWRTQFLPTSSTGNKEDSKLQLAAATKLNLEILVEQLKTNEVQSIIKNETFDLLLLEAWVRPALFFTHIYKDVPVIAISTWGGYFDNYEQIGAASHPLLYPKSSAQILNNRTMWDKVTELYNYWYLDSIFQNREKVENRELRKFAPDMPDLSELHKNIDMMFFNMHPLWDGNRPVPPSVIFMNGINKKPQKELPKPSTLPAEKIQTLVNVFSKLPYDVLWRWDKDELPGKTKNIKTFKWLPQSDLLRHLSIKVFVTQCGLQSTDEAITAGVPLVGIPMLGDQWYNAEKYVHLKIGKTVDMETLNEGNLKAAINGVLNDDSGKHLRAPSANMTWREYLELDLLLVLLFIALVLVLSVITALYYAVRNMPVISFTKCLSFIMLRLVVTSCALLYIAEAAKILAVFPTPSISHQVPFRPITQELARRGHEVVIITADPAFEKEKSPPNLREVDVHDISYDLWKAKFLPTTSTGYKEDLKLQLPTLTKLIFEIFVEQLKSNEVQGIIKNETFDLLLLEAWVRPTLFFTHIYKDVPAVTVSTFGGWNDNFERIGAASHPLLYPKSSAQKLNNRTMWDKITELYNYWDSDSNFQNLEAVENSELRKFAPDMPDLSDLHKNIDMMFFNAHPLWDGNRPVPPSVIYMNGIHKKPHKELPKDLETYLNSTTNGVVYVSFGTNVKPSTLPAEKIQTLVNVFSQLPYDVLWSIKVFVTQCGLQSTDEAITAGVPLVGIPMLGDQWYNAEKYVQLKIGKTVDMETLNEGNLKTAITGVLNDDSGKHLRAPSANMTWREYLELDLLLVLLSIALVLVAFVISALYYAVNNMPVISMWCLILASCALLYISEAAKILAVFPTPSISHQAPFRPITQELARRGHEVVIITADPAFEKGKTPPNLREVDVHDISYELWRAKFLPTSSTGYKEDLELQFTAAATLCIEILVEQLKTNEVQSIIKNETFDLLLLEAWVRPTLFFTHIYKDVPVIAMSTWGGWFDNYERIGAASHPLLYPKSSAQILNNRTMWDKVTELYNHWNLISIFQNREGIENRELRKFAPDMPDLSELNKNIDMMFFNMHPLWDGNRPVPPSPSTLPAEKIQTLVNVFSQLPYDVLWRWDKDELPGKTKNIKIFKWLPQSDLLRHPSIKVFVTQCGLQSTDEAIIAGVPLVGIPMLGDQWYNAEKYVHLKIGKTLDMQTLTEQYNFIVL

SEQ ID NO: 6373 - protein, 491 aa, Bactrocera dorsalis
MPQVADALAQAGHNVTVYGASKNVIPKAKYKYIELEPKTQDNLIASALVGSSILYKFANVVETIASASNDSLTHPRVQSLLREHGPGDFDLGHSRLLYERLPLSLWRRIFKCPLILSFMIQPVLAVNSLVGNPTELAYTPTVLGNQRQPMNFVSRVKNFISIGMELLMAEFGIHFQTKIYNYNFPASSGYPSFEEARRNVALIFANHWFAQGPVRPHVPSLIEVGGIQVKEKPDPLPTDIAELLDGSPEGVIYFSFGSLIRGNTLKPDTVHIIFNVLSKLPYKVLWKWGADYPGNSSNILFKSWLPQTDVLAHPNIKLFITHGGKGSVVEAEYNGVPMVGIPLFSDQPANMEEVRQAGFGTYVPYADLTEESLREAIEEVINNPKYRKAVREFSEVYRDRPMTPRQSVVWWVDYVLRHKGAKHMQSPAVYLTHWQLMSLDVLGVLLAIAAAVVGLLIILWRFCITKLVARLIKTNGVNGTKRNAKKSAKVE

SEQ ID NO: 6374 - protein, 1040 aa, Trichoplusia ni
MRLLVTCLLLLGIALSCEAYKFLVVIPMPARSHGNLGQGVVRHLLKAGHEVTYISAIPYKNPSPKYRNIDVSASVQLPEELINIKSIMNKEAPEMDPTMLVFMMSMIIKMYVESKEVQALFTNPKEQFDAVITEWMFSDIPSGLAAVFDCPMIYLSTVEPHWRILKIVDLATNPAYDVDATSTYSPPLNFYQRVNELWIRIKSTFLETFVTDAVEKQTYDDLFVPIIQKRGRKAPSFEEVRNNVSLVLGNSHLSMGFPSSQPQIYKSIGGYHIEDTVDPLPKDLQSLLDNAKHGLIYFSMGSNLKSKDLPREVKQNLLKMLGTLKQTVLWKFEEPLPNLPPNVHIVQWAPQRSILAHKNCVLFVSHGGLLSTTEAIHFGVPVVGIPVFADQFTNVLRSEAKGFAKKVDLSYTMDGPLKAAIEEVISNPRYAEKAKELSFIYHDRPVKPGDELVHWVQHVVRTRGAPHLRALAYHVPLYQRLYLDLVALLILAYIIMKILVKRAYSAVFSKNKSDKKKTKMASAINLLLCFFILSTCDALKILVIYPLPSKSHSILGEGVVRPLLKAGHEVTYITAFKYKDPPANLREIDVSETFNFLPSAQINLKKILASEVPLTMPGLMIPLMRSLQAKSLEYDHVQKFLGDPNEHFDVVVAEWMTVYFLNGLGPLFNAPFVWATSMDVHSHAISMIDAAPNPAYTTDLSTTRFFPFSFLDRVGELMHRITDFAEDYMYHEPAEEELYNRLIAPLIAKKGRKPPPFSDVRFNASLVLGNSHISLGSIYTLPQNYIPIGGYHIDENIEPLSKELKTLMESNKNGVIYFSMGSNLKSKDWPEDIKTGLLKMFGNLKQTVIWKFEEDLPNVPKNVHILKWVPQTSILSHPNCVAFITHGGLLSTTETVFSGVPIIGVPVFGDQLVNIQMAANRGLGLGVKLSYKVVEDLKVAIEEMVSNPRYKEKAKQQSLIYHDRPMKPADELVYWVEHVVRTRGAPHLRSPALLVPLYQRLYLDLAALVVLSLIALLCLLRYLSNAVSSKCKVNSDKKRN

SEQ ID NO: 6375 - protein, 382 aa, Cephus cinctus
MIIGHQLKIPIIGVSSSELYPWGHEMIANPRNLAFVPFELLPMTPPLSYWERMKNFLLYWWSYHEFNYYTRVQDDMIRKNFGEDAPGVRELERSVSMILANSHSSVNGAKPVTAGLIEVGGLHVRDDGPELPENLQKWLDESAHGFIYFTFGSMVRIETLPKETLAILYRSFGKIAPVRVLMKIAKPQELPDGLPGNVITQAWIQQLKVLKHKNIRAFITHGGLMGTQEAIHCGVPMIGVPLFADQFVNIHNYVEKKIALFLDYKAITEEKLDAAIDAILNDPVYLKSVRAISEKFRDRPLTPAETAVYWVEYIIKHGSQALRSPALDLTWWQEALLDVYVALVLALLVTVYAIIMIVGALVRLIFGKKRGSKRASRSKKNK

SEQ ID NO: 6376 - protein, 528 aa, Loxodonta africana
MSMKWISLLLIQLSCYFTCGTCGKVLVWPTEYSHWINIKTILDELIQRGHEVTVLTSSASILIDPNTPSAIKFEVYPTALTKDDFEFLFMKWIRKSDDLPKDTFWTYFSVVQEIAGEYSDCIQRLCKDVVFNKKLMMKLQQSRFDVILADAIGPCGELLAELLKIPFVYSVRFTYGYTFEKYSGGLLTPPSYVPIVLSGLQDRMTFLERVKNMIYVVYFDFWFQTFNEKKWDLFYSEVLGRPTTLYETMGKAEIWLIRTYWDFEFPRPVLPHFDFVGGLHCKHAHPLPKEIEEFVQSSGEYGAVVFTLGSMVSNITEERAHTIASALAQIPQKVLWRFDGKKPDNLGPNTRLYKWIPQNDLLGHPKTKAFITHGGTNGIYEAIYHGIPMVGIPLFADQPDNIARMKAKGAAVSLDMNTMTSTDLLSALKTVITDPSYKENAMRLSTIPHDQPVKPLDRAVFWIEFVIRHKGAKHLRPAALSLTWYQYHSLDVIGFLLACVAIVTCLVIKCSLFGYQKFFKTEKKKKKK

SEQ ID NO: 6377 - protein, 326 aa, Branchiostoma floridae
MNFVQRVQNVVCYSLLSILGPWLATNTYDGLVRKYISEDETIQSVVSNTDLWLYQTDHVLDFPAPSMPNMVQIGGFHIGAVSSLPKELEAFVQSAENDGVIVVSLGSIIKTMWPKKTQIFAAAFARLRQKVVWRYTGEKPAGLGNNTKLMAWIPQNDLLGHPGTRAFVTHAGARGMYEALHHGVPMVCLPLFFDQPGNSARVVARGLGVKLDFSKVTTDQLYEAITHVLTNNSYRETAARMSRLHRDQPQSPMERAVWWIEHVIKHGRLPHLRARAVDLPWYQYYLLDVTVFLVSVCTAVLGTVWYSCSLIRKKITCRTGDKVKSQ

SEQ ID NO: 6378 - protein, 531 aa, Neodiprion lecontei
MTSGCLISVTLILVAGVLQQGYASRILGIFPFPSISHQIVFRGLTVALRERGHELVVITTDPINDPTLKNYTEINVNFLYEDFNEDVDWIATRKKRTWLGLCHDIFPRLIQMTERVLNHPEVKRLYSPESGEKFDLLIIEMLVWPAFLPLAKQFDVPIIGMTSLGLPLQMQYGIGNPIMPSHPAHWDAEIKELGRLSFWQRLQNFVHAWRFVHFYRTDYLPRQQAIAEKHFGRGIPDVADMENNVSLVFVNQQAPISFVKPNIPKIIDIGGFHVSKQIEPLSKHLQRILDEATQGFIYMSLGTNVKSVMLSDETREEFLAAFSKLPYTVIWKFEDDILIGQPDNVIIMKWAPQQSILAHPNIKAFIYQGGLQSTEEAISHVVPVIGLPVFADQDTHVNKMVSLGVGTKLEILTVNRTGLLEAIQSVVLDGSYKQRMLKLRDLMEDKPYDSLENAVWWTEHVIRHKGAPHLHSTTADDPWYQRQDMDIIFIITTAILTALSISAVVVYKLMAYCIHLLNHNWQMISKKEKTC

SEQ ID NO: 6379 - protein, 412 aa, Loxodonta africana
MSKKWISVLLIQLSCYISCGTCGKVLVWPTEYSHWINIKIILHELIQRGHEVTVLTSSASILIDPSTPSAIKFEVYPTSLTKDDFEIFFMKFTRKWTYDLPKDNFWFQALNEKKWDQFYSDVLGRPTTLYETMGKADIWLIRTYWDIEFPRPFLPHFDFVGGLHCKPASPLPKEMEEFVQSSGEYGVVVFTLGSIVSNITEERAQTIASALAQIPQKVLWRFDGKKPDNLGHNTRLYKWIPQNDLLGHPKTKAFITHGGTNGIYEAIYHGIPMVGIPLFADQPENIDRMKAKGAAVSLDMNTMTSTDLLNALKTVINDPSYKENAMRLSAIHHDQPVKPLDRAVFWIEFVMRHKGAKHLRPASLSLTWYQYHSLDVIGFLLACVAIVTFLVIKCCLFGYQKFFKTEKKKKRE

SEQ ID NO: 6380 - protein, 520 aa, Aedes aegypti
MSRCVFLLLTVLCGLTRAANILYIDGVPSPSHFIWHRALINGLAAKGHSVTALSVDIEENPPQNVSYIKIEGVYESINELMGMESDFFELGDMNPFTSIAMFNDYIMLSCEMTLKSKGLQQLMAYPSDFKFDLIISDYLNGPCLSAVTQHRFGRPPYIAATAFHVLTTTNTLSGAYSYPGSVPDYALNTPQKMTYCQRFTNFLYNHWVELLKIYDMYPKVDKVVRKLVPDIPYVGDLDRDARIILLNSDPVIQYSEASMPNVISVGGMQIVKPKELPEDLKKLVDNAKNGAILFSLGTNVRSDMLGDKRIIEILSAMSQFPEYQFLWKFESDAMPFEVPKNVYIRKWMPQNDLLAHPNLKLFITHSGLLSTQEAIYNGVPIIGFPVFADQHQNINYCMEQGVGKKLLIKDVKSSDLANAIRELMTDGSYRENMSRLSKIFRDQKESPLERAIWWVEWVLRHPTSQILQSNAVRLDWFVKYSFDVIVPLVGLLLIVLIVPVKILCCVMFRKRRQQLKSKRE

SEQ ID NO: 6381 - protein, 738 aa, Rousettus aegyptiacus
MSINNILLLALQISILGNTLGGNVLIWPMEGSHWLNVKMIIDELIKKEHNVTVLVASGALFITPTYNSSLTFEIYKVPFGKEKIEGVIKDFVLAWMENRPSISTIWKFYQEIAKVMEDFHMVSREICDGVLKNQKLMEKLKKSKFEVLLSDPVFPCGDIVALKLGIPFMYSLRFSPASTVEKRCGKIPYPPSYVPAILSELTDQMSFTDRIRNFISYHLQDYMFDTLWKSWDSYYSKALDGSHWLNIKIILEELTQRNHNMTVLAASKTLFINSNTDFPVNFEVIPVSFKKSDIDSLIEHIIMLWLDHRPTPLTLWTFYKELGKVLDTFFQINMQICDGVLNNPELMSRLQKGGFDVLIADPVTSCGDLVALKLGIPFIYTLRFSPASTVERHCGKIPAPTSYVPATLSELTDQMTFSERVKNTISYSLQDYIFQSYWGEWNSYYSKVLGRPTTLCETMGKAEIWLMRTYWDFEFPRPYLPNFEFVGGLHCKPAQPLPKEMEEFVQSSGEYGIVVFSLGSMVKNLTEEKANLIASALAQIPQKILWRYKGKKPATLGANTRLYDWIPQNDLLGHPKAKAFITHGGTNGIYEAIYHGIPMVGVPMFADQADNIVHMKAKGAAVEVNINTMTSADLLNALRTVINEPSYKENVMRLSRIHHDQPVKPLDRAVFWIEFVMRHKGAKHLRSAAHNLTWFQYHSLDVIGFLLACVATVIFLVTKCCLFSCRKFGKTGKKKKRE

SEQ ID NO: 6382 - protein, 247 aa, Drosophila sechellia
FTKIERFINESEHGAIYFSMGSNLKSKDLPPAKVQEILKALDGLKQRVLRKFELDNLPNKPENVYISDWFPQTDILAHPKIIAFVTHGGMLSTTESIYHGKPVVGLPIFSVQFFNMAHAEQGGYGIMLDFKTLKADDFRQAIERITSEPSYTKVVQGMSFRYRDQQHTPMEKAIYWVEHVTRHQGAAYLKSAAQRLNWWQYHNVDVLLIIFAVMVLLLIVLPITNYNLLKKLLFTGERTQSTKVKRN

SEQ ID NO: 6383 - protein, 382 aa, Aedes albopictus
MNDFIVGVRSWLNCPTIMYCSAGFTSMTNVVGNPLEISAVPHILLGNKNPMGFLDRVKNTIIYTVDFLMGKILAHYTQPYYESNFPAEKGYPSFEQAKLDISLVMLNSYFTQTVPRPYLPNMVEVGGLQIKPKPDPLPEDIQAWLDGATDGAIFLSFGSNLKSSNLRQDKFDAIVGSISKLKQRIIWKWDTDQMPGKPANVMIGKWLPQDDILAHKNLKLFVTHGGLGSITESMYHGVPIVGIPMFGDQDTNVAQVVKEGWGASVSFDDLTEEKLTAAIKEVLGTPKYAQQIESMAERYKDRPQSSMDLATFWVEYVIRHKGAQHLHYQGADLNVLQRNLVDVFAFLGAVVYVAVKLVCFVLCRVKRMLCGGKKTTKKQKKQ

SEQ ID NO: 6384 - protein, 695 aa, Neodiprion lecontei
MWLTVEGGRKPKNTSAMALLSEARTGRAWYTGEYLKTGEEESLWGVVPKAPSGWHQPVAESSRVEFSTGLGLRCGQLRKDKGSGTGTWLACFYAGWSRDMFIQCVGGKPKELEPLQLGYGGENGEEERGGYRHRGWISHQAVFRKLKTLKPSKRGHDSILVTTDSVNDPILKKLYGNKSVVGPLNYGNCARILGVFPTPSFSHQVVFRGLTLELNKRGHELVIVTTDPVNDPSLKNYTEIDIGFMYEMHERLGRNMIEYRRSPPSLTQMSTLSSYMNLGTEKILTYPELRRLYERDSDEKFDLVIMEQLFSFALLPLADRFDAPMIGISSLVLSTNTQYGIGNTIIPSHPANWELQENINNPLTFWQRLKNFCKIWSTIYVFRTYFMPGQEEIARKYFGDDIPSLYEIEKNISLIFVNQVGPISYAKPNVPKIIEINGFHISKHKKPLPQDLQNVLDRATQGFVYMSLGTNVKSITLSAETRSEFVAAFSKLPFKVIWKFEDDNFPDKPDNVMILKWAPQQAILAHPNLKVFIYQGGLQSTEEAIEHAVPLVGFPVIGDQDAIVNKMVSLGVARKLEITAVNRDDLEEAILTVALDDQYKKKMLDLRSLLKDKPRDSLENAVWWTEHVIRHRGAPYLQSATADEPWYQRQDMDIVAFLSATSVITFVTILLISYKSLIFTINALTYSPLDKAKRN

SEQ ID NO: 6385 - protein, 483 aa, Ochotona princeps
MLGNILLWSLQLSLLGTTLGGNVLIWPMEGSHWLNVKIIIDELIRKEHNVTVLMASGALFITPTINPSLTFEIYKVPFDKERIEGVIRDFVLTWLEHRPSPSTIWRFYHEMAKVMKDFHMVSREICDGVLKNQKLMEKMKKSKFEVLLSDPVFPCGDIVALKLGIPFIYSLRFSPASTVEKHCGKVPFPPSYVPAVLSELTDQMSFTDRVRNFISYRLQDYMFEALWKSWDSYYSQALGRPTTLCETMGKAEIWLMRTYWDFEFPRPYLPNFEFVGGLHCKPAKPLPEVLWRYKGKTPDTLGPNTRLYDWIPQNDLLGHPKTKAFITHGGTNGIYEAIYHGVPMVGVPMFADQPDNIAHMRAKGAAVEVNMNTMTSEDWLNALRTVINDPSYKENAMRLSRIHHDQPVKPLDRAVFWIEFVMRHKGAKHLRPAAHDLTWFQYHSLDVIGFLLACLATSIILITKCCLCVYHVFGKTGKKKKRE

SEQ ID NO: 6386 - protein, 1000 aa, Symbiodinium microadriaticum
MDQQITAEGPTIAIFNVAMIGHVNPTFALVQELCKRGCKVSYFLPPVAPIRAAAIESGAVVEGYLPEDPSDFVMEKCGIDEPLCHAVPEIVEDDRAEYERAVWPLAHVESMSSSGADSTKLGIQCASLVTYPGMGSLSGLMSTLEAEGRLERAGAIRKPYGKAIQDKFGVDLRCNLLTRRQFYAKTNFVTTCEDLIAELPASGEQKWADELSTEFSFSAVGCLVSSSAPHVITARSDSFIPRVKSFGHSLPVAELSDQLAKGRKIIYAALGTMALSDRWSIDLGRISGYNLPHGTTGKAFCQHVWKALLAAMEELGDEFFCLLSVGKQPDALDFLGSSEAEIFELVPSNVLIRGFVPQVDMLNNYTSAFISHVGVNSLQESLMAGVPLVAIPQAVDQPANACKVEQRGWGQAFFKPMETVSSTALAESLRQVCDENSMYRQQVQCARSELAGGAPRLAERLLSMSYQSSAAMGGVCHSELWETLLERTEAWQPPYFIRGATNLREANESAEFWFHRRNGSVLAHADLTLPKFADFHPYCSRPNFESVRERLRRLGKHWRLMPHPHVNMSRWAPNSHDGGIYRTDLWQPAWEATVEQGEAIVFFPNIFHETQVPEATTFQFQLPVPARIQAARPPRPGVLLPELLSATFPSRLRSRMADDSARRRDEAEALSAMFGDDFFETDVCEWILRCTDAHAELTVQLPTDYPSRSPPALLLDAPLCERGQAEAMCRSFLEDFSPGEEYGATLATRFFEAFERQQDGGHAVSGEAALQDESAPVAAVVKLEGHLAAEIAAALLDAGFQKHSTQIYVHGELGVAAEIGEELHLSVDGVDALRELSEWVASQLVLDLSELSCFGKRVLAWANSRRAASESADGSADGIIESESEVPEVGGAKLTGNAAWRARLQAGETVEFRGSGNSLHPRIKSGECCRYVPVRKHEDIKEKDIVFCQIKGRYWGHMVKKKTFVGGKDDYEYTISNIHGWENGTCALEHIYGKVVDHWK

SEQ ID NO: 6387 - protein, 527 aa, Drosophila grimshawi
MSQSSSKVGFIGLTLLCLLSCVASYNYMVVLPCAARSHYNVGSALAKGLAAAGHQVTLVSPFALKKPIKNINDLPVPSILKAMSGDIGNLLKTSEASIIQQILGLYDMGIRRTGVLLSDSSVIELMQSNQTFDAVICEVFLNEAQFGLAEHFNAPLIGMGTFGAISWNTDLVGTPSPPSYVPHPLLKFSDHMSLVQRVINLAFLSYEYLFMELYYLPQQEQLYTKYFPNNKQNFYDMRKNTALMLLNQHVSLSFPRPYSPNMIEVGGMHINRKRQPLPQDIEEFIKGAQHGVIYFSMGSNLKSKDLPQQKRLELIKTFSKLKQRVLWKFEEPNLPGKPENVFISDWFPQDDILAHENVILFITHGGLLSTTESIYHGKPFVGIPMFGDQFLNMERAEQNGYGRSLVYEQLSAERLLAAIQQLIEDPKANDLVKAMSARYKDQPQLPLERAVYWVEHVTRHGGARYLRSASQDLNFVQYHNLDAILILYGGILFFVLYCIALLICCAWRALQNFFMGRKTSQDKMKQH

SEQ ID NO: 6388 - protein, 525 aa, Austrofundulus limnaeus
MRGRVWFPTAGLLVWLCCLNAGSVQAGKVVALPVDGSHWLSMKILVKELTRRGHEVTVLVPESSLLIKGSDSYKTEIYPVPYTQAELDSILNSFREGVFEKHPGIMDLFANVDRLVNFTSIQVTACESLLDNEPLMRQLKNEGFDILLTDPFLPCGSVLAKILSIPAVYFLRGLPCELDVKANQCPSPPSYVPKFFSGNTDRMDFPQRVNNMLMFSLESYLCTVLYKPFDGLTGRLFDMTYKELISEGAIWLLRHDFTFEWPKPLMPNMILIGGINCAKKAPLPADLKEFVEGSGDDGFIVFTLGSYVASMPEEKAKMFLDAFRQIPQRVVWRYTGVLPKDIPKNVRILKWLPQNDLLAHPNAKVFMTHGGTHGIYEGICNAVPMLMFPLFGDQRDNVHRMVARGVAEEMSIFEVTTEKLVAALSRMIQDKSYKERVVELSQIHLDRPVEPLDLAVFWTEFVIRHKGAPHLRVAAHDLNWVQYHSLDVVGFLLTVLVVTLWVMLKSCQFCTRKFCGKKTTKKKSE

SEQ ID NO: 6389 - protein, 518 aa, Anopheles sinensis
MRESLVLLVLCTVGYAVNGANILCLMGVASPSHHIWNRAIMDALAREGHNLTILSADVEKDQPSNVHYVHLEEIYPTLYTGPESLDLMEMANENLFKSVISFYRDFVVNECAGTLKSKGLRTVMDYPDEFRFDLVLHDFTCGPCLLGLLHKFKYPPLVSVTAFNNPPYSTEVIGGHKFYSYLPFYSLSYDTDMNFFQRVHNTLLSVTDVIYRNYVSNPRIDAMMRKYFRYEDMPYAPELHQRSKLMLVNAHYSIDFPESTPPNLIAVGGLQIREPKALPTDLEQFVNASRKGTVLFSLGTNVRSDQLDTERQKMIVEAFRQLPDYNFLWKFESDLGIPLPKNVLIRPWMPQNDILAHPRTKAFVTHAGLLSTHEATWYGVPIVGIPFIADQHRNLERCIRSGVAKRVAFQTMTTGQLRDAIREVLENPQYRSKMAAQSALFRDQPEKPLARAVWWIEWLLRHPNTTQLESPVLRLGFVRTYLLDVALFLAAIPILGLCVLSKLCRRVPSRVDGDKKRK

SEQ ID NO: 6390 - protein, 542 aa, Musca domestica
MERSKLSLICVFAVIASLSLQITPTNGANILGIFTSHSPSHLIVHMSVVKVLAERGHNVTVVVTQKPKVTHKDINVIVIPPKPDVEEKLNREVSGMALKKNSLINTVSNFFGSLSLLIDMQRDALQDARFTALYDNPQYDLVIIGFFFNNFQLGAAAKFKAPVAISWSGPSISMTDNFIGNPLEVSYVPNMNMAIKAGEKMTLLQRIQNIFMNGFFDMIMTAMDFKMRAFYNELFPNDGSFPTLKEMMKNISLVLVNGHFSEGPIRPNVPALVEVGGIQVKDKPDPLPKDIADFLDGAKEHGAILFSLGSNLKGSSIKPETATYIFNVLSKLKQKVIWKWEDLKNTPGKSANILYKKWMPQDDILAHPNIRLFITHAGKGGVAEAQYHGVPMMALPVFADQHGNADKIVKSGYGKQLELLTLTEDKLRENVLELLNNPMYRKNVQEFSKLYRDRPLSARENAAFWLEYVIRHHGAAHMQSPLVHMNFIESNNLDVYAVLLAVFYVLYRIFRLMLCFACKKLLKKNCSGAASKDKSKKKVKKQ

SEQ ID NO: 6391 - protein, 543 aa, Oryctes borbonicus
MRLLYFALLLVSVQSGDSANILAIAPFGGKSHYSIIEKLLKALVARGHEVDVISHFPSKTPIPRYNEFSVRGSLPIYQDNMTIDSVRDKNLIQQLTLIFANGGVSVCEAIFNTKIAQDLRNSTKKYDLLITHYFATNCMLAFAHLFSVPSVAVITSVSLPWAPSLIGLPDNPAYIPNYFTMFLPKMGFGDRFFNTMTYIITKIGFEVQSNKQSNAVVKKFFGPQLPDLDDLARNVSLVLVNSHFSTHQSRPVVPNFVEVAGLHIDGNATLTKHYEEILKTDTKIEGIIYLSFGSMIVTESFSEEVLLAFFNAFKRLPYKVLWKASRERFPKHLKLPNNIQFEPWMPQMEILCMLFQVQIYINTFLKSLLCLKYFTGHPNVKLFVSHGGMLGTSEALYCGVPVLGIPIFADQLLNIRNSVSKGVAIEIPYNQITEEKLVVAIQSLLNDPTFKTNTERVSRLFKDRPMSALDTAVYWVEYVIRHNGAPHLRSIAADLPWYQYYLLDVIFVFIVCVSTFCFVLCKLVIYIVLKLLVALYKNKIKKE

SEQ ID NO: 6392 - protein, 537 aa, Drosophila virilis
MRMVRGNVLLMILAPLLVLPDSRVNGANILGMFSTFSPSHLIVHMSMMRALADRGHNVTIVTALKPKLVPHENITYILAPLSEHHLAFVNEYMANSAKEKHSMAMTFLKTIIGTGQLMDSQYEFLLHPNVRALHEQPQVKFDLMILGYVFNDYQLGVAAKLGIPAIISWVGVPFSFVDDEVGNIYDPAYVPNVNVVQDKRLRTMGFGLRLRNYLSWLLLKGIGLALDVRMNNYYTRVFGEDPALPSYQDVKRRVSLLFYNYHSHSEGPVRPTVPQSIEIGGVQIKEQPDPLPKELAEFMANATEGAIFFSLGTNVKSSYFKPHIMEAIFQVLARQPLHVIWKCDDLQHKPGHAANIYFHNWLPQDDILAHPNTKLFITHAGKGGIAEAQYHGVPMLALPVFGDQPGNAELMVSAGFGLSLDLLTLTEDRLEQSIRELLHNPAYRQNVRKFSQLYRDRPLTARQSVVYWTEYVMRHNGAYHLQSPWLHMDFVARHNLDVYACLLLALAVSLFVFALLLRFTLKQLRRLARSKDKVKEN

SEQ ID NO: 6393 - protein, 518 aa, Polistes canadensis
MVSLIATTVTVLLIHNIGFTSSARILAIMPTPSYSHQIVYHSIFRNLNLRGHHITLVTTDLLPDRNLKNFTQIDISHTYQLKKSLNFLETRHEYSWLEIIGVMLLEITEKLCILTFEHPDFKKIYAPDSYEKFDLVMVEIIWTPAFSALGHRFKAPLIGVTSSGLLQQNHFIMGNPVIPSHPSSYELNIGIGLNVPFWKRVQNFVLTWWYIHVTCNNKLYKPQQKIAEKYLGNIPSIRELEKNISIIFMNYQEEISFTRPNMANIINFSGLHIASNASNKPLPKGLKEFIDNGSNGFIYVSLGTNVHSSMFPKKLMDIFLNVFSNLPIKVVWKFKGNFLKIPENIYIAEWFPQQAILAHPNLKLFVYQGGLQSTEEAIHFGVPLVGIPIIADQDMQVIKMESLGTCRSVDILQITRESLNEAIMDTLNNKSYKENMLKLKNLTKDKPYNSMERIIWWTEYVIRHKGAPHLRSSIVDEPWYQRYNTDVIAFLSVTLFTIVLLNLYLTDKTTKRKRDISR

SEQ ID NO: 6394 - protein, 518 aa, Papilio machaon
MKLCVIFILVTIINFVVSANILAVYPCPSISHQVVFRSLTLELLKRGHRITVVTPDPMYPKGSGHENLTEIDVHDRTYAVLKKYFVSYVTGSYWDLLNQVKGILDLVSASFEELMETKEVQHLINNKKKNEKYDLILLESMYPQALAISYTFRAPTILISSFGPYVDSYKIMGIPTNPILYHHMFRQRLYNLTLFEKLNELYNQLVIHYELNRREEKENELLKKFFGPDIPPLNVLKNYVDMLFINIHPIWEGNTPVPPNVIHMGGLHMKEPKNLPQDLQQYLDASDNGVIYFSFGTNVQLSLLPQNKIEMFENVLSQLPYNVIWKRDTVVMKSKNVEVYKWLPQADLLRHPNIKLFITQGGLQSTDEAITAGVPLLGIPMLGDQWYNVEKYVYHEIGQRLYFEELTEEKLKNAIIEVAENKRYKDNIIRLRSLMVDQPQAPLERAMWWVDYVLRHGGAKHLRAPAANISWTEYLEQDLLLFITCTLFILFGSIFLVMRVLVRIVASKIKHDKKLKNE

SEQ ID NO: 6395 - protein, 550 aa, Lucilia cuprina
MNFIFVILIALKLSHAENILMITMGGTKSHKIPFWELANGLIKRGHHITFVSGFPADFHMVGLKEMTPKSLVNYIKNFTDWDLVGARLDNKAPIPAWKALRYPAESCNSLLEPDAETGVAVTDELLTQKFHLAIVDGAFPECALGIVHRLSLPFMFINTVGFYTGSLAIAGNPIAYAVTPHVFTALTQTMDLWQRVQNYVTHILADLLHMYYTNQVHDVLIAHFGSSVPHPFTIAHNVSFILQNGHAIVTNPRPLYPNVAEIACMHCRPAVKLSHELEEFFETAPAGVIFFSMGSSVKPANMPEKFRNLLLKVFARLSQYHIVWKWDEHSSTKTRTMEAPTILSMRNTTKSTHIITDIPKNVYLSGWLPQQDILGQRKLKAFITHGGLLSMYEAIYHGVPMVMLPVFCDHDVNAAKAEQDGYAIRLSLEIITADKLYHAILAIINNDKYKREINEKRQLLLDQMNTPLDTAVFWTEYVLRHQDTTHLLSPVRNMSILKVCILFFSYNCVGFMYVLGIFIILKKILHYAFATTANTQTVSERLKRKFIKQC

SEQ ID NO: 6396 - protein, 342 aa, Ursus maritimus
MRYLQTDIHRSTINKCQEAKATQVAIDRYSNKQDESSGENGIVVFTLGSIVSNMTEERANVIASALAQIPQKVLWRFDGKKPKTLGPNTRLYKWIPQNDLLGHPKNKAFITHGGTNGIPMVGIPLFANRPDNIRKMKAKGAAVTLNLNTMSSSDLLNAQRTVINDPFYKENAMWLKTIHQDQLIKPLDRAVFSIEFVIRHKGAKHLRPASYKLTWFQYHFLDVIGFLLASVATVTFLVIKCCLFCCRKFKKRKKGNRLLRHSRHRTHFLEQRLNMGGGAIFKDTSHDPSTDGREVKVWSKILAHCLGKSFVFIVHNPLEIQNILSCKFPVTGILNGSNWLPT

SEQ ID NO: 6397 - protein, 515 aa, Tribolium castaneum
MHLLKLFGFLSLFFYSCECYKFLALFQTSTKSHYILASKLFKEIAKKGHEVTFITPFEEQTPTKNLNVVPVKTLQTFFCTRRNSMFEFESANPLEKAKFLFEISYNFTEHLIQSTEVQTLLKSDEKFDGVIIYQYLNEALLGVAHHFKAPVILFSSMPLYAPESFLLSHPNPPSYVPNILVEYTGRMNFWQRLRNTFYDTSMIAYYLWNYLPKHRELVRKYVPGGPDLYDFVNNASLILINSHVSANEAVPLVPNAVEIGGYHIEEPKALPQDLQKFLDDSKNGVILFSMGSIVQSTHFPEEKRRELFKTFAKLKENVLWKWEGDDFPGLPKNVKVMKWIPQSDVLAHPNVRAFISHGGLLSTMESVYHAVPIVGIPVMADQKMNIELAVSYGYAVAVPYPELREETLTKALDKVLNDPTYRNNIKKRSLIMKDRPIKPLDNALYWIEYVIRHEGAPHLRYPGMDLTWYQRNLLDVAGFVLVVIFSLVFVIVKICKLLFREKSKAKVVSKKKKNN

SEQ ID NO: 6398 - protein, 507 aa, Diaphorina citri
MIRLTLIFLGVLLCHIDASNILAFFPMALNSHIKPFQPLLYELSRRGHNVTEVSSFPPPPGVDNYTYVYVPHLFNATNTMEFRNRTHADLIGLFHSLCLAQMEQVLRTPEIQTFVQRDDSHFDLVIIEGTFCGECLLAMGHKYKAPVINFQPLGYWPSNYYVYGNLLSPAVIPDFRLPSTTQMNFWGRLDSLWFAVTDLFLTNLFYYPKQVALMDKYFKYPGYQSRPPMVDMLRNISMTFVEHDISIGVPQALTPNMLFTGGMHIKHAKPLPPDLDKYMSDAPNGVIFFSFGTNVRFANMPPYVLNAFVESFSKIKQKILWKTDVEVEVPPNVLVRKWFPQADILGHKNCRLFLTHGGIHSAMEAGYHGVPVVMMPGFSDQFQNVLLMQEKGLGRVIDMDSLDSDVVVEAVNAVLGDKTYAANAKRISAIMKSSPVSSLEKAVYWTEYVIRHEGAHFLKPASTRLSLVQFLCLDILLVVISVMAAMLFVLFKCGQVLLRAKKKDKTE

SEQ ID NO: 6399 - protein, 615 aa, Zeugodacus cucurbitae
VQSYLKTLAARGHEITSVSAFPQKKPLKNFRDITLINEHKDHDELIDNAVEAMSESKLSQLRSFMDYVLMASLSVLKNEEFQQLLRSDAHFDLIIIEVASQDSLYVLGKHFKAPMIGVSTFGTDVVIDQLVDNISPVAYVPALTGRNLDRMKFWQRLDNLYAYTIELLYNHLVIIPEQQRYYDTYFPNAFNRCAQRFFSFTDLAGKPMNVYINKWFPQPDILAHPKVKLFITHGGMHSLIETVHYGKPIVGMPVFYDQYLNVEKAVSKGFGLALNFRNFTSVELRDAVLEVLNNPKYTERAREISATFHDRPMKPLDAAIYWTEYVLRHKGAPQLHFSLLLLNQHYSFSWPRPLVPNAIEVAGMHIDHKPSKIPDDMEAFINASPRGAIYFSMGSNIKSEFLPKHKLQDIMNAFASLPVNVLWKFEKTDLVGKPKNVYINKWFPQSDILAHPKVKLFITHGGMHSLIEAVHYGKPIVGMPVFYDQYLNVEKAVSKGFGLALNFRNFTSAELRDAILEVLNNPKYTELAREISATFHDRPMKPLDAAIYWTEYVLRHKGAPQMRVAARHLNFLQRHSVDTVVVLFAIPLLLILLITRLILVIFRGKDCVSKKLKHE

SEQ ID NO: 6400 - protein, 979 aa, Tribolium castaneum
MFIRNLFLFCILLCASESYKILAIFPTPSHSHHTLASKLVKELAKRKHEVTFVSPFPQKETVENLKEISVEEIIPIFNQQKKHLFKLNELTLFENVIFVNNIGLLVTEELLRNEKIQKLLESNEHFDLIILPQFINEGLLAIGHHFKAPVVLLSSMPLFSWSSFLLGHPTSSSYVPNIQTHYTGHMNFWQRLCNSIYDAYSILYHQWVVLPKHRQLVKKYVPGQPDLYDFLNNASLVLVNSHVSSYDATIQVPNVVEIGGFHLEEAKKLPEDLQKYLDGSKEGVVIFSMGTLMKSSSMPKEKLQALLQAFSKLKQQVLWKWDSEEMEGKPGNVKLVKWLPQSDVLAHPNVKVFITHGGLLSTMESIYHGVPTLGIPVFTDQKANIEFAVEAGSGIAVPYPELSEEKLSQALDQIINNASYKTNALKRSKIMKDRPIHPLDYAIYWIEYVARHEGAPHLRYPGMGLAWYQRYLIDVAFFVGCECYKFLALFQTSTKSHYILASKLFKEIAKKGHEVTFITPFEEQTPTKNLNVVPVKTLQTFFCTRRNSMFEFESANPLEKAKFLFEISYNFTEHLIQSTEVQTLLKSDEKFDGVIIYQYLNEALLGVAHHFKAPVILFSSMPLYAPESFLLSHPNPPSYVPNILVEYTGRMNFWQRLRNTFYDTSMIAYYLWNYLPKHRELVRKYVPGGPDLYDFVNNASLILINSHVSANEAVPLVPNAVEIGGYHIEEPKALPQDLQKFLDDSKNGVILFSMGSIVQSTHFPEEKRRELFKTFAKLKENVLWKWEGDDFPGLPKNVKVMKWIPQSDVLAHPNVRAFISHGGLLSTMESVYHAVPIVGIPVMADQKMNIELAVSYGYAVAVPYPELREETLTKALDKVLNDPTYRNNIKKRSLIMKDRPIKPLDNALYWIEYVIRHEGAPHLRYPGMDLTWYQRNLLDVAGFVLVVIFSLVFVIVKICKLLFREKSKAKVVSKKKKNN

SEQ ID NO: 6401 - protein, 438 aa, Sipha flava
MDFRRPFVVLLLIGFGCSGLPNGKSSNILAFLPTETRSHFNGFKPLLETLVARGHNLTLVSPFPLSPVTDDGSPLLYTHVQVEFHNKVSGVDFLDKNSETNTWPSYVYVLWLGPRITRFAVDKPSVKEFILNDGGRFDVVIIENFFHECFVALGHKYGAPVVQLLPLAANSRVSQWHGNPYHPAYIAELFNDYAAPMTFRQRVGNTVSAAFNTWVNRLVYMPQQRAIMLEHFRYPGHERRPDLDTMVQDVSLTLVNSHPLVSSVAPFVPGYVQVASMHVQPVKPLPRDLKNILDAAERGVIYFSLGSVIKSSKMPRETVALLLSEFAKIEQIVLWKWEDDQLPDLPKNVIVRKWFPQNDILSHPNCRLFITHGGIHSLIESIYHGVPMLLIPVFADQVHNAAEAMRRGFALYVPYFELTAEEFSEKLQTILQDPGSST

SEQ ID NO: 6402 - protein, 525 aa, Culex quinquefasciatus
MSTSGKSLSAVIVLLVLVAVPLISADNILFLQSLASKSHHIWNKQIFERLYDNGHNLTILSFEEEPSVPGKTFLMVRGLMDKVMQEYGGAEWDVTVEQSAIVNVFFLYDFYERASRHLAQEEAIHRLLAYPRSFKFDLIIHDFTMGHFLLGFVDYFGNPPLVSVTAFNIPSHTPDLSDAPVHPSYMPHYASSFGSQMNFVERAKNTLYWTLDHVCRNYIYMTSEDRRVKQLFGPDAPSVKDVEKRSDIILVNGHFSMDYYQLLPPNVISVAGLHVSRSEEVAPIVKQFIARANKGAVLFSFGTNIQSEMLGPDVNKQILAAFRSMPEYGFIWKHGDPLSLGVVPPNVLVLKWVPQSAILANPRTKLFISHGGLLSTQEATWHGVPVVAVPFFVDQYANADKLVRAGVATKLLPKDVNEKTLKEAILRVVEDPSCRSKMKERSYHFKGQPDHPLDRAIFWIEKVLENKGLAYLRSPALEMSAIQVYNLDLLGAVALAAFLFYVLLGKILGCFIPKTNKRKTKSKTT

SEQ ID NO: 6403 - protein, 660 aa, Diabrotica virgifera
MSDGRSVRKTVTFSIPHMSHQMVLGLLERTMFLLFLLLDSFSFIQCVKILGIFPTPSYSHQIVFQPIWKELSLRGHNVTVVTPHPLNDSSLTNLTEIDVSFVYDIVPKYGWPKEYLKLPSTLHKLDYFLNAGNDFTMEIFEYGPVQRIIDQRDAFDLLIVQLSHNMNLLLYGLAFNLHIPILVNECLNNTSQASQARLSNSCALRKTIRRKRNEIQAAPPNPVNLEELRIPEHYRIYEVSDGVKENFLLADNGKGSNRILIFRRDSWLQHLQTSPIWFADGTFSIAPPLFSQVFTVKATKNNGVHPIFYALLPNKSRATYSRMFDLIKNLKPNLSPTAIHCDFEQAAFAAMEDCFPGVNINGCFFHLAQNMKKHVAQLGHLTEYNNDAQFALNFKMVTSLAFVPVRHLDQAIDVLENALPVDIQEYLDSALQGVVYFSLGSNVKSANLTEQIRKEIVAALGELPYNVLWKWETDYLPDKPDNVMTKKWCPQQDILAHPNIKVFVMQGGLQSIEEAITLEVPFVGIPLITDQHANVKRIVELGLGVKVDYKTLTKDILQNAIMEVAQNPTYKEEVRKAKSILLDEPMKGVEKAVWWIEYVIRHKGAKHLRSPAADMSFCEYFMVDVVLFLLTCITVVLYSAYKLLTVLRSMLRSLKKIKKQ

SEQ ID NO: 6404 - protein, 1038 aa, Halyomorpha halys
MIFWLCFLALVALAKSARILAFFPQGTPSHHFIFRPVIEGLAKNGHDVVYVSAFPYKELPENITQIDLSNYDIMSEFADVNIMDMTELNIMLYTIFMYSFGELMARYYVGSKEVQDLIHSDQKFDAVMFESYFYQEYLSAFIHKFNAIPIEVLTLGDCAWVNEMSGLQDNPSYQVDFKSGLSGDLSFWQKLHNVYATAFTIISNYFFLHYTQQSLMDLYFNYTGWESRPSIGILAKNRSLILTNFDHVFAYPYPMAPHRKDIGGINIKPPKPLPEDLQKYIDESEHGLIYMSMGSHIDPTHFKDQIKAFLEVFSELPQRILLKYDPEKAGEIPPNVKVSKWLPQQDILAHKKCVLFITHGGLLSLSEAIYNGVPLIGIPIFADQPKNMAMMESQGIGRMLKMKNITRDTISWTIREVLSNNRYRDEILRRSKILKDRRNSPVEEAVYWIEHTLKYPFSLTPKSTNLSAIEFHLIDVKIFITLVLILVLYMLYSGFTIAKKIVLRAIRKPKQNIPVMTKGNVSLLLLLALAAYAESARMLAFFPMPARSHHFVFRPILEELAKRGHEIVYVTGFQYDKEPKGITQIPLPAPKPSSSDKFSWVEFGEANVPITVIALYEIFLSLAPLHLGNPRIQELIHSNEKFDAVLVESYFVQEYLSAFLHKFGAVGIEIMPLGDCAWVNELSGLPDNPAYQLDYKYDHTNDLTFFEKLYNIYVTTTLTLFGYYYLHKQQAVADTYMNYTGWETRPPLYKMVSNRSIILTNSHFALGYPAPAAPHKKEIGGINIRKSKPLPKDLQTYMDQSKQGVIYMSLGSNMNVSDIATENIREDFMSVFKELPYNVLMKWETDYPGKLPPNVKTSSWFPQQDILAHKNCVLFITHGGYLSISEAVHFGVPLVGIPIFGDQAKNLVLVEDAGYGRTLKFRNITRDTVAWTVNEVLSNKRYKEEALRRSKIFRDRILSPAEEAAYWIEHAIKYPNALTPKGAWLTFVQLHLIDVKLFILATVICLLCVACKLLTAIGKLCKSKPNQKQEAKKKLKKN

SEQ ID NO: 6405 - protein, 512 aa, Drosophila busckii
SSVAMRVCWGVPLLLLAATPARAANILALFSTFSPSHLIVHMAMMQTLADAGHNITVVTALKPKLAAHENITVVLASPTEQGLLAINQQMEQSTKQKLSMLSAMLKLLTNTQQMLGGQLDFIMHPNLRDVYEQPQIKFDLLWLGYFLNEFSMGIAAKLDVPVIMSWVGVPFPFVDEHVGNVCDPTYVPGVGQTPLQAQDMTFSWRLRNYFNWLVFEGISYGMEHHMQKYYSRAFSHLPESYMEAKRRTSLLFYNYHSHSEGPVRPTVPQSIEIGGVQIKDQPAPLPAELRDFLDNGSEGVIFFSLGTNIKASFLGSDTVRIIYNVLSRQAQRVIWKWDDSTQTPGNATNIYFHSWLPQDDILAHPKIKLFITHAGKGGVAEAQYHGVPMLALPVFADQPGNADAMVKAGFGLSLDVQQLSEQQLEQHIQELLSNATYTLKVKKFSQLYRDRPLTARQSVVFWTEYVLRHKGAYHLQSPRLHLSFVARHNLDVYAAILSTLLLCWLLLRFVAR

SEQ ID NO: 6406 - protein, 386 aa, Spodoptera frugiperda
KFLNNKKQKFDLLITEAFIDYTLVYSHLFNDIPVIQISSGYAVAENFETMGAVGRHPVYYPNLWRDKFYNLNVWDLINELYVELRLYNEFYKLADQQNRLLKEQFGQDTPTIQDLRNRVELLFVNTHPVFDNNRPVPPSVQYLGSLHLTHKHPKPIYGTIGELLDNATNGAIYVSFGSGIDTEEMESEFIEMLLKTFEALPYLVLWKYDGYLNRMPENVYIQSWFEQYDLLHHKNIRAFVTQGGVQSTDEAVEALVPVVGMPMMGDQAFNTNKYIELGIGRVVNTVSVNSKELIDAITDVVENPNYRKKINELRHVIRHQAITPLHKAIWYTEHVINSKNRRGETMLKTKASNVNYSDYVMSYIFVPLASYTIMNHLRQLLRLNFV

SEQ ID NO: 6407 - protein, 562 aa, Drosophila pseudoobscura
MMERLFSPIEQSFFSYQLKAYDYTYIVGTFREVHSISLYLRSAMRILFVFIGSILLALGGLPLPAEGAKILATLAWPGRSQYIFVENYLKGLAARGHEVTVINTFKNKATPNMRFIEALKVQEFHQQMLAELEASTLWQELNAISGLEEKVAAFTLDDEGVQKLMKSGETFDVVLAEMIEVPALYGMAQHFNATLVGFSSYGSDYRIDSQLGNTSPLSYNPSIMSPRTDRMSFCERLTNHYEYLVEMLHRQLVHLPAMERMYNKYYPNARQTMDEVLDSFALVLLGQHFSLSYPRPFLPNMIEVGGLHIAHKPQPLPEDIKAFIEGAEHGVIYFSMGSNVKSKDLPQETRDTLLKTFGKLKQRVLWKFEDDQLPGKPANVLIKKWFPQPDILAQTNVKLFITHGGLLSTIESLYFGKPVLGLPVFYDQHMNVARARRVGFGLGLDLYNLNEQDLEEAIHKLLSEPSFAKASAQISERYRDQPQPSLERAIWWTEYVIRHQGAPHLRATSRDLNFIQLYSLDTLFVLVGLPLLLVALLLKVSCRLLQGRKPKGCPYADKLKKQ

SEQ ID NO: 6408 - protein, 223 aa, Capitella teleta
KPLESELAEYADSATKGLIVVTFGSMSRQIPSDVMQKMLNVFGHFPTISSSYGTLKISTKASPGNVKLSKWVPQIDLFAHRNTKLFIGHGGNNGQMEAVYYGLPMATLPIFGDQFYNAQRITARNYDRVVNIREFTKDELYEAIADVLGNQTYADNIQKCSRIFHSMRDPHERLLFWVDHVLRFGGDHLRPTYMDLTLWKFFMLDVVGAILVFLLATVYCIWK

SEQ ID NO: 6409 - protein, 512 aa, Photinus pyralis
MEAAKLIALILSVTRVSESARILGAIPTPSYSHQVLFQPLWRELSLRGHQVTVLTTNPINDPTLTNLTEIDLSSSFKILDDKLLEIINSSQNVLKVMQLTIKTFHDVNDFQLQHPEVRSLIDDEDQHFDLLIVEYILSPMFYFSKRFRCPYIGLLPLDSSNINYRSFGHPAHPTLYPDMLMGIHGETSLLERVQLILFELFMVCIAPMVRGWEQEMAWNHFRDTTPVETIRAEISLLFVNSDPVLHYNRPLLPSVISIGGTLARIPTKPLEKNVREFLDGASQGFVYFSLGSNVKSKDIPARSMDVILATFRRLPYKVLWKYELSDLPNLPTNVFISQWVSQMEVLGHRNIKTFITHGGVHSMQEAIFSRVPMVGMPFFVDQPFNVKKMTHLGVALSVDYKTMTVEELESSILEVIDNPRYRNRIEELADLAEDQPTTGLERAMWWTEYVLRHKGAPHFRSPYLDIPWYQYYLVDVFGTVFLGVSFGIFVTVKIVSVSLRYIFGKSSKITKI

SEQ ID NO: 6410 - protein, 349 aa, Capitella teleta
DPWNNGVPWLPSFTPFAFLPYSHEMNFMERLKNTAYFVSITLFGISPKLSPEIVQRYSQYGSFSSLGEISAKSKLWILTSDPVLDYPKPMMPNMIEAGGISTKPAKPLDVTWTDVLQKSVKGVVLVSFGSVVSNFPEEIATKLLTAFGRLEQTVIFRFNNKDELTIPANVVISDWIPQNDLLANPNTKVFVTHCGNSGLYEAVFHGVPMIAMPVAGDGFHNAKRVVYRGYGIFVDAFNFQADDLVSAINRVAKDPSYKQRIAKASMIFRDRPETPVQRAVSGVEHILKYGGDHLLSHSSKMPLHQLLMLDILVVTLLCCVIGAFVSFRIIICVLRLCCSRRDHHKSKKE

SEQ ID NO: 6411 - protein, 354 aa, Aethina tumida
MLSVLLIFSTVNQVFSARILGFFPTPSISHQVTFQPVWKELSLRGHNVTIICIQSMPGILSTHDMVGNPTNPVTTTDLLLPFDDNKSFPERIKTVLYQITFRLYWNWYLLPRVDTIARKYTNDNIPYMGDVEKNASLLLLNTNVVMNYPRPNVPSIVEIGQMHIKPKKPLPKNLKYFLDKSKRGVIYFSLGSNVKSANEPEEFVNNVKAAFASLPYDIIWKWERETMKNKPDNILLHKWLPQQDLLGHPNIRVFVTQGGLQSIEESISNGVPMVILPIIADQPFNAKRMENLGIAKVLEIETMTRDQLHEAIVEYQKLILDQPNTGIEKAIWWIEYVLRHNGAAHLRYSADKLK

SEQ ID NO: 6412 - protein, 516 aa, Tribolium castaneum
MTRFFTALFLLSIVWSAQSAKILVNAPMPAYSHFSLSFRLAKELADRGHQVTVINPYPQKTPIKNYRDISVEEHVEYIEELKKNLFGMNNMGFVANINFLLTMCSDLTERTLINKNVQQLLNSGETFDLVITAHFLNEAHFGLAHHFKAPLVVLSPGAANSFTNHFVANPSPSSYVPNVMAGFTNHMSFWQRTTNLIANAVFDGTREAIMMPIQRKIFKKYIKSDVELDDVLFNVSLILTNSHVSVQDAIPHVPNMIEIGGFHVKPPKKLPDDLQKFLDESKEGVILFSMGSNLKSKDLKQDVRDGILKAFSKIKQKVLWKFETELEGAPKNVKIMKWLPQQDILAHQNVVAFISHGGLLSTIEAVYHGVPIIGIPVFGDQESNIAAAASKGYAVPVPLKELSEEKLSWALNEILNNPKYRENIKQRSKLMQDQPLKPIDSAIYWIEHVIRHKGAPHLKSAGLDLKWYQREMIDIFLFLTLVTVVLFVIFYLIIKKILGLCCGKKPVKVSKTKKNK

SEQ ID NO: 6413 - protein, 561 aa, Lymantria dispar
MRSRFDRAPRNDVTPKASGQRVRGDPSPRARGLYKYGTRGRPSLVDDSTRRNDTMTAYLIVFCLCCWSAARSANILAYFPTPSYSHQLVFRAYVELLAERGHAVTVIRPLTRVDFNRNAGNLTTVDLDGDGLLLLMKASTTHRKRGIVADTDTVTANNYEALVRMVDRQIHSEPFQRHLKKSDRRGYDLLVVEAFVDYALIASHLFGDVPVVQISSGHATAENFETMGATSRHPRYYPNLWRFNFGPLSVWDGVRELYTELRLQREFGLLADRQDALLKRRFGPEAPGLRELRSRVRLLFVNVHSVFDNNRPVPPSVQYLGGLHLHDRRAEPLSEAVARFLDESRRGVVYVSFGSGLATEDMDADMTAALLDAFKMMPYDVLWKHDGRVDGLTIPANVFVQKWFAQFEVLQHKNVKAFVTQAGVQSTDEAVENLVPLVGVPLMGDQAFNAHRYVELGIGVALDATRLTAADLARAVEQVTSDRAYRANLERLRRLLRHQCASPTHKAVWYTEHALRRDGDALKTKAANVDYAEYCMSDLLAPLLSVSLMSHLHSLIRMFVW

SEQ ID NO: 6414 - protein, 347 aa, Tribolium castaneum
MGSHKSGLKITEYTLANPKVQELLQSGVNFDLVIVEQFFCEALFGFAKHFNAPLVVFSSIGPSEWNNNQMGNPHLPSYMPMTKLTYNSQMNFYQRIKNTAAFLFDATYKRYVTYPIHDKLLKKYFPKSMDLEDVLYNASLMLLNSHYSITEPFPLVPGMVEIGGFHVSNSEALPKKLETFLDGAKDGAIYFSMGTNIKSSNLNPNLIQDIVDMFSQLKLKVLWKFDKTIPKLPPNVLVEKWFPQNAILGHVNTKLFISHCGLLSTTESVYFGVPMIAIPVFGDQKMNAAKAEHFGFALTIPYPLLSGETLRQGISEVLSDSKYVENVKLRSRLYHDRPVKPLDLAMN

SEQ ID NO: 6415 - protein, 528 aa, Drosophila pseudoobscura
MKPLSRKTSFAALLLLCLLSCVSAYNYLVVLHTAARSHYHVGSALAKGLAAAGHQVTIVSPFELKKPIKNIRDVPVPSILNAMKGHIGKLLEKSQEPIVTRIIDFHHMGLAITESMLRDPIVVELMQSNQTYDAVISEVFLNEAHFGLAEHFKAPLIGLGTFGAISWNTDLVGTPSPPSYVPHAMLKLSDRMTLFQRIKNLAFVSYEYLFINYYYLPLQEAIYRKYFPNNKQDLYETRKNTALVLLNQHVSLSFPRPYSPNMIEVGGMHINRKRQPLPKDIGEFIEGAKHGVIYFSMGSNLKSKTLPLEKRQALLDTFSQLKQRVLWKFEDTELPGKPKNVFISDWFPQDDILAHENVIAFITHGGLLSTTESIYHRKPFVGIPIFGDQFLNMARAEQNGYGVTVNYVELTAPKLLAAIERLIGDPEATKKVQDMSDRYRDQPETPLERAVFWVEHVTRHKGAKYLRSASQDLGFIQYHNLDAILILYGGIIFVLYCLFLLIRRVWRLLQELFIGIANNKTKPKAKLN

SEQ ID NO: 6416 - protein, 533 aa, Drosophila guanche
MVVGRLGFDGLLVVIVIVIVVLLGQQTVQTANILAVFSYALGSSYVLVTPYIQQLVSRGHRVTMISAPVTYMPDIEGVQHIRVAKLKELTEDLEIYEYEAAVPTKWYEASFIADYFYNCSKLILEDAGVRSLLHNASAQFSMVVLGVPHTDALYGFGKHYNASLVGLAAYGGAWNIDFLAGNSAPSVYEPMSASGFTAGLSFFEKWINLIFISEERLVERFIYLPRQLKLYKRHFAADSSSLLEMRRKFSLILLNQHFSLGRVRSNVPNLVEVGGMHLAQLAEPLGAELQSFLDGATDGAIYFSMASDMLEKWFPPDFHETMLTAFGQLKQRVVWTTKRQESEITSNNVYIRRRQPQREVLHHPNVKLFITQGGLLSLIEASYYAVPVLMLPVYFDQHINAERMERLGIGRCLNFHELTPKVVLEGIQEMLHNASYALNARELALRFRDQPMKPMETAVWWTEYVLRHKGADHMRINEQDMSLMQYYSVDLFSVLFGRIGLTALIVGFLAYTVATIALQSAHYLFKLSIPVVS

SEQ ID NO: 6417 - protein, 530 aa, Musca domestica
MNFLGFVFVIIGFACVALIQNNEASRILSVFPSPSKSHLLIHCAVAQTLAEAGHEVTVLATIGNRDDATTMAMHRRAAYKFIAIEGPTFDRAFSQEMVNRPMAIYRRVFNILETIFTLANSTMNHPQMQEFLATHKAGDFDALILGYFMNDFMLGLGAHFQCPVILSFMIQPIFPINRIIGNPSESSYVPNLYTGLKQPMSFRQRVKNYLSTIFEQKILATILEWNLQKLYRYNFPADRYPPLEEVYKNVSLVLTNHHFSQGPIRPNVPALIEIGGIQIKEKPDPLPKEIADIMDSAENGVIYFSLGTNVQGSNLSPEKAKMIFNVLSQLPYTVLMKWGDKAFPGQAKNIIYKSWLPQDDILAHPKVKLFITHGGQGSVVESQYHGVPMVGIPFFGDQHSNMANVRSSGFGLSLKYATLTEEELRSTVLEVLNNPKYRENVQTFSKLYRDRPMTPRQLVRYWVDYVIRHNGAKHMQSPAVHMTWWQIQSLDVIGFLLVVVLGVVGVFVGLCKFLCCKGKKKSVNLKKKNK

SEQ ID NO: 6418 - protein, 590 aa, Zeugodacus cucurbitae
MFKLRASTTHRAKVFSCAFLLLIGCSLPTYTSAANILCFFQTFSATTLYMHSQIAELLAWSGHNVTVIGTIPNMLPAARYRYIQIKFPKRHLELLSPFQRGNRTVYWEFIVMFGNTLLLSDLAFSQPLMQKWMKNAKEDDFDLLIFGYFLNDFQMGLASLYKCPIIISATTAPTFWLNRLVGNPAESSYVPSALTPYSQPMDFWNSWWNFWIVLLERTYFSRVMEQENDEFFCLHFNCQNIRMWDVRRNITLIFTNHHFSQGPVRPNVPAMVEIGGIQIPEYRVPLQPHIADHINKAQNGVIYINLGKSVNCTELPKALLDSLHDVLVETQMHVLWRWTHCTKPRQSSRILYTKWMPQNDILALKSVKLFITHGSMSSLGEGQYYAVPMLGITYLSEHVGNVEYLVQFRFAQRIDAYRTNVNEIRRKIFDILNDPSYKERMVLYSRIYRDRQLTPRETVLYWVNYVLRYQGTPHMRSPAAEMTQLQMLGLDLVIFTVSSLILIWKFRGFIWRCITGRLMANIRKLLYKYVFVKDYEIVIERYSNIRYDEAVVDAARECQIRPQATRDPDVPRVVPVKAPRQRKGSGRRRR

SEQ ID NO: 6419 - protein, 415 aa, Aedes aegypti
MIGPSLSEVILTHPKVKTLMNSGEQFDVVIVECFVSDVLYGFAQHFNAPLVVFSPFGASLWANELIGTPYPFSQIPHTFLSYTDRMSFGERFINTLLWNVDSFYYRNIFLPRQEEMYKTYFPNAMQSLPQVMKNVSLALLNQHFSLSFPHPYAPNMIEIGGIQIDDPKPLPEDLQHILDNSKHGVIYFSMGSMLKGCRFPEEKRNAFISAFSKLNETVLWKYENTSLPNKPKNVFIRKWMPQSDVLAHPNVKLFITHGGLLGSTESLYHGKPMVGVPIYGDQRLNMARAEKAGYGTHIEYENLSEETISNAIRSVLDDPSFSSNAQLISERYRDKPMTPAQLAVYWIEYVVRHRGAPQLRSAILELSFIERNLIDVYSVMMLLVGTVLVSLCVALRKIMRFIGLLPKRIDKIKQQ

SEQ ID NO: 6420 - protein, 522 aa, Haemonchus contortus
MNWYILVNLLLVIESVVSYKILILAPKYGISHMNFMSKVADTLVDAGHNVTVYSPNILPHNGPMPTKARTVEADFDGLFLDVESAQRHVWNSDIASYVQLSKVVFKPLRVLVKALYSSDEFHAWIREQNFDIAVSEGFFALDCLLYMMGIRKFVVTVSTNPVEQVVNALGIPVTPSFVPVNNKGFSVPMTYMERALNLLEYVFVKAVIEYSLQPEFDTYFDEKFGKDVWSMQKQAEQTSYIFVNNDEAIDFPRVISHKWHYIGGLRRRMPKPLSPEWEKVYARAKRGVILMSFGTMARSTEMGEARRTAFVKAFQAFPDITFIWRYENLTDNFCNASNIILYDWLPQVDMLNDKRTLAFITHGGMGGVFESAYAGVPVITIPLFADQLRNARMMQYRGMGVVINKDDVTTDRLIAAIQEILQPRYSEAVRRLSEQLQNKPFTPEDILVRHIEHAIRFNVTASLNNASTHQSVIQYYMLDVIVPFLILVTIIILVICRIIFAAISLGLRLLQVKAGAMKIKQN

SEQ ID NO: 6421 - protein, 534 aa, Caenorhabditis elegans
MKFPIFLFLILVELCFSYKVLVFNPAFGASHANFLGKISDILIDAGNDVTMLIPIFVNGKKELVGSKKVKKIIRIDQDPRIAQIHKEGSTEEIMRKTIWKMDSAITSMFGFIGNFSKTAAYQTEYMFQQTELIEQLRKEKFDLAITESLFLGAFALFDEIGIRSVINADSTLYMGGMKGALGEPAAISYYPGLFSSIDDKMNFFGRVKNAVGYLFGLWFSVLKYDDEIVAFPKSYKGSRDWREHLSNVAFNFINSNQYIDYASPTLPKTVFVGGMQVNTKKSGKSTLSKEWNDVLSLRKTNVLVSFGSNAYSSDMPDEFKKSFLEVFASMPETTFIWKYEVANATLVDHLPNVKLTTWMPQNDILADDRLTLFITHGGLGSSVELAYQGKPAVVIPLMADQPRNAHMLTRHGGALQLDKTWLNNSEKLREAIQTVLNDVSYKHNAERLAKILEDQPHKPKDVVLKHCDFAVQFGPLDTLNSEGRLLNTFQYYSVDIVLAIFVILSVILFVVYLVIKLLFRFLGRLFSISKRKVD

SEQ ID NO: 6422 - protein, 274 aa, Necator americanus
MIDFPRVITSKFKYIGGLRMPKPKRLCQEWDSVFASAKRGIILMSFGTMARSTEMGIQRRDAFVRAFKAFPDITFIWRYENSSDYFTDASNIILYNWLPQVDMLNDERTLAFITHGGMGGVFESARAGVPSTVKVITIPLFADQLRNARMMEYRGIDKDDVTENRLITAIEEILKPRYVQAAKRLSEQLRNKPFSPEEVLIRYVDYAIRYNISETLTNIAPHQSFIEYYMLDIIVPFLVVSLLVAILTLRLVYSIISMILKLFPRVNTIKTKQQ

SEQ ID NO: 6423 - protein, 553 aa, Papilio machaon
MDDRLSLDVLCTMKLLVFLVSLVTLSVAVAAVAVEGQGHVPEAQSRGRVLLVFPVPGKSHSILGNSIADILIDDGFEVTYVTPFPSQSNRTGLTVADISSLLVADRDANHLDIANLFENPKPSHWVLTMGHMFARQALHHVALQELLNDDKVTFDLVIADWFYSGLLAPLAAVFDCPLVWYSSGDVSWQSLRYVHEASSAALAVDPQERRAPAAPLNTGDKLRQLLLQLYLTGWTHYYTSHIDAVVYREVYSAPLLLRGRRPPPYEPLVYNGSLLLVNCHPPLGNNLPLPGNVQYVGGHHLSTAPKPLPSDLQRLLDDSTHGVVYFNLGSNVRSRDLPEAMTRSLLAVLGQLRQTVLWKFEERLDHLPANVHLLDWAPQESILAHPNVLVFISHAGLLSVMEATQHGVPLLGLPIFGDQFVNIDKVVQRGCGLRVDFSDDLPARLQEALREILDNPRYQENAKQSSRMFRERLAGPRAALAHWARLVASTRGAPHLQPPARHMSTFVWLHLDILLVFGTIGWFLSKVVKVIRVHLKDSQKDSQATDNSIKKNN

SEQ ID NO: 6424 - protein, 432 aa, Nitrosococcus halophilus
MTHFGLLCPALTGHLNTLLPLGQALQKRGHRVTLVGLLDAEPPTRAAGLEFRPIGETERPAGAIAELTAQASTLSGRAALRYAVAVFQQDAALLLREAPAVIKAAGIDALLVDQFSRGGGTVADFLNLPFITLCSGVVLNREPSIPPFNTSWNYHPAWWAQLRNRLGYGLLSRVTQPLTEVVAEYRRTWNLPPLSHPNEAYSQLAQISQQPAELEFPRQQLPPWFHFTGPYHSSGSREPVPFPWEKLTGQPLIYASMGTVLGRFKGVFQQIAAACEGLDAQLVISLGGSVPPEALPALPGSPLVVGYAPQLELLQRAALTITHAGMNTTLESLSNGVPLVAIPIANDQPGVAARVAWTGAGVRVPLKRLRVPRLRQAIAQVLTHDSYRKHALRFQAAIQRAGGVDQAVEIILQAVSTGKPVLRETNAPGMGG

SEQ ID NO: 6425 - protein, 543 aa, Drosophila erecta
MTQNRSTWIGCSLGGLLVALLALQSMPQGTEGANILGVFTSYSPSHFIVHMSIMKTLAEKGHNVTVVSSVPPKVTHKSIKHIVIPMSAEDEKTISDGMSLMAKEKPSIWNTMISIFSSLALIIDKQVDVLEDPRFQELYLNKGNKFDVVFVGFFFNTYQVALGARFNCPVIVSWSGPPMMMVNEVLGNPELSSVPQMHISTSHGQPMNFQQRMQNFVGTLGFNVLSFFLEHKYNKFYERLWGNDKSIPTFEQAKKNVSLAFFNSHGISEGPIRPNVPAVIEIGGIQVKRQADPLPEDIKEFLEKGKHGAILFSLGSNLKGEHIQPEVVQTIFKGLSSLKQQVIWKWEDPKKTPGKAANILYKKWLPQDDILAHPKIKLFITHAGKGGVAEAQYHGVPMLALPVFADQPGNADKLVASGYGLQLPLATLDVDEFKASIKEVIDNPKYANTLKSFSQLYRDRPMSPHESVVYWTEYVLRHHGAAHMQSPLVRMNFIASHNLDLYIIAALVLYIVFLINKIVWKFVWRKLFGKSNKASQKKKVKKQ

SEQ ID NO: 6426 - protein, 529 aa, Drosophila persimilis
MKSLSYKTSFAALLLHCLLSCVSAYNYLVVLHTAARSHYHVGSALAKGLAAAGHQVTIVSPFELKKPIKNIRDVPVPSILAAMQGNIANLLTSSKQPIIKQIINFHHMGLNITEFLLSDPVVVELINSNQTYDAVISEVFLNEAHFGLAEHFNAPLIGLGTFGAISWNTDLVGTPSPPSYVPHALLKFSDHMSLVERVANLAFVSYEYLFLNFYYLPHQEAIYKKHFPNNKQDFYEMRKNTALVLLNQHVSLSFPRPYSPNMIEVGGMHINRKRQPLPKDIEEFIEGAKHGVIYFSMGSNLKSKDLPLEKRQALLDTFSQLKQRVLWKFEDTELPGKPKNVFISDWFPQDDILAHENVIAFITHGGLLSTTESIYHRKPFVGIPIFGDQFLNMARAEQNGYGVTVNYEELTAPKLLAAIERLIKDPEASKKVQDMSDRYRDQQQTPLERAIFWVEHVTRHKGAKYLRSASQDLNFIQYHSLDAIVILYGGIIFVFYCLFALIRFLLRSLQECCAGRAEARSKKPKAKQN

SEQ ID NO: 6427 - protein, 531 aa, Drosophila pseudoobscura
MVQNVGRVFLLAAVAVAFIGGSQGANILGLFPSLSPSHLIIQMSAAKALAEQGHNVTVVTVLKPAVTHKDINVIQVPLTKEEAASMSAIIEKMSKNDNKNMLTTMFRMIGQMGFMFDKMVDALKDPRVRDLYENKDNKFDLVLSGFFMNEYQMGFAKKVNAPLIVVATMPPNLLLNFLVGNPEEIAYVPSINDSLERGQGMSFKQRISGFIMSLGFRVFGKVLEYRNKNSYKELFGDDPNMPEYSEMMKNVSLVFFASHAISEGPIRPNVPGVIEIGGIQVKDTPAPLPKNMAEFLGNATDGAILLSLGSNVQGSHLSPDTVQKMFNVLSKLKQRVIWKWEDLDKTPGKSDNILYSKWLPQDDILAHPKIKLFINHAGKGGITEAQYHGKPMLSLPVFGDQPANADAMVKKGFGLTQSLLTLEEQPFREGIEEILSNPKYSQAVSTFSKLYRDRPLTARETVIYWSEYVIRHHGAAHLQSPLVHMSFVAANNLDVYALLAIILVVFLLLTKAVIKFILRKLSSKPKKVKKQ

SEQ ID NO: 6428 - protein, 1051 aa, Bicyclus anynana
MSTGLKISVVYFITFNLYLTSGARILGVFPTPSISHQVVFRPLVQELVKRGHEVTVITTDPAFKPGQAPNNLTEIDVHDLSYKIWTNALQEKKTGNEDDDLYSQIQLILISVSKVFEAQIATDEVQKIITKKKGQFDLLILEAFVKPTLAFTHIFNIPTIQISSFGGLQYNFEVIGAPIHPLLYPTVLSQRVYNLSSFEKLQQLYKLHKINRFFDLAEQDDDKLVKKIFGPDIPSLRNLANNVHMLFLNNHPIWSDNQPVPPSVVYIGGIHNNQQKKLPKDLNDLLDKSKHGVIYFSLGTNVRPSVMPPKKVQMMIKVFSELPYDVLWKWDLDSMPGKSDNINLYKWLPQSDLLRHPKIKLFITQGGLQSTDEAIDAGVPLVGIPLFADQWFNTEKYPYHKIGVKLDLPSLTEEIFRDAIVTVISDKSYRENILRMRNIVRDEPQTPLERAVWWTEYVLRHGGAKHLRAAGANISWTQYLEIQLIVIVLPVLLFVILLFLWVLKFLKHFVREIIGSSIKINGARILGVFPTPSISHQVVFRPLVQELVKRGHEVTVITTDPAFKPGQAPTNLTEIDVHDLSYKIWINALEEMKTGVEDDDVYSQIQVVITSMSKVFEAQIATDEVQKIITKKKGQFDLLLLEAFIKPTIAFTHVFNVPTIQISSFGGLQYNFEAVGAPLHPLLYPTIVSQRINNLSSFEKLQQLYKLLKINRFYDLAEQDDDKLLKKIFGPDIPSLRDLTDNVHMLFLNFHPMWSNNQPVPPSVVCIRGIHNDKQKELPKSRSFPFTAIGVSQLFVIAASIIIWYYLQDLNDLLNKSKHGVIYFSFGTNVRPSIMPQKKVQMMIKVFSELPYDVIWKWDLDSMPGKSDNIKLYKWLPQSDLLRHPKIKLFITQGGLQSTDEAIDAGVPLIGIPLLGDQWYNTEKYQYHKIGVKLDMPSLTEDIFRDAIVTVISDRSYRENIIRLRNIFRDEPQTPLERAVWWTEYVLRHGGAKHLRAAGANISWTQYLEIQLIVIVLSVLLFVILLFLWILKFLKHFVREIIGSMIKIKTN

SEQ ID NO: 6429 - protein, 461 aa, Papilio machaon
MNVEDARDIKTAAKGCALCQSVDPVHPKDQVPENLTEIDVHDISYSRWNKAILEIEDGSRDVSKQVEAMSDINMEIFEEQVKSKSVQKLLSYKDDYFDLILVESLLAFSLGFSHVFKAPVILVSSFGGVWDNYDAMGAPTHPLLYPSMVRDRLNNITMWEKIIQLKKEYKMRNLDRNHENMNKFLKKVFGADTPPVQKLFDNVAMLFLNQHPIWDSNRPVPPGVIYMGGLHQNPLKELPKDIKLHLDSSTNGVIYFSLGTNVKPSYVPPEKLQAIINVFSRLPYDVLLKWDNNELPIRSNNIKIFKWLPQSDLLRHPKVKLFITQGGLQSTDEAITAGVPLIGIPLLADQWYNVEKYVQHKIGVRIDIDSLTEEMFENSIHTVINDTSYRENIVRLRSIMQDQPQRPLERAVWWTEHVLRHGGALVDASNNIICCNNGPRPVEYHDHIENRRQVKVIPRFS

SEQ ID NO: 6430 - protein, 520 aa, Anopheles sinensis
MVRCIAAFYLLVTSVRYLQCANILCLTPVPSPSHHIWNRVWIEALAARGHNLTVVSADVEKATHPNVTYIHLEHAYSDLHDDLDLFQMAGNSALLGIKDLYTWGIAMCKGVLRSEGLRTIRSYPDDFPFDLVIADITCGPCLFPLIHKFGYPPLIAVTAFNNPQFTTDFVGGHKHYAYVPFFTMNYDSDMGFLQRFHNWILHNVDHIYRQNVFLPEIERMVQTHYRYEGMRSLSEIEHGTFLLLANYHYSVDFAESIPPAHIPVGGLQIRPPKALPDDLAQFLASGREGSVLFSLGTNVLSADLGEDRIQLFLDAFRQLPQYNFLWKFEATPNFSVPPNVLMRKFLPQNDILAHPNLRAFITHGGMLSTHEATWHGVPMVGIPFICDQYRNLHKSVSAGVAIRLAHDSLSTAAIKGAIMEVLHTPSYRENMRQRSALLRDQPEHPLERAVWWIEWALRHPNVNAIQSPTKRLSFWQYELYDVKLTLLLVTVIGAYLLKHIIVSYVMQSKVVSQPIGKKSD

SEQ ID NO: 6431 - protein, 562 aa, Drosophila simulans
  MOD_RES (109)..(109): Any amino acid
MIVYILTYLYKSMLSTVSIISVWQRRAQFGSVWLLVARLIFITMRIFTLILGLLCTLGYSSGYNYLMVLNSAGSSHFNVGHALAKGLVKAGHTITVVSVFPQKKPIPGXTDVNVPNVVKVMGGDIGSLWASIQKPFTQNLIDLYQMGFHITRGLFEDANFQDFLKSNQSFDAIICETFYNDAHYGLAEHFNAPLIGLGTGGGLTFITDLVGSPAPASFVPHVMLPFNDHMSLYERLLNVAFLGYERLLLDYYFLPTQEKFYKEFFPGNKRCFYEMRRNVSLVLFNQHVSLSFPRPHSPNMIEVGGMHIDGKLNPLPEKIERFINESEHGAIYFSMGSNLKTKDLPPAKVQEILKALGGLKQRVLWKFELDNLPNKPENVYISDWFPQTDILAHPKIIAFVTHGGMLSTTESIYHGKPVVGLPIFSDQFFNMAHAEQAGYGIMLDFKTLKADDFRQAIERITSKPSYTKVVQGMSFRYRDQQNTPMEKAIYWVEHVTRHQGAAYLKSAAQRLNWWQYHNVDVLLIIFVVMVLLLIVLPITIYKLLKKILFKGERTQSTKVKRN

SEQ ID NO: 6432 - protein, 527 aa, Eufriesea mexicana
MKHSVTGLFFVLCVLCVAKQTECYRILAVVATPSYSHQIPYWSLWLELHERGHEIVLVTPNPIPGIESPNFTQIDISKGYGVMKDINFVQLRLEGATWHDFVLEHLLDINEDSVRHVFEAPQMKKLYAPNSNEKFDIFLTEFLYMPSLYAFAHRFNVPMIALSSLGMITLNEYILGGLVLPSHEYTWEMQANTGPNLPFTKRLTNFVAMWRLTYVLYRDILPLHQKLAENYLGPLPPLVDIMKNVSALFLDQSDVLTPARPKLANIITFTSFHINENPDPLPKDLQEFVDGADAGFIYFSLGSNARSADLPMELQRMFCDVFAKLPYRVVWKFEKDLVGKPSNVYTGKWFTQQTILAHPKIKLFITQGGVQSTEETINFGVPAIVIPVLADQDYQAARMDALGIGKRLELATITKDEFENAVQEMITNKEYKKRMIRIQNLIRDTPYDLVKNLAWWTEYVIRSDGAPHLRSSLVMQPWYQYCDMDIVVFLTIVIFLIVSNTLNLIVKFIMYSYKRWQLSIHQKQKIS

SEQ ID NO: 6433 - protein, 569 aa, Poecilia latipinna
MQPALPTEFRHTHTHSDSESQPSTTGSTGSHTKLSLQRSEEAMRSRVWCPLTGLLAWLCCLRLGPVQGEKVLVMPVDGSHWLSMKILVKELGRRGHEVTVLVPESSLLIQSSDSYKTEVYKVPYTQAELDKNFNKLREGLFDQQPGLADLFVNVNRLVKFTSLQSVGCEALLDNEPLMTKLGREGFDMVLTDPFLPCGSILARIFSIPAVYFLRGLPCDLDIKANKCPSPVSYVPKFFSGNTDRMTFPERVKNMMMSFMESYLCTVLYQHFDELVSKRIQDGMSYKELISEGAIWLLRYDFVFDWPKPLMPNMVLIGGINCAKTAPLPAELKEFVDASGDDGFIVFTLGSMVSDMPEAKAKQFFDAFRQIPQRVIWRYTGEIPKDVPKNVKLMKWLPQNDLLAHPKAKVFMTHGGSHGVYEGICNGVPMLMFPLFGDQRDNVHRMVSRGVAVKLNIFDMTTETLVDGLKKVIYDKGYKERMVELSQIHLDRPVEPLDLAVFWSEFVMRHKGASHLRVAAHDLNWFQYHSLDVIGFLLFVFVAVLWVTLKSCLFCTRKCCGKRGAKKKSE

SEQ ID NO: 6434 - protein, 519 aa, Spodoptera litura
MNGCTVLILFFALTTTGMASSARILAVFPTPAYSHHSVFKVYVRALVERGHEVVVIKSTDKVDYKSDHRPYRLSNNNNVTEIDVSLSQDYFKKLMKQAQVFRKRGLVADSSTVTADNYMGMVRMISDQFNLPAVKKLIKEKPKFDVIITEAFIDYSLVFSHLFDDAPVIQISSGYAVAENFETMGAVSRHPVYYPNMWRDKFSNLNVWDLINELYVELKLYNEFNKLADEQNQLLKQQFGADTPTIQELRNRVQLLFVNTHPVFDNNRPVPPSVQYLGSLHLTDKHPKPLFGTVREVLDNATNGAVYVSFGSGISTDEMESEFIEMLLRTFETLPYTILWKYDGYLSRMPDNVFVQSWFEQYDLLHHPNLKAFVTQGGVQSTDEAIDALVPMVGMPMMGDQAFNTNKYAELGIGRVVDTVTVNTLEMIDAITDVAENPRYRKKMTELRHLIRHQAIAPIHKAIWYTEHVIDSSRQGETLLKTKASNVNYSDYIMSYIFVPLASFTVMNHLRQLLRINLV

SEQ ID NO: 6435 - protein, 521 aa, Tribolium castaneum
MMKLSTSLLFLFLGLICGTKSARILGIYPLPGRSHYRLGSALFRELAERGHDVTVISPFGEKDPPKNGTYRDIVLDGIFEGDEKHKGKQWNMFKREGLNPFVGAYVVATMASKFMGVILNHTKVQELLHSDEKFDVVITDNFLSDAFKAFAMHFDAPLIVINPVGPNFWINPLVGNPSPPSYIPDILLNYYHPMTFCERMVNTLIYGFNFLLYNWMVFPRHNEYVKQFIPRGGDLNDILYNTSLVLLNSHPSLNQPVPLVPNMIEIGGFHMKPAKKLPDDLQDFLDKSEEGVVYFSMGSNLQSVLWPIEKREVFLKTFSKLKMKVLWKWEDDELPGKPPNVKISKWVPQMDVLAHPNLKLFITHGGFVSSVETAYHGKPMLAIPIYGDQRNNANFAYKNGFGRYITYGNLTEENLLATINEMLDNPKYSENAKIRSQIFHDRQVHPMDTAVYWVEYVIRHRGAPHLQVAALDLPWYKYLLVDVIFVVVMALSSLIFVTWFVLKKVCKKICAKKNTQKVKTN

SEQ ID NO: 6436 - protein, 413 aa, Loxodonta africana
MSTKWISALLLIQLSCYVSSGTCGKVLVWPTEYSHWINIKTILDELIQRGHEVTVLTSSASILIDPNTPSAIKFEVYPTSLTKDDFEFLFMKWIRTWTYDLPKDNFWFQSFKEKKWDQFYSEVLGRPTTLYETMGKAEIWLIRTYWDFEFPRPLLPHFDFVGGLHCKPADPLPKEIEEFVQSSGKHGVVVFTLGSMVSNTTEERAHMIASALAQIPQKVLWRFDGKKPDTLGPNTRLYKWIPQNDLLGHPKTKAFITHGGTNGIYEAIYHGVPMVGIPLFADQPDNIARVKAKGAAVSLDMNTMTSADLLNALKTVINDPSYKENAVRLSAIHHDQPVKPLDRAIFWVEFVMRHKGAKHLRPASLSLTWYQYHSLDVIGFLLACVAIATFLVIRCCLFGYQMFYKAGKKKKRE

SEQ ID NO: 6437 - protein, 407 aa, Oesophagostomum dentatum
LYQTLFIVELDPDFKYSTGTQFVNHIIRYSSPYHNSADWRSLTFKRNEVFNSILGFNFIDLIKVQMYAYRVCKGILEDSGLIRLMHDSKFDLGVFEMFHHCPAGVMELAGIPKTMLVSAIGIGYHHYRLLGMERQSSFVPASFTMCGGRMTFLERLYNVFINGCGFVFSNIFEHFEQSLFERRFPGFKVLHDLVKDKTDFMLMNSNEFTESTRPTLRSIQYVGGATIPEPEPLDEDFDWILSRGSKGAILFSLGSLVKPSNMPLAFREGAFIFIDTFVDAFRAFPDYSVLWKDDIEMNFTYPNIHFREWVPQVDLLADGRVKLFITHCGMNSMQESLLFGVPMVTIPLFADQDSNAAVAAERGYSVNLNKLSITTEKIIDAISAVLGKPGEERYRITSYFLRLIQYV

SEQ ID NO: 6438 - protein, 527 aa, Neodiprion lecontei
MSRHFITATLIAIVGVLHPGCAARILGIFPFPSFSHQIVFRGLTLALRERGHELVVVTPNPINDPTLKNYTEIDVSFMYEHWRLDWISVAKKYTYYDFIMQSTPTFSTITEGILSHPKLQKLYEPESRETFDLLLFEALRWPAVLLFAKRYEIPAIGITSLSPTNQVHYQFGSPIMPSQPPYWNSRGIGFEKLTFWQRLCNFVQTWRFLFYYRTTYMQTQQEIARKYFGNDIPDLRDLEKNVSLVFANQQAPITFVRPSVPKIIDIGGFHISDRLEPLSKDLRMILDEATQGFVYMSLGTNTKSASLSNEMRGEFIAAFSEMPYTVIWKYEDDLLPGQPDNVHTVKWIPQQSVLAHPNIKVFIYQGGLQSTEEAISHAVPVIGLPVLGDQTSNIDKIVSLGVGKKLDISSVDRFDLVEAIQSIVRDDSYKRSMLKLRDLVRDKPYDSLENAVWWTEYVIRHKGAPHLHSTTADDPWYQRQDIDLIFIIYTAILTASTIALRVLYKLLAYSIYFLKHQHLIRKKEKVY

SEQ ID NO: 6439 - protein, 398 aa, Unknown
  Description of Unknown: Actinobacteria bacterium OK006 sequence
MGRFLFVVPPLVGHVNPAVGTAAALAGRGHEVAWAGHPELVRALVGSDAAVFPCALPEDGLSRPADLKGPAAFQFLWESFLVPLADAMAPGVRAAIEAYDPDVVVCDQQAVAGALISESLGRVWVTSATTSAELVDPLAGMPKVAAWLDGLLARLRNRICDGAGSADPRFSPHGVLAYTTRALLGPAELPDRVWLVGPSVADRPASGDDFPWDWLDASPLPTVLVSLGTANNDAGARFLNATARALGGLAGRVRAVLVDPGGLVEGPVPDNILLRPHVPQLALLPRLDAVVCHAGHNTVCEALWHGVPLVVAPIRDDQPIVAGQVVDAGAGVRLRFGRADAARIRAAVETVLDPAGGHRKAAEAVGESFRAAGGSASAAARLVALPAGSAVTRARGGA

SEQ ID NO: 6440 - protein, 537 aa, Monomorium pharaonis
MMRLTTSISPIITILWILITSNFAYGKKLLIITPTPSYSHQIVFRAICLALNKRGHDIVTLTPNVLNDTSLTNYTEIDFGFEYEKINDTDISPSRWNLTQLAGLKTRLRTLGHNIAEDVLSHPDLVKYYANGTDVQFDAVIAEMIMTPAIYILAHRFNAPLIGIMSMDLQNCHRFILGSPVLPSHPSNWELEDFTGLNLPFWKRLMNFVNTWWNIYSWFTFANKQQKIAEKYFGNDIPHIIDVSKNMSLILINQEPSLAYARPEIPNIVHFSGLHIAKTPPLLPQDLKEFLDSAINGFIYMSLGSNTKSKLLPNKILKIFRNTFVNLPYKVLWKFENDSFDIPSNVMISKWVPQQSVLAHPNIKLFIYQGGLQSTEEAVHYAVPLVGIPFVFDQVYQVMKMVSLGVARYLNIVQLTTSELHDTVLEVADDKRYKDRMLALRALTKDKPYDSLENVIWWIEYVMRHNGAPHLRFNGADTVWYQQFDLDVTVFLTITLFLVLCAILYTIGWISKQLYTYYDIGNRCILRKWIRNKVKLA

SEQ ID NO: 6441 - protein, 511 aa, Lepisosteus oculatus
MAREHCIGVAGFFVFLSLSALGPVEGGKLLVMPVDGSHWLSMQLLVKELAHRGHEVVVLVPEASIFIKGSDDYRSEHFPVPHSKEQLQVNGVFVHESNLAGILLGIEKLLNFTNMQVKGCESLLYNQPLMQRLREGGYDLMLTDPFLPCGAIIAETLSLPTVFFLSGIPCGLEMAAAQCPSPPSFVPQLFTENTDRMTFPQRVKNFMMLLVQSFLCKNLYASFDEVASRFLKTDVTYKELIGRGSIWLLKYDFTLEFPRPLMPNMALIGGINCAKQSALPAVSLVSHTAISLIPQCQQISSEFIINVYGFLSFQVLWRYTGPIPDNLPDNIKIMKWLPQNDLLGHPKARAFITHGGTHGIYEGICNGVPMVMLPLFGDQSDNAHRMEARGVGVVLSINQITTEVLLEAVNKVINNKSYKEKMTKLSALHRDRPVEPMDLAVFWTEFVMRHKGAQHLRPAAHELNWIQYHSLDVIGLLITIVVVLVIVTVRSCAFCFRKCCCKKPSLKNKSD

SEQ ID NO: 6442 - protein, 522 aa, Drosophila willistoni
MDHGGMAKILVVALILTLIGGSQSANILGIFTSTSPSHLIVHMSVAKVLAENGHNLTIITVLKPPVKHKDFNIIQVPLEKDQENQLNTAMASMAGKNFNMIRMLIDMLGQMRIVFDVGATALKDPRVVDLYENKDNKFDLAIVGHLLTEYQLGLAHKLKVPVILSATMPPSDSVGGIIGNPKDNTITGKGLKERFRTLALSNAFRIFNWFQDSRNIEHYKNLYGNDPAMPKYEDLRKNISLIFCNSHGLSEGPIRANLPGIVEIGGIQVKDKPAELPQNLKEFIGNATHGAILLSLGSNLKGDFIKPNTVKDMFKVLSQLKERVVWKWENLENTPGKSDNILYSKWLPQDDVLAHPKIKLFITHAGKGGISEAQYHGKPMLALPVLADQPQNAIAMAKAGFGLSLPLLELEEEKFRENLLEVLNNPKYGQSIKQFSQLYRDRPLTARQTVLYWVNYVLRHRGAAHLQSPVVHMGFLQANNLDIYFILLTLFVISIWLFKISITFIIRKVLKKKTVSEKVKNQ

SEQ ID NO: 6443 - protein, 518 aa, Culex tarsalis
MKSAWLLMFGGLLAISTLSETESAKILGVFPTTARSHYIVAASLMKALAKKGHEVTVISPFPQKKPIENFRDITTTKIWDAVKPLTSNMLNFAQMGALDSIKKTYSFGHTVTNETLTDPAVQKLINSNEKFDLIVLEIFMNDAMLGFIHHFNAPCVAVSTFGASKWTTDLVGTPSPPSYVPNPFLSFTDHMNFKERTLNTVMSMVEILVENIMDKPTQLEMYESAFPDPKPDLYELKKRAVSFVLLNTHFSIGYPRPYVTNMVEVGGMHINRVANALPDKIQRVMDNATEGVIYFSMGSNIQGKDMPPEKRDAFLKVFSELKQTVLWKWEDENLPNKPKNVIIQSWWPQDDILAHPNVRLFITHGGLLSSTESLYHGVPIIGIPVFGDQHLNMAKAKRGGYGLAVAYQEITYERLTNAIQTILKDPKYSDNAKAISQRYRDQPQTPLELAVFWVEYVIRHKGAPHIRTASMDLGFVQYHNLDVLAMLLGVPALILYLLGKLICGKKKSKKTQSSKKTN

SEQ ID NO: 6444 - protein, 530 aa, Carlito syrichta
MSMKWTSVLLLIQMSCYFRSGGCGKVLVWPAEYSHWLNMKAILNELVQRGHEVTVLTSSASILVDPSISSSIKFEVYPTSLTKDDFENVFGKLVDTWMYDLPKYSFLTYFSKVQEILWKYFECIRNLCKDIVLNKKLMDKLQTSKFDVILADPAGLGGELLAEVLKIPFVYSLRFSPGYIFEKYSKGFLFPPSYVPVVLSELSDQMTFTERIQNMLYMLYFDFCFQILDTKKWDQFYSEILGRPTTFSETMGKAEMWLIRTYWDFEFPRPFLPNVDFVGGLHCKPAKDLPKEMEDFVQSSGENGVVVFSLGSMVSDLTEERVNVIASALAQIPQKVLWKFNGKKPHTLGPNTRLYKWIPQNDLLGHPKTKAFITHGGTNGIYEAIYHGIPMVGIPLFVDQPDNIARIVTKGVALRVDFNTMSSTDLLNALKTVINDPIYKENAVKLSRIHHDQLVKPLDRAVFWIEFVMRHKGAKHLRAAVHDLTWFQYHSLDVIGFLLACVATVIFTITKCCLFCFQKFAKTRKKGKRE

SEQ ID NO: 6445 - protein, 530 aa, Pteropus alecto
MVSEKCILVVLLLQLCGVGCGFCGKVLVWPCDMSHWLNIKIILEELTERGHEVTVLTPSNTWLIDYKKPSQLNFEVLLPGYDKELMKKTNDKFVDLIINVLPKVTLWQSMIKLKEFFIEITEYLKILCESVVYNQTLVKKLQETNYDVMIIDPVMPCGELVAELLEVPFVLTLRISLGGIKEKHCGKIPSPPSYVPVPMMGLTDRMTFLERVKNTIFSVFFDFWIQDYDTHFWDQFYSEVLGRPTTLCETLGKAEIWLIRTYWDFEFPRPYLPNFKFVGGLHCKPAKPLPKKMEEFVQSSGEDGVVVFSLGSIIQNLTEDKANLFASAFAQIPQKVLWRYKGKKPATLGANTRLYDWIPQNDLLGHPKTKAFLTHGGMNGIYEAIYHGVPVVGVSIFGDQHDNIAHMKTKGAAMEVNMNTMTSADLLRALRTVINDPSYKENVMKLSKIHHDQPIKPLDRAVFWIEFVMRHKGAKHLRPAVHDLTWIQYHSLDVIGFLMACVAFAVFLVTKCCLFSYQKFGKTGKKEKRK

SEQ ID NO: 6446 - protein, 531 aa, Mythimna unipuncta
MAGRVLIIFLATIMMMMSMMVPSSEAARILAIFPTPAYSHHSVYKIYIQALAVRGHDVVVIKSTDRISYTSRDDNDDSVEDNFVVAKKPYNITEIDATLTERDYKRLFRQASVFRKRGLVADSSSVTARNYVSLVRMISDQFDLPVVKEFIARQQEPFDLIIAEAFIDYSLVFSHLFNDAPVVQISSGYAVAENFETMGAVSRHPVYYPNMWRDKFSNLNVWDTIGEIYNELRLQNEFSRLTDEQNELLKRQFGVSTPTIQELRSRVQLLLVNVHAVFDNNRPVPPNVQYLGGLHLAHKRPKPLFGMVREFLDNATAGAIYVSFGSGIDTDAIDGEFVEMLLRTFEALPFAVLWKYDGRLDRMPRNVFVQSWFEQYDLLHHDNVRAFVTQGGVQSTDEAIEALVPMVGMPMMGDQSFNTNKYFELGIGRVVDTVNVNARELVDAITDVAMNQKYRKRLVELRHLIRNQAMSPLHKAIWYTEHVIKNQHHTMLKTKAANVNYSDYIMVNIFVPFAVFSVMNHLRQLLRINLV

SEQ ID NO: 6447 - protein, 519 aa, Caenorhabditis briggsae
YYSKMRVLLYCFAVILLECFIVGSAKILVYCPSISKSHVLFIPSYSSALNNFDGAKHANVWRLHNVTHAYDAKLDSLANVMEDSHIGFLDRLTYDVDFWMEMCEDLARQHHRMQHLIDYGFDLALFNDIDPCNSAIISLQVSQHLQDGATLQRGHHGQDCMGPRQDDDYGRKLITDRISGLPMLPSYVPSIEENPNHDRMNFLERMSNAYKYFQSLVVHYLQERRVLHLFRNYISPDFPSIMEIIRNVSVVFVNTDEMFDITRSYSQKFVFVGMLEAEKSKNETLPEKLNEYFSKGKLGSVFVSFGTVTPFRVLPERIQLSVFNAIQKLPDYHFVVKTVIDDTTTAELFAGVPNVDLVNWVPQTAILNHPNLKMFVSHGGMNSVLETMHHGIPMVIMPVFTDQFRNGKNVERRGAGKMVLRQTVANETFYETMNEVLTDERYTKGAKRTSQLMKNRPFTPEERVSKWVDFIMTHDTSEQFHLESNSFTFIEHNQLDIFFVFILLPLITFFVYRRFLKRK

SEQ ID NO: 6448 - protein, 537 aa, Anopheles gambiae
MWGYKGTVPVSVMLLVLAATRMPTPACGARVLAIFPSPARSHQIVYRAFMKGLIERGHELTIMTTDPFAADHPNVTVIDWSYAYRIVEENLDVVDMKQRNMNFYQIAVELRRTTRLFLEAQLAHPDVQALIHSRDAHFDVVIVEYYQFTPMYAFAELFQAPMIGISSIDSMGMCHEAIGNVMNVVAHPEMNHKFTRDLTFLQRVEAVISNLMIQYHILPTDFAVFDRMIEQNFGSNMTRSWELMRRIDFLMVNAEPTLGYVRPLVPNAIQLGFMHIQPPKALPADLQNYLDRSVHGVVYFSLGTLIRSDSLNQHNLNLFLEVFKSLKYDVLWKHDGDLDLNGTTNIRMERWLPQQDLLAHPKVRVFVMQGGQQSMEEAIDRHVPLVVIPFNFDQFGNADKVTERGIGRSVWMERLTVESLRECILDVASNKRYKRNVARLGRLVRDQPMRPVEKAVWWTEYVIRHGGADHYRYPAAHMSFLVYHYYDVVGAAVLLAIALLAALHYLAGRLFRRFVGAIMSSFDRPHAVGKMLKEKAL

SEQ ID NO: 6449 - protein, 527 aa, Neodiprion lecontei
MTQVRFIISAIFVSVLAFEGGNGARILGVFPTTSISHQIVFRGLTLALNKRGHELVIATPNPVNDPNLKNYTEIDLSELYTIKKQRNLVDSRFMDWLSMLQGAAGNMYTYMNVILGHPEMRKLYALNNNEKFDVLIVEPLYWPAILALAPRFNVPIIGVSSLGLSISNHYSIGNPILPSHPSTWEFQNNIDSASTFWQRLNNFIRMCRYLYFYRMVYMPAQEAIAQKYLGDNIPSLADIEKNISLFFVNQQGPISFARPNVPGVVEIGGFHIVKCTERLPKDLQEILDDATQGFIYMSLGSNVESKMLSNETRAEFVAAFSALPYKVIWKFEDNVFPNKPDNVLILKWTPQQAILAHSNLKVFIYQGGLQSTEEAIHHGVPLIGLPVFADQDMQVDKMVSLGVAKRLEITRITRQSLLEAIHAIALDSSYKQKMLTLRSLLEEKPHDPLENAIWWTEYVIRNRGAPHLHSSSADEPWYQRQDMDIIAFISASSSISIFLALVILYRLLVKLRHGCSLQFLDAKKKMH

SEQ ID NO: 6450 - protein, 513 aa, Strigamia maritima
MKFLLLFFLINAIHGYKILLLMPSASKSHTHVTKPIISELAKRGHHITVVSSYTFPKPIQNVREIVPKPMIEDFSMFAKQVFAAAGTHVIPVFLSYKFLLGPTCENYLTNPEVKELLKQGKQFDLVMVSQILNDCALATAPLLGKNIMYFSASNLVPWLPTSVPQPRSYVPSSLSPYGSKMTFFQRLDNVVSWFGMRLIMDYIFIPHVQGIIAKHLPENPSVMEARQMVSFAMTNADPVITSPRPSVPNVVNVGGMHCKKPNPVPKEFEDFIQSSGENGFILFCLGSNVDSKDIPDEVKERIVNALGRLKQHVIWKHEKELDNCPKNVKITKWLPQQDILGHPKIRLFITHGGMLSLQESVYNAVPVVAVPLFAEQPGNVARIEEIGIGVKLLPQNISETSLYEAVTKVLDDKRYAENVKKYSVVFHDFIENQVEKAAYWVEYVIRHDGAHHLRNQGEDMNYIQYFLLDVIVFLLAILITMSWGSVKLCKIATRKFCSCKKAKIEKSKEKKEQ

SEQ ID NO: 6451 - protein, 542 aa, Pogonomyrmex barbatus
MKLIISISPIITILWILVMSNLVCSKRLLIITPVPSYSHQIVLQTINLALNKRGHEIVTLTPNILSNPNITNYTEIHFHRNKLNSFEYEKIANIDISQVRWNLRLLAELKIRAQLLGHDIANNVLSHPDLMKYYAKGTNAKFDAVITEMFTPATYMLAHRFNAPLIGILTLGLQNYHRFNLGSPVLSSHSSNWELKNHTGLNLSFWKRLENFINTWWDIYSWYNDFIYNQQKIAEKYFGQDIPYITDVAKNMSLILINQEPSFAYARPEIPNVIHFSGIHIAKTPPLLPKDLKKFLDEATNGFIYISLGSIRKSQLLPPKILEIFVNTFANLKYKVLWKFENDNFDVPSNVFTSKWVPQQGVLAHPNIKLFIYQGGLQSTEEAVHYAVPLIGIPFLFDQVCHVMKMVSLGVARYLDIVQLTTSELHDAILEVIDDKGYKDKMLELRALTKDKPYDSLENIIWWIEFVMRHNGAPHLRFNRVDTAWYQQFDFDIIVFLTITSFSVLCVLLIIIGWVSKKVYTYYDIGNRCPLRKWIRNKMKTA

SEQ ID NO: 6452 - protein, 363 aa, Capitella teleta
VALTKNEDSLIRLESMGFDLVVVDGYFMTKHKYLIAHRLKLPIVTLTDTLEPWVTRVPWLPSFVTLNIVPFSDRLTFLERVHNLFLFLAMYSRPLSPQIPRDLLDTYGVISVDDVIKTTQLWITTSDVVLDYPKPEMPNMLACGGMATKPARPLTDPWTRIVAEAQNGIVLVSLGSIASTFPTEISRKLLKSFSQLKRTVIWRFNNEDDLKVPSNVFVSEWIPQNDLLAQPKVKVFITHCGNNGQFEAVYHAVPMVAMPIFGDQFHNAKRMVHKQYGLEVMMQCFEPRDLVNATEEVIHNPLYSESIAKASNIFHDRPETPAERAASGVDVILKYGGKHLRSSAVDMPMYQFIMLDVLVFACV

SEQ ID NO: 6453 - protein, 690 aa, Aethina tumida
MLRLLLVITTISQVFSARILGLFPCPSISHQVTFQPIWKELSLRGHSVTIISPNVIKEPGLTNLTELDMGFTYDILSKPENNFGKIMRKDNHPIYNIHYALYTVELAITMMLESPDVQNLLKDDSEQFDLIMYEAVHPLAAIFSAKYRVPTIGIQSMPGFTATHDMVGNPTNPVTTTDPMLPFGVNKSFPERIKSVLYQMILRFYWNWYLLPRVDTIARKYLNNNIPYMGDVEKNVSLLLLNTNVVMNYPRPNVPNVVEIGQMHIKKKKPLPKNLKAFLDKSKTGVVYFSLGSNVKSANESKDFVYKVKAALGSLPYDVVWKWETDTMESHPNIRVFVTQGGLQSIEESISNGVPMVILPIIADQPFNAKRMENLRIAKVLEIETMTRDQLHEAIVEVAQTKEYKDNVLKYQKLILDQPNTGIQSMPGFISTHDMVGNPTNPVTTTDSLLPFDVNKSFPERIKSVLYQMIFRLYWNWYLLPRIDTIARKYTSDNIPYMGDVQKNVSLLLLNTNVVMNYPRPNVPSVVEIGQMHIKSKKPLPKKVKAFLDKSKKGVIYFSWGSNVRSANESEQFVNNVKAALGSLTYNVIWKWETDSMENKPDNILLQKWLPQQDLLGHPHIRVFVTQGGLQSIEESITNGVPMVVLPIIADQPFNAKRMKNLGIAKVLEIETMTRDQLQEAIIEVAQTKK

SEQ ID NO: 6454 - protein, 504 aa, Strigamia maritima
MKLILPFIISFNIALALGSEILYLMPVATKSHRNVFDPLIFELAKRNHHITIVSPYASPNFEPHQNVREIRLAYNIDSQMFTQDLFSNFETRSLISGFLPLKYVLAPCCESYLQNPQVKQILKQRKHFDLVIVSNVYNDCALATAPLFGSIIIMQSATSLIPWTYSSIPQPPSFIPLNVISMQSKMNLIQRLNNAVSWIVVQIIMRYDYGSYIQGTIEKNLAENPILSEAEKKVSLILTNADPVLTSPRPSVPTIQDVGGMQCKKAKPVPKELEEFIQTAGNDGFIMFSLGSFAQSKSMPKTLVKDLLQAFSRLKQNVIWKYEEELEDLPSNVKISKWLPQRDLLGHPKIRIFITHGGMLSLQESIYNAVPLVAIPLFAEQPGNAARVVEIGIGIKLDFQNISGISMYEAINRVLDDKSYVVNMKKYSAIFNDFIENQVDKAAYWVEYVIRHKGAGHLQTGKEELNFFQYFLLDVIVFILCISYIFAYVLAKIVQLIVRKKNRK

SEQ ID NO: 6455 - protein, 518 aa, Aedes aegypti
MIRWVILIVSFLQISVLIEGANILCLTPIPSPSHHIWNRAWMEALAARGHNLTIVSADIEPHSRENMTYIHLEKAYSFLTLDLNEMANENAFGGVRSLYAWGIGMCKGALHSEGMNIIMNYPDNFNVDLVVADVTLGPCLFGLLQKFGNPPVVGVTAYNNPSYTIDFIGGHKHYAYVPYVMLNYDHDMNFLQRMYNYIVFLYDDYYRHHTFLPTIEKMMRQYHKHSTIPSASELEKKVFLLLVNHHYSVDFAESVPPNHIPVGGLQVIPAKALPQDIQLFIEAGSNGAVLFSLGTNVMSSGLGKERIHMFLDVFKEFAQYNFLWKFETDLEFALPKNVMIKRFLPQNDILAHPNVKAFITHGGMLSTHEATWHGVPMVGIPFICDQYRNLHKSVQAGVAIKLEHDALTADKVRDALREILENPSYRDNMKTRSSLLRDQPEHPLKRAIWWIEWALRHPNCERIQSPSKWMSLWKSELYDVKLFMLSAFIVMTLYVKSLLTNALSMRKEDTEASNKKRD

SEQ ID NO: 6456 - protein, 469 aa, Aedes albopictus
MSRCIILLLAVICGFTRAANILYIDGVASPSHFIWHKALINGLAAKGHNVTALSVDIEEIPPSNVSYIKVEGVYESLFEEDGLESDFFEIGQMNAFSVLAMFNEYMIVGCQTTLKSKGLQQLLEYPKEFKFDLIISDYLNGPCLSAVAQHRFGRPPFIAATAFHGLTTTSTMSGAYSYSGSVPNHEFNTPQNMGYYQRFMNFLYNHWEELLRVYDMYPKVDKIVREVTPDIPFVGDLDKDTRIILLNSNPVIQYSEATMPNVISVGGMQIVKPKDLPDDLKKIVENAKKGAILFSLGTNVRSDMLGNERIIEILNAMSQFPEYQFLWKFESDAMPIEVPKNVYIRKWMPQNDLLAHSNLKLFITHSGLLSTQEAVYNGVPIIGFPVFADQHQNINYCIEQGVGKRLSIKDVKSSELVNAIREVMTDERYRENMSRLSKLFRDEKESPLERAIWWVEWVLRNPTAQILQS

SEQ ID NO: 6457 - protein, 512 aa, Diabrotica virgifera
MKRIFLLWFLIQITSGARILAVIGNPSFSHQLFYRPIWLELAKRGHDIVLLTTDPMPEVPANIKQIDWHFAYEIRHNKYDLAKRMKDCNFNIFTIMNSFQEVFHDIVDEELSSPEVQVLIRNETEYFDLVITEYLPATLTAFSERFKCSFVTVFSTEVGNSYHQVLGNMLNPVLYPEHMASYEINLNFEQRLSSTLYWLYNSFYKQSSWDKMNDALLKKHFGQLPPLRDIVRNVSVVLVNSHHVFSSKPMGPGFIRIGGGLHVSQKNELPQDIKSFLDSAAEGVIYFSLGTNVRSSNIQQDILNKFLNVFKRLPYKILWKLDADIPDIPANIKIFKWVPQQDVLRHKNIKLFITQCGAQSMEESILAEVPLLVIPFISDQKMNAQKIVNRGLGIEIDRTTMTDQLLYESIMELINNESYKRRVKKTAILLKDEPMSGLEKAIWWIEYVIRHKGAKHLWHPNLDLPLYKYFLLDVFAFLLLVIVVLSFMIYMVCYFLRKKFFSSCKVVKVKKC

SEQ ID NO: 6458 - protein, 541 aa, Toxocara canis
MDACQSVEIAGNGCVMLVSYFATLIWLVQFVYAYKIVLFVPNIAQSQVIFNVRIAEKLATAGHNVTLVLLKMFEFDKEKEVQTNVNSIKVLPWEMYVLDWSSAARPERNFKELTFWEARKDISVKLQLFPAACEKMVQNREFIERLRVERFDVAFAPMFDLCTAGIIKHLGIEAWIWLNTGRIMDYVAYYIGLPSPPSYLPPMMSDLPKNMTFIQRVKSFLGWAITIPIYKKSIVAPENALFRKYIDADFPDLIEVARRCPLIMVNSDELYDQARPVFHKVIYIGGTGMNQDDRKTLQGDLKKIADKATNIVVMTMGSHAQLSDMPSEWKTAFMNAFGKFNDHDFLIRYESDDLERVKPGNVHFYKWLPQNDLLQHSKTRLLITHGGYNSVQEAIHAGIPLITMPLFGDQFSNGHIVESHGLGRILRKNEINEQRIVETLSAVLKDPQYKKTAERMQRMIQRKPERPEDRLVAWTEFLAEFKTLDGLIPYAIHLGFIQYHCLDVIAFLALCVTVTAGVIFWLIKLLIRAVKIPFSRKQKTH

SEQ ID NO: 6459 - protein, 693 aa, Ictidomys tridecemlineatus
MFNKILLLSLQISLLGTTLGGNILIWPMEGSHWLNIKIIIDELITKQHNVTVLVASGALFITPSVSPSLKFERYKVPFSKETVEGVIKNFVLTWLEHRPSPSTLWRFYQEMTKVIEDFHMVSRDICDGVLKNEKLMEKLKRGNFEVLVSDPVFPCGDIVALKLGIPFIYSLRFSPASTVEKHCGKVPYPPSYVPAILSELSDRMSFADRVRNFISYHLQDYMFETLWKSWDSYYSNALDCSHWLNIKIIIEELIQRNHSVTILTSSETLLINSSPDFPVKFEEIPVSYKTRNLDSLIEHMIMLWINHRPTPFTMWTFYKELGKLLDTFFQINIQICDGVLNNPSLMARLQNGGFDVLVADPVTICGDLVALKLGIPFMYTLRFSPASTVERNCGKIPAPVSYVPAALSELTDQMTFGERVKNTLSYSLQDYIFQSYWGEWNSYYSKVLGRPTTLCETMGKAEIWLIRTYWDFEFPRPYLPNFEFVGGLHCKPAKPLPKVLWRYQGKKPATLGANTRIFDWLPQNDLLGHPKTKAFITHGGTNGIYEAIYHGIPMVGIPMFADQPDNIAHMRAKGAAVEVNFNTMTSADLLSALRTVINDPSYKENAMRLSRIHHDQPIKPLDRAVFWIEFVMRHKGAKHLRPASHDLTWFQYHSLDVIGFLLACATTVIFMVTKCCMFSFKKIGKTGKKKKRE

SEQ ID NO: 6460 - protein, 518 aa, Lissorhoptrus oryzophilus
MVKHKIIVLIFFISILQSSFCARILCVFQMAAISHQVTFQPIAKELSLRGHEVISVTPHPINDPSLTNLTEINTNYTYSIILGHGFEFFMSKELTVQSKVAKIFAMYNDYAEAILSNKQFRKVYNDPSQKFDLIIAQIYVSPIMFALSSKFNAPVVGISSMGGWTGTHIAIGNPTPPSLYSEMFLHYNGDLTYYERIKSTLYFLWSRLYVNFVAMPKCDAIARKYLGSDLPYLADIERNVSALFLNINPILYTPRPMVPTVVPLGFMHIKPPKPLPKDIAEEIESAKNGVVYFSLGSNVKSINIPKRIRDLLMQVFAEVPYKVLWKFEGEELPGKPRNVIIRKWLPQQDILAHPNVKVFISQCGLQSTEEAIDREMPMVGIPFIADQEMNAKRLVRQGVAKQIDYVNATKQEIIDAIIEVAENPIYRKNMKKLRLLLQDQPMTGLERAVWWSEYIIRHKGTKHLRSPTVDIEWYKYLLIDVFAAIFGVITLLLIVLIKLIKVLKRGCVRNVNEKKKKQ

SEQ ID NO: 6461 - protein, 242 aa, Saccoglossus kowalevskii
EWTEFVESAEEGIVVFTLGSQVNIGEDPEKASKFVRAFARLPQRVIMKYVGKPLNGVGENTKLSSWIPQNDLLGHPNTKAFVSHGGINGVNEAIYHAVPFVGVAAVGDQAENVGRLVDKGMAIAIDLQSFSEDDVYNAVKRVIEDPRYKDNAARLSSIQRDTPMPPGDTAVYWIEHILKFGGDHLKPASLQLNLIQYYLLDIALFLLAVAAIATIILKQVIRMVFKICCRPNNVKLNRKKKQ

SEQ ID NO: 6462 - protein, 549 aa, Eumeta japonica
MKLLLLLSLVYASDAYKILVVFPMPGKSHSILGQGFVDTLSQAGHEVTYITAFPIDRPPANVRQIDLSSVLDNMPPDILKITELVKSPFRAHMMAFMGTGMAMGTLEHENVQKFLADTTQEFDVVIVEWFFTNVFSGLATIYKAPLIWVSSMDPHWQVLQLVDEPSNPAYTASVLTKAIPPFDFFARVNELFMQLYVKFLTSIAHFLIERPAFNKHILPAFEKRGMVPPSFDEMAYNGSFMFFNAQPVLGIGYRLTQNTRYIGGYHIDPNTKPLPENLEKIFTNAKNGVIYFSMGSNLKSKDMSDYTKRGLLKMFGSLKQTVLWKFEEELKDLPPNVHVIKWAPQPSILSHPKTLLFITHGGKLSTTETIHYGVPVIGIPIFGDQFANMDQAVYKGYGIKVDYEEDLAKPLKAALDEMLNKPSYTETAKRMSAIYHDSIASPRQELVHWVEHVVRTQGAPHLRSIALHVPWYQKIYLDLIVVTALLLYVVKKVLCWVVTATHGYSQPSRSYQCVAGLLTMNWISGRGTNEQRFESELMKGEWATGTLTH

SEQ ID NO: 6463 - protein, 221 aa, Saccoglossus kowalevskii
DLNKLMQNSGDEGVIVVALGSFITFLPSKTLDTILTTLARFPHEIIFSYSGSTPRHIGDNINIFQWFNQNDVLGELSHPKTRLFITHGGLSSYREAMYHGVPMVCMPLMIDQFDTAAKIVSNGVGTYVKMKSLNNENLYEAMVEVLSNKKYSDRANQLSAAVKDVRMNATETAVFWIEHVTKYGVSHLTVHRKHLSVIEYYLLDVIAVIVTIMCIAGWSLR

SEQ ID NO: 6464 - protein, 527 aa, Oryctolagus cuniculus
MLSNILLLSLQISLLGTTLGGNVLIWPMEGSHWLNIKIIIDELIRKEHNVTVLMASGALFITPTINPSLSFEIYNVPFNKERLEGIIKNFVLTWLDHRPYPSTIWRFYQEMAKVMEDFHMVARQICDGVLKNQKLMEKLNKSKFEVLVSDPVFPCGDIVALKLGIPFMYSLRFSPASTVEKHCGKVPYPPSYVPAVLSELTDQMSFADRVRNFISYRLQDYMFETLWKSWDSYYSKALGRPTTLCETMGKAEIWLIRTYWDFEFPRPYLPNFEFVGGLHCKPAKPLPEEMEAFVQSSGEDGVVVFSLGSMVKNLSEAKANLIASALAQIPQKVLWRYKGKTPATLGSNTRLYDWIPQNDLLGHPKTKAFITHGGTNGIYEAIYHGVPMVGVPMFADQPDNIAHMKAKGAAVEVNMNMMTSEDWLSALRTVINDPSYKENAMRLSRIHHDQPMKPLDRAVFWIEFVMRHKGAKHLRVAAHDLTWYQYHSLDVIGFLLACIAAAIILVTQCCLCVYHKFGKTGKKKKRE

SEQ ID NO: 6465 - protein, 939 aa, Drosophila busckii
MKCCLLSLAGLLLLSAGHVLSYSYLMVLTTSAKSHFYVGEALAKGLVAAGHEVTLISAFPQQQPMKGLIDIPTPSIISAMAVDKAKILQRMNVPMIKRMPLFHALGLKLTRTLLAEPAVQQLLQEKRSYDAVICEIFLNEAQLGFAEHFKAPLIALSSFGASSWTTELVGTPSPLSYVPHALLKFSDRMSMYERAQNLLFTAYEKLLRQWRYLPQQQQLYEQYFPHNKQRFDEMLRNTALVLLNQHVSLSSPRPYAANMIEVGGMHIKRQLETLPQHMAQFIEGAQHGCIYFSMGSNLNTADLPPAKRQALINTFAKLKQRVLWKFEEPQLAGKPDNVYIADWFPQTAVLAHPNVKLFITHGGLLSSTEAIYHATPIVGIPLFGDQFLNMARAEQSGYGVTVMYDQLNVDTFHAAIAKVLYDPSYAQRVQEMSARFRDQPQAPLERAVYWVEHVSRHKGAKYLRNAGQDLSFIESHQNVGAALAKGLASAGHKVTLVSPFALKKPIANIHDMPVPNVLKAMGGLRITEALLKEPSVDQLRQSNQTFDAVICEVFLNEAQFGLAEHFNAHLIGLGTFGAISWNTDLVGSPSPPSYVPHALLKFSDHMSLVERVINLAFLTYEHIFMDFYYLPQQEEIYTKYFPNNKQSFYDMRRNTALVLLNQHVSLSFPRPYSPNMIEVGGMHINRERQPLPEEIENFINGAEHGVIYFSMGSNLKSTSLPQEKRQALINTFAKLKQRVLWKFEEKNMPGKPKNVFISDWFPQDDILAHKNVVLFITHGGLLSTTESIYHGKPFVGIPIFGDQFLNMARAEQNGYGKTVNYEELTTERLLNAINQILKDPKAKQLVAQMSERYRDQKEKPLDRAVYWVEHVTRHKGAKYLRSASQDLNFVQYHNLDAMLILYGGILFVFYVLIMLMRVAWHALQRGDEASSVKPKEKRN

SEQ ID NO: 6466 - protein, 557 aa, Monodelphis domestica
MLPHRDADLYGKKKLFTLDSTKVSTSRSTMLGKNSLLLALQMTLLGTVFGGNVLIWPMEGSHWLNIKIILGKLIEKHHNVTVLVASGALFISPINESSWKSEVYKVPFGKEKIEGVIRNFVLTWLENMPSPATLWQFYSEMTKVIHEFHQVSQAMCDGVLTNLKLMEKLQKGKFDILISDPVFPCGDLVALKLGIPFVYSLRFSPASTVEKHCGKVPYPPSYVPAVLSELTDKMSFSDRIRNFVSYHLQDYMFNTLWSPWDSYYSKILGRPTTLCETMGKAEMWLIRTYWDFEFPRPYLPNFEFVGGLHCKPAKPLPEEMEKFVQSSGDHGIVVFSLGSMVKNLTDEKSNVIAAALAQIPQKVLWRYKGKKPATLGPNTKTYDWIPQNDLLGHPKTKAFITHGGTNGIYEAIYHGIPMVGVPMFADQPDNIAHMKAKGAAVEVNFNKMTTADLLNALKTVINDPSYKENAMRLSRIHHDQPVKPLDRAVFWIEFVMRHKGAKHLRPAAHDLTWYQYHSLDVIGFLLACVATVVFIVAKSCLFCCRKFGKTGKKQKRA

SEQ ID NO: 6467 - protein, 447 aa, Chinchilla lanigera
MSRVTKRILLLLPLCCYFSAGSCGRVLVWHMEFSHWLNAHVILTELVQRGHQVTVLRPSSSAFLNLNSPSDMKFETFPTSSNTEEMRNFFQQMFDTWIYNIQQDAHWKYFPLLQSMFWEFSDIYYNISKDAVLNKKLLTKLQELKFDVLLVDVTFSGGDLETHYISQSMEKAETWLIQSYWDLEFPCPTLPNIEFVGGLHCKPAKSLPKEMEHFVQSSGEHGVVVFSLGSMVHNLTEERANVIASALAQLPQKVIWRYNGKTPDTLQPNTQLHEWIPQNDLLGHPKTKAFITHGGANGICDAINHGVPMVGIPLFGEQHDNIAHIEAKGAAVVLDFKTMSTADLVNALKEVMNNPFFKQNVMRLSTIHHDQLVKPLDRAVFWIEFVMRHKGAKHLRPLAQNLTWYQYHSLDVIGFLLACVVTVTLLVTKCCLFYYQKTVEIGKKKKE

SEQ ID NO: 6468 - protein, 515 aa, Caenorhabditis remanei
MIFLTSVLLGFLFQNVKTARILLTVMDQGRSHATSFNAFMHRLQQDNHTTALEFAKFHPDIDFGMEEKFVDMDGFQNPFASPDFDKIAFEEDYSFIHQAVAYGFGSETCNNILNHKREKFFEIVSEDWDLYLSDSLFAVCGYGMAEISGKPHVMMHSTDLESAQGSFKGFSRYIYSKIQNISFENFRNYATFVPSNLPFTMLDFSVSKYSHRVWAAYDWFGSYIFTAIVGNFAQKWALRSIIPFPYFSFSEYNRKSSFTFTDMPDSLFPPASRTNDFFSFGAYCKSSSKPLDSEFLSFIDDPKSKGTIIIAFGTFIDWRKAPDHYYETFSTVINQLTDYRVIWSMKGDRPLGLGNHVKTSGWVPQNQILHHNKTVLFLSHGGLKSTKEAICSATPTIFVPMFGEQTRNSWLIKEKGFGRIMNKFQINVRELETHIREVLDHPSYQQNANKFLTHYMDQPIPTLDEGAFRFNKLLKYYGKMPAYFYPKSLDLSYITALNLDLLILLPVFSLYLVSK

SEQ ID NO: 6469 - protein, 581 aa, Eumeta japonica
MKLFLLLSLVYASDAYRILVVFPMPGKSHSILGQGFVDTLSQAGHEVTYITAFPYEKPPANVRQVNISSVIDNVPSDILKITNLVNSPFRAHMAALMGPGMMVTLLDHENVQEFLADTTQKFDVVIVEWFYTSLLAGFASIYKAPLIWVSSMDPHWQVLEIVDEPSNPAYTASVLTKATPPFGFFDRVNELFMQLYVKFLTIIANFVLARPTYNKHFVPAFEKRGMIPPGYDEMAHNGSFMFFNAQPVLSIGQRLTQNTRYIGGYHIDPDTKPLPENLKKIFDNAKNGVIYFSMGSNLKSKDMSDYTKRGLLEMFGTLKQTVLWKFEEELRDLPHNVHIVKWAPQPSILSHPKTVLFITHGGKLSTIEAIHYGVPVIGVPIFGDQFANMDQAVLKGYGIKVDYEEDLAKPLRAALDEMLSKPSYAEIAKRISTIFHDVIASPRQELVHWVEHVVRTQGAPHLRSIALHVPWYQKIYLDLIAVTVILLNSLNEVVSAFDTPYALVDVNLCSFLRMCLGKNSNFLKLISKRCTRSELVNCANGSLLQHRNSMNIRGVSAEKDAIRHQTMETAKINQSGSFDVR

SEQ ID NO: 6470 - protein, 530 aa, Leptonychotes weddellii
MVSKKWISAIVLLQLCYIGRGFCGKVLVWPCDMSHWLNMRILLEKLTERGHEVTVLVSPESFIVDYNKSSTLKYEVIPMPHNRETAEKRFSGFLDMATNVMPTLPRWQSAIKLQEFLFNISGYLKLLCESVIHNQSFMKKLQATNYNVMVIDPVVHCGELIAELLTVPFVYTIRFSIGDNVEKYCGKLPAPLSYVPVTMAVLTDRMTFLQRVNNVMFSILFNFWIHQPDTQFWDQFYSEALGRPTTLCEIMGKAEIWLIRTYWDFEFPRPYLPNFEFVGGLHCKPAKPLPKEMEEFVQSSGEDGIVVFSLGSMVKNLKDEKANLIASAFAQIPQKVLWKYKGKKPATLGANTRLYDWIPQNDLLGHPKTKAFITHGGTNGIYEAIYHGVPMVGVPMFADQPDNIAHMKAKGAAVEVNINTMTSEDLLNALRTVINEPSYKENAMRLSKIHHDQPVKPLDRAVFWIEFVMRHKGAKHLRPAAHNLTWFQYHSLDVIGFLLACVATAIFLVTKCCLFSCRKFGKTGKKKKRE

SEQ ID NO: 6471 - protein, 1100 aa, Eufriesea mexicana
MKHMVTGLFFVLCVLCVAKQAESYRILAIVATPSYSHQIPYRRLWLELHERGHEIVLVTSNPIPGIQSPNFTQIDISKGYSDIRSINFVQLRFEGKTWYQFVQNELKAMCDSFARHVFDAPEMKKLYSPDSDVKFDVLLTEFLYMPSIYSFAHRFNAHLIGLSSLGSVTINDYVLGGLVLPSHEYTWESEANTGPNLPFTQRLLNFYNMWHLLYTLYRDVFPDQQKLAESYLGPLPPLLDIMRNVSVMFLDQSDVLTAARPKLANVVTFTSFHILENPDPLPKDLQEFLDGADAGFIYFSLGSNARSSDLPMELLQMFCDVFAKLPYRVVWKFEKELAKKPANVYIGKWFSQQTILAHPKIKLFITQGGLQSTEETIHFAVPVIVFPVLADQDYQANRMDALGTGKRLEITTVTKAEFENAVQEVLTNKEYKERMIKVRNLTMDTPYDLVKNLVWWTEFVVRSDGAPHLRSSLAMQPCICHLTDHKDIVEFRNYVATPVSRHFPVSAETAESYLGPLPPLLDLMKDVSAFFLDQSDVLTAARPKLANVITFSSSHMEENPDPLPKAVYLNTRSMKHAVVSLFIVLCVLCFTKQTECYRILAIVATPSYSHQVPFWRLWLELHERGHEIVLVTTNPISGINSLNFTQIDISRNSGQLGQMNLVELRFDGRVWHKIMEDVFLEKCTDYAIPVFETPQMKKLYAPDSNERFDVFLTEFLYTPSLYAFAHRFNVPIIALSSLGMISHNEHTLGGIVLPSHEYAWESQANTGPNLSFTQRLLNFIYMWRFLYILHRDVYPSQQKLAESYLGPLPPLLDIMKNVSAFFIEQSDVLTPARPKLANMITFTSTHIVENPDPLPKDLQEFVDGADAGFIYFSLGSNAKSADLPIEIQRMFCDVFAKLPYRVVWKFETDLVEKPSNVYTGKWFSQQAILAHPKVKLFITQGGLQSTEEAIHFGVPVIVIPILGDQDYQAARVNALGIGTRLELRTITRDEIENAVREVITNTQYKERMSRVQNLTKDVPYDLVKNLAWWTEYVVRSDGAPHLRSSLAKQPWYQYCDMDIVVFLTIVTVLVVSNALNIIAKLFVYSYKRFYSCNSQKQKVN

SEQ ID NO: 6472 - protein, 423 aa, Vanessa tameamea
MFLVRIIFVTLLIITKSEPARILALFPTPSISHQVVFRPLTQELAKRGHEVVVLTTDPAFPKGKSPKNIYEMDFHDLSYKTWKEFYVISTGNKGDLLNQIECVFTKVTKVIEEQLLSEEMQNMINNKNITFDLLIIEQFSRAALGYSHVYKVPVIQISSFGGMTETFESIGVPSHPNLYPAPARQRILNLSIWENMLELYSYRSIHKAVNGMENVENEMLKKIVDPNIPPISELRKNVQMVLLNIDPVWDFNRPVTKNIVHINGIHHKPKKELTEDLKLYLDNSKYGVVYVSFGTNSKPSSLPPERIQILMNTFSQLKYDIILKWDTEELSNCPKNVRVGKWFPQSDLLSHPNIKAFVTQAGLQSTDEAIDAGVPLIGIPLLGEQWFNSEKYELHKIGIKLDIETLTEEIFRNAIEAVISDPR

SEQ ID NO: 6473 - protein, 501 aa, Tetraodon nigroviridis
MRGSVGILTLGLLAWIGCFGPQPVQAGKVLVLPVDGSHWLSMKILVKELIQRGHDVLVLVPETSLLIKSSENYRTEIYQVPYSKEDLGGSFQALKDGLFLKPPSMADLFVNVERLMNFTTMQVTGCESLLRNQPLMTRLREQGFEVVLTDPFLPCGPIVSHLFNIPAVYFLHGLPCELDSKANQCPAPPSYIPTSFSGNSDVMTFPQRVKNMLMYLVQSYLCKVMYREFDRLVTRHMSDIQSYRELISRGAFWLLKYDFTFQHPKPVMPNTAFIGGINCAKKAPLPADLEEFVNGSEDHGFIVFSLGSMVENMPVEKAKQFFDAFAQIPQRVLWRYNGAVPENAPKNVKVMKWLPQNDLLAHPKAKVFMTHGGIHGIYEGICNGVPMLMFPLFGDQIDNVPRMIHRGVAETLSIYDVTSQKLVAALKKMVQDKSYKENMVTLSQLNQDRPVAPLDLAVFWTEFVMRHQGAQHLRVPPHDLNWFQYHSLDIFCFLAVVLLTV

SEQ ID NO: 6474 - protein, 483 aa, Peromyscus maniculatus
MLSNVLLWSLQISLLGISLGGNVLIWPMEGSHWLNIKIIIDELIRKEHNVTVLVASGALFITPSKSPSLTFEIYPVPFDKGRVENLIKNFVLTWLENRPSPSTIWKFYNEMAKVIQDFHTVSRGICDGVLKNEKLMAKLEKGKFEVLLSDPVFPCGDIVALKLGIPFIYSLRFSPASTVEKHCGKVPFPPSYVPAILSELTDQMSFTDRVRNFISYRMQDYMFETLWKPWDAYYSKALGRPTTLCETMGKAEIWLMRTYWDFEFPRPYLPNFEFVGGLHCKPAKPLPKVLWRYKGKIPATLGSNTRLFDWIPQNDLLGHPKTRAFITHGGTNGIYEAIYHGIPMVGVPMFADQPDNIAHMKAKGAAVEVNMNTMTSEDLLSAVRTVINDPSYKENAMRLSRIHHDQPVKPLDRAVFWIEFVMRHKGAKHLRVAAHDLSWFQYHSLDVIGFLLACVASALFLLAKSCLFVFQKFAMTGKKKKRD

SEQ ID NO: 6475 - protein, 513 aa, Dendroctonus ponderosae
MLLRGLPLILITLELCGAANILAMFPLPGLSHFVMFRALLKELAQRGHNVDVFSHFPLEKPIKGYHDIDLRGSSPLLTNNMTFDVLRDEKGVEFAKLMSNEAGFKICEDSFKATQLKQLKTSRKKYDLLLTELFGSDCMLGWAWHFKVPTIVMTSSANLPWAADRFGLPDNPSYIPTYFMGSVSKQDFFGRMMNTWTLIRSKMLYRLHSTIPSNKLAKEFFGPEMPDLDVLAYNTSLQLVNSHFSVNNARPLVPNVVEVGGLHVGEPRPLSKHFDDVLAADKRGVICFTMGSVVVIESLPRGKLEALLNALAELPYTVIMKANVQKFPKDIAAPKNIVFEPWIPQLDILCDPRVKLFISHGGMMGTQEAVYCGIPVLGIPIFADQSLNIKYTEAMGFGIMVDYEKITKETLVIAAGKLLEDPKYRANAQRLSAYFKDRPMKPMDTAVYWVEYIVRHQGAPILQSAAKDLAWYQYYLIDVAAFLMFFSALLASIVAKVFVLLRNLGAKKKTKTS

SEQ ID NO: 6476 - protein, 542 aa, Trichoplusia ni
MRLCRPYITVGDRRVLHLHAVTRNKMKLLILFGLTLLCGVESLKVLVYYPLPVRSVSMLGNGVVRHLLDAGHEVTYVTVYPLKNMPPTLKQVDISGNEEMLAKDDSLSISHMLENNVQDNDVLHIQEFAKENTRQTFTNKNFTKFLQDTSQRFDLVFSDLFESEVCAGLSVVYDCPLVWFYSMGAHWNVLRLIDEGRNPAYDPDYLTTNVVPFSFLERVEQLWARIKYMALKTFITLPDEKKMYEEIFTPLVAQRGRTLPNYEDVIYNASIIFGNEHNAVKLRPSTPQNFKYIGGMHIPDPVTPLPKKLQDLMDNAKHGVIYFSMGSFFKSKHLPKSLVRGLVKTFGELKETVLWKFEEDLPDLPSNLHILQWAPQSSILAHKNLKFFITHGGLLSSIEAIHFGVPVIAIPVYFDQFTNVRKAVENGYAIRVPLSYDLPETLRPAIKSMLTDNTYKKRITELSTIYHDRLVPPGKEMVHWVEHVVRTRGALHLRSPALNVPLYQRLFLDLLAVILIILYIIKRIINNLTRKTSKKTDKKKKN

SEQ ID NO: 6477 - protein, 280 aa, Dasypus novemcinctus
MGKAEIWLMRTYWDFEFPRPYLPNFEFVGGLHCKPAKPLPKEMEEFVQSSGEDGIVVFSLGSMVKNLTEEKANLIALALSQIPQKVLWRYKGKEPATLGANTRLYDWIPQNDLLGHPKTKAFITHGGTNGIYEAIYHGVPMVGVPMFADQPDNIAHMKAKGAAVEVNMNTMTSADLFRALRTVINEPSYKENAMRLSRIHHDQPVKPLDRAVFWIEFVMRHKGAKHLRPAAHDLTWFQYHSLDVIGFLLACVATALFLVTKCCLFSYKTFGNNGKKRKRD

SEQ ID NO: 6478 - protein, 460 aa, Penaeus vannamei
MRVLLTLLLAAALAEGSRVLMVLPLGSASHKNILTPLAERLAQRGHQVTIASLHASAAPANGSALPFTDLVAADAWDVVRKVTGGFDVFRMREASGGKDVNSQVMKKVVRHLPEYCDAFLRDPALQAAWAERPDLVLLPAFMNECGLAFVHKFKAPFIYVTTSGLTPWTADLLGNPENPAYVPNQYLPYDTHMTLWQRTLNTLVRFISPHLRSQLVLSPWTAWSSGSWATPQCPCPSLGSAIRSEQLPASVRDTLVRAFARLPYRVLWKWEGAAVPGLPPNVLTRPWFPQQDVLGHERVRAFLTHGGLSSMQEAVYHGVPVVGLPLMSDQHLNVRQAVTLGLGRELTLETMTEDDLVEAITAVVEDDGFRTRVRARSLMLRDQETTPLARAVYWSEHGVQAVRRQGPASPVEPRQGGVAPPARGGTPISAAPHSPPSTLTDVTTHHCESPVNTVMAAIPS

SEQ ID NO: 6479 - protein, 499 aa, Aethina tumida
MLSLLLVFTTINQVFSARILGFFPTPSISHQVIFQPIWKELSLRGHNVTIISPNIIGDPTLINLTELDMGFTYDLLKKPENNIGKIMRKGNYPIYNIHYAFCVVELAMTMMFESPPVQKLLKDDSQQFDLILLEVLQPLANIFSAKYRVPTVGIQSLPGILSTHDMVGNPTNPATTTDLFLPFDDNKSFPERIKTVLHQMIFRLYWNWYLLPRIDTIARKYTSDNIPYIGDVEKNQDQNVPSIVEIGQMHIKPKKPLPKSLKAFLDKSKKGVIYFSLGSNVRCANESKDFIDNVKTALGSLPYDVIWKWEIDIMENKPDNILLQKWLPQQDLLGHPNVRVFVTQGGFQSIEESIVNGVPMVVLPIIADQHFNAQRMKHLGIAKVLDIETMTRDELKNAIIEVAQTKKYKDIVLKYQKLMLDQPNTGIEKAIWWIEYVIRHNGASHLRYSAMDTPFYKYYLLDVIGFFLVIFIIFLLLLLKLYKLVKYFPKAVIKNKKIN

SEQ ID NO: 6480 - protein, 527 aa, Drosophila simulans
MKPTAGQTGFLALLLFSLLSCVSAYNYLLVLHTAARSHYHVGSALAKGLAAAGHQVTIISPFELKKPIKNIKDVPAKSILTSMQGIGNLLQTSKEPIIKQIVDFHEMGIEITELLLKEPSVIELMKSNQTFDAVISEVFLNEAHFGFAEHFKAPLIGLGTFGAISWNTDLVGSPSPPSYVPSALLKFSDRMSLAERVGNQAFLTYEYIFLNYFYLPRQEVLYRKYFPNNKQDFYDMRKNTALVLLNQHVSLSFPRPYSPNMIEVGGMHINRKRQPLPKDILEFIEGAEHGVIYFSMGSNLKSKTLPLEKRQALIDTFAQLKQRVLWKFEDTDLPGKPANVFISDWFPQDDILAHDNVLAFITHGGLLSTTESIYHRKPFVGIPIFGDQFLNMARAEQNGYGVTVHYEELSAAKLLAAIQKIINDPEATQKVRDMSDRYRDQQQTPLERAVYWVEHVSRHKGAKYLRSASQDLNFIQYHNLDAMLVLYGGIIFVLYCIFLLIRLVWRFLQELFVKKESSKPKKKEKRN

SEQ ID NO: 6481 - protein, 518 aa, Heliothis virescens
MNNWTLFLLSSIFLSHVCAYKILVVFPYPGTSHSILGEGYVRHLLRAGHEVTYLTAIPYKKPHPNLKQVVVASVVDKFELFQQLNFDKFISKEIDMTDVRKFYEVMITIANRSLTHENIQKFLMESNERYDLVVAEWLYHVLYSGFAAIFNCPYIWSSSMEPHPVILSLIDEPGNPAYFPDHMSPVAAPMTFSERVNELWYLFYIYRVLWSVKGAEEKVYKEVFGPAAAKRGITLPELEDLKYNGSLVLGNSHISSGEPQRLPINHINIAGYHIQDVVPTLPENLQKIMDDADHGVIYFSMGSMMKSRTMPMKLKRDFLDVFGQLEQTVIWKLEEELTDLPKNVHIVQWAPQQSILGHPNCKLFVTHGGLLSTTETIHFGVPIIGIPLFADQFLNVVRSVRKGFALQVNLGLDTPAKLKVAIDEILSNPKYVQKVKELSFIYHHRETKPGHTLVHWIEHVIETNGALHLRSPALHMPFYQKMYLDLLALVLLVIIVLVKVVQVLLSSKKKSDIKLKRT

SEQ ID NO: 6482 - protein, 445 aa, Loxodonta africana
MSKKWISVLLIQLSCYISCGTCGKVLVWPTEYSHWINIKIILHELIQRGHEVTVLTSSASILIDPSTPSAIKFEVYPTSLTKDDFEIFFMKFTRKWTYDLPKDTFWTYFSQIQEMEWEYSDFIENLCKEAVFNKKLMMKLQKSRFDVVLADIIAPCGRPTTLYETMGKADIWLIRTYWDIEFPRPFLPHFDFVGGLHCKPASPLPKEMEEFVQSSGEYGVVVFTLGSIVSNITEERAQTIASALAQIPQKVLWRFDGKKPDNLGHNTRLYKWIPQNDLLGHPKTKAFITHGGTNGIYEAIYHGIPMVGIPLFADQPENIDRMKAKGAAVSLDMNTMTSTDLLNALKTVINDPSYKENAMRLSAIHHDQPVKPLDRAVFWIEFVMRHKGAKHLRPASLSLTWYQYHSLDVIGFLLACVAIVTFLVIKCCLFGYQKFFKTEKKKKRE

SEQ ID NO: 6483 - protein, 395 aa, Daphnia pulex
MSSTEQFDLLIIEALFNECVLPLVRKFDVPFVYMVSMTPSPWLLDAVGSSLALDHLPHAGSNYADEMDFWQRTYNTISGMMITYFHRFFVIPVVDRLASEILKLNNQPSYMSLIISNTHFSINYQFPASPALIQAGGLHCLPSKQLPKDLESFVDGSGDAGFIVVSFGSVLRGSDISDHVRQLFLSTFSRLPQRVIWKWEEKLDETDSIPSNVKLLPWMPQQDLLGHPKIRLLITHGGLNSKQEAVYHGVPFIALPVFADQPINAQKAHDDGYAIRLDWDNLTEEILFDAIQRILSNSSYVERMNQVSALMRDQTDRPLDRAVYWIEYVIRHQGASHLRSASRKLSLFQRCLIDVLLFTLFLLLFLLISVFLLCRFVHQKVLHETNLQTSTKKTD

SEQ ID NO: 6484 - protein, 529 aa, Oesophagostomum dentatum
MPFFPIFFALLLASSDAYKIVVFVPSMVKSQVVFNTRVAETLAKAGHDMTLVMIDPLGGAKSSTVMIPEQVKTYYLNTSTGLSAETFDESVEKLIFKDLTLWDIKHFLDFAIRIFIGSCRKMVENKEFIKWLEAEKFDLAFSYVADICPVGVIHHAKVPTWIWLNSAPLIDFVAYYMGVPIIPSYVPPLAMASSDHMNFIERTKSLIGYGMEIILWKWFIADKQTVIFREVLDPHFPDLVELGKKCPLVMVNSNELYDYPRPTLAKIVNIGGVGYQMKDAKPLEPEFSRVVDTASDVILFSFGSVVPSDRMPMAWKMAFIEAFKRFPNYQFIWRYVGSDIKDKLPSNVHIYKWLPQSDLLQHKKTRAFITHGGYNSLQEAISAGVPLVAVPMGGDQPRNAELAERHGFAVRLEKSHIKADAIAEALNKILSDQSYSRNVKRLSQMVKKKPVSVAHLLVSWTEFVAEFKTLDNLVPAGVKLNFFQYHSLDVIALLLFVAVIILFVALQIVKYVVRKLLSAFSRAEKPKTD

SEQ ID NO: 6485 - protein, 508 aa, Strigamia maritima
MVYLYFMSVLCAMTNAGNVLLLTPFGSPSHKNLFTPTAYGLAEKGHSVTLVSIYKPKESSPNVKEVVMENLIPTSKELVYWLCKEGIDGPTVEVLNGYISTAKKMCETFFMNDLVQSWVKRKEKFDIVIVDGVLHDCLFPVANLMGKKVGALNTAALFSWIADSIDSPYPYSIIPFYLFPFKARMNFWERMINAFSFSKYDHEMQSAYYPAMEEIVRKYYPQAITISESMKNLSLVLCNGEPLLGTIRPSVPTVKYMGGIHCRPGQAVEKVFEDFIQSGKDGFIIFSLGSIFNESLMSEERKEHIFTAFSKLKYKIIWKINADMGTGVPSNVKIVKWIPQQNLLSHPKCIAFITHSGLLSLQEAVYHSVPMIVIPLFADQPMNAALVEELGIAVRLDWTNFTSDDLVKAVKTVTSLEVQSNLKKYSAIFKDVPSTSLEEAVFWTEYVMRNEIADSILRVNTHGMNLIQYFSIDVIAFILIVAFTILIILYKCMRFNYFIVKNHKRKDE

SEQ ID NO: 6486 - protein, 521 aa, Caenorhabditis brenneri
MYLLILFCSIISTTYAYNILVYSPSFGGSHTNFMARIADTLTDAGHNVTFLVPVVDSARKFQLGVKTTKDVVMVDREKHDGSFVDKGAGKYWAAEINAGNIKEVFGEFTAAQTHTCHDFLQRKDIFEEMKSKNFDVGIYEPLTVCGLGFMHAIGIRKIITACSEVFYDTVLDVIGEPLDLSHVPTVLSKLEDPGKWSFWDKIQNYKLSMAYQKWTCEVFDAQTAIYKKYLGEEVPDWRELIAKSSLQFVNSIPYVDFPRTVGQKTISIGGIQVESQTEDLDKELDAVLSERPMNVLISFGSVVRSMDLPEVWRSNLLAAIKSQPNTTFIWKYESDDVSFAQEVPNIHFSKWVPQTSLLNDPRLTAFITHGGLGSTNELSYHGVPAIMVPVFVDQHRNSNMLARHGGVIVFKKQDLGEADKIKNALQAILYDEKYKKNSVKLAELLNNQPLKPREQVVRYVEFVARYGPFSGMDMEGRGLGLLEKNVLDIYFVLVAPYLLSLGLVIVVTFIMLLRVRSVKVQ

SEQ ID NO: 6487 - protein, 530 aa, Xenopus laevis
VVTDSSSSCCFFRRFFLLLVLGCADVGRLLVVPQDGSHWLSMRLLVDRLAQKGHHIVLAIPEANFLFKDIDNYTVKTYSSSYSKDVLENHMRRMSQELFVDRILTQKIKFLYESASNGTQLILTTCKDFLQNSTLIRELEKEGFDAMLTDSVFPCGAIVAEHLSIPSVSFMRGTIFGMDQIASLTPSPPSYVPRMFTVYTDNMSFGQRVNNFLIHSLEHIVCHIFYYPYAQLASDFLKKEVNALSLFSRTSIWLMRYDFVFEFPRPVMPNVIFIGGINCVNRKPLPQEFEKLINRSDEHGFVVFSFGSMVSEMPMNIAMDIAEALRYIPQQVFWRYTGKTPPNLGDNTHLVKWLPQNDLLAHPKARAFITHAGSHGIYEGICNAVPMVMLPLLGDQMDNAIRIESRGAGLTLSVLNLIPEDLSNAVMAVIENPSYKENIQRLSSLHLDRPINPLDLAVHWVEFVMRHKGAPHLRPAAHDLNWIQYHSLDVFGFLLTVLITTLFISLKCCICVCRCCCKRNSKQKRKTKSE

SEQ ID NO: 6488 - protein, 522 aa, Drosophila yakuba
MRWLPNSWLLILSALLGQSWGYSYLMISPTASKSHYTVVFALAKGLAAAGHEVTLISSFPLKKPIKNIIDVDTPSIITVMGVYKARILENAKKPVILRYPRISLMGLDLTETLLKEPSVQELLKQNRTFDGVICETFMNDAHYGFAEHFGAPLIALSSLGATGWTSDLVGTPSPPSYVPHNLLRFGDRMNFWERAQNLGFQIYEFIYENLINLPRHEALYRKYFPNNKKDFYRMRKDTSLVLLNNHVSISNPRPYSPNMIEVGGMHVNRKAPKPLPKNIRKFIEEAEHGVIYFSLGSNLNSKDLPKKKRKAIVETLRGLKYRVIWKYEEETFVDKPENVFISHWLPQDDILAHEKVIAFITHGGLLSTMESIYHGKPVVGIPFFGDQFMNMARAEQMGYGITVKYAQLTASLFRSAIDRITGDPGYTERVKVISNQYRDQLETPLERAVYWVEHVTRHKGAKYLRSASQDLNFIQYHNLDVLAAFVSVIGLTVIFIFLLVRFLVSSIRGRFLKSKTSRLKVN

SEQ ID NO: 6489 - protein, 533 aa, Anopheles gambiae
MKRKGNDIMTRLMVTFSMGLLATLLVIGHAESAKIVCVFPTASKSHVLGAQALLKELAHRGHEVTMVSAFPLKKPPKNYRDVYIPIEDAFSSIMSDFMQGGSRNMMKLLPKILRASHDASNATLNSAELLRLAREEQFDLALVGFFMNSFVIGVGQLFRCPTVLYWSAVGSGMINYVGNPAEVAAVPHMMLGQRNPMTFFDRVANTLINGVEKILLTYQRYKELPYYESNFPAEKGFRSYDEALRNVSLVLINTHFTQTVPRPYLPNMVEVGGIQINAKPDPMAQDLQQFLDGAGRDGAIFISFGSNLRSSNLRQDKLDAILGMIRGLKQRVIWKWDQDEMPNRPSNVFIGKWLPQDAILAHPNLKLFVTHGGLGSISEAMYHGVPIVGIPMFGDQDGNVAQVVKEGWGLSVSFDELTEPLLSGVVQEVLRDPKYREQVQGRALLYKDRPMGALETGVYWIEYVIRHHGAPHLHYQGADLNAFQLALLDVYAFIIGVLYIVYKAVVLIGRKVKRALFGGAKSDQKTKNKQKKA

SEQ ID NO: 6490 - protein, 599 aa, Toxocara canis
MNLASILSLLPWIIAASEAYNIALFVPAMAASQVIWNIRVGEELAKAGHKITLIHLRIANITLHETKVMDGIEQWRVDAFAVDYAEIESKHSKMIFRDYSFFEPEVRGMLSLMTNAFIDGCELILQNVQFMERLKAAKFDVAFAPMYEFCPIGLIHAANVPTWIWLNSGQLMDIVAEYIGVPSPPSYVPIILQNVQFMERLKAAKFDVAFAPMYEFCPIGLIHAANVPTWIWLNSGQLMDIVAEYIGVPSPPSYVPMMMADSSDEMTFIERLKSFIGRIITPIIADRMLISHQTKLFRKYIDPHFPDLVDLAKLCPLVMVNSNELYNLPRPTLHKIVYIGGLGMKNQDAKPLNGQFKEIADNAKRIAVMTFGSHANSSAMPQSWKKAFLESFRKFPDVDFIVRYTAKDLIGKTSNNVHLKSWIPQSDLLQHKKTVLLITHGGYNSLQEAINSGVPLLTIPLFGDQPGNAKLAVKRGFGYSLTKSDITTEKVTKALQAVLQNPSYMESAVRMQNMVRKKPSQPERLLVRWTEFIAEFKQLPNLVPYGTKLNFIQYHCIDVIAFLSFITAIVVFVVVKVVRFTCCFVYKKVKGDTRKRKAE

SEQ ID NO: 6491 - protein, 522 aa, Stomoxys calcitrans
MKIWNPLKWVVLILLHFSARESESAKILAIFPYPGPSQYLVVQPYLKALAARGHELTVISAFPQKKPLENYRDIEVPEVLKYVGDIFDYIDMEISKFQEIVGFSFYYISVVKDVLGNEQVQNLLKSPQEHFDLVIVETLQTDALFGFADHFQAPLIGFSSYGTDPYIDALVDNISPMAYSPLHTDPSTERMDFSQRLRNMWHNLLMMGHRVFMMNPMQDRLYREYFPKHTKTLEEMRQNISLILLNQHFSLSFARPYVANMIEVGGFHLQHKPQPLPQDVEEFIASSSQEVIYFSMGSNIKSENFPLPIRKLLLNVFSQLPYKILWKFENPSLLADKPSNVFISKWFPQGDILAHPKVKLFITHGGLLSFIESIYHGKPVLGIPIFFDQIMNVLRAEQYGFGLSLIYRQLNESSLLAAVTELMENPHYGERAQEISKRYRDQPIDPMEKAIYWTEYVIRHRGAGFLRSPAQYLNFWQKSSWDCAAVIGGAFVMGFVVFAYIFVQITKCVVRLISSKKKKFYC

SEQ ID NO: 6492 - protein, 526 aa, Cyprinus carpio
MVRALIVPTLGLLALLCLFSSEPVQAGKVLVLPVDGSHWLSMKILVEELSLRGHEMVVLVPETSVLIGKSGNYTTKSFRVPYTHADLKANLDNIEKNAFEKPPKLTDIFENLGNLIQFLNMHVTACEWLLYDESLMKSLRETGFDVLLTDPFLPCGAIIAESFSIPAVYFLRMIPCLLDVEATQCPSPPSFVPRFFTGYTDKMTFPQRIENTLMTVFDAFLCRKLFASTDELASRYLQKDTTYKELLSYGAVWLLRYDFTFEYPKPQMPNMVQIGGINCAKKGPLTKELEEFVNGSGEHGFVVFTLGSMVSQLPEAKARVFFEAFRQIPQRVLWRHTGPVPENAPKNVKLMKWLPQNDLLGHPKVKAFITHGGSHGIYEGIYHGVPLVMLPLFGDQGDNVQRLVSRGVAETLSIYDLTSEKLLVALRKVINDKSYKEKMTELSAIHRDRPIEPLDLAVFWTEFVMRHKGAVHLRPAAHELNWIQYHSLDVIGFLLLILVTVIFVTVKSCMFCFRKCFKKTQKKKKE

SEQ ID NO: 6493 - protein, 527 aa, Athalia rosae
MLWRFFAVAIFLFTGIVEHGDGARILGVFPIPSISHQVVFRGLAKALNKRGHELVVITTDPVRDPTLKNYTEIDLHVLYEGFKIFDHVMLRGAINWEDNLPLMHALFSQQTETILSHPEVKRLYSPGSGEKFDLVLIELLLSGALLPLAKRFDAPIIGITSMGLTLPTQYSLGIPILSLHPSSWELDNRDSSSYSLWPRLSNFIRMWKYIHFHRTTWIPDNERIAKKYFGNDVPSIAEMEKNISLIFVNQQVPLSFTKPTVPGVIPIGGFHISKKLEPLPESLRKILDEATQGFIYMSLGTNVKSFMLTDEMRAEFVAAFSQLPFKILWKFDDDEFPNKPDNVIVMKWFPQQAILAHPNLKVFVYQGGLQSTEEAISNGVPLIGIPVIGDQDMQVKKMVQLGVAKMIEIKTLKREELLEAIRTVTTDGSYKENMLNLKSLVSDRPNDPLENAIWWTEHVIRHRGTPYLRSSTADDPWYQKNDMDIVAFITATFTTVLFVTLFVLYKCIIYMNGSSTRRSLDEAKKLN

SEQ ID NO: 6494 - protein, 1254 aa, Trachymyrmex cornetzi
MTFMCDAFYKDDPTMVNIGLNKQEPASSLLQIMYDEIREGMTLIAEEEEDECIIGAAVNAGSCPWDPDKFVEFARCCECEPTRDVIEFEAYVTGKPNLWERYCVLKIFECSYLAVRPDFRNQGIARKLVLDSWYLARDCGYRLFRVDCNNRYIARIAKGFGWKRVCIIPFHEYARDGELVFKHIKEPHTEVQIYIDQVTFCKDYCPPYKTCDKIISAPNNLTCSERLLIITPTPSYSHQIVFRVICLALNKRGHEIVTLTPNVLNDTGITNYTEIDFGFIYEKIDDTDMSQTRWNLTQLAGLKTRLLTLGHNIAEDALSHPDLLKYYTNRTDMQFDAVIAEMIMTPAIYMLAHRFNAPLIGIMSMDLQNCHRFTLGSPVLPSHSSNWELENLTGLNLPFWRRLINFINTWWSIHSWFNNFAIKQQKIAEKYFGNNIPHITDVAKNMSLVLINQEPLLAYARPEIPNIVHFSGLHITKTPPSLPKNLKAFLDSATNGFVYMSLGSNTKSKLLPKKILQIFANTFASLSYKVLWKFENDSYHVPPNVFISKWIPQQGVLAHPNIKLFIYQGGLQSTEEAVHYAVPLIGIPFVFDQVYQVMKMVSLGVARYLDIVRLTGSELHDAIIEVIDDKGYKDRMLALRALTKDKPYDSLENVIWWIEFVMRHNGAPHLRFNGVDIAWYQQFDLDVIVFLTITLFLVLCAILAIIGWVSKKLYNTHYNNISNRYIKMKPVAEITFWIACFVYIATPIETARILAIITIPSYSHSIPYRPLWTALIRRGHEIVVLTTDPMNDPSLTNLTEINFKSHYNILSRLDFIKNIETYTWLSTVREQLWSVCNEMTENIYKHPEVRKMYELDSDTKFDLVIAETIKSPGLYALAHRFNAPLIGVSTFGLYNSAYYLLGAPVLPSHPSSWEMEDSADFNLSLWQRIKNFIRLWYHIYRTLNHFYSEQQAIAEKYLGKNIPDICDIERNISFVFQNQQEILSFVRPHTPNVLPFGNFHISKKLMVLPENLKKFITDAPNGFIYVSLGTNVRMSSLPKHVQSIFRDVFASLPYKILWKHDSELPNKPDNVYIAKWFPQQSILAHPNIKLFIYQGGLQSTEEAVYYTVPLLGLPVLADQYAQVKKMVSLGVAKRLNIMELSRENLNASIIDILYDEGYKKRMLKVKEVNEDKPYDLLEHVIWWIEFVIRHKGASHLRTSIAYDPWYQKHEMDVIAILSIIIFVTLICILIVIYKLLKIIFNLTKITVTTKEKIN

SEQ ID NO: 6495 - protein, 434 aa, Strongyloides ratti
MKKSLKILVFSSGHGYSHNLFNAKIADTLSKSGHNVTLMTLGFSSLSKSNLTKYANFIYVPIEKKLKNQIINGESLKDMWIKDDHILLKLLKFQSISNEYVDTCKYIFDQDKITENIRQINFDIMISEIFLLCPLVLNKNKGKTVDISNVFIKSSAIFINLMSFLDYSLPLTNKIYYIGGIALQKPKPLNKNINNILNIKKYNVLFSFGSIITLHYMSQYLIENIFKTFSKLQEVTFIINIPNFNLTLKIPNNVYVYKWIPQTDILHDNRINLFITHGGQNSINEAISAGKSMLVIPVFGDQDRNTGMILRLKIGDYFNKLNLNNSKLFKNKIWKMLQSKKYTKNVKELKNLYEKSPFKSNEIVVKVTEYADCLKSIMNKIWLFFILTIILIVATNIHCSEHERKKRQYGYVQYYPDDCYNIVYQPEYVPVIPC

SEQ ID NO: 6496 - protein, 527 aa, Wasmannia auropunctata
MWKIICKVFIVSSLWFLIASNITSADRILMLMPTSFYSHQIIFQSLCLALSKRGHELTIVTSISLKDLITKNYTEIYLADLKHQTNEYIDNSLEMKTSDLLKFAWKMSHRGSIETFNNSEFKEIYRHDSNKKFDAVILEVLCYPSLAVIAHRFNAPLIGLLPLGIHNYHRYLFGSPIFSSHPSNWELDVLVDENPSIWQRLWYFIDTWRLVYFWMNDYATVEQEIVEKYLGNDVPSIIDVMKNMSLLLVNENPVLAYPKPEQPNAIFFNGIHIQNPPPTLPKNLQQFLDDAMEGFIYVSFGTMATCRNLPKETLRNLVEVFSKLPYKIVWKFECDELPGKLDNAFISNWFLQQSVLAHPNIKLFIYQGGAQSTEEAVHYAVPILGIPTIFEQEKRVHRLVSFGVAECIQLNDLTKERLDSAIYQILDDKSYKEKMVYLSSLAKDQPYNNTENVIWWIEFVMRHKGIDHLRFSDSDKPWYQRYDMDIVALLALTLFIMECVIALIVIKIIRFILNKTVLYSQHQMLKS

SEQ ID NO: 6497 - protein, 396 aa, Frankia sp.
MGRILFVVPPLTGHVNPAVGIAGELAARGQQVALVGHTSVVGPLVPPEVPLIALPGEITAEQRGELEARSRSLRGPASLKFLWEEFILPLGDSMARDVTTIIDQWRPDVVVVDQQAVGAALAVRRSEARWVTLATTSAESDDPYAVLAGIGNWVAQRLHQFQVANGVPEPEATRTDLRFSEELTLVCSVPSLLRPGGHPSHHVFVGCAAGVRRASPDFPWTWLDSDRRTVLVSLGTVTREAGGRFLRAAAEALLGMSDRAQGIIVAPAGSLDDLAEKAPDDLLVRSFVPQVDLMPSLDAVVCHAGNNTVCEALSHGVPLVVAPVRDDQPIIAEQVVRAGAGLRVRFGRSTPATLATAVGAVLDEPSYRAAATRLRDEFTAAGGVVTAAHHIEKLLP

SEQ ID NO: 6498 - protein, 539 aa, Dendroctonus ponderosae
MLSRCFQIVTLVTLAVIHHCTCANVLMITMGGTKSHKIPFWELARGLIPRGHNITFINAFPSDFYLEGLEEITPSSYVVYVRNFTNWDLVGARIKGEEPVPFVDMIKFGYEACDVLLSDPETKEFLRSGLKFDLLVLDGAYPECAMGFVHFYGAPFIYINTVGMYMGSLSTAGNPTLYSVTPFLARPFSDTMNFIQRVLKTRTSNTFGFDIVQNFGFYMVANIMHSVMTRGKLQDIVRQYFGPDVPGIYDMSRNVSFILQNGHPVLTYPRPFLPNVAEIACLHCKPAKKLPEHLENFIEGAGDAGFIYFSMGSSVKASNFPDYFRALLMIVFRNLPQRVLWKYEGDDLIDLPSNVLLGKWLPQQDVLGHPKLKAFVTHGGLLSMFETVYHGVPVVSLPVFCDHDSNAAKAEADGYAIKLDLFTITPEGLLRAIKTVIRDPRYKTQVKHRQKLLLDQSEIPLEKAVYWTEYVLRHKGAVHLQSPSRHMGVIDYYSLDVVVFLALVLIGIYYTTKKLLRLMRILPKDEVSIDLPRKSIKVE

SEQ ID NO: 6499 - protein, 535 aa, Caenorhabditis remanei
MIGLKDILFYCFLLFLYPTGSESYKILVYTNLFGHSHVKVMATVADALTDAGHNVTVLMPIIEQQFINKTCLKSTKNVIFVEQDDKLKALMAIRSKRFETLWTSGFNNPFVVAKKSKLMSELFSEHCRKVMSEKKLIEQIKSENFDLAITEPFDTCAYAFFEAISIRAHVAVYSCSRLDHVSEVIGQPAAPSYVPGMTSLFGEQMNIWDRFLNFYLYKANSYSFSRIGDENYRVAKEFYPNIRSWREVVPEATFLFTNYIPYLDFPAPIFDKMIPIGGLTVKTDQKEVQLEEKWSKILDERKKNVLISFGSNARSEEMPIEYKNALLKVFQSMSDTTFIWKYENPEDPFTKHLENVYLSAWLPQNELLADPRLTLFITHGGLASVLELAMTAKPAIMIPVAADQTRNAQMMKRHGVVAVLKKFDLANPVKIQEVIEEVITDSSYRNNAKRLAEILHNQPTDPKEKLVKYVEFAARFGKLPSLDNYGRHQSFVEYFFLDIISIISFTVLVSSYIFYRLFGYLFRKCTGSSFKNKKE

SEQ ID NO: 6500 - protein, 566 aa, Lambdina fiscellaria
MFTQKLRKAITISTTIYCFSFWSPISSFLSCSSFLLLNNADAARILAVFPTPSYSHQSVFKVYVQALVRRGHTVVVIRPEARVKYDNDIVTGDESLIFVNNVQPNEIVYKNNDNNKTRAKGAIVVVDASASQSHFESLMQNASSFKKREGLVADSDSVTADNYMALVRMISDQFKLPAVKRFLDRRHALRFPFDLLVTEAYLDYPLVLSHLFGKLPVVQLSSGHGVAENFETQGAVARDALHYPNVWRSEYASTTTTALFFNNSASWTKILNAEKRLKTEFQQLAQRQNQLMQNQFGVDTPDVKQLRARVQLLLVNVHAVLDNNRPVPPSVQYLGGLHLVNKKRHPLALQVRTFLDAAVRGVVYVSFGSSLTAARMPVDFIQLLLDSFRVLPYAVAWKFENDVSQHQIPANVLVQQWFDQYELLHHKHVRVFVTQAGVQSTDEAIETTVPLVALPMMGDQVFNAQRYAQLGVGIALDTLTVTADLLRAAIERVATDQRYKTNMRQLRHLVRCQPGSAIRRAVWYTEYVAANKNNIFNQNLLKNTGAAAQSRLVPIQWLSVESDVQQ

SEQ ID NO: 6501 - protein, 536 aa, Caenorhabditis elegans
MLLNSLIFTLLFCSSSSLNILVYSPAYAASHSNFLGKLADTLTERGHNVTYLMPVMDPGKRDECIGVKLTKDLVIVEADEEMMSREEGVTLDEEIMELYWKSEMDSSNSRDMFSFFNNAMKAACRNFLKRRDIFEQMKSRNFDVAIVEPLSVCGLGFVKALGIEKTILASSCTFYDSIMDYIGEPLDFSYVPALFSVTGDVMTMSERYENWMVTKEINIGIHEKFDDEMKSYREFLGQDLPDWRELLSTASIFFINSNPFFDFPRPVLQKTVPIGGISVNLKWIKEQKLTKDWEEVLEMRKKTVLISFGSLVKSAYMPKKWRNGLLDVIKSMPDVTFIWKYETDDVSFADGVSNIHFSKWVPQTALLNDPRLSVFVTHGGLGSTMELAYSGKPAVVIPVFADQIRNANMIARHRGVIYLHKNSMENVKVTRKAFTDVLFDDSYQKNAEKLANILMNQPYSPKENVIKYTEFLGEHGPFPNMDPHGRHLNYFQKTFLDIYTLFALFYIFVSTIIIVTIRFVYKFTRKHFILVKSKEN

SEQ ID NO: 6502 - protein, 525 aa, Haemonchus contortus
MWQRAFLILGLLNTVTSFNYLVVSPLFGHSHSHFMGTIADILTEAGHNVTVLMPIMDPDMKDTGLRSTKNVIKVPPDNRTAAMFIQKAKFMKKLWNIEPSAYGMVELGLQLARSFTWQCERVFNDDAVMYTLRQTNFDVGIAEAFDLCGFGIFEVLDVKATIATTSCVHSEAVSKAIGIPSAASYVPGAMSTKSDVMNTFERLQNVVEITLGAKFFDTLFEMEIAAFRAKFGQNFKDYEELLAQVSYVFTNSNPYLDYPRPTIHKSIDIGGIAVSLDSSHNKLPKKLDEIIDLREKNVIISFGTVVKSCYMPDEYKKSLLKVFEMMPDTTFIWKYEIDDSEMIRNLSNVYMSPWLPQNALLADSRITAFVTHGGLGSTTEIAYMGKPAVMVPLFADQIRNANMLAKHGSAIVLQKYDLGNPDRLLSAIETVINDRRYTTNAKMLADMLLNQPISSKQLMLRHAEFAARFGRIPNLDPYGRHLTTIQYYLIDLFLIAIIAMASTIFVCYFALRTIYRVTLHKAKTD

SEQ ID NO: 6503 - protein, 539 aa, Drosophila willistoni
MTKILNYSLGGLLLLLALTFSGPPTIEGANILGVFTSHSPSHFIVHMSIMQTLAEQGHNITVVSSVPPKVTHKSIKHIVIPLSAEDEKSLNDGMSALAKQKPSFITTMKTMLSSLSLLLTKQVDVLEHPKFKELYLNKDNKFDLVFNGFFFNLYQVGLGARFNAPLIVSWSGPPAAMVNGIVGNPELPASVPNMNVAVQPGQIMDFKLRFTNYISGLSFGALTWYLESQFNGYYKRIFGDDPTLPSYEEAKKNVSLVFCNSHGISEGPIRPNVPGVVEIGGIQVKDKPDPLPTDIKEFLDKSKHGAILFSLGSNLKGDHISADVIGEIFKALSKLKQQVVWKWDDLKNLPGTSPNILYKKWLPQDDILAHPKIKLFITHAGKGGVSEAQYHGVPMLALPVFADQPGNADKLVDSGYGLKLDLLTIEEETLTAGIKEILNNPSYAAKLERFSKLYRDRPMTARESVIYWTEYVLRHHGAPHIQSPLVHMGFIASNNLDIYALLVVVLVIVILINKVVWTYLWRKCCGKSKKVTQKKVKKQ

SEQ ID NO: 6504 - protein, 432 aa, Lasius niger
MDSDYEQLSMHLINYTEIDFGFEYEKIDDTDLSQTRWNLTQLGGLKTRLLRLGHDIAEDVLSHPDLLKYYANGTNVQFDAVIAEMIMTPAIYMLAHKFHAPLIGIMSMDLQNCHRFNFGSPVLSSHPSNWELENYTGLNLPFWKRLTNYINTWWSIYSWFNTFAAKQQQIAEKYFGKDIPHVIDVAKNMSLILINQEPLLAYARPEIPNIIHFSGLHIKKTPPVLSKNLKDFLDSATNGFIYMSLGTNVKSKLLPKGMLEIFTNAFANLPYKVLWKFENDSFHVPSNVFISKWIQQQGVLAHPNIKLFIYQGGLQSTEEAVHYAVPLIGMPFVFDQVYQVKKMVSLGVAKHLDIVQLTTPELHDTILEIAGDKRYKDRMLTLRALTKDKPYDSLENAIWWIEFVMRHNGAPHLHFNGVDTACYYRMGIEGFV

SEQ ID NO: 6505 - protein, 529 aa, Danio rerio
VMLKKGWLWGLGSGLLLLWLSAGLGPVQGGRVLVMPVEGSHWLSMKVLATELARRGHDVLVLVPEKNILIQSSELFRTETFPVKISKEQLSKSLKGFQQGVFTRSPALMDVFVQLERLLNFTGSQVEGCESLLYNEPLMRKLKEQNFELMLTDPFLPCGPIIATALGVPAVYFLRGMPCGIDLLASQCPSPPSYVPRFHSGTSDKMNFVERIRNFFMSGFELVLCKVMYASFDELAARYLKKDVTYKEIIGRGALWLHRYDFTFEYPRPIMPNMVFIGGINCQKSAEISAEVEEFVNGSGEHGIVVFSLGSLVSSMPKEKADIFFKAFSMIPQRVLWRYTDEIPNNVPENVKLMKWLPQNDLLGHPKARAFITHGGTHGIYEGICHGVPMVMLPLFGDQADNVHRVATRGVGVILSIHDITVETLLDALNSVINNSSYKQKMQKLSAIHNDRPIQPLDLAVFWTEFVMRHKGADHLRPAAHELNWLQYHSLDVIGFMLLIVLIVTLAMLKCCSLCWRRCCRKTQKRKED

SEQ ID NO: 6506 - protein, 537 aa, Salmo salar
MAGGGVWLRGAAAGLVLSLCLVVSCRAGKLLVIPADGSHWTGMKPLVEELGRRGNQVVVVIPEVSGSLGPSEHTITLTYPVPYTRTQLQTIQRANLDTIMASDTSNDISRMWSYYQTLTVLRNYTRNNCDSLLSNQDMMQTLREQAFDAILTDPFEPLGVIVGALLSLPAIYIQNGLPCGTDLEASQCPSPPSYTPGRFTHFTDHMTLRQRSVNFLWALLRPLACRYLYLCTLMFARFDKLTSRYLEKDITYRELLGDGAIWLLRYDYSFEYPKPRMPNMVNIGGINCGKRAPLPPDLQEFVDESGEDGFVVFTLGSLVSQMPEERAKQFFDAFSRIPQRVVWRYTGVVPENAPANVRVMKWLPQNDLLGHPKVKAFITHGGTHGIYEGICNGVPMVMLPLFGDQDDNVHRMAVRGVGEVLSVFDVTSDKLVEALNKVINDKSYKEKMLKLSTVHKDRPIEPLDLAVFWTEFVMRHGGANHLRPAAHDLNWIQYHSLDVFALLLTIVLTVVMVTVKCCKVCFRKCCGMIWTMKMKSE

SEQ ID NO: 6507 - protein, 527 aa, Nothobranchius furzeri
MGSRVWFPTAGLLVWLCCLSLGTVHGGKVLVMPVDGSHWLSMKILVKELSRRGHEVTVLVPESRLLIQGSDSYKTKIYQVPYTQAELDSQFESLRERLFDTPPHFTDFFVNVDRLVAFTSVQALGCKALLNNEPLISQLRVEGFEMVLTDPFLPCGSILAKIFSVPAVYFLRGLPCGLDTQASQCPSPASYVPVSFSGNTNNMTFLQRVTNIMMSYVESYLCGIMYKHFDDLTSMQFGNGMTYKELISHGAIWLLRYDFTFEWPKPVMPNQVFIGGINCAKKAPLPADLQEFADGSGDDGFIVFTLGSLVASMPEEKAKQFFDAFRQIPQRVVWRYTGPLPKDVPKNVRVMKWLPQNDLLAHPKAKVFMTHGGTHGIYEGICNGVPMLMFPLFGDQGDNVHRMVARGVAEKISAFEVTTETVVAALKKMIQDKSYKERMEALSQIHLDRPIGPLDLAVFWSEFVMRHKGAPHLRVAAHDLNWFQYHSLDVIGFLVAVVLVVLWVTLKSCAFIFHKCCGKRIVKKKSE

SEQ ID NO: 6508 - protein, 564 aa, Athalia rosae
MGSRYHRGKLPRDHSIAVGRPERVQPFVSCNGMASSSLLILGAVGLLGFSAPLVSSLNILGIATLPSKSHHLWYTELMKGLARKGHQIYSVGIEPTEFGDSVVRENQTRSIVLEDMISCLNKDGNFDPVSWRELSPMQTTVELYSVCNILCDYATKTNGGKEALELVRNTKLDVIVMDITMGQCFYGLREEALGNPPLVGFTPFGSPGWVKDIVGGSNWPAFKGYENYQKAPPFNLWERTWNLIYYQVDDFWRKFYYLPREKEVAEAYIGRKLEKSLEDIEREMTTLLTNTHASFDVGTFLPPNVIEIGGLHVKDTKPLPQDIKKFIDEAEHGVVVLSLGTNVQSSTLGTEKLQAIVSALGQLKERVVWKFETDTLPNLPKNVMIKKWLPQSDILAHPKIRALWSHGGLLSTQEAVWRGIPVIAMPFFMDQYRNIDMLVSKGVGLRLDYDSLSTETVLKTLKQILTDPGITTRMKRLSASYRDRPMSPIDTAIWYIEHAVRHPEGPLSSPGRNMSWVQFHLVDVYAVLGLVFLLVVWILKLLLKTVYNLVFRRGKKVEPKLKRK

SEQ ID NO: 6509 - protein, 530 aa, Daphnia pulex
MVSYFCATPLGFVLLVVSFRISSIVAHNILVLSPITTNSHSNFIKPVAKALADRGHTVTYWNGLPPDKETLTNPKANLNLLYSPGLRPLNDNHQVGYDDRPFQLLLAIPDRMATYCTAIYRDPVFHQLMSSTEQFDLLIIEALFNECVLPLVRKFDVPFVYMVSMTPSPWLLDAVGSSLALDHLPHAGSNYADEMDFWQRTYNTISGMMITYFHRFFVIPVVDRLASEILKLNNQPSVFEIQSEYMSLIISNTHFSINYQFPASPALIQAGGLHCLPSKQLPKDLESFVDGSGDAGFIVVSFGSVLRGSDISDHVRQLFLSTFSRLPQRVIWKWEEKLDETDSIPSNVKLLPWMPQQDLLGHPKIRLLITHGGLNSKQEAVYHGVPFIALPVFADQPINAQKAHDDGYAIRLDWDNLTEEILFDAIQRILSNSSYVERMNQVSALMRDQTDRPLDRAVYWIEYVIRHQGASHLRSASRKLSLFQRCLIDVLLFTLFLLLFLLISVFLLCRFVHQKVLHETNLQTSTKKTD

SEQ ID NO: 6510 - protein, 529 aa, Neodiprion lecontei
MSRCSIFAALILVAGVLHQGRASRILCIFPMPSLSHQVVFRGLTMALRERGHELVVITTDPINDPTLKNYTEIDINFLYADFTKDVDWIATRHKVTWNELFQSVAPRFIPMSERVLKHPDVKKLYSPNSGEKFDLLIIEMLYWPSFLSFAKYFDVPVIGMTSFGLPLQMHYGIGNPIMPSDPAHWDTEIKALGKLSLWQRLQNFVYAWRFLYYYRTVYLRGHQEISRKYFGTELPDIADIERNVSLIFINQQAAISFVRPNIPKIIDIGGFHISKKIEPLSKNLQKTLDAATQGFVYMSLGTNVKSVMLSNETREEFLAAFSKLPYIVIWKFENEVLPGRPDNVIIMKWAPQQSILAHPNIKAFIYQGGLQSTEEAISHVVPVIGLPVFADQDTQVNKMVSLGVGKKLEILTLNRMDLVDAINTIVLDGSYKQRMLKLRDLMRDKPYDSLENAVWWTEHVIRHKGAPHLHSTTANDPWYQRQDMDLIFLISAAILTTLTISLIVLYKLLLYSIHVLKYKLLVSKKEKVC

SEQ ID NO: 6511 - protein, 530 aa, Loxodonta africana
MSVKWISVLLLIQLSCYFNSGTCGKVLVWPTEYSHWINIKTILDELIQRGHEVTVLTSSASILIDSNKTSAINFEIYPTSVTKDDFEFILIKLMKKLTNDLLKDRFWAYFSLLQENLWEFTDCIQRLCKDVVFNKKLMMKLQESSFDVVLADALGPCGELLAELLKIPFVYSVRFLPGYTFEKYSGGLLTPPSYVPIALSELQDRMTFLERVKNMMYVLYFDFWFQAFNEKKWDQFYSEVLGKHTTLSETMGKAEIWLIRTYWDFEFPRPLLPHFDFVGGLHCKPADPLPKEIEEFVRSSGTHGVVVFTLGSMISNITEERANTIASALAQIPQKVLWRYDGKKPDTLGPNTQLYKWIPQNDLLGHPKTKAFITHGGTNGIYEAIYHGIPMVGIPLFADQPDNIVRMKAKGAAVSLDMNTMTSTDLLNALKTVINDPSYKENAMRLSAIHHDQPVKPLDLAAFWIEFVMRHKGAKHLRPAALSLTWYQYHSLDVIGFLLACVVIVTFLVIKCCLFGYQKFFKTGKKKKTE

SEQ ID NO: 6512 - protein, 521 aa, Culex tarsalis
MKVVTLMMVLAVGLLPVESARILAIFPSPAKSHQIVFRALVEGLLDRGHQLTVMSPDPIETNNPNLTQIDWSYAYKLVDENGDVAVATQEKWSSLKVTQKLLAVTEMFLTAELNHPEVQDMIRNPVENFDVVIVEYFQMTPFFAFAELYNAPMIGITSIDSIALAHSIIGNVANAVAHPEMVHKVSRVLSFSKRLDYFITMLFTEYVLFPGEFEKYDRMIEQHFGPNMTKSVQLMNRLDFLMTNVEPALGFVRPTVPRAIQLGFLHVKPPKPLPEDLQQYLDSSKHGVIYFSLGTLIRTKSLNAKNIGIFIDTFRSLKYDVLWKCDGQIDRIEKPSNVRLMRWLPQQDVLAHPNVKLFVTQGGQQSMEEAVDRHVPMVVIPFNFDQFGNGDKVVERGIGKSIWMERLTTDGLRQAILEVIENKKYKRNIERLGKLIRDQPMRPVDKAVWWTEYVIRHQGASHYRYKPAKMPAWQYHYYDVVAFLFTVTVLLVVALAYVVRRFFRFLAGHRWLSTQVKQKSL

SEQ ID NO: 6513 - protein, 605 aa, Symbiodinium microadriaticum
MAPMSQPMDQQITAEGPTIAIFNVAMIGHVNPTFALVQELCKRGCKVSYFLPPVAPIRAAAIESGAVVEGYLPEDPSDFVMEKCGIDEPLCHAVPEIVEDDRAEYERAVWPLAQALLCGEYVIERCRQLGVSVVLYDPFLPIGLLAGTKLGIQCASLVTYPGMGSLSGLMSTLEAEGRLERAGAIRKPYGKAIQDKFGVDLRCNLLTRRQFYTKTNFVTTCEDLIAELPASGEQKWADELRTEFSFSAVGCLVSSSAPHVITARSDSFIPRVKSFGHSLPVAELSDQLAKGRKIIYAALGTMALSDRWSIDLGRISGYNLPHGTTGKAFCQHVWKALLAAMEELGDEFFCLLSVGKQPDALDFLGSSEAAIFELVPSNVLIRGFVPQVDMLNNYTSAFISHVGFNSLQESLMAGVPLVAIPQAVDQPANACKVEQRGWGQAFFKPMETVSSTALAESLRQVCDENSMYRQQVQCARSELAGGAPRLAERSSAMIRKERSECFIPSCGAAMQRAQFADGGRARVACPGSAPWGQVVTTQWALPAHAGPYIQAEQVILPERCAVGQGSCRPTAILAGKLAGGGRRASSGRTYGSCHGIPGPGPEALL

SEQ ID NO: 6514 - protein, 512 aa, Dictyocaulus viviparus
MLDFLLLTMLMRCVKLTWILLWMLFYLDITINAGKILVYSPSYSHSHLISNGRIADTLVNAGHDVVMFIPEYLSSTTKFSGSKLAKIIRMNNISSRYDEGLLGGETEMMRQKNLNFASRLAFEHIGYEMCAALLDRRNELDELRNYGFDVAFAEQIEFCGIGVIRYLGIKNLLWISTTPIMDAVSYDLGIPAPPSYVPTIEENDNGDVMTLWQRAYNFYMYIGAIYIHRKGTDMITKIFKKFDPNFPNVREIAANASLCFVNVDEMFDLPRPIIHKTIYIGGLGIKQPKKLDQKFSNLMEKGRKGVIIVSMGTIAPFHGFTDITKIAFANVFRSMPDYHFILKIAKDDVTTASFLEDVPNSDLVEWLPQSDILAHPRLKLFIMHGGINGVMEAMLRAVPVIVIPIFADQFRNGRNVEKRGAGKVILKLDLTEITIRNTIRDVIENESYKANAVRLSKLMSEKPFTAEERLVKWTDFAVRHGVLDVLHVQGSRMNFIQYHNLDVFTVAIVLLW

SEQ ID NO: 6515 - protein, 577 aa, Caenorhabditis remanei
MIGLKDLLFYCFILFLCSTSSESYKILVYTNLFGHSHVKVMATVADALTDAGHNVTVLMPIIEQQFINKTCLKSTKNVIFVEQDDKLKALMATRSKRFETLWTSGFNNPFVVAKKYFIQKSKLMSELFSEHCRKVMSEKKLIEQIKSENFDLAITEPFDTCAYGEMIRFFQLSMDTVLHKFTSCLVLRCFRDILRNYASPAFFEAISIRAHVAVYSCSRLDHVSEVIGQPAAPSYVPGMTSLFGEQMNIWDRFLNFYLYKANSYAFSRIGDENYRVAKEFYPNIRSWREVVPEATFLFTNYIPYLDFPAPIFDKMIPIGGLTVKTDQKEVQLEEKWSNILDGRKKNVLISFGSNARSEEMPIEYKNALLKVFQSMSDTTFIWKYENPEDPFTKHLENVYLSAWLPQNELLADPRLTLFITHGGLASVLELAMTAKPAIMIPVAADQTRNAQMMKRHGVAAVLKKFDLANPVKIQEVIKEVMKDSSYRDNAKRLAEILHNQPTDPKEKLVKYVEFAARFGKLPSLDNYGRHQSFVEYFFLDIISIISFTVLVSSYIFYRLFKFVFQKCTGSSVKNKKE

SEQ ID NO: 6516 - protein, 693 aa, Cavia porcellus
MLRNILLLSLQISLLGTTLAGNILIWPMEGSHWLNVKIIIDELIKREHNVTVLVASGALFITPSSQSSLTFEIYKVSFGKERMEGLIKDFVLTWLENRPSPSTIWRFYQEMAKVIKDFHTVSREICDGVLRNEKLMDKLKKSKFEVLVSDPVFPCGDIVALKLGIPFIYSLRFSPASNVEKHCGKVPYPPSYVPAILSELTDQMTFADRVRNFISYHLQDYMFETLWKPWDAYYTKELDGSHWLNLKTLLEELAKRGHEVTVLSTSNNLFIDYNRHSAFNFEVIPVPTDKNLAENRLNEFVELAVNVMPTVSLWESGRLLQQFFIDVTKDMGLACRSTVYNQSLMKKLQESKYDVLITDPVLPCGELVAEMLGIPFVNTLRFFTGYTVEKYCGQLPAPPSYVPVPLGGLTTRMTFMERVKNMMFSILFDFWIQQYDYKFWDQFYSEALGRPTTLCEIMGKAEIWLIRTYWDFEFPRPYLPNFEFVGGLHCKPAKPLPKVLWRYKGKEPATLGPNTRLFDWIPQNDLLGHPKTKAFITHGGTNGIYEAIYHGVPMVGVPMFADQPDNIAHMKAKGAAVEVNMNTMTSADLLGALRTVINDPSYKENAMRLSRIHHDQPVKPLDRAVFWIEFVMRHKGAKHLRVAAHDLSWFQYHSLDVIGFLLVCVASAILLVTKGCLFFYQKFINTGKKIKRE

SEQ ID NO: 6517 - protein, 436 aa, Cryptotermes secundus
MVSVRDAMAVTVLVLVLVFLTSLQECKGAKILGLFPVPSPSHAAVSFALVKELAQRGHQVTVLSPYPQEEPVPNYTDIALQKIELKDVLNITVVPNPYEMQSLNYFQRVPIVWAMGIFLCDRVLGEPSVQKLVHSDGDHFDIIIMAGFYVDCLLGFAHKFKAPVVQVCPFGGAEYIGDTVGNPNPYSYIPDVFQEFSDKMSFGERIINTLCQLFQQVGRRYFLIPRQEVIMRKHFNYTSSMPSIADLEKSTALVLVNQHFSISYPKPVMPNFVQVGGMHIKAPKSLPADIKKYVEEATEGVIFFSMGSNLKSSQLPDKKLRGILEAFSKVKQRVLWKWESESLPGKPSNVKVAKWLPQSDILAHPNVRLFITHGGLLSAQETIYHGVPIVGIPVFGDQRLNMAKAVSSGYGFQLDYTDVTAESLGSAIREVLDNPR

SEQ ID NO: 6518 - protein, 837 aa, Symbiodinium microadriaticum
MGPHVLPLHTPVLEGAEYRTRRELATYDATDPQLAFDFLGRYVKTLEVVLNGKAPRNSASSTRPDVKMKSFIQMCDSAFVIFVRRSRLILALSRHIAAGSLNAVRIRSHFQRQALSTEAQLYLPDGVHGPSLHRWHMQAQLPVPLSIKKVQTQYPKRWRAITLVLTPLFMTFLGAGIITFVYGAIGLHNFRDEFGMYCDENIMAWHLVCTQSILYMGTRSGIVGLSGMMDQVGYFVIFGVMLLNTIVALIVDSFQTQSVAQSAGIVDGFEYHETYKQNKWDYMAFVFHLREKHALDRGLPESQIRQFIDNSDALRLSSLVCWTRAPHRKLIPEQKLRCGVHATTTCAGPAAPHCWPGLQRLWLPTHRLPMGLIQASAKPPSEEVRKVAAFFCTEDAGHINPMLAFAESLTVRGWQVSFFVPKSKRMQVEGVGATWSHFGTESWDLYESAIRVCTELGLEVPMELDPQKIMPFAVVPATLEILPYLIPRMSELQPSFICFDAAAPFGYLLAEHMKIPAVCSMSALPMPMADREKESSRRSEQGRQVLDATSAALAEKYGLNFNHNYSYTCYSDYNIVWCSRYWHEDSSEFSPEQFHYWGPLTSQRKGIASGPGSDAVSTTLCNLPGRLVLCSLGTIATGDAFGKFGAAVVDFFQKLCRAAALLQKELPDVQLVLSAGKSTDLVEEGGRVTSLFGEQVPSNVVVARSLDQLALLEKASAFVTHCGQNSSSEAVLAGVPVVAAPFFGDQPLNAHRFISLGCGLLQSYVDVPAKTSDKQFRPDLDRVSSESLAAAIRRVLEEPQFGEAMRTLREKEEGEPVDEKLQSLYKFIAGHQAVQPS

SEQ ID NO: 6519 - protein, 669 aa, Bactrocera oleae
MHLLSVILMVTALLCTSNVQAYRFLGILHTGARSHHIVGSSLFKELARRGHQVTVISPFPLKKPLENYVDIETPRIKAVMESECYELKSLSIICRYLKIKIIMQSIKRYAYPQLEGKPDNVYISEWFPQDDILAHPNVKIFITHGGLLSTTESIYHGKPFIGIPIFGDQFLNMNRAEAGGYGISVDYTNFTKEKFKVAIERMLNDDSYAKRLAAISAIYRDQPINPLDLAAYWVEYVVRHKGAKHLHCAGQDLSFIQYHSIDSMLILFGGLALAILLTMLLIRLIWERLRDIPLSEHYNVPLIGLGTFGAHPWNTDMVGSPSPPSYVASAMLPFNDRMTLWQRVGNFAYNIFERLLLDLYYLPKQAAIYREFFPHNKRDMYEVRRNAALVLLNQHVSLSFPRPYVHNQIEVGGMHINRKRSPLPADLERFINESKHGVIYFSMGSYLRSKFLPLEKRKAILETFRGLKQRILWKFEDPQLEGKPDNVYISEWFPQDDILAHPNVKFFITHGGLLSTTESIYHGKPFIGIPIFADQFLNMNRAEAGGYGISMDYASFTRDKFKAAIERMLNDDSYAKRVAAVSAIYRDQPINPLDLAAYWVEYVVRHKGAKHLHCVGQDLSFIQYHSIDSMLILFGGLALAILLTILLIRLIWGWLQFALARKDIKEKTH

SEQ ID NO: 6520 - protein, 528 aa, Chrysochloris asiatica
MLNRIILLLSLQISLLGTTHGGNVLIWPVEGSHWLNVKIIIDELINKQHNVTVLVASGALFITPSSKSSLTFEIYKVPFGKERIEEVIKNFVLTWLENRPSPSTIWRFYQEMAIVIKDFHMVSRALCDSVLQNQQLMERLKKGKFEVLVSDPVFPCGDIIALKLGIPFIYSLRFSPASTVEKHCGKVPYPPSYVPAVLSELTDQMSFTDRIRNFISYHLQDYMFDTLWKSWDSYYSKALGKPTTLCETMGKAEIWLIRTYWDFEFPRPYLPNFEFVGGLHCKPAKPLPKEMEEFVQSSGEHGVVVFSLGSMVKNLTEEKANLIASALAQVPQKVLWRYKGVTPATLGANTRLYDWIPQNDLLGHPKTKAFITHGGTNGIYEAIYHGIPMVGVPMFADQPDNIAHMKAKGAAVDVNMNTMTSADLFNALNTVINDPSYKENAMRLSAIHHDQPVKPLDRAVFWIEFVMRHKGAKHLRPAAHDLTWFQYHSLDVIGFLLLCVATALLLVIKCCLFSYQKFGKTGKKKKRE

SEQ ID NO: 6521 - protein, 524 aa, Aedes albopictus
MAARSAVAAILLLAVTFSEGAKILGVLPTGGKSHFYIGAGYMKALAEAGHDVTVISPFPLKNAPKNYRDIELTGFLEQFEKDYEQNMFKYKSSGGVIAPLFMLFMMYEMFAEVMCKAVLEHPNVVELLNSGEKFDAVLVETFITEALYGFAQHFDAPLITYSTFGSSMWTNDLVGSPAPPSHVAHFLLSYTDKMTFWQRFHNTAMTIVDRLYYELRYLPSQKRIYEAGFPNAKMTFEQQMKNVSLVFLNQHFSISSPRPYPPNMIEAGGIQVEEGKPLPEDLQKYLDEANDGVIYFCMGSNIKSIHFPEEKRDAFLKVFSKLKQRVLWKFEDETMPNQPPNLMIKAWMPQNDILAHPNVKLFITHGGLLGTTEALYHGKPLVGIPIFGDQPMNIQKAVRSGYAVLLDYDDITEKNVEKALDAVLNDPSYARNAKLVSQRFRDKPMTPKKTAVFWTEYVIRHRGAPQLRSSALDLSLFQYQLMDVYAVMLAILLAVVTLNVCIAKRILRKVFKRKSSVDKKKKQS

SEQ ID NO: 6522 - protein, 526 aa, Apis dorsata
MIRNIARLSFFLYVLIIANKSDCYKILSVVPTPSYSHQIPYRRLWLELHARGHEIVVITTNPIPDISLPNFTQIDISHSYSCLKELDFIENRFEHVSWLRILENYIISLYTCFLTEVFNSSEVKKLYVPDNPVKFDVLLAEFFYGPAMCAFAHRFNVPLIGLSSLGMIALNEFILGGLVLPSHEYTWEMEANTGTNLPFFKRLNNFVTMWNFLYHINFDVFFFQQKLAEKYLGPLPPLMDIMKNTSLIFTNQIDILSPARPKLPNIISFNSFHVSNNPSPLSKDLEEFLDDAKEGFIYFSLGTNARSSCLPKEIIRMFCDIFAKLPYKIVWKYEQDLPEKSGNIYIKDWFPQQSILAHPKIKLFIYQGGQQSTEEAINFGVPIIAFPILGDQDYLVRRIEALGMGKYLDIRTIVPDQFENTIKEVITNKEYKERVLDIRTQIRETSQDVKKIAWWTEYVIRTKGALHLRSTLAWEPWYQRYDTDIIIFLTIVIFVNFLIVISIIVNILMYFYKKMDTSTHRKSKIH

SEQ ID NO: 6523 - protein, 469 aa, Aedes albopictus
MRIVSLWTLVTLSSLCSAADILMITMGGTKSHKIPFWELAKGLIPRGHNITFLSGFPADFSFNGLQEVTPSGLVEFIRNYTNWDLLGARMRGDLPLSLWDVFRYSWQACDATLEDKETMDLLGRKFDLLILDGAYPECVVSLAYRLGAPYMYINTVGFYTGTMAMAGNPGPYSVTPVFYRPLTDDMDFLQRVMNSIFHLTIQPVYVASMTLLQAIVRRHLGADIPHVWDLARNVSFILQNGHATVTYPRPLLPNIAEIACIHCKPAGPLPKDLEDFIGGAGESGFIYVSMGSSVKAANMPDHLRKLLIQTFSRLPYRVLWKYEANSSMLTDLPPNVRLGRWLPQQDILGHRKLRAFVTHGGLLSMFETVYHGVPVVTMPVFCDHDANAAKAETDGYALKLDLETLTTEKLVRGIHRVIHDPKFRNEAKRRQMLLKDTRTTPLETAVYWTEYVLRHNGAYHLQTPARNLS

SEQ ID NO: 6524 - protein, 513 aa, Mythimna unipuncta
MIRFGLLIASIALVRGARILCMFPTPAYSHQMVFRSYTQALIKRGHQLTVITPTPVDNKNVNLTEIDISSSHANYKRLLDNSKVFKKRGIISDVETVNHHNYLGLVRMVSDQFRNERLRRMLHEDLDRKRFDLIVIEAFIDFPLVLSHFFDAPVIQMSSGHGIAENFETMGAVSRHPIFYPNVWRDNFLNLNAWQMAVETYREMMLYKEFSLLAEEENKLIKLQFGAQVPDVQVLRKNVQMLLLNTHAMFDNNRPVSPSVQYLGGIHIKKPSKIMNTHLLNFLEKSTAGVVYVSFGSGLHALDMDDEFLHVFLSTFRSLPYNILWKVDSINDTLLPSNVLVQKWFPQQDVLNHRNVRVFVTHGGVQSTDEAIDAQVPLVGLPLMGDQYFNVAKYSELGIGRSLDAKTVDSAELIEAIVDANENPLYKKNLARVKQIISDQPMKPLDKAVWYTEHVIRHGGASHLKTKAANVAWHEYLMVGVIVPILVSTFVGCLGTYSKYTLGLLSNPIHYMF

SEQ ID NO: 6525 - protein, 554 aa, Ostrinia furnacalis
MRLFFICLLLASAVNLEAYKVLLCFPFPVRSMNSLGDGYARHLINAGHEVTFITAFPKKQNIPNLREIDVSDNYEIIANENFNNISFILENILDLSSDVEFLQRLTLDIALKTLENKDVKALMGNPKETFHVFIADLLETELYAGFAALYNCPLIWAYSMGAHWVAMRLIDDPTNPAYSSDYFTTPIAPFSFTDRFRVLWENVKWRYAKIFITQPKEEAAYISIFGPELKKRGMIMPDYDDLIYNASLVLSNDHHASGNTPKTPQNWKFVGGFHIEAPVKPLPEVSDLATGRVKTIHQIMWFHHHHFSHKTSTAEHRDLKTIMDNAVHGVIYFSMGSVWNSELIPMQIIDGLLETFGELKATVIWKYEGNLPDVPKNVHLIKWAPQQSILAHPNCKLFITHGGLLSSTEALHFGVPIIGVPISYDQFLNIEKAVTRGYALQVALSYKLPEKLRSAINVVFDNPKYREQVKKLSKIYHDRPIAPGKELVHWIEHVIRTQGAPHLRSPANLVPLYQKAYLDILMLAIAVIALVIYLKNLVFGESNKRQSKKKFKKN

SEQ ID NO: 6526 - protein, 491 aa, Zootermopsis nevadensis
MLCADTESVGAFPAQSSAEILRTEMDLIRASCLVVLLACAEFQGDGARILGIFPSPSFSHQLVFQTIMKALSARGHHVTVISTDPLKEPIGNYTDVDLSFMYDYVRGKLNFSDCQGITAFGTVLRFSLHVGIVCNMQLGSPAIQDFIRCHPSTNTSFDLVFMEMSRYQCYYGLIHHVGSPPVIGIRSVGTTSATLAAVGSPNNPAYFPDYYLPYTGHMTFFQRLHNTAIYVWNSVLWHALLMPMNEVAMRYHFGRGPPSVWEAEKNVSLVMVNSHWSQSYPLPLLPAVIQLGNIHIQEKPKQLPQDLQEFLDGAAKGAVYFSLGSNVRSETMSPEKRRVFLSAFADVPQRVLWKWEANDTSDVPDNVKLAKWLPQQDVLAHPNVRLFITQGGLQSFQEATYYAVPLIGIPFIADQQHNVRKMVDAGVGLQLDYATLSKDGLVTATRKVLHDPTRRFKDWNFDRRAETKSPFLKRSSEAPQPRPLLAASRAS

SEQ ID NO: 6527 - protein, 550 aa, Dendroctonus ponderosae
MLLRGLPLILMTLELCGAANILAMFPLPGLSHFVMFRALLKELAQRGHNVDVFSHFPLEKPIKGYHDIDLRGSSPLLTNNMTFDVLRDEKGVEFAKLMSNEAGFKICEDSFKATQLKQLKTSRKKYDLLLTELFGSDCMLGWAWHFKVPTIVMTSSANLPWAADRFGLPDNPSYIPTYFMGSVSKQDFFGRMMNTWTLIRSKMLYRLHSTIPSNKLAKEFFGPEMPDLDVLAYNTSLQLVNSHFSVNNARPLVPNVVEVGGLHVGEPRPLSKVVRKKAYRLHSTIPSNKLAKEFFGPEMPDLDVLAYNTSLQLVNSHFSVNNARPLVPNVVEVESLPRGKLEALLNALAELPYTVIMKANVQKFPKDIAAPKNIVFEPWIPQLDILCDPRVKLFISHGGMMGTQEAVYCGIPVLGIPIFADQSLNIKYTEAMGFGIMVDYEKITKETLVIAAGKLLEDPKYRANAQRLSAYFKDRPMKPMDTAVYWVEYIVRHQGAPILQSAAKDLAWYQYYLIDVAAFLMFFSALLASIVAKVFVLLRNLGAKKKTKTS

SEQ ID NO: 6528 - protein, 310 aa, Danaus plexippus
MYNDHVQYENEVLKRLFGSEIPDINELRKNIRMVFLNVHPIWDFNRPVPPNVIYLGQMHLQKERVKKLPEEIELFVNSSVHGFIYMSFGSNVKLSSLPQEKIQIFSKIFSEIPYEVLWKRDGEIPVNLSQNIKISEWFPQSTLLRHPKIKLFITQGGLQSTDEAIFAGVPLIVVPCLGDQWYNAEQYVRHGIGRKLELNNLNEKLLKESIEDVIHNKSYRENVKKLRQIITDQPQTSLEKAVWWTEYVLRHKGAKHLMSPAANLSWLEYYEINFVIFLLGILFLCIISIIFILRLLVTFLFVRDIKIKEN

SEQ ID NO: 6529 - protein, 485 aa, Culex quinquefasciatus
MGRIVEYLVAALAVLSSFAGGTNILCLMSVASYSHHIWNRVLMEALATKGYNLTIVSADVEKVQKVNMTYIHLEETYHAVHEGDSAIDLYEMAQEGLVKSMRTFYDYGIASCEGSLRSKGLGQILSYPDDFKFDLVLYDFTLGPCILGLFHKFGQPPLVGVTAFNIPPYTDDLIGGHKYPAYIPYYTLNYDSYMTFLQRLENAFIYAADYFYRTYVFLPATDKQIRQIPAFKNMPYVGSLQEKTMLVMVNSHHSVDFPEPIPQNMVMVGGLQIMEPKPLPEDIKKFIDSGRKGAVLFSLGTNVLSSDLGDERISMFLEAIRQFPEFNFLWKFEADLKNHRVPKNLMVKKFLPQNDILAQPKIKLFITHAGLLSTHEATWHGVPMVGIPFIADQYRNLEKSLQAGVAERLVIWTVSTEKIVATIRKVLEDDGYRVRMRVKSALFRDQPEKPLERALWWIDWCLRHPNAETIRSPTVRLGPWKSELA

SEQ ID NO: 6530 - protein, 506 aa, Strigamia maritima
MKLLITYFVILLFNIIHAYRILYLFPFTTKSHMFVFEPLIEELAKRNHHITIVSPYTFSLHQQQNIREIIINIEDDNSKNMSTGRFSSYGNHILFQFISFKYVVKPGCEAYLKNFEVKELLKQGKQFDVVIVSAIFNECALATAPLLGKNIILHCSSAFLPWFNFHDSQLQLPSVVPVVMTPFVSKMNFLQRLDNGILFLAVRLLMEYNFVAAIQAVITEHLLQNPSVSEGFESIDLVFTNADPVITSPRPAIPTIIDLGGMHCRKAKPLSKEFEDFVESSGDYGFILFSLGSISQSKDLPVETIKSLLDGFSRLEQRVIWKYEKDLENVPKNVKISKWLPQKDLLGHAKIRLFITHGGMLSLQESVYNGVPVVAVPLFSDQPGNVARVEEIGIGVKLALSNISGDSMYDAINKVLGDKRYAENLKRYSAIFHDFIENQVEKAAYWVEYVIRHKGTDHLRTGSKELNFFSIFTRCNCFYSLYLFIFAYVSMTILKLIVAKKIKNEH

SEQ ID NO: 6531 - protein, 536 aa, Drosophila virilis
MKTFAALLLLLLLFCHKWQQLNAASILCLIGTAQHYNPGWTKPFFEALAGRGHSLTVIGTQPDLGLPHIRQIFLPNEHDVVKKHYTNDMGHYRHHWDIKQLLIWYEALLGGCRSITEANFYKTFDMTALKYDLIIYDATFSMDCLLTTLPRYRSVPVLGLSGGKFTTDLIDLVQGEDTISAATIPHFIGRLPITMNYWQRIQNHVMYLAESFIHWAVVQPVLNGMLESGVSSIKAQVVLLNTHPVLDYVQNMPPNVIEVGGLHIRAESEPLPFSLQEFIERFSEGIVYINLPHIELMYGLGLKAVESMIKEFSQLGFLWNVNNLKDLQLSESLYNLRAISVFDNMQQNILAQSNVKAFLTHGDSFGIQEAIYNAVPIIVLPLLMDQMNNGERVQERYLGVCISAKNFSVDSFSAALKQIIRDEIYLEELRQAQLNFRTRPAKPVDLAIWYAEQLVSQPDIFKQSSVPESSQRSYFVRKSLDVLSLPLLFFLFFFANVVLAIMQSIVTDNQKKTAKQVKKLNGIGKEQSSDKEQKED

SEQ ID NO: 6532 - protein, 383 aa, Apis cerana
MPAMYAFAYRFNASLIGLSSLGLLSINDFVLGGAVLPSHEYLWENEGNTGINLPFYKRLHNFVKTWRLLLHLNFNIFPKEQKLAEQYFGPLPPLIDIMKNVSMIFINEADVLTPGRPILPNIVRFSSFHVSENPDPLPKNLQKFLDDAKEGFIYFSLGSNARSSTMPKEIKRIFCNVFAKLPYKVIWKYEEDLSEKPKNVYIGKWLPQQSILAHPKIKLFIYQGGVQSSEETIRFAVPVLGFPILADQDYQVRRMEALGIGKYLEITTFTEDQLKNAIYEIINNKKYKERILIIRDQIKDTPYDTVKHLAWWTEYVVRTKGAPHLRSTLALEPWYQRFDMDIVVFLAIVTCIIVSILFYIIIKLLVYLYKISQISTNKKQKIT

SEQ ID NO: 6533 - protein, 462 aa, Culex quinquefasciatus
MGSFINSKDFPVEKRDAIIKAFARIDQRVVWKFEDESIPDLPNNVLIQSWLPQNDILAHPNVKVFITHGGLLSGTEALYHGKPIVGIPIFGDQTMNVQRAVKAGYGVELQYKDITKSSIRNALDKVLRDPKYAETARSISRRYHDKPMSTKKTALYWLEYVIRYQGAPQLRSPAMALTLIEYCSIDVYSLVVTISYATGARILGILPMGAKSHNIIGAAYMKALAAAGHEVTVVSPYTLKTPPKNYRDIELTGMLEAMDDQEKNLFNYKGSGIGSFFIMMYVLYGKLPEVVGKLVLQHPNVVKLLNSNEKFDLVIVESFLTESLYGFAQHFDAPLVTYSTFGNSMWTNDLVGTPAPPSHVAHFLLSYADRMAFWERLVNTVVTILDRVVFEWYYLPKQREFYEVGFPNAKISFEDQMKNVSLVFLNQHFSVSSPRPYAPNMVEVGGIQVEKPKALPKMFTEF

SEQ ID NO: 6534 - protein, 523 aa, Rattus norvegicus
MFKMPRKWISALFLLQISYCFKSGHCGKVLVWPMDFSHWMNIKIILDELVQRGHEVTVLKPSAYFFLDPKKSSDLKFEIFPTSISKDELQNHFIKLLDVWTYELPRDTCLSYSPILQNLVYEFSYFYLSICKDAVSNKQLMTKLQESKFDVLFADPVASCGDLIAELLHIPFLYSLSFSPGHKLEKSIGKFILPPSYVPVILSGLAGKMTFIDRVKNMICMLYFDFWFERLRHKEWDTFYSEILGRPTTVDETMSKVEIWLIRSYWDLKFPHPTLPNVDYIGGLHCKPAKPLPKDMEEFVQSSGEHGVVVFSLGSMVSNMTEEKANAIAWALAQIPQKVLWKFDGKTPATLGPNTRVYKWLPQNDILGHPKTRAFITHGGTNGIYEAIYHGVPMVGIPMFGDQPYNVTHMEAKGAAVKVTISTMTSADLLSALRAVINEPSYKENAMQLSRLHNDQPVKPLDRAVFWIEFVMRHKGAKHLPVAAHDLSWFQYHSLDVIGFLLVCVVTLTFVITKCCLCVENFV

SEQ ID NO: 6535 - protein, 1005 aa, Laodelphax striatellus
MKLFLVLAFITTGILSIASCESYNILAIVPIRTRSHFMVIEAVLKGLADKGHNLTVVNVNPQKTPIKNYHDIDVSQHPKHIVSNTTVDFIISNMRPIHKGLLFIWDFGFEKMCKNVFKDQQFQNLINTTQKFDLVLTEIFAYDCFAPFAYKLNVPLVSIVTSTALQWMNPRVGNPDNPSYIVNYASAFSPQMTFLERLVNFYFLIFAKIGYHFLSDNRGYEIAKQYFGDDLPHLSEIYQNTSLILVNSHFSINQARPFVPNVKEIAGIHLKEPKPLPEDMQILLDNAHNGVIIISFGSIVRMSSFPENVKFAFIKAFSSLNQLVVWKYEEELLTIPPNVVLRKWIPQFDILGHKNVKLLITHGGQSSCIESVYHGVPVIGIPMFADQPGNVMNLVNRGMAIHIDYFNITAESILHAIQTILNDKSFEENARKVSEIFKDRERTPMETAIYWIEYVIRYKGAPHLQTSANQLSVFQLYLLDIFAFLILMLATIVLVCFGFLVCLTFSDAANILAMIPFKGKSHFIVIQPLLEGLTGRGHNVTVVGPYPRDVPLHNYHDIDLSTEMGPQLLNRLRIDEINSNFRSPTQGYHWIWDICRSMCEIAYNSSKVQNLVKSEEKYDLLITEIFASDCFIPFAHKLRVPLVSIATFYPVSWLNPRVSNPDNPSYIANYALPFTDKMTFFERILNSIAFVYARLGYYYLSDSPSYEMAKTYFGSDSDMPQISEIAKETSLILVNNHHSISQVRPLVPNVIEIGGIHLRAPHPLPLDLQKLLDGSEKGVIVFSFGSVVRTASLPPAIIDEFIKAFAKIKLTVLWKFEGTIENLPPNVVTREWIPQCDVVAHPNVKLLITHGGLASTIEAVSNGVPIIGIPMFGDQPGNIQRIVEKGAGLKIDYSEINTDKVYRSIQQLLLNPKYKTNAKKLSRIFKDRELPPLETAIYWTEYVLRHGGAHHLKSGAQHLSWIELHCLDVLAFILLGFATVLVVAIKLFASLVKLIKKNHNFFSSH

SEQ ID NO: 6536 - protein, 405 aa, Daphnia pulex
MSTGLDEKFHLILVDGFFNECTLLLAELFDVPFVYLNCFVPPPWLQNTMGTPFAFDHFPHSGLSLSDRMNFWQRSLNAVTGLALVAFYHLHVVPVIDAAAVKVLGLDNFTSIVDIEDRRLSLLLTNTHFSINYLMPTSPAVVQVGGMHCVPPKPLPTDLESFVDGSGDAGFIVLSFGSILKGVEIPGGVRNIFLSTFARLPQRVIWKWEDKGVLPDGLIPSNVKLVSWLPQQDLLGHPKARLFITHCGLLSKQEAVYHGVPFIALPVWSDQPINAQKAQEDGYAIKLDWNQLTEEVLYDAIQLVLNEPRYKRRMKEVSAVMRDQMESPLERAIYWIEYVIRHQGAPHLRSASRQLSIYQKCLLDVMAFLSAVCLLAIYFLFRLCRRSVCSGQRRQKSAGPRKKLN

SEQ ID NO: 6537 - protein, 540 aa, Bombyx mori
MWAGTRWPIIGLPILLVASVCGSDILMITMGGTKSHKIPFWSLAGGLTRRGHNITFISAFPPDFHIAGLEEIAPEGLVSYVKSYMSWDLVGARMRGEEPLPAFDILRYGYEACDALLKDYEMRSFLQSGRTYDLIIIDGTYPECALGITYKMKVPFMYINTVGFYSMPLSNAGNPAPYSVTPFFGRAFTDNMGIIERAMNSAWQIGAMALHGVSMTILQGVLRRHFGSQMPHVYDMSKNVSFILQNAHYTVSYPRPYLPNVAEIACIHCIEPKRLDPEIEEWISGAGDTGFVYVSMGSSVKTSKMPLTAHRMLINALGRLPQRVLWKQDAVQNMTDIPSNVKLLKWSPQQDLLGHPKIKAFITHGGLLSMFETVYHGVPIVTIPVFCDHDANAAKAEVDGYAKKLEFQYLTSDKLHEAIQEVINNPKYRREVKYRQNLLRDQKESPLDRAVYWTEYVIRHKGAYHLQSPAKDLTFIQYYLLDVAMLFVISALAFYALISFAIRSSFQRLAVFIQNRQMKMLFDNSTGLIGNSLMEQKKKL

SEQ ID NO: 6538 - protein, 908 aa, Blattella germanica
MIPVGKVNSWSSVFNKTAVLRLMIEPVMRLFTLAVCLFIAKESGIAFGARILGLFTIPSISHQIVYRSLMRELHARGHQLLVFTPDPIKDPTLKNYTEIDLSASYDVWRKRFDSLTKTRDKGISVPLMLIDFVHAGLDLCDVELNLPEVKEFMKGNDKEFDVVIAEWVMSPCFAVIPHKIGAPLMGISSVAPSLTVHSVVGNPVNPAYTPDILLGYTDHPTFLERIYSTLHTTMVKFVYHFWIIPAHDAVVRKIFPDIDMPFIQEVINNVSVILVNSHYSFYYPRPNVPTMVEIAGLHLSDPKPLPKDLQEFMDGAVEGVIYFSLGTNVRSDSMSDTKRQMFLDAFSELKHFRVLWKWEGDEIPGLPENVQIRKWLPQQDVLAHPKVKAFIYQGGLQSTEETIRVQVPVIGIPFFADQVLNVRKMVHAGAGVRLDFKDISKESLLNALNEVIYNPIKMESTISISVFAVIWLSTIESARILGVFPVPSISHQVVYRALFTELNSRGHEIVIVTTDPLNNSSLKNYREIDIRASYKVWGDKFNFLKNRVMGATRKDFMNGLLDISEGLCTGVFDNAEVKKLMRTNKERSFDLVMVEWLVTPCTYTFAYHFSAPLVGISPLVILYSGYESVGNPVHPIYFSEALCPALKNPTIWDKIERISYFIWYKWYWYTITLVQDEIARRYLGSSMPYLGDLEKNVSLVFTNVPTSNHFVVPKVPALVELGQMHFQEVKPLPKDLQDFLDEATEGVIYFSLGTNVRSDSMSQEQIQIFNDVFSQLVNFRVLWKFEGDILLGKPNNVKISKWFPQQDILAHTKIKAVIYQGGLQSTEEAIRMKVPVLGFPIFGDQDLNVQMVVDNGIGEMLYIDELTREKLLSTLKKLIYDPKYVGIHILDRCSRTSPPTRVKVVSGR

SEQ ID NO: 6539 - protein, 508 aa, Tribolium castaneum
MRTVLFILQTTVLFSATTCARILGVFPASGYSQFILAEALMKEIASRGHEVTIISPYRPKTAFFNYTTIQTSDVLHSDDGFDLFELDNKSLFKNILTTYEYGNLLTEFTLKDKGVQKLLHSNESFDLVIVEQFFTDALKGFATHFNALLVLFSSVGLTEWNKHYMGNPVLPSTNTIVYTGYTNQMNFFQRIRNLAGTIFDYCYRTWVFYPIQRKYAEKYFPKPVNFDGIINNASLMLLNSHFTTSENVLLPYNMIEIGGFLVTQNRLNNDTQKLLDEATDGAILFSLGTNLKSCDLAPNTLRTILKVFGRLKQKVLWKFEKDLPGKPKNVVISKWLEQADILAHPNVRLFITHGGILSVTEAIFNGVPMVGIPVFVDQKMNMARAKHARIANVISLKELTEERFFSMINETINNPTYSENVKKMSKLMKDRVVRPLDLAMYWIEYAIRHKGVRFETPVSKMYWFQVYMLDIFCFVIFNLLITYLLITGLCTYLGKEKSSVINDNKKKQ

SEQ ID NO: 6540 - protein, 549 aa, Salmo salar
MGWRKGVLVLRPGLRLGPGLGMRQGLRLGLLVLLCCLALCPAPLQGDKVLVMPVDGSHWLSMKLLVKELAARGHEMVVLVPDTSILIQGSDYYRTETFRVPYSKAQLDENVNKLKDAAFLKAPDIMDIFVNVQHLIHFTTMQVKGCEGLLYDKPLMQRLRGERFQMMLTDPFLPCGSIIAESFNIPAVYFSRGIPCGLDEKAAQCPTPPSYVPRLFSGNTDHMDFLGRVKNMLMYSLESYLCTVMFASFDELTSRYLDKDMTYRELLGHGAIWLLRYDYSFEYPKPRMPNMVNIGGINCGKRAPLPADLQEFVDESGEDGFVVFTLGSMISQMPEEKAKQFFDAFSRIPQRVVWRYTGVVPENAPDNVRLMKWLPQNDLLGHPKVKAFMTHGGTHGIYEGICNSVPMVMLPLFGDQSDNVHRMTVRGVGEVLTLFDITSDKLVEALNKVINDKSYKEKMLKLSAVHKDRPIEPLDLAVFWSEFVMRHGGAEHLRPAAHDLNWIQYHSLDVFTLLLTIVLIVVMVTVKCCKVCFRKCCGKKKTMKKKKSE

SEQ ID NO: 6541 - protein, 800 aa, Symbiodinium microadriaticum
MVTPARKFGFIFPMASGHINPSLPVARTLVEEGQEVHYLCREQMKDAIEDTGATFHSEIEALPEMYEGRNVDIFGCLSDLQKEYGLEEDPLFVAMFKIREIMQEMMLPGILRWLEKVGVDVVVICPLMNKEACWAAQILGIPCVGIMTTAGPGSLRSATLEWMEKMGYTTERCLKERRAYQPLLEAVDRLRAKYGLEIELDEEMAPVGMSVVAKQSALTLVTTVDFLADPLSPELEKIYEEAQTEFVFVGPLLDKAGAKRAAGHKFQKEAESAQGLAPLAETAPIDPVALIRKAREAGRKVIFASMGTVITGDSPEVGWANHMSVDGVFQGLTGKELCQAAWGGLFDAFGTDSADAGPLLLVSLGPQPDALENLVAPANAACLPVMPQVDILKEGVDLFLTHGGQNSFMESLSTGSPVVVCPGFADQPVNAQKAVQLGVGLQIERPMCDLSEASQVAAKYRCDVAAALQEVHGNPEFKTKANECSSKMQSAGALANSGCRPGLRRRLGPWLMAAALSPVVAQLAVAFSGSAIHAPPRRRLVSRPASSSELPALRSKASLKLIQAQVAAGHDMKELGVRMEQSEFKASALDGAATVTFDGMQNLRSVDISDDALAKAGSETALAEALLKALQEGHDSSVAGSEDDIWSLYQNNPDLIQAPLIQIGAGNTAQDLWANVTKTNETLKLAEELFLHFDQDKDGFWNFKETSAVQLATEGTEMGEEAFNSLIIAAAPNGGRHLTEEDMARGLSKDQVLDLYTNAQRQRQLGFVLDIMKDHQRVFSQESNAEETESKPAPVSVSVD

SEQ ID NO: 6542 - protein, 523 aa, Xenopus laevis
MAVGRKSLILSLLIQHFVLLHGAKILTVCFLGGSHYLWMDEISRILHNNGQEVTMFLQIADGLLPDYQMQESPYRLITWSLDKNYLKEFSEFFRDSKYNFKDCDELSSYLGLMTHFSRQCKMIFNQTSIMNLLKEEKYDLAVIDSFNPCTFLVSEKLGIPFIATHPFPVKSPWHSGIPNQLSYMPVYQSQLTDHMDFFERVKNVFMYIASAVLERKIYSLFDDVIEEHFPACSRPSFEELYKKTALWMYLTDFTIEFPHPFFPNVLYIGGVLAKPAKPVSEELEDFIAQSGEHGFIIVTFGSMVPSNPLTEFVKEMNDGFSKIPQKVIWRYRISEWPKVLQLAPNVKIMNWISQNDLLGHPKARLLVTHGGVNSIQEAIYHGVPMVAIPLFFDQFDNAVRIKAKHLGTFIPKDQLKAEKLANAIRDVIGGESYKNSAMHLSLIQRSQPFPKDQQIVRWVEHIVKVGGTDHLIPYSYQQPLYQQYLLDVFLFVCVCVIGACYLTVKLLKMFIQKLCSFRKLKQN

SEQ ID NO: 6543 - protein, 536 aa, Ceratotherium simum
MVSIKDITMPKKFVQLLVFNFTLTEIVLSGNVLIWPTDGSHWLNIKIILEELIQRNHDVTVLASSATLFIKSNPDSPVHFEVIPVSYKKSNIDSLIEHMIMLWIDHRPTPLTLWTFYKELGKLLDTFFRINIQICDGVLNNPKLMARLQKGGYDVLVADPVTICGDLVALKLGIPFMYTLRFSPASTVERHCGKIPAPASYVPAALSELTDQMTFGERVKNTISYSLQDYIFQSYWGEWNSYYSEVLGRPTTLCETMGKAEIWLIRTYWDFEFPRPYLPNFEFVGGLHCKPAKPLPKEMEEFVQSSGEDGVVVFSLGSMVKNLTEEKANLIASALAQIPQKVLWRYNGKKPATLGANTRLYDWLPQNDLLGHPKAKAFITHGGTNGIYEAIYHGVPLVGVPMFADQPDNIAHMKAKGTAVEVNINTMTSADLLNALRTVINDPSYKENAMRLSRIHHDQPVKPLDRAVFWIEFVMRHKGAKHLRPAAHDLTWFQYHSLDVIGFLLACAATVIFLVTKCFLFSFRKLGKTGNKKKSE

SEQ ID NO: 6544 - protein, 528 aa, Microcebus murinus
MLNKILLLSLQMSLLGSTLGGNILIWPMEGSHWLNVKMIIDELIKKEHNVTVLVASGALFITPTSKPSLSFEIYKVPFGKERIEGVIKNFVLTWLENRPSPSTIWRFYQEMAKVIKDFHMVSGEICDGVLKNQKLMEKLKSSKFEVLVSDPVFPCGDIVALKLGIPFIYSLRFSPASTVEKHCGKVPYPPSYVPAVLSELTDQMSFTDRIRNFISYHLQDYMFETLWKQWDSYYSKALEMGVSVCFPGWSSTPGLNSQQPQTPGLKQSSCLSLPSSWDYRLPVGRPTTLCETMGKAEIWLIRTYWDFEFPRPYLPNFEFVGGLHCKPAKPLPKVLWRYGGKKPATLGNNTRLYDWIPQNDLLGHPKTKAFITHGGTNGIYEAIYHGIPMVGVPMFADQPDNIAHMKAKGAAVEVNMNTMTSADLLNALRTVINEPSYKENAMRLSRIHHDQPMKPLDRAVFWIEFVMRHKGAKHLRPAAHNLTWIQYHSLDVIGFLLACVATCIILVMKCCLFSCQKFGKTKRKKKRD

SEQ ID NO: 6545 - protein, 519 aa, Plutella xylostella
MWKLLLVLCVCAAPLSAAYKILVVSPVPGKSHTILGDGFVRNLLNAGHEVTYITAFPVENPPARLHQVNVSDNIKYFPVDLVNIKKLIDDKGEQPSLSVFFGIIEQQARNTVSNENVQRLMRDPKQNFDAVIVEWFFSEVFTGFGSVFGCPMILFSSVEPHWMVLQWIDGLPNPAYTVDIQSTGTAPLGFLARAKELFNQVAGLLFKSLYFEAIENKIYEENFRPAAEARGRTLTPLNVQRYNISLMLGNSHVSLGEATRLPQSYKPIGGYHIDPDLKPLSKELKNIIESSKDGVIYFSMGSNLKSKDWPVEIKQDLLKMFSGLKQTVLWKFEEDLPNLPKNVHILKWAPQPTILAHPNTKLFITHGGLLSTTETIHFGVPIIGIPAFADQFVNVDRAVGKGFAKRVDLSYDIAQELKGAIEELLTNPSYTERVKELSLIYHDRPAPPARELVHWVEHVVKTRGAPHLRSPALLVPWYQKVYLDLAVVVFSVLAAIYIGLKRLCCSKKGEKTSAKQKKN

SEQ ID NO: 6546 - protein, 525 aa, Ceratitis capitata
MTKITFTILALALIVLTPNYLESAKILSIFPFTGPSQYLLVQPYLKALAARGHEITSVSVFPQKTPLKNFRDIAIKNTDADHNDYIKYAMENFAGSKLNELRFVKGYVLPATLAVLKNEEFQQLLWSNEEFDLIIIEVFSQEALYALGHHFKAPMIGVSTFGRDVVVDQLVDNVSPVSYVSAPSGRQLHEMNFWQRLDNLYINTMEWLYDKLVLLPAQQRFYEQYFPNATLDLSEVRRNFSLLLLNQHYAFSWARPLVPNAIEIAGMHVEHIPKKLPADMEAFINASPKGAIYFSLGSNIKSTYLPREKLSAIMDAFASLPVNVLWKFEKTDLPGKPKNVFINKWFPQQDILAHPKVKLFITHGGMHSSIEVVHHGKPIVGLPVFYDQHLNVERAVNNGLGVGLDFRNFTSEEFRDAILEVLNNPTYAERAREVSAGFHDRPMKPLDAAIYWTEYVLRHKGAPQLRVAARHLNFLQRHSVDTMAVLFGIPILLAISVIYCIFKLSLVVYGSKSISQCDVKKRKAE

SEQ ID NO: 6547 - protein, 473 aa, Haemonchus contortus
MDPHANLVGHTKPIFQIPYYSKYLNNSGFDDYDMGSPAFWTSPMVEGRSISIEDIKRYHENALLMCKALIEDHELLDRLRNSRFDVALHELYELSAVAFLELIGVKKAIVVSAAGMTLHMKEITGMPPNPSFVPGIFTTYNDEMTFWERLDNFKCEIELNYRFLQWEEKLRQLFNKASPGFPDLRKLLKQKIGVILVNANEFTETPRPRGNIVRYIGGMAIPEPKPLNQELSAVLDKRSTNVLFSMGSLAKSSTMPLHLKKDILNAFAAFPNTTFVFKYDGKDDLELFKPYPNVHVMKWVPQVDLLGDKRLSLFVTHAGLNSITEATYFGKPMITIPLFADQFINAKNLRRIGLAVLIERNNLNKDTLITALCEVLSPDAKYAHKASTVARYLRGLPSAARAEVTRWVELVAEEGQMEHLMMKARDLSFIQYYCLDIIGYLLAQIVIVLCVMFLLMRYLSRRITLVFQKKKIE

SEQ ID NO: 6548 - protein, 537 aa, Daphnia pulex
MSSLFVSCVLTLMMVLFFSAAADAYNILVLTPITSPSHTNVFKPLVTALAERGHFVTHWDGLKPPSHSSSSNNRTSNSNVRVLYSPVMAEINREHNVNFSDRDHPLRLLFRVPKTVANYCRAIHEDPVFRQLMSTGLDEKFHLILVDGFFNECTLLLAELFDVPFVYLNCFVPPPWLQNTMGTPFAFDHFPHSGLSLSDRMNFWQRSLNAVTGLALVAFYHLHVVPVIDAAAVKVLGLDNFTSIVDIEDRRLSLLLTNTHFSINYLMPTSPAVVQVGGMHCVPPKPLPTDLESFVDGSGDAGFIVLSFGSILKGVEIPGGVRNIFLSTFARLPQRVIWKWEDKGVLPDGLIPSNVKLVSWLPQQDLLGHPKARLFITHCGLLSKQEAVYHGVPFIALPVWSDQPINAQKAQEDGYAIKLDWNQLTEEVLYDAIQLVLNEPRYKRRMKEVSAVMRDQMESPLERAIYWIEYVIRHQGAPHLRSASRQLSIYQKCLLDVMAFLSAVCLLAIYFLFRLCRRSVCSGQRRQKSAGPRKKLN

SEQ ID NO: 6549 - protein, 784 aa, Trichuris suis
MHTSFHMPVHFLLLLLRLCSSQSKTIGLFMNTGPYSHDAMMQHIADDLYDKRYKVFLLQIRVFNFNMTLPKSKYVHPTLRYDYSGPETLAVMQEAQAQIWHGPVPLGGGTVNLKGVYAFQKLYEVQSAACQAALKSESYLSKIKAAHLDFIVIDYVLNECALGISAILKIPRVYLSNYPLIEVYSNTFGVPSNPSYVPAVLSPTSSRMTFVQRLQNVLIHTATIFIRASLIWRSQKLLHSVGHDAELRGEERKAIFYGTPLEFLLDGPRPLSNSVKYLGCLRCSRRDEIRTSQSQSWLPDKNMIIASFGTCASATRLPKQVLNSFITAFSQLKQYKVLLQMPGIEIHNSTWPSNVVAVQWIPLLDLLRSPSVKLLISHGGMSTTVEAVNNAVPMLGIPLQGDQMYNVGRLVEKGVADVLPISGLTAELLSKKLRRMLPITANDQTLNLKQKRAIKNYSIGVVVTMIREQVLNSFITAFSQLKQYKVLLQMPGIEIHNSTWPSNVVAVQWIPLLDLLRSPSVKLLISHGGMSTTVEAVNNAVPMLGIPLQGDQMYNVGRLVEKGVADVLPISGLTAELLSKKLRRMLPITANDQTLNLKQKRAIKNYRGVVNYEEDLECESLEVFLRFKNEPFQKQDNRHPDLVLLPEYRQALSTFIAKIPKILVQQMTPGLIKCPAGLPQNSRVKRTLNGLNLWACLALLWMCVRLDIFFQNKAVSSQLKRCSGRDPFSSVTFLNCSGNVDRANTSTIAASPVLFKFFLLEYVFGQHVTQAVDKRFNSRVNMER

SEQ ID NO: 6550 - protein, 531 aa, Salmo salar
MVSVRLLLSMALLILCGCQGTHSGNVLVFPGEYSHWLNMRVILEELVVRNHSVTVLVCSASPTVNYTKPEGFSFKVYNVPFERHDLESLQEDFLNFWIYEAQNASMWQVGLKIREVLGSMTALQLSMCDAIFHNKELMDTLRQWEFDAVLSDPMMPCGDLMADALDVPLIVSLRFTFGMAMERHCGQIPAPPSFVPAPPLTYTDQMSFLERVHNFVTYMIHSSFFSIHCLQNMDKYYSGIKGRPTTLCEIMGKADIWLIRTNWDFEYPRPFLPNFKFVGGLHCKPAKPLSKAMEEFVQSSGDDGIVVFSLGSMIKNLTKERGNTIATALGQIPQKVLWRYSGEKPETLAPNTRVYEWIPQNDLLGHPKTKAFVTHGGTNGLYESIYHGVPMVGIPLFADQPDNIMHMKNKGAAVMVDFNKMTSKDLVDGLNSVINDPSYKASMMRLSRIHHDQPMKPLDTAVFWIEFVMRNKGAKHLRVEAHNLSWYQYHCLDVAAALLTIVALVIVVSIKTCIFCFRKCCKKTKSRQKTE

SEQ ID NO: 6551 - protein, 262 aa, Aedes albopictus
MIEAGGIQIEDAKPLPADLQKYLDEAKDGVIYFCMGSNIKSIHFPEEKRNAFLKVFSKLKQRVLWKFEDEKMPNQPPNLMIKSWMPQNDILAHPNVKLFITHGGLLGMTEALYHGKPLVGIPIFGDQPMNVQKAVRSGYGVLLDYDDINEQTVETALRTVLNDPSFTRNVKEVSDRFRDKPMTPKETAVFWTEYVIRHRGAPHLRSPALDLSLFQYQLLDVYAVMLVLLIGIVAVDVYIAKKILRKICRKMCSGGNKKKKQN

SEQ ID NO: 6552 - protein, 1142 aa, Culex quinquefasciatus
MGRIVEYLVLALTVFSPSEGTNILCLMSVASYSHHIWNRVLMEALAAKGYNLTIVSADVEKVQKVNLTYIHLEETYQAVHEGDSAIDLFEMAQEGLVKSMLTFYDYGMASCGGSLRSKGLKQILSYPNDFKFDLVLYDFTFGPCILGLFHKFGQPPLVGVSAFNNPPYTDDLIGGHKYPAYIPYYTLNYGSDMTFLQRLENAFIYAADYFYRTFVYLPALDNQIRQIPAFNKIPYIGSLQEKTMLVMVNSHHSVDFPEPIPQNMVMVGGLQIMEPKPLPEHIKKFIDSGCKGAILFSLGTNNDILAQPKIKLFISHSGLLSTHEASWHGVPMVGIPFFADQYRNLEKSLQAGVAERLVIWTVSTDKIVATIRKVLEDDGYRVRMKARSALFRDQPERPLERALWWIDWCLRHSNAETIRSPTVRLGPWKSELYDVKLLVVLVALLVSSKENKAAADQNSNISQQLEEINAKLAKLDSLEKLNKDLLTKLLKLSQRVDAVTVESRKCPSNIWKPSPRFASWLASRNPRTLVFKQNKRTDAVLVKFWRVQDKQRFIGCVRALKRPVTPAELNIRSQNKFVLVQDHLTPEKVELHRQTWELCMLGLQRPWIYNGSTWTTHPETNKRFQQTGRKDPAHSTEIVSVAFGANILCLFGVASPSHHIWNRAIVDALAAKGHNLTIVSPDVEKNTVENIHYIELEETYPELYSGPHNVDLMEMANENVFKSVISFYRDFVITECQGILKSKGLALIKNYPDDYKFDLVLYDMTCGGCMHGLLHKFKYPPLVSVTPFNNPPYVTEVIGGHKFYAYTPFFSLGYGSDMTFFERVHNTLLYTVDFIYRNYYSNPVLDKMVREYFQYDDLPYVPDLDRLSRVLLVNAHYSIDFPEPAPPNLIPVGGLQIKEAKPVPDDLEKFINAGRKGAVLFSLGTNIRSDELGKERQILLIEAMRQLTDYNFLWKFESDLDLKLPKNVMIRKWMPQNDILAHPKVKGFITHAGLLSMHEASWHGVPMIGIPFIADQHRNIQKCIRMGVAERVVFQTLSMEQVRDTVRKVLETPSYRKNMDRISVLFRDQPEKPLARAVWWVEWALRHPDVESMQSPVLKLGFLRSNLVDVIAFLVLLPCVLIFVVRKLVCKGRRVDRSKKNN

SEQ ID NO: 6553 - protein, 440 aa, Dendroctonus ponderosae
MHLTGKVWLQLVIIVNVVVAMDAAKILFLSCTPARSHQKPFQVVWRALSQRGHDVHVLTPNPLNDPTLNNLTEYDLSDFYEDLKAMKNDDIQYFLHRPTFFSSFVKDVVATKMFSRLYNKTINHQETRRLLRENDRFDAVIVEWIFPTLASIGAYYKAPIIGITSLGAPLVALDSLGNPSHPLVAPEMNLPLKRDLSIKERLLSVLYAFYVRLYYWVVVLPREDENVKKHLSSELPYIGDIAKSLSLLLMNRNPVFHRVVPLNPNTIDLGGISVLSPATSLDSSTEEAIAAHKPIIGIPFHSDQTTNVDTCAMYGMGKLLDMEDITIETLRSYILEIVNNPRYAENAKKLDELMKDQPQDGLDKAIWWIEYVIRHKGAKHLRSIAVDLPWWQYFLLDVFGFIFTVLLIFLLSVRFTLKLVFRLISYIRKPKEKSMKKKKQ

SEQ ID NO: 6554 - protein, 521 aa, Aedes aegypti
MAARSTVALALLLLVAFSEGAKILGVIPTAGKSHFNIGSGFMKALAEAGHDVTVISPFALKNAPKNYRTIEVPEVLAESNFDQNMFNFKSSGGAIAPLFLLFLMYESFAKVICKCILDNANVVKLLNSDEKFDVVFVETFISEPLYGFAQHFDAPLITYSTFGNSMWTNDLVGTPAPPSHVAHFMLSYTDKMSFWQRFHNTAMTIVDRLYYELRYLPNQKRLYDAAFPNAKMSFDQQMKNVSLVFLNQHFSLNSPRPYPPNMIEAGGVQIDDAKPLPEDLQKYLDEAKDGVIYFCMGSTIKSTHFPEEKRNAFLKTFSKLKQRVLWKFEDENMPNQPSNLMIKAWMPQNDILAHPNVKLFITHGGLLGMTEALYHGKPMVGIPIFGDQPMNIEKAVRSGFAVFLDYDDINEDTVDKAINEVLNNPSYAKNVKQVSDRFRDKPMTPKETAVFWTEYVIRHRGAPHLRSTALDLSLFQYQLLDVYAVMLVMLVAIVAIDVYIAKKVLKKVLRKMCSASKKKKQ

SEQ ID NO: 6555 - protein, 246 aa, Asbolus verrucosus
MDLIAESELNSTQFKKLIADQSKEFDLILIECFHPVMYALAGRFKAPVIGVSSLGVLTAGYDVIGNPVHPVLFPDVILGMNTGQLTIWQKIKSVLFNIWSRYYHHNVLVPRSDKLARKYFGNDIPYVGDLERNMSMLFLNVNPLIYPPRANVPMIVEMGQMHIKPVKPLPIVAHPNIKAFVTQGGLQSTEEAISRGVPLVGMPFMGDQPMNVQKLVEIGIAVGVDPVSVTKDELKKAIIEVAENCK

SEQ ID NO: 6556 - protein, 520 aa, Aedes aegypti
MKLCWLLLLSSLCIISVQNVQSAKILGVFPTSSKSHYIVGSALMKALARKGHEVTVISPFPQQKPMKNYRDITTTKVWKAVEPIVTNLLDIAKKNPIESIQSTYDFGHRITNSTLTDPPVVDLIASNETFDLIVLEIFMNDAMIGFCHHFKAPCIGMSTFGASKWTADLVGTPSPPSYVPNAFLGFSDRMSFKERLFNTLMSAMEILVDATIDYPVQNKIYQDAFPGPKPPLAELKKKAISLVLLNNHFSLNYPRPYVTGMIEVGGMHINRVPKPLPDNIQSFMDNATDGVIYFSMGSNIKSKDLPIEKRDAFLKVFSKLKQKVLWKWEDDNLPGKPDNVFVQSWWPQDDILAHPNVKLFITHGGLLSTTESLYHGVPVIGIPVFGDQYLNMAKAERGGYGLSVAYAEISETKLSNAIEAILNDPQFKVNALAISQRYRDQPLTPLELATFWVEYVIRQKGAPHIRTAAMDLSFVQYHNLDVLGLLIGLPIVILHLLVRRVCRKKSSKPSNKNNERKKRN

SEQ ID NO: 6557 - protein, 310 aa, Daphnia pulex
MPVVDRMAQKMLGKNLPAIEEIERHYMSLLIVNTHSSINYQLPLSPAIIQAGGLHCVPPKPLPKDLESFVDGSGDAGFIIVSFGSVLKGVDMPNNFRRIFLSAFARLPQRVLWKWEDQPGENDSIPSNVKLLPWMPQQDLLGHPKIRLFITHGGLFSNQEAVYHGVPFIVMPIFADQPINAQKAHDDGYAIRVDMDSMSEEILFDAIQRILTDPKYAEKMNQVSALARDQMESPLDRAVYWIEYVIRHQGAPHLRIASRKLSLFQRYLYDVLLFVLFSALSFLFLVFYLCRHIICSNGRVKINGQKKKKN

SEQ ID NO: 6558 - protein, 520 aa, Bos taurus
MSKMSMKRLSLLLLLQLTCYFSGGSCGKVLVWPVEFSPWLNIKTILEELVTRGHEVTVLISSASTIPNSSKPSTMKFETFPVSLTKSDYENFMERILEELTYVAKDSFWSYLSTVKNVFWEFFDIALHMCEDAVSNKKLMTKLQESRFDILIADAVGPCGELLAELLKIPFVYSHYTSPGHIIEKKSGRLPFPPSYVPVMFSELSDRMTFLERIKNMLYALYFDLFFMTYKEKKWNQFYSEVLGRPTTLSETMGKAEMWLIRTYWDFSFPRPRLPNVEFVGGLHCKPAKPLPKEMEEFVQSSGENGIVVFSLGSMVSNVSEDRAKVLWRYDGKKPDTLGPNTRLYKWLPQNDLLGHPKTKAFITHGGSNGVYEAIYHGIPMVGTPLFADQADNIARMKSKGTAVRLDLETMSTRDLLNALKEVINNPSYKENVMRLSAIQHDQPMKPLDRAVFWIEFVMRHKGAKHLRPAIHDLTWFQYHSLDVIGFLLACVATAIFVITKCCLFCCLKFAKLGKKEKRD

SEQ ID NO: 6559 - protein, 429 aa, Cryptotermes secundus
MGQKWTYSLLALLLCTGFQSDGAKILGIFPTPSLSHQLVFQAIMKALVARGHEVTVLSTDPLKERLQNYTDVDLSFMYDYVRQRYNFTDYQDVTAFGATLRFTLHTGIACNMHLGSPQIQDFLRVHQGSNRSFDLVFMEMSRYQCYYGLVHHVGSPPVIGIRSVGVTAVTLAAVGNPNNPAYVPDYYLPFSSSMGLLERIHNTAYYVWNRFLFHTVQMPASELVMRYYFGRGPPSVWEAENNVSLVMVNNHWSQSYVLPLLPSVVQLGSIHMQEKPRPLPEDLKKFLDGGTKGVIYFSLGSNVRSETMTEEKKQAFMSTFAELPQRVLWKWETNAMSEVPKNVKLVKWLPQQEVLAHPNVKLFITQGGLQSFQEATHHAVPVIGIPFICDQQHNVRKMVDAGIGVKLDYSTITKDKLVKAITKVLHDPT

SEQ ID NO: 6560 - protein, 238 aa, Notothenia coriiceps
MAARPSVHCRHGRPATRVAGWDAGAGGLEDKYNYFTLNCFKVLWKYSGEKPATLGANTRIYDWIPQNDLLGHPKTRAFITHGGANGIYEAIYHGVPMVGIPLFGDQPHNMVNMKTKGAALSVEFNSMKTEDLRDAVNTVINEKSYKENAMRLSSIFHDRPMSPRDEAVFWIEFTMRNKGAKHLRVQAHELTWYQYHSLDVLALLLAIALFLILLFIKTCSFCFRRCYGRKGKTKRKAE

SEQ ID NO: 6561 - protein, 404 aa, Branchiostoma floridae
PVVDSHWMALAKIGRALVDKGHTVAVVISEDIVEKRHTEWPDFQFEAFQDQGTRARLIELQDRDFSTAGKLSFFEKGKAFVAWAGELAKHCGLLLGDGKLEHRLRASQYSVVIFHPLFPCGAILSARLHIRVPHIAVMRKDNYCIDEKGTGVPTPPSYVPSLLADFTDDMTFGQRVQNSALSTLLPILLRHFGGRAFDGLVRTYVGEEETIQSVTSRTDLWLYQTDNVLDFPRPSMPNMVQVGGLNVRVAAPLTENMDAFVQSSGDDGVIVVSFGSMIKTMSAERQEVFAAAFARLRQKVVWRYVGEKPTGLGNNTRLLAWLPQNDLLAHPKIRAFITHAGSNGLYEALHHGVPMVCLPLVSDQPGNAARVVARGLGVRLDFSTVTSDQLYQAILHVVTNTRYS

SEQ ID NO: 6562 - protein, 522 aa, Drosophila mojavensis
MLGIRYLLIVTFTCQALAADILMATMGGTKSHKIPFWELAKGLISRGHNITFLSGFPADFHIDGLHEVTPASLVEYIQNYTNWDLLGARMNGEMPIKPWDGLRYAFESCDAMLGDAETKDLANRTFDLAILDGAYPECLQGLTHLYKIPFMYINTVGFYTGSLSLAGNPASYAITPNFYSSFTDQMSLYERALNTGMQIGQNILHSYVMRRTHRIMRDHLGAHIPHPYDMSRNVSFILQNGHAVVSYPRALNPNVAEVACIHCKPARPLPKDLDDFISASGASGFIYVSMGSSVKAANMPESLRRMLVKTFARLPYNVLWKYEGSAADMQDLTPNVKLSRWLPQQDILGHSQLRAFITHGGLLSMFETVYHGVPVVTMPVFCDHDVNSAKAEVDGYAIKLDLETLSTNQLYKSIMKVIHDPRYRNAARYRQNLLLDQRSTALDTAIYWTEYVLRHNGAYHLQTPARNMSWWQYYLLDVVGLYLLALCALILILRRLDIRSEKVRNPHYPNLIPPTKKKSKKL

SEQ ID NO: 6563 - protein, 839 aa, Caenorhabditis brenneri
MSSLFSSHCRNVMSKRKLIKELKNEMFDLAITEPFDACAYALFEAISIRAHVAVYSCIRLDHVSEIIGQPVPLSYVPGMQSSFGEKMNIWERYMNYFQFKGSSFIFQTIGDKGYEAAKEFYPNIRSWREVVPEASFIFTNSIPYLDFPSPTFDKMIPIGGFTVKTDKKSLVLEEKWSKILNQRRTNVLISFGTNARSVEMPEEYKKSLLEVFKSMPNTTFIWKYENPEDPFIKDIENVYLSSWLPQNELLADPRLTVFITHGGLASVMELAMMGKPAVMTYGILKTDNSKVFSYKKNAERLAEILHNQPTKPLETLVKYVEFAARMDKLVLFTILLLFPIKSESFKILVYTNLFGHSHVKALGKVADALTDAGHNVTVLMPIMERRFINETCLKSTKNVIFIEQDDHSKQLIEKWSNRSSVWTSGGITPLNVFKKATVISNLFGAHCKNVMSQTKLIEELKTEYFDLAITEPFDTCAYAFLEAISIRAHVAVYSCSRLDHVSEIIGQPVPPSYVSGMYSPYGERMNIWERLENYFVFKARSYMFQAIGDRNYEEARKFYPGIRSWREVLPEASFIFTNSIPYLDFPSPTFDKIIPIGGYTVKIEKKFLKLDEKWNEILDKRKTNVLISFGTNAKSDEMPEKYKKSLLEVFKSMPNTTFIWKYENPEDPFIKDIENVYLSSWLPQNELLADHRLTAFITHGGLASVMELAMMGKPAITIPVAADQTRNAEMLRRHGGSIHLRKFDLANSDLVKGAIEKVVNDKRRVFFSLKQFPRHEFFQALPCHTNNYKKNAERLAEILENQPTKPLETLVKHVEFAARSVGITDNRLKCFDSDSENYR

SEQ ID NO: 6564 - protein, 694 aa, Echinops telfairi
MLNKIFLLLFLQLSILGTTHGGKILIWPVEGSHWLNIQIIIDELIKKEHNVTVLVASGALFITPTSKSSLTFEIYKVPFGKDRIEEVIKNFVLTWLTHRPSPATIWRFYQEMAVVIQDFHTVCREICDSVLQNPKLMERLKKGNFEVLISDPVFPCGDIIALKLGIPFMYSLRFSPASTVEKHCGKVPYPPSYVPAVLSELTDQMSFADRIRNFISYHLQDYMFDTLWSSWDSYYSKALDGSHWLNIKIILEELIKRNHSVTVLASSATLFINSKMDSPVNFEVIPVSFKKRHIDALIEHMIMLWIDHRPTPLTLWAFYKELGKLLDTFFQINIQICEGVLNNPKLMTKLQKGGFDVLVADPVTICGDLVALKLGIPFMYTLRFSPASTVERHCGKIPAPTSYVPAALSELTDQMTFGERVKNTLSYPLQDYIFQSYWGEWNSYYSKVLGKPTTLCETMGKAEIWLIRTYWDFEFPRPYLPNFEFVGGLHCKPAKPLPKVLWRYKGQKPATLGANTRLYDWIPQNDLLGHPKTKAFITHGGTNGLYEAIYHGIPMVGVPMFADQPDNIAHMKAKGAAVDVNMNTMTSADLLNALKAVINDPSYKENAMRLSAIHHDQPVKPLDRAVFWIEFVMRHKGAKHLRPAAHDLTWLQYHSLDVIGFLLVCVATALFLVTKCCLFSCKKLGKRGKKKKRE

SEQ ID NO: 6565 - protein, 240 aa, Otolemur garnettii
MGPKELLTKIPEVVVGWSKCRGAADAVIQKGHKGLRILKVLWRYTGTRPSNLAKNTILVKWLPQNDLLGHPKTRAFITHAGSHGIYEGICNAVPMVMMPLLSDQMDNAKRMETKGAGVTLNVLDMTSADLENALKAVINDKSYKENIMRLSSLHKDRPMEPLDLAVFWVEFVMRHKGAPHLRPAAHDLTWYQYHSLDVIGFLLATVLTVAFIAFKCCAYGCRKCFGKKGRVKKAHKSKVH

SEQ ID NO: 6566 - protein, 496 aa, Saccoglossus kowalevskii
MARSQMTSHELLLLTLMCVLVGSVSCYKILILPGLPFGSHFLYFAKLGEHLKSKGHDVTMLLGENNNVLNKIPHIVDSLYFEKYTTAMDNKLMTKLDKVRTKSLNGDFNPMDMMILNNALVEDCVLLLENQELFQRLQRKKFDIILIDNFASCTILMSQKLDLPFVIVSTNRPIIMMDAYYLNMPSPIAYAPSMMSELSDNMNFGQRLSNLIYRIIGHSMYGLLFLAPYDELKLKYDIKPEMDMMTSSGKSEITLFAVDWALEFSRPIMPNTIFLGGLLASPSSPLTNEWAEFMESARHGVVIFSFGSMVDLALCPEKAELVCAELSRLPQKVIMKYNGPPPTTLGNNTKLTKWMPQNDLLGHPNTKAFVTHGGMNGVYEAIYHAVPMVGFPLYGDHYETFSRVSSKGMAVILNISTLTSDELYDAVIKVINTPSYKENAKKISAIHKDKPMSASDTVVFWIEYVIKHGGQHLRTEAFNLSFVEYFLIDIAVFLIL

SEQ ID NO: 6567 - protein, 246 aa, Saccoglossus kowalevskii
EWTEFVESAVEGIVVFTLGSQANIGEDLEKATKFVKAFARLPQKVIMKYEGNPPNGLGENTKLSSWIPQNDLLAHPNTKAFISHGGINGVNEAIYHAVPFIGMALFAEQLENVERLVNKGMAISLDSKSFTEDDVYNAVKKAIEDPRYKDNAARLSSIQRDTPMPPGDTAVYWVEHILKFGGDHLKPSSLELNLVQYLLLDIAVFLLIVVAIVIIIAKLVMKQIFKICCKLTDVKLNRKKNSDKIN

SEQ ID NO: 6568 - protein, 524 aa, Bombyx mori
MKSIALYFLLSIFGVESARILGVFPMPSISHQVVFRALSMELARRGHELVIITTDPALPKNRPKDNITEIDISRSYQLLRKFDEYAEKTQPIQKRGVISGVEIMISEHAAGAMFMLMAEVFNSEEVNQLLQDKNQKFDLIISEAIMSFHLIIGKIFNAPVILFSSLYGLPETFETVGAVTRHPILYPHLFRNKFTDLTLFEKIREVYYEARLTLLYWGLQNAENNYLKSRFGENAPTVQQLRENVCMVFLNSFPLFDNNRPVPPNVVYLGALHLQPVKELPEDLKTYLDNSKRGVVYASLGTNVRASAMSKEFLETFIKAFEALPYDILWKIDGDDIKAFPKNVRVQKWFPQRDLLVHPNIVAFVTQGGLQSTDEAIDAGVPLVGIPLIADQWYNVNKYKELGIGISLDSFTVNAEELAQAVKTVATDKSFKNNIAKIKTLMHDQPLKPLERAVWWTEHVLRNGGSKHLRSPAANMNYSEYLMLDVVLALLFLFFTVISILALIAYKLFGILKKMTFSGKLKSS

SEQ ID NO: 6569 - protein, 540 aa, Drosophila simulans
MFPPGRWLLPMFWLISNAICGIRSYRILVIAPFESHSQCMLVTPYIQALKDRGHQLTVIHAYKHCMHKIEDVTFIRVWYNNNAYADFEESVAIDSVASKWEEISTISKVMVNATLNVLNNAEVRALMRSGITFDAVVLEAGYSDVLYGMAAHFSAQLIGICTCVADWNINNLVGFSTSTLTEPIMPFGVKSVKNVWDRIYNWFYTTEEWLLMNLVFLPKQRLIHDHFFGHLEKSFQEIRQDFALMLLNQHFSLFRARPNVPGMVEVAGLHIPKEDPQLPSDLQVFIDEAEHGVILFSLGLEQDSKDLPRKTQEILVETFKSVPQRVIWKFDGEPTMSLGSDIYHSKLLPQQAILAHPNVKLFISHCGMISVIEAAYYAKPVLGLPSFFDQFRNLEIMKEEGAALQLNINSLTVKELKDAVHSMINEPEYRESALAISQRFRDQPMHPLDTAIYWTEYIIRYKGANHMKVSQSQLKLFDYYSLDNFIMVVSRLSLVVALVFLALSKSRRWLNHFSTSAKPFLPDDIQHNRKEYLSNFSANI

SEQ ID NO: 6570 - protein, 509 aa, Zygaena filipendulae
MNLIVLTALFCLHSVAAYRILSVLPTVTKSHYAPQGKLIRGLLERGHEVVSISPYEEKDVTANYTWVHVEIGSLVEAVPDLHKTSMVKLSFFDRQKIVWDSLWKYVNHIVKLPKLKNFIENDQSHFDIVIAEEFFQPIFFVFSHKYNAPLIIMSSFGSGHFINQYMGDALELSYVPHEFTNIFGYLNLYERARNVINTVYDIIGREIYVVRKQNAIVRDVFKDVQDVPYLGDLERNASLMFLNSHYSLSTVKPSLPNIVEIGGIHMDKVKPLSKEIQNVLDGATDGAILFSFGSVMELSKQSSEMVAKIMETLGKFKQRVLLKWNGENDIPNKPKNVYPFSWLPQNDILAHPKVVLFVTHGGLLSAMETVYHGVPVVCLPFYGDQHRNCDRGVKMGYGLLVELEKIDTDLHKSMERVLSDPSFRSNIKSLSERFRDRQNPVLDTAVYWVEYCARHRGMPFMSSPKRRLYWFQYYFIDVIVFTLTTLWLAVKICAKIVARLKGLVKVKTS

SEQ ID NO: 6571 - protein, 522 aa, Musca domestica
MNRSGYLISIVFVLSAIVVIPNESARILSVFPSPSLSHLFIHLSVAETLARDGHNVTVIATTPNPYKNLDIEYIYLKEPMFDAEFARKMVNKSSPIYVKLAHHFNLVLDMTNNTLNNPLMQKFLSEHKAGDFDLLVLGYAMNDYILGLGAHFQCPVVLSFMVQTVFTTNALVGNPSEASYVPSLFVGLKQPMDFGTRVKSFLASIYENFVFKSFLSWKGQRYYRYNFPADRYPPLEEVYKNVSLVLTNHHFSQGPIRPNVPALIEIGGIQIKEKPDPLPKEIADIMDSAENGVIYFSLGTNVQGSNLSPEKAKMIFNVLSQLPYTVLMKWGDKAFPGQAKNIIYKSWLPQDDILAHPKVKLFITHGGQGSVVESQYHGVPMVGIPFFGDQHSNMANVRSSGFGLSLKYATLTEEELRSTVLEVLNNPKYRENVQTFSKLYRDRPMTPRQLVRYWVDYVIRHNGAKHMQSPAVHMTWWQIQSLDVIGFLLVVVLGVVGVFVGLCKFLCCKGKKKSVNLKKKNK

SEQ ID NO: 6572 - protein, 527 aa, Stomoxys calcitrans
MLFIHKPCLLLWLCVIQLLFVVDAARILVVVPAPSKSHLMIHASVAETLAADGHNVTMIAVFPDVLKNTHFSKYIHIEGKPFDQSFTAEMVNKPQPFYKKMAPMMTLIFDHAHETINSPKMQEFLQTHGPGDFDLLILGYFMNDFMLGLGAHFQCPVVISFMIQPVGPINDMVRNPFEVAYVPSLAMDVRPPMNFGGRLKNFLAIGFERIVMGGLMSYKNKQFYSYNFPADRYPPLEEVYKNVSLILTNHHFSQGPIRPNVPALIEIGGIQIKEQPDPLPAELAKILDNAKEGVIYFSFGSNVQGSHLSKEKAKIMFDVLSKLPHTVLMKWGDSHFPGQAPNIIYKSWLPQDDILAHPNVKLFITHGGQGSVVESQYHGVPMVGIPFFGDQPANMAAVEKAGFGLALQYTQLTEVDFRNTILEVLNNPQYRENVQRFSKLYRDRPMTPRQMVRFWVDYVIRHKGAYHMQSPAVHMTWWQLHSLDVIAFLMAVTFGVFGLLVGLCRCLCCRGGKKATAKTVNKSKKNK

SEQ ID NO: 6573 - protein, 488 aa, Ceratosolen solmsi
MDISKYIILLLVCSFHIQNSYGKFKILAIMPFNGKSHFFVSDVLFEALAQRGNDVTVLSHFPKKTPVKNYHDISMSMEDDAGIHKINMEHVTSTFPFFTLKEMFNTDCFLGFVHKFQASLIFIRTSTLPIWLSERTGNPENPSYIPGTTSGNPSRMSFLQRLDNIIYYINYKLLYWFYNKRCEAVAREHFGDDMPNLLDIARNASFYLINSYFVHQYPKPLLPNTKEIAGMHVKEPKKLPQDLENWISGATHGLIYFNLGSMLRISTMAEDKRLAFLESFAQLPHRVLMKWEEKENTADIPDNVKLTTWSPQNDVLHHPNVKLFITHGGMLGTVEAVHAGVPMIAIPFYGDQLTNVVLLEERGLGIALRYKDISFETINRTLHKVLYDPGYARRAKDMSAAFRDRPISPLDEAIHWVEYVARHKGTAAESLLQSPAHELAFYQYLLLDVLAVLLLGLLIIFFSVCLVGRFLTRVMAVRCRGTSEKKTK

SEQ ID NO: 6574 - protein, 399 aa, Drosophila grimshawi
MGLSLTQSLLKEHSVQSLLSQNRTFDAVICEVFMNEAHFGFAEHFNAPLITFSTLGASSWTTDLVGSPSPPSYVPHFLLQFGDHMNFFERAHNLLFILYQGAYEQYVYLPKQEQLYKKYFPNNKQNFYDMRKNTALVLLNNHVSLGFPRPYAPNMIEVGGMHINRKCQQLPRDIVDFIQGAQHGVIYFSLGSYIKSSSLPLEMREALVETLRNLKQRVLWKFEELNLPGKPDNVFISDWFPQDDILAHEKVILFITHGGLLSTTESIYHGKPVLGIPFFGDQFMNMARAQQSGYGLTLRFTELTAETFKNSINKLLSDPSYTQKVHDMSVRFRDQHETPLERAVYWVEHVTRQKGARYLRSASQDLNFIQYYNLDVLIMIIGGLGFIIVGFLKRKKVMH

SEQ ID NO: 6575 - protein, 520 aa, Bombyx mori
MMPLWILVVLLTFSYSGAHKILVVFPLPEQSHGILGARFVRHLLNYGHEVTYITPFIEKYTHPNQQQVDVSRNLKLIPENPVNLSSLISKEVSAPGFTETMNFMNLVAVQTLENENVQKLLKNPNLEFDLVILEWNFSELLAGIAAVFDVPYIWVSNLEPHWLIARLAGESFNPIFNSNILSPYIPPLNLYQRVEELWTQITFHFHMYWYNDRIQRNDYERFFGDIIRMKGRESPLFEELKRNGSFVLGNSHLALGHEMRFPNNYKNVGGYHVDEEVKPLSPKLEKLMNNAADGVIYFSMGSKLKSEDLPVDIKKGLMKMFGELKQTVLWKLDDKSIDPPSNVHIFKRVPQQSLLAHSKCVLFITHGGILSTIEAVHYGVPIIGIPAYGDQFLNIERLVRKDQAKRVDLSHSLVADLKYAIDELLNTKRYNDTAKNNSFIFTHRTVNAGAEIVHWVEHVILTKGAKYLRTENLDLHWYQKLYLDLGLLLISAFLFLTYTCKLFLIFISKTRKVDVKKKKK

SEQ ID NO: 6576 - protein, 496 aa, Branchiostoma floridae
PCGVSHWFTLAKIGQALVRRGHAITVVVPEDIAEKRQTERPDFKFETFRDQGTHALVQEIDGNLHSNQDSETSVYQYANHGINLSKVITKHCDLLLGDVDLMSRLKAAQYSLVIFDPCIPIGAILAAHMGNRVHSIATLRVDHYFLETKATGIPLPLSYVPFWPFDFTDNMTFSQRVQNVVFATLLPMLGRWVASNTYDGLVRKYVSDKDTVQSVVSNTDLWLYQTDHVLDFPGPSMPNMVQIGGLHVDEVSPLPKELEAIVQSAGDDGVIVVSLGTIVKTMSSEKTQIFATAFARLRQKVVWRYTGEKPVGLGNNTMLMEWLPQNDLLGHPKTRAFITHAGINGVYEALHHGVPMVCLPLFFDQPGNAARVVARGLGVKLDLSAITTDQLYEAVTHVLTNNSYRETAARLSRLHRDQPQSPMERAVWWIEHVIKHGGLTHLRARAVELPRYQYYLLDVAAFLLAVCTGVLATVWCSCSLVCRKISCKTEGKLKSQ

SEQ ID NO: 6577 - protein, 414 aa, Drosophila melanogaster
KMAGALKDDRVRDLYLNRDNKFDLVLSGYFMNVYQLGFAKKVKAPVIVVATMPPNQLLNPLIGNPLEIAYVPSISDSVEKGKGMSFRQRLAGYSSSFFFGIFDFVTQRRSKRLYKELFGDDPNMPEYSELVKNTSLIFFASHAPSEGPIRPNVPAAIEIGGIQVKDTPDPLPQNMAEFLGNATDGAILLSLGSNVKGSHINPDTVVKMFNVLSKLKQRVIWKWEDLEKTPGKSDNIFYSKWLPQDDILAHPNIKLFINHAGKGGITEAQYHGKPMLSLPVFGDQPGNADVMVKQGFGLTQSLLSLEEQPFKEAILEILSNPQYFDKVASFSSLYRDRPMSARESVIYWTEYVIRHHGAAHLQSPLVHMSFIAANNIDIYALIAVVLVILVLLLKLLLQFIYRKIFAKPKKEKKH

SEQ ID NO: 6578 - protein, 520 aa, Culex quinquefasciatus
MCITANIVVVLLSVLVGPTLGANILCLTPVPSPSHHIWNRAWMEALTARGHNLTIVSADVEQAANPNMTYIHLEQAYSFLAEALDLDEMANANAFGGARSVYAWGFGMCKGVLSSRGMDQIMSYPDSFRVDLVVADVTLGPCMFGLLRKFGNPPVVGVTAYNNPSFTTDFVGGHKHPSYVPYVMLNYDHDMSFFERMYNYIVYSYDHYYRHNVYLPKIDEMMHQYYKSENMESAFDLEKRIMLLLANYHFSVDFPESVPPNHVPVGGLQVRTKPKQLPVDLKTFIEAGQKGSVLFSLGTNVQSSGLGKSTIRMFLDVFRQFPQYNFLWKFETEIECDLPNNVMLKKFLPQNDILAQSNIRAFITHGGMLSTHEATWHGVPMVGIPFIADQYRNLYKSVRAGVAIKLDHSALTAEKVRTALVDILENPSYRQNMKQRSALFRDQPELPLNRAVWWIEWALRHPNCKSIQSPSKWMSSWTSDLYDVKCTLLFGFIVVVWVLKSALMKILSTKTRKLSDKKRQ

SEQ ID NO: 6579 - protein, 483 aa, Ictidomys tridecemlineatus
MFNKILLLSLQISLLGTTLGGNILIWPMEGSHWLNIKIIIDELITKQHNVTVLVASGALFITPSVSPSLKFERYKVPFSKETVEGVIKNFVLTWLEHRPSPSTLWRFYQEMTKVIEDFHMVSRDICDGVLKNEKLMEKLKRGNFEVLVSDPVFPCGDIVALKLGIPFIYSLRFSPASTVEKHCGKVPYPPSYVPAILSELSDRMSFADRVRNFISYHLQDYMFETLWKSWDSYYSNALGRPTTLCETMGKAEIWLIRTYWDFEFPRPYLPNFEFVGGLHCKPAKPLPKVLWRYQGKKPATLGANTRIFDWLPQNDLLGHPKTKAFITHGGTNGIYEAIYHGIPMVGIPMFADQPDNIAHMRAKGAAVEVNFNTMTSADLLSALRTVINDPSYKENAMRLSRIHHDQPIKPLDRAVFWIEFVMRHKGAKHLRPASHDLTWFQYHSLDVIGFLLACATTVIFMVTKCCMFSFKKIGKTGKKKKRE

SEQ ID NO: 6580 - protein, 519 aa, Aedes aegypti
MSRCVFLLLTVICSFTHAANILYIDGVASPSHFIWHKALINGLAAKGHNVTALSVDVEENAPMNVSYIKMEGVYESLFEEDGMESDFFEIGQMNPFSVLAMFNEYATIGCKLTLKTAGLRQLLEYPREFKFDLIISDYLNGPCISAVAQHKFGRPPYIAATAFHGLTTTNMMSGAFSYSASVPNHEFNTPQSMGYCQRFMNFLYNHWEELLKIYNMYPKVDKIVRKEFPDIPYVGDLDRDTRIILLNSNPVIQYSEASMPNVISVGGMQIVKPKELPEDLKKLVDNAKNGAILFSLGTNVRSDMLGDKRIIEILNAMSQFPEYQFLWKFESDAMPIEVPKNVYIRKWMPQNDLLAHPNLKLFITHSGLLSTQEAIYNGVPIIGFPVFADQHQNINYCMEQGVGKRLSIKNVKSSELVNAIRELMTDDSYRENMSRLSKIFRDQKEPPLERAIWWVEWVLRHPTSKILQSNAVRLDWFVKYSFDVIVPLVLAGLIVLSIPIKIMRYVMCRKQGQVKTKRE

SEQ ID NO: 6581 - protein, 544 aa, Papilio polytes
MGSRWPVFWLPILLAASVCGSDILMITMGGTKSHKMPFWELARGMIRRGHNITLISAFPPDFHIPGLEEIAPEGLASYVRGYMTFDLVGARMRGEEPLPLYDILRYGYEACEAFLDDFETRSFLRSGRTYDLIILDGAYPECALGVVYRLKVPFMYINTVGFYSGPASMSGSPAPFSVTPFFGRAFTDNMGFVDRALNSAWLVGSLFAHGFSMTILQGVLRRHFGQQIPHVYDMAKNVSFVLQNGHFSVSYPRPYLPNVAEVACIHCKEPKKLNADIEDWIAGAGEAGFVYVSMGSSVRTNKMPLAAHHMIVKALGRLPQRVLWKQDAEQNLTDIPSNVRLYKWLPQQDLLGHPRIKAFVTHGGLLSMFETVYHGVPIVSIPVFCDHEANAAKAEVDGYAKILDLQYLTSDKLYRAIKEVIVEPKYKIEVKKRQILLRDQKETPLERAIYWTEYVIRHKGAYHLLSPAKDLNFFQYYLLDVAFAFFILLITISVLIAFVIRRSFNWLVDYLQSRRMDKLLDNSSDLLKSSKQLIDSNTIVKKNL

SEQ ID NO: 6582 - protein, 522 aa, Camelus bactrianus
MGEQRVLLLVGFLLPGLLLSEAAKILTVSLLDGSHYFLLERVSQILQDHGHNVTMLVNTGPILDPDLKKKGKSFQVISWFLSEDDVNELRKRFHFFVTEALHGREALVNLVRIIEHLGTRCSYLLRSDIMDSLKNENFDLMVVEAFDFCSFLIAEKLEKRFVSVLPTPFGSADIGLPSAVSYVPVHFSYLTSPLDFWGRVQNFLLSFHFSMRQWQMHSAFDKTIKEHFPEGSRPVLSHLLKKAELWFVNSDFAFEYARPLLPNTVYIGGLLAKPIKPVPQELENFITKFGDSGFVLVALGSMVNDCQPDEVLKEMNAAFACLPQGVIWNYKASHWPKDIKLAANVKLMDWLPQNDLLGHPRICLFVTHGGMNSVMEAIQHGVPMVGIPILEDQHENMLRVEARNFGVSIQLKQLKAETLVLKMKQVMEDKRYKPPVVAASIIRRSHPLTPAQRLVGWIDHILQTGGAAHLKPHALQQPWYEQYLLDVLLFLLVATLGTAWLCGKLLGLVARWLCGSRKLKKA

SEQ ID NO: 6583 - protein, 352 aa, Trichoplax adhaerens
DLLLVDITSVCSGIVDGILNISKVIAYSPAGFIDPSLSRLFHIPASPSYVPTVIVDYSNKMTFFQRLHNSLTYVAMVILRSAFDPSVQAMYEKLVNSSFKSYGQLRPSMLIVSTDFAIDYPRPITPATKVVGALLPHAPLKLPQELSDFAELLHNDSQDFAIVSFGTLVSKAMDNIIDFQAIGRVLSRLPMKVIWKYHHQIDDLGDNVKVVSWFPQNDLLAHRNCKLFVTHCGLNSMYESAYHGVPMVAVPLFADQPSNAQRIKSAGIGEIVLFKELNEQSLNDAILKVYKNPEMATKCSTISNIMRDRPGNRTPVEEVGDWIEFAIRHDGGRHLNLAASQLRWYELYMIDV

SEQ ID NO: 6584 - protein, 228 aa, Zootermopsis nevadensis
MGSNLQSSELPESIRKAFLEAFSKFKQRVLWKWETDSLPGQPKNVRLGKWLPQSDILAHPNVRLFITHGGLLSMQEAIYRGVPLLGVPIFGDQGLNMGRAVSAGYGLKIDFVNVTTESLTWAIREIIETPTYRENAQRLSRIYRDQPLTPLDQAVFWTEYVIRHKGAPHMRSASLDLAWYQYFLIAVLTLAAVSSVIGVFLILRSIVRKICSGRRQDTDDLLRQKKRS

SEQ ID NO: 6585 - protein, 523 aa, Drosophila yakuba
MLQKIALYLIIWSCNTLAADILMATQGGTKSHKIPFWELAKGLISRGHNITFLSGFPADFNIEGLHEVAPAGLVEYIHNYTNWDLLGSRMAGEMPIKPWDGLRYAFESCDAMFRDSKTMELTTKSFDLAILDGAFPECFLGLIYDLRIPFMYINTVGFYTGSISTAGNPVSYAITPNFYSRFTDTMNLYERAINTAMQIGQTIMHMYVMRRTHLVMREHLGAQIPHPYEMSRNVSFILQNGHAVLSYPRALNPNVAEVACIHCRPARKLPRHLEDFIGASGSSGFIYVSMGSSVKAANMPEALRHMLVKTFARLPYHVLWKYEGSSDIKDITSNVKLSQWLPQQDILGHPKIRAFVTHGGLLSMFETVFHGVPVVTMPVFCDHDVNSAKAEIDGYAIKLDLQTLSANQLYKAIMKVIHDPHYKNSARYRQKLFLDQRSTALDTAIYWTEYVLRHNGAYHLQSPSRNMTWWQYYLLDVVAVYFILFYGLILALKRMDFRSEKVRNLHFLMAPLFTIAKSKSKKI

SEQ ID NO: 6586 - protein, 462 aa, Asbolus verrucosus
MKLVLFIVINLLFLHIKCAKILGVFPAPGYSQFILAEVLMKELANRGHQVTVISPYSPKNATENYRTIEVTDVLSSGDQFDLFELERKNLFTNIMTTYKFGNFMTEVTLSSKKVQDLLHSHETFDLVIIEQFFNDAMKGFAIHFNAPLVLFSSMGITEWNNYVMGSPFIPAINAISYTSYTNFMNFSQRFRNLYGTVFNYFYRNLFAYPLQKEYLQKYFPTFMDFDQIVCNASLMLLNSHITTSENSLLPYNMIEIGGFHIVQNPLSKEVQEYLDSAHDGAILFSLGSNLKSSDLSEETLNGIFKVFSKLKQKILWKFERDFPNKPENIFIFKWLKQSDILAHPNTQLFITHGGLLSTTEAIFYGIPMVGIPIFADQKMNMARASRSGIAKMLPFQELSEETLSAAINETINDTRYQENVRRMSNIMRDRVVRPLDLAMYWIEYKQILEELRSEFFNILMQI

SEQ ID NO: 6587 - protein, 529 aa, Branchiostoma floridae
MDVGSKSSTVLLFFLGLLVRHIISGENVLLVPTPCAESHWFTLVNIGQALVRRGHVVTVVVPEDIAEKRRAGRPEFKFETFREQGTFVSLKEAEDNHHSNTKSGTSILQYAQGFINVTNVITKHCDLLLGDIDLMSRLKAAQHRLVVYDSCIPVGAILAAHKDVQVPSIAMLRGDHYFLDIKATGVPLPLSYVPFVGFDFTDHMTFVQRIQNVVFYTLLPMLGRWLASNTYDGLVSKYVGKNETIQSVVSNTDLWLYQTDHVLDFPGPSMPNMVRIGGLHVGAATPLPKELEVFVHSAGEEGVIVVSLGSIIKTMSSEKRQVFAAAFARLRQKVVWRYTGEKPAGLGNNTKLVAWLPQNDLLGHPRTRAFITHAGIRGVYEALHHGVPMVCLPLFSDQPGNAARVVARGLGVKLNLRTVTTDQLYKAIIHILTNSSYRETAARLSRLYRDQPQSPMERAVWWIEHVIKHGKLPHLRARAVELPWYQYYLLDVTAFLLAVCAAVLGTVWYGCSFVCGKITCKTGVKLKHQ

SEQ ID NO: 6588 - protein, 527 aa, Osmia bicornis
MKLNVAVVLCVVCAVCVLEETRGARILAVVPTPSYSHQIPYRKLWTELHKRGHDVVLVTANPIANMTSKNFTQIDISSGYKDLQALNFLKLRFEGVSWITFAESYLFDLSYTFAESVLNNTEVRRLCAPGSKEKFDVVLTELLYMHSVPALAYRFDAPLIGLSSLGLVAIQEHDLGGFILPSHEYTWEMEANTGPNLSFWRRLWNYVSLWRITYSMYRDIPRHQEMAEHYLGMRLPPLTDITRNASLLFVNQADALTPARPKLPNMITFTSFHVNENPAPLPKDLQSFLAEAKDGFIYFSLGSNARSADIPMAVQQVFFDVFAKLPYKVVWKYENDLPVKLDNVYASKWLPQQSILAHPNIKLFIYQGGLQSTEEAVNFAVPLLGFPILADQDYQVARIDTLRVGKRMEILTVTREELDGAIREIITNKEYKERMLHLRDLIRDNPYDLIDNLVWWTEYVIRHKGAPHLRSTLAGQPWYQRYDIDVVMFLTIVVFVIASKLVNIVATLAVHLYKRFLSSAVQKQKKS

SEQ ID NO: 6589 - protein, 1061 aa, Caenorhabditis remanei
MKPTTISSLIFLFLLEAVTSYKVLVFNPAFGASHSNFLGKISDILIDAGHEVTMLIPISMESKKDLIGSKKVKKVIRIDQEPRSRKMQEEAKTEDMIKKQIWKLDADITIFVSMIKNFSLASGYQCEHIFQQTAILEELKNEHFDLGITESLFICGFPLLDHIGVKTVINADSVLYLDVVKYALGEPASTSFYPGVFSRNIDKMSFSERTRNLFGMAFSWYFSWTRFQGELEAIKPYYKKSLTWEEHINGAAFYLINSNRYLDYASPTLPKTVFIGGMQVNTKKNGKVQLDREWDDLLNIRKQNVLVSFGSNAFSCNMPDEFKKSFLEVFASMPDVTFIWKYEEENATLADHLPNVKLTTWMPQNDLLADDRLTLFVTHGGLGSSIELAYQGKPAVVIPLMADQPRNAHMLTRHGGAFQLDKSQLDKPEVIRNAIQTVMNDDNYKRNSEKLAEILSSQPYQPKDVVLKHCDFAVKFGDLKTLNSEGRNLNVFQYYSIDIAVAAISLILTVLVVIVLVFSCIFRKCSRSFFNGKIFDLSSAYKVLVFNPAFGASHSNFLGKISDILINAGHEVTMLIPISMQSKKHLVGSKKVKKIIRIDQDPRSVELYKESGAEDVLRNKIWKIDSDMMVFFQMASNFSKNCGYQSSDVFQQTEILEKLKNEKFDLGITESLFICGYPLFDHLGIKTVINADSVLFMDIVKNILGEPASSTFYPALISPMTDKMSLMERIKNMIQMLVPMYFSKMRFDEELKMIKPYYNGTNTWREHLEGVAFNMVNSNRYLDYASPTLPKTVFIGGMQVNTKKNGKVQLDKEWDNLLNIRKQNVLVSFGSNAFSCDMPDEFKKSFLEAALTDWFASMPDVTFIWKYEEENATLADHLPNVKLTTWMPQNDLLADDRLTLFVTHGGLGSSIELAYQGKPAVVIPLMADQPRNAHMLTRHGGAVQLDKNNLANSDLIRNAIKLILENTSYKKNSEKLAKILEEQPYSPAEVVLKHCDFAVKFGALETLQSEGRNLNLLQFYSYDIFVVFCLCLVFVLTFMILIVKSTVKFCRKSGNIKLKNE

SEQ ID NO: 6590 - protein, 517 aa, Papilio polytes
MSFIKVFIIIAVITSCFAYNILLVSPLPSGSHGILGDAFIRIFTNAGHKVTFISSMTKLTSSPNVTVINVAANIKTFPDDLLNIKAIMDQQSDMRDDDLFFPVMDNLSLVTMQMKEVQELLNDETQSFDVVIAEWMYNEIYAGLSTLYNCPLIWFSSLEPHWLFLRVIDEAPNPAYNSDSMSANVIPYTFSQRVEELWLQISRSFYREIWTYKDTEDVFNEIYTPLLTKRGRPVPKYNEVRYNGALTLGNSHAILGQATRLPQNYKPIGGFHIEENVKPLPEKLKQIMDDAKHGVIYFSMGSNLRSTDWPLEIKKKLLKVFGELKQTVIWKFEETLSDLPSNVYIVKWAPQQSILAHPNCVLFITHCGLLSTTEAIYFGVPTVGIPVFVDQFVNAERAVRKGFGKKVSLSYSLVDDLKVALKDVLSNSRYRDKAKELSAIYHDRILKPHEEIVHWVEHVIRSNGATYLRSPALMLPWYQKLYLDLLAIIFSITITAAVIMKCLVTMIQRKFSKTKTD

SEQ ID NO: 6591 - protein, 520 aa, Daphnia pulex
MKFQSLNTLVLLLSAIVVENCMAAKIVVLYPVGSKSHFYAVMPVIEELGERGHNVTVFSPFKGITKNATNVHEIIMTSVAKELDTMEIDWFAMQKEGATQILTMMQTMIALSTLGCEDLLSNTEFRRIVEKRDVDLFIVDAFGNEFTYPIIDKLAVPFVIHGSSSAFPSTLNAMGAPADYASVPLMLAEYDEQMTFTQRLINTFSGEFMKYFRHFYIFTKLDAIVQREFPGVKSIVELEGDASLYITNTHPVTNWPRSLPPTILSIGALHARPAKQLPPALKTFADEAKDGFIVFTLGSFVSVSTMPKETVDTFIRVFSKLPQRVVWKWEADIPQGVPSNIMMVDWLPQQDLLGHPNARLFITHGGMLGTQETIYHGVPLLGLPFGNDQRANVAKAVKGGWGLKLDWDKIDDNNLYEALTYLINDPSVRKSAKKLSQLMQEEIMPGKDVAAYWIEYVIRHGGTKHLQLASKGMPFCQRHLLDVALLSFVIAIVFLSVSYKLTCALCRCCFKAKSDKIKTN

SEQ ID NO: 6592 - protein, 443 aa, Bradyrhizobium sp.
MKALLVSSPMMGHLHPVLGVGRILIADGWEVMGLTSSYLRNRVEAIGATFRSFVPAADIDTRNAAELFPEIRRAAPGAQQLRLILEQGFADFMLPQYESIETVMREFPPDIIIGDHLMLGVLPMLLGPRAQRPPVALLGTTYLLSRRDDGAPNDAGIPPARNDQQQREYAALFQTYEQSVFGPAGRCVNEYLAQIGSRPLRLNLYDAMVELPDIYLQLTVPRFELSRRRLPGSVHFVGPLPITPNQAPVPSWAYELDGSRKVVLVTQGTLTNNDFSELVLPTVQALANEPDVLVMVTTGGRSIDALSGTLPGNVRVAQYLPFEWALSKADAFVTNGGYGSVNQALSYGVPIVVAGTGGDRGDVSVRIAWSGVGINLATSAPTAEQLRPAVRSVLDDPKYRERAASLADDIRKIDTAAEIRRILREPIATSSQDRPRAKKAARR

SEQ ID NO: 6593 - protein, 514 aa, Bombyx mandarina
MIKWILFLCVTLLLCTCDAYKVLVVFSMPGKSHSILGYGIVKHLLKRGHEVTYITPFPVDNTDPKLKQIDVSSNIDILPKTSLNLNVILEGKVPKVDHGGIHLVMNAVEMNTYNNENVSRLINDPKQKFDIVIAEWMFTEICASYAAIFNAPLIWVSSFQTHGMVTRLIDEALHPAYNTDVVGRNIPPLNFFQRVQNLWILLRTLYQVKNSGQEDFYNKAIVPVIEKRGLVAQKFEDVQFNGSLVLSNSHLSYAPAVRLPQNYKTVGGFHVEEKVEPLPEDLKKVLDSASTGVIYFSMGSNLKSKEMPDRLRKSLIKLFSGLKYTVIWKFEEEFSGLPKNIHVVKWAPQQSILAHPNCVLFITHGGLLSTIESVHFGVPIITIPVFADQFMNAERSARVGFGKIVYLSYTMADDLKVAIEEIFSNPRYKEIAKETSLVYHDRPVSPGAELVHWVEHVVKTRGALHLRSPALQMPLYQKLYLDLLTVVLVSLIVIYKIVRCLFSRISVTSNKKTN

SEQ ID NO: 6594 - protein, 525 aa, Haemonchus contortus
MSPIVTAVLLFLAINSVDALNILVWTSTIGRSHTNFVGSIADTLKEDGHNVTLLLVEFDSEFISETGTKHVEHIIRYSSPYHNPADWFTLTFKKEQVFNVVLGLNVLDFAKMQLFAYNVCKGILDDSLLIRKLRESRYDIGIFEMFHSCPAGVMELAGIPKTMLVSAIGMGYHHYRLLGMEKQSSFVPATFTIYGGRMTFLGRLCNEVFNALGWLFANICEYSEQNLFNSMFPGFPRLHNLIQDKTDYFLMNTNEFTESTRPTLLSIHHVGGCAISPPRPLSEEFERIVSKGSKGVILFSLGSLVKSSDMPVNVRRAFTKAFQSFPDYVVLWKEDRKFNSTNSNIFYYDWVPQVDLLADGRVKLFITHAGMNSIQEALLFGVPMVTVPLFADQYTNAAVAEERGFSVTLNKLSLSSEDIIKAINTVLGDNGESAYTMRVRQAARLLKGSPEEMRRKVKRLVRISGSEPPLSHLKLDIDHLNHVQYYNIDVYIFFGALFCFSILVFYYLTVWTVQSILFPLKYKSD

SEQ ID NO: 6595 - protein, 1074 aa, Drosophila mojavensis
MATLRLSVVGLCLLLIALPARGANILGLFSSHSQSHLILHMSMIKALAESGHNVTVVTMMKPTIMHEDIHLIVVPLTDEQEHILEGQMKEMAGQKNSLLSTMIRLMSGMSVMIESQFQLLSDPRFQRIYETKFDLMFMGYFINDFQLGVAAKLKVPVIISWMQAPASIINTYVGNPTEISYVPNIQTALGQGEQMGFAKRLENLSKELLVRAMMLILDRRLDRFYETQFGEEPNFPTLAEMKRNVSMLFTNSHLISEGAIRPLVPAIVEIGGIQLKEQPDPLPEDIAKFLEASQHGAILLCLGSNIKSTAVKPELIQAMFKVLSSLRQNVIWKWEDLDNTPGKSANILYKKWLPQPDILAHPKIKLFITHAGKGGITEARYHGVPMVALPIFGDQPANADSMEKSGYGLSQDLLMLNEENFRAKIEEVIGNEKYARAIKSFSKLYRDRPLTAKQSVVYWTDYVLRYNGAVHLQSPAVHMSTLAYFNIDVYAAVLAALTLVVLLTWLALRFTYRKLCRKSQKVKRHALFIQLRSSPQANMSRTKLQLAAYAIILLVLSCRPTDGANILGLFSTFSPSHLVVHMAMMRTLADRGHNVTIVSAMKPKLAPHENITLIMAPFSEETLAEVNQFMESSTKDKVSMIATIYRMLMKTAVMLDSQYKFLLHPNVRAIYERPQTKFDLLFLGFIFNDYQLGVAAKLGIPAVISWVGVPFMHIDDEVGNIYDPAYVPNFNVCVDSSQRAMNFGQRLKNYFTWVILKSSAIILDRRMVNYYNRAFGADLQMPSYWEVRRNISLLFYNYHSHSEGPIRPTVPQSIEVGGVQNKEQPDPLPSELAEFLDNAKDGAIFFSLGTNVKSGYFPPHVMETFFKVLSSLPLRVIWKWDDLQHTPGNASNIYYHNWLPQDDILAHPNTKLFITHAGKGGIAEAQYHGVPMVAMPIFGDQPSNADNMVSAGFGLSVDWTTLTEASLAQTLNEVLQNSSYREKVRSFSALYRDRPLTARQSVVYWTEYVLRHKGAHHLQNPALHLDFVARHNLDLYACLLILLAVSVTILKLLLRCIWQTLRPLAPSKDKVKTQ

SEQ ID NO: 6596 - protein, 437 aa, Haplochromis burtoni
MDLRLSACILLVLCATSCANGGNILVWYTDGSHWINMKPVLETLVDRGHQVTVLVPSSSMYMKTNEPARFHYEPFNASFSLETIEDFLEELLQFVLYELDYMNYWEIFTRSVKYVNTHIQISFQYLDGVVKSEVIMKKLKEGNYDLLLADPVKAGSDLVADILGIPLVLSFRSSPVNNWERHCGQMPAPPSFVPGAMSKLTDKMDFSERVWNFLFYALHDILLHPNRKLVVEDSNECQNKVLWRYKGEKPETLSANTRIYDWIPQNDLLGHPKTRAFITHGGTNGIYEAIYHGVPMVGIPVFSDQPDNMIHMKEKGTAVILNLNFMTAEDLRDAVNTVINDKSYKENAMRLASIHHDRPMSPLEEAVFWIEFTLRNKGAKHLRVQAHELTWYQYLSLDVLGFFFTIVLLLIFIFIKTCSFCLHICCVRRGKTKRKAE

SEQ ID NO: 6597 - protein, 1488 aa, Ooceraea biroi
MRTGISAICIIVILRLLANAERILILTGAPFFSHQVVHRAFNLALHKRGHELVVLTASPLRDPTLKNYTEIDVSDVFLIGVTKDYNDRRWKSSQMESCRQAFMTATEITAKFFDNPEFKKIYRRDNGEKFDAVIVEAISDLSLFAVAHRFKAPLIGIMSLGIHNYQRYIFGSPMLPSHPSTWEINTLVEGNPSFWQRLQNFIDVWSYLYYWTHNNAITEQKRAEEYFGSDTPNVVDIVKNMSILLVNENPALTYARPEQPNVIFFTGFHIQKTPPLLPEDLRQFLDDATEGFIYVSLGTTVSCDNLPTEIVGNFIQVFSKLPYKIVWKYECDELPGKLDNAFISKWFPQQGVLGKIKTHHNIRLFIYQGGLQSTEEAIHYAVPLLGIPIMFEQASRIQRLASLGAAIFLKLNELSKERLNTAIHQILNDKSYKERMAYLSELSKDQPYDSLENAIWWVEYVMRHKGISHLRFSESDKPWYQRYDMDIIGFLAVMTFVAFLISFYTIFRILRFIYHYYQIPCHNFQYSNAKSKIQFLHKRGHELVIVTTAPLKDPTLKNYTKIDVSYGFSIITEYNDAKWKISQMESCRQVFTITTEFMGTIWDNLEFKKIYRRNSGEKFDAIMMEPICDLSLYSMAHRFNAPLIGLTPMGFHNFQRYIFASPMLPSHPSNWEVNTLVEGYPSFWQKLQTFIDVWGYLYAWSHHVVTARKRVEKYFGSDTPDPMDIAKNMSIVLVNENPLFAYVRPEQPNVIYFSGFQIQKTPPTLPKVFWKYECDEFPGKLDNIFISKWFPHQGILAHHNIRLFIYQGGVHSTEEAIHYAVPLLGIPIMFEQASRIQRLASLGAAIFLKLNELSKERLNTAIHQILNDKSYKERMAYLSELSKDQPYDSLENAIWWVEYVMRHKGISHLRFSESDKPWYQRYDMDIIGIVMPNQRYNDICVSQSVYLCDRNNLRSGSFLKHKMRTVISALYVILFQLPLPASAARILILTGAPFFSHQVVHRSFSLALLKRGHELVVVTPSPLKDPTLKNYTEIDMSHIFSRITDYNDARWKISQMESCRQMFMITNEIVANFFTVPEFKKICRKDNNEKFDAVIIEAMSDLSLYVLAHRFNAPLIGILSLGIHNYHRYIFGSPILPSHPSNWEVNTLVEGNLSFWQRLQNFIDVWSYLYYWTHHNAVRNGIEENFESDTPNVIDIVKNMSIFLVNENPLFAYARPEQPNVIFFTGFHIQKTPPLLPEDLRQFLDDATEGFLYVSLGTTVSCRNVPKEIVGNFIQVFSKLRYKIVWKYECDELPGKLDNALMSQWFPQQGILAHPNIRLFIYQGGQQSTEEAVHYAVPLLGIPIIFEQASRIQRLASLGAAILLKLNELNKERLNTAIHQILNDKSYKERMVYLSELSKDQPYDSLENAIWWVEYVMRHKGISHLRFSESDKPWYQRYDMDIIGFLAVVAFVMSLISLYTLFRILRFCCGYYQLYKNIHYPNIKFKMQ

SEQ ID NO: 6598 - protein, 873 aa, Plutella xylostella
MYVGLAYKRSNKMTRVYFVLLILSGSAVFHSVHAARMLCIYPVPFHSHQAVFHVMTEALAAEGHELVVLTPLPHEKPIPNVTEIDVHDISYKLWEDKYGEYQKTHEFTADPVTFWEDAVTPIIHSVVDAQMSSPGMQALINDQNQHFDVILAEAPAPLSIMIAARFDAPIILVSSFFGSDDNFLTIGAPIHPIYFPEYNMQKVGNMSFWERAKQIYTTLRLRWMERVLKEKENAMIRKHFGNDAPTITELKKRVEMLFVNVHPIWDNNRPVPPSVVYMGALHLRDPKPIPEELQSYLDASRNGVVYMSLGSKIRFSDLPAGTMQVFLNVFASLPYDVLIKWNGGELMNKPANVRLEKWLPQNDMLHHPKIKVFLMQGGLQSTDEAIAANVPLIGFPVYVDQFYNAQMFIKLDIGRQLDIQTINEQDLSVHAARMLCIYPVPFHSHQAVFQALSEALARAGHPMSMTFHINSGNTGYGEYQKTHEFTADPVTFWEEAVTPIMHGIVDAQMSSPGMQVLIKDQNQHFDVILVEPVVPLSIMIAARFDAPVILVSSFFGGDDSFLTIGAPIHPIYFPEFNMQRIGNMTFWERVKQIYTTLRLRWMERSFRDKENAMIRKHFGKDAPTMTELMKRVEMLFLNVHPIWDNNRPVPPSVVYMGALHLRDPKPIPKDLQSYLDASKNGVVYMSLGSKIRFSDLPAGTMQVFLNVFASLPYDVLIKWNGGELKNKPANVRLEKWLPQNDMLHHPKIKVFLMQGGLQSTDEAIAANVPLIGFPVFGDQFYNAQMFMKLDIGRQLDIQTINEQDLRQAILDVAENERYRRNIASLSLVLQEQRAGGLQRVVRGAARVAARATRSLRSPLADASLAYKASTVSD

SEQ ID NO: 6599 - protein, 529 aa, Drosophila willistoni
MRLKFRPVFLAVLSLVAVLATPSEGANILGLFSSHSQSHLIIHMSVAKALAKAGHNVTVVSMLEPKVKSKDIHVIVIPVTDEQEAILEDQMKEMASQKNTVFATMNRLLSGMTVMIESQYELLSHPKFQQIYDTKFDLMIMGWFINDFQLGVAAKLKVPVIVDWMNAPMAIIDGYVANPSELSYVPSMFTGVPKGEVMGFRHRLQNYVTDWILTYLFHVFDLRLTGYYNEQFGKETNFPTLAELRRNVSLVFVNCHLISEGPIRPLVPATIQIGGIQIKDTPDPLPKDIEEFLSKSEHGAILLSMGSNIKSSAVKPELNKNMFNVLSKLKQNVIWKWENLDDLPGKSANIFYTKWLPQDDILAHPKTKLFITHAGKGGITEAQYHGVPMVALPIFGDQPGNAEKMQNSGYGLSLDLLTLTEENFGAALREVLENGKYAQEIGQFSVLYRDRPLTARQEVVYWAEYILRHKGAPHLQSPRVHMSTIAAYNLDVYALLITVLIISLLLTTLAFKFVLRKVFGKGSLHESKD

SEQ ID NO: 6600 - protein, 534 aa, Cyphomyrmex costatus
MRLIIGISPIITILWILVTSNLTCSKRLLIITPTPSYSHQIVFRVICLALNKRGHEIVTLTPNILNDTSISNYTEIDFGFIYEKIDDTDMSQTRWNLTQLAGLKTRLLTLGHNIAEDALSHPDLMKYYANRTDMQFDAVIAEMIMTPAIYMLAHRFNAPLIGIMSMDLQNCHRFTLGSPVLPSHSSNWELENLTGLNLTFWRRLLNFINTWWSIHSWFNNFAIKQQKIAEKYFGNNIPHITDVAKNMSLVLINQEPLLAYARPEIPNIVHFSGLHIKKTPPSLPKNLKTFLDSATNGFVYMSLGSNTKSKLLPKKILEIFMNTFANLPYKVLWKFENDSFHVPPNVFISKWTPQQGVLAHPNIKLFIYQGGLQSTEEAVHYAVPLIGIPFVFDQVYQVMKMVSLGVARYLDIVRLTRSELHDAIIEVLDDKGYKDRMLALRDLTKDKPYDSLENVIWWIEFVMRYNGAPHLRFNGVDIAWYQQFDLDVIVFLTITLFLFLCAVLAIVGWASKQLSTHYDIINLYMWFKNKTKLE

SEQ ID NO: 6601 - protein, 445 aa, Loxodonta africana
MSMKRISLLLIQLSCCFNCGTCGKVLVWPTDYSHWINMKTILDELIQRGHEVTVLTSSASILIDPNTPSAIKFEVYPTVLTKDDLEILFVEWIRKLTYDLPKDTFWTYFSQIQEIEREYSDCIQRLCKDVVFNKKLMMKLQQSRFDIVLADTLVPCGRPTTLYETMGKAEIWLIRTYWDFEFPRPFLPHFDFVGGLHCKPANPLPKEIEEFVQSSGKHGVVVFTLGSMVSNVTEERAHTIASALAQIPQKVVWRFDGKKPDNLGPNTRLYKWIPQNDLLGHSKTKAFITHGGTNGIYEAIYHGIPMVGIPLFADQPDNIVRMKAKGAAVSLDLNTMTSTDLLNALKTVINDPSYKENAMRLSAIHHDQPVKALDRAVFWIEFVMRHKGAKHLRPAALSLTWYQYHSLDVIGFLLACVAIVSFLVLKCCLFGYQKYFKTEKKKKRE

SEQ ID NO: 6602 - protein, 543 aa, Tetraodon nigroviridis
MRSATLFTVLLLSLQVKGGVRTENSAGKGNQRPEETETPANDSDAPFLGNLLVVPMDGSHWVDLKALAQELGRRGHRVTVVIPEFSIRMGPGKYYDTVTYPVPYTQADIDSIIAANKDVLEKSTLSFTDKISKRFNQFRKIASFLHSTAESLLFNASVISQLEQQKFDAMLTDPMVPTGSLIARKLGIPVVNLLRGIPCLMDMKAAGCPSPPSYVPRFMTGYTDKMTFRERTINTLIALLEPLMCKLFFWHFDNISHQFLGEKVGIAEVLAESDVWLLRIDMTLELPRPLMPNTILVGGINCNVRDALPEDLLPWVSGEHGFIVFTLGSMVSEMPEEITSVFIEAFRQIPQKVIWRFTGEIGGSIPENVKIMKWVPQNDLLAHPGARAFITHAGSHGLYEGLCHAVPMVMVPVSAEQPDNAEKMASRGAGIVLNILTVTSENIVQALNAVINDTRYKENVKKLSELHKDRPVDPLELSVYWTEFVMRHKGAKHLKPAVHELNWIQYYCLDVLAFLFTILLLVVVLTVKCLKLCFGKLGRKRKQ

SEQ ID NO: 6603 - protein, 505 aa, Caenorhabditis brenneri
MKLVIIFILLILIELTFSYKVLVFNPAFGASHSNFLGKISDILLDAGHDVTMLIPVFMSSKKDLVGSKKITKIIRIDQDRRSKQMHEEANLEEMMKKQIWKLDADNSAFFFMIKNFSLACGYECEPLFDHIGVKTVINADSVLHLDIVKYALGEPASTSFYPGPFSKFIDKMSFFERTRNLLGYAFLWYFSWTRFQAELEAIKPYYNKSLSWEDHINGAAFYLINSNQYLDFASPTLPKTVFIGGMQVNTKKDGKMELEKEWDDLLSLRKENVLVSFGSNAFSSDMPAEFKKAFLEVFASMPDTTFIWKYEEANATLADHLPNVKLTTWMPQNDLLADDRLTLFITHGGLGSSIELAYQGKPSLVIPLTSDQPRNALMLTRHGGALELDKTNLDKPNKILHAIKTILDDPNYRKNAEKLASILSSQPHQPKDVVLKHCDFAVKFGDLKTLNSEGRNLNLLQFYSIDIALAALAVTVSVLLIVASLIRCLFRKIVSLFLNVKIKTE

SEQ ID NO: 6604 - protein, 531 aa, Neodiprion lecontei
MSRQSVWQSVSLILFVTVWEFGNASRILAVFPSASVSHQVVFRGLTLALRERGHELVVVTPNPVRDPNLKNYTEIDVSYIYDPNIKLDLIELRRKMNWAEWICTVADGFHVVSEQIFDHSEFKKIYELGSGERFDLLLMETLYFPAFLSLAKRFDVPIIGMTSLSPALNLQYSIGNPILSTHQSIWDLQRNEMSDPPTFFERLRNFINVWKYIYYFNTEFMPAQHAIAEKYLGIEIPDLGEIERNLSLIFINQQAPISYPRPNVPTVVEIGNFHVSKKSEPISKDLQKTLDESKQGFIYMSLGSNVKSTMLDKKSRSEFIAAFSKLPYTVIWKFEDEFLPGKPDNVIIIKWAPQQAILAHPNLKAFVYQGGLQSTEEAISHGVPVIGFPVMADQDMNVNKMVSLGVGKKLEITDVKRDDLIEAIQSVATDGSYKQKMLNLRELLNDRPHDLLENAIWWTEHVIRHRGASHLHSSTADEPWYQRQDMDIIFVVTAVSLIASTLSLIIAYHLLSYSINAFSHHQLPVKKKKKM

SEQ ID NO: 6605 - protein, 507 aa, Zootermopsis nevadensis
LLVAFLFLSTSFDEAYCANILAVFSVPAPSHMALKSALLTELAAKGHHVTVISSFPEKVSVPNYTDIPVLSQEFVKIGMNDRKVYDFVHQNALMMQIRFWQIAGDMCSEILSDKRVQELIDSTDLHFDVIILEAFFSDCFLPFGYKFKAPIIKFCTFGGTNWMGYWVGNPNPYSYVPDGLLGFSDRMNLWERIINSLCGVFFTLGRQFYFLPRQDKIVKPFFKDVEGLPHLAELDATSTALLLVNSHFSISSPKPLMPNIVQVGGLHIKPPKPLPDDLQVFLDDAPHGVVYFSMGSIWRSCDLPDSTRQTLLVAFSKLKQRVLWKWETDSLPGQPSNVKLGKWMPQSDILAHPNVRLFVTHGGLLSSQEAINRGVPIVGIPIISEQRHNVVRAVLLGFGIKLDFFNISAESVSWALREGLENPRYRENAQRLSRIYRDQPLTPLDQAVFWTEYVIRHKGAPHMRSAALDLAWYQYFLLDIIVALTLALSLLLIVAFFAFRAVARNVF

SEQ ID NO: 6606 - protein, 218 aa, Oryctes borbonicus
MGSSVRAANMPEYLRRMLLCVFKQLPQRVLWKWEADHMPDVPPNVKLSRWLPQQDILGHPKIRAFVTHGGLLSMFETIYHGVPIVTIPVFCDHDSNAAKAHLDGYAIQLDLATLTADNLLRAIRNVIHTSKYKANVKRMQYLLKDQKETPLERAVYWTEYVLKHKGAEHLMSPARNLNIFQYYLLDVIALCLACLILSHYLLKLSITLVYKYLSGNIG

SEQ ID NO: 6607 - protein, 520 aa, Danio rerio
MACLWLLGSLLLLGSAEAGKLLVIPTDGSHWLGLKPIVEELGRRGNQVVVVIPEASLSMGPSEKTTTLTYPVNYTKVELEAVLASELNALLSIDVSTDLAKFQSFFFTLNVLQTFILRNAEGLLFNKDLMKKLQDYNFDAILTDPFEPVGAIAGEYLSIPAIYMQINHPCGVDTLASQCPAPPSYVPQTFTHFTDRMNLWQRSINFVRALLQPKACKLIFARADEIASHLLQRKTSMVEIFSRAALWFLRFNFALEFPRPVMPNMVMIGATVNQKPKPLTHELEEFVNGSGEHGFVVFTLGSMVSQLPEAKAREFFEAFRQIPQRVLWRYTGPVPENAPKNVKLMKWLPQNDLLGHPKVRAFVTHGGSHGIYEGICNGVPMVMLPLFGDQGDNAQRLVSRGVAESLTIYDVTSEKLLVALKKVINDKSYKEKMMKLSAIHRDRPIEPLDLAVFWTEFVMRHKGAEHLRPAAHDLNWIQYHSLDVIGFLLLILLTVIFVTVKSCMFCFRKCFKKSQKKKKA

SEQ ID NO: 6608 - protein, 1069 aa, Lucilia cuprina
MGPKKVTFLSILLTVCVTWQIGQVDSANILGLFTSHSPSHLIVHMSVVKALAERGHNITVVASQVPKVKHDKIHFIIIPPTEEQEQILNKEVSGMALKKNNIFTTVSNFFGSLKLLIDMQADVLKHPRFTALYENPDTKFDLVIVGYFMNSFEYGVAAKFKVPLVISWSASSMLLSDIMVGNPSEVSYVPGMNMAVKLGEKMTFLERIQNFFSNLFFHLVKELLDIRMRSFYHDLFPTDGSFPSLSEMEKNISLVFCNGHFSEGPIRPNVPAVVEIGGIQVKDTPDPLPEDIAKFLDSANETGAILFSLGSNLQGSSIKPETATYIFNVLSNLKQKVIWKWEDLKNTPGKSNNILYKKWMPQDDILAHPNIKLFITHAGKGGVAEAQYHGVPMVALPVFADQHGNAMKMVANGYGKYLELLTLTEDPFREAILDVLNNPQYRENVQRFSQLYRDRPLTARETVVFWTEYVLRHYGAAHMQSPLVHMNFIESHNLDVYLFIMIILYVAGTNFSSFSKIVRTSTRAMTRKSLAAAFGILLTICFLTWQVPQVNGANILGIFTSHSTSHLIIHMSVAKVLAERGHNVTIVASQEPKVKHDKINMIIIPPSSEVEELIGKAMKGMATQKTTFFTTVGNFFGSLKPMIDMQADMLKDPRFTALYENPDTKFDLIIMGYFMNSFVLGMGARFKAPLVISWMGPPMILSDIFVGNPSEVSYVPDMNMSVKVGEKMTFLQRLQNLFMNMFFRLFKQILDIRMRHFYSELYPTDGSFPSLSDMEKNVSLIFCNSHFTEGPIRPNVPAVVEIGGIQVKDKPEPLPEDIAKFLDSANKTGAILFSLGSNLRGSSIKPETTTHIFNVLSKLKQKVIWKWEDLNKTPGKSPNILYKKWMPQDDILAHPNVKLFITHAGKGGVAEAQYHGVPMVALPVFADQHGNAKKLVDAGYGKDLELLKLTEESLYAAIVEVLNNPEYTKNVQTFSKLYRDRPLTARENVAFWAEYVIRHHGAAHMQSPLVHMTTIESLNLDIYLLLSMIIYIIYRLLKLLVLCVVCKLCRNSSKTITKKAKKSKKVKAQ

SEQ ID NO: 6609 - protein, 463 aa, Trichoplax adhaerens
MKTLSRVCVFFMLIISTPCILALKVGVLPLVAGSHTLSMDAITRQILQRGHQAITIISNEDRYLKRLMPSALALYEVDEPLTEMDSQKMLTSKIRLQILRNFYEIQSRYCDATLSNKTLLQSIQDVDIIITDNLYVCSILLPELLNKPSIIMSFSAGIAGMHTFLGEYEPTTYIPIHGSMISSQKMTFKQRAINVIQGKIMYAAMNYISASAINKLRLKHNISMHLTLDQLRRKFSLHLSSIDFSIEYARPLPPYIHVVGPVTPRPPSSLPPIFENIIQNLKNQTIIVLSFGSELQLSNEKLPEMVTALRQLPYTIIWKTKQNIQNIPSNVKIMEWIPQNDLLGCNKTIALITHCGCNSLYEAAYHGVPMIGMPAMIEQMGNAARMVHAGIGIHVDFHSFEAADMINAVTELVENSRYKENVAKVAKIIKSNGRSPADAIVDWIEMLYHCCLGEGLTFLPRID

SEQ ID NO: 6610 - protein, 419 aa, Agrilus planipennis
MSGFQKEITASTFGPELTRKVVTHPSFKTLIHSNETFDLIIFERFMNEALFGLSHRFNAPYIVLSTIGYSRWTIEMAGNPGYTAYIPDLYLHYASSMTLWQRFHNTFFDCFVKLYRHFVVLPKHRSILRETFPNAPSLEDLYYNASLIFMNTHVSIKYAVPSVPNMIEIGGFHVSPPKPLSKGLKEYMDDASDGVIYFSLGSICQSKDMAPETRDIILRVFSKLKQKVVWKWEDQNSTFTLPPNVRFEKWVPQQDILAHPNLKLFITHGGLLSIIEAIYHGVPLLVIPIFAEQFMNAADVESLGYGLKLYYTHITEENFSYLINELLINTRYKENVKLRSKLFHDQETKPIDRALWWIEYVIRYKGAPHLKSVTLNLKWYQYFLLDVLALAIILILFIVVLIVVCLKQFCKNRGKSKID

SEQ ID NO: 6611 - protein, 1066 aa, Pseudomyrmex gracilis
MWLVTCATCISLLLCSLSTNNVATAKRILVITIAPFYSHQTVIESVCSELNKRGHELVVITPHSMRNTSQNYTEIIVSEVKLLIDSVLLNMNIWELSTIQTPITMTQISSKISITIFNNPEVKKLYRHDSNEKFDAVIVEAVSSPSLFALAHRFNASIIGLSSLHMHNYHRYVFGSPIYPSHASNWEIIYEFDVPTENSSIWERLRNFIVTWRYVYYWMNTFVDFEQETIKKYLGNDMPPVTDILKNINLFLTNENPVHVYPRPEHPNLVHFSGFHIKKTPPPLPKDLIQFLNGDEFIYVSFGSTIPNEMFPREWLKILVQVFSKLPYKVVWKFAREELPEELGNNVFISKWFPQQGILAHPKIKLFIYQGGCQSTEEAIHYAVPVVGIPFIYEQVGRLHRLASLGVALYINSRTLTAEKLRSVINQTTSNNRYKEKMEHISAVFKDQPYDSMENAIWWIEFVMRHKEQLQFKIDEPWYQLYSIDIIALLITILFTAAFIITLIIFHIIRYFFRVTIRQFVKKSERMWAKNFLIFPMLCLIVRYNAIHAKRILFVVQLPSYSHQITYRNLCLELHKRGHEIVSITTDPIGNSSLTNYTEINLNYFYKGFLEAKEVSSYESVTQISLNNPFFQEERILWRIINVFNRKTFENEEIKKLLSDSNEHFDAVIVEQASTLSMNALAYRFNAPLIGIQSQDVYNHLRFMSGSIILPSHASNWQSNMIFDRDLSFWERVVNFCQVWGQIYHIMNEHISAEDALVKKYLGQDMPHIIDITKNMSIYLVNRHPAFSLHRLEQSNVIFYHSFHVAKVPPALPENIKTFIDEADEGFIYVSFGTMVTWEHLPSTTLKAFVEAFCALPYRIVWKFPNNDQLPKCKNILAANWLPQQGILAHPNIKLFVYQGGVHSTEEAIYYGVPVVGYPVAWDQKYQVQNIEKLGVGVRLPLHETSKENIIAAIQKVINDKGYKERMERLSIRLKDSPYNSLQHAAQWIEYVIRQNGTLFLRSSLCDEPWYRRYDWDVIGFLAIVGFIASLISLWILLQILRCHLRMLFYLNGSVVARSITLNQRF

SEQ ID NO: 6612 - protein, 404 aa, Armadillidium vulgare
MLTISRLLWVLFFTVNICWAYKGLYIMNHGTRSHLSFHKAILETLSESGHKITFVTPYNTKFNIKNVTEILLKENWTDKLLGNPFNNSNDLSLVWKFLEYGPKSCTGPLGDPAMQKALEEDYDYVLLSIFLSECFLTVPYVKKCSCFGIPGKTDVAQCRLCWRNSHKRTSAPSTGVGGLARWVRGRRLHLFLFGNSYQSRTFKAGVSKHKIHSVLTSLINLRTLPWEIERHISSILKVFGSLKQRILWKWNSEIENLPSNIKISSWLPQQDILAHPKIRLFISHGGLFGSQEAMYFEVPVLGMPVFLDQHMNIDEIVSQGWGKSISWDNLTEENFAEAIQDILSNSSIREKAHERSVLMRDWPRTPKEEVFWWLVVVRPMEQNTFKNLSPIYMVRKFYFLFLNL

SEQ ID NO: 6613 - protein, 529 aa, Drosophila busckii
RNSVLIALLVSLSISCLPSDGANILGVFTSHSPSHLIVHMSVMKALAEEGHNVTVVSSLEPKVTHKSIKHIVIPMSKEDEKTLNKNMGDMTREKQSLFSTIKNLFGSFSMLIYKQLDVLEDKRFTELYTNKDNKFDAVVVGFFFNRYQVGLGSLFKCPIILSWTSGPMDHINELMGNPVLISTVPNMNMPSDGKPMNFKQRMTNFASTMVFPLFIYIFIYKFFFCSRMWGKIPHMLSFEEAKKNVSLLFCNSHALSEGPLRPNVPAVVEIGGIQIKQKPDPLPQDIKEFLDGAKDGAILFSLGSNLKGDHIKPEIISNIFKTLSSLKQRIIWKWEDVKHTPGKAANILYKDWLPQDDILAHPKIKLFITHAGKGGMAEAQYHAVPMLALPVFADQPANAEKLAEAGYGLALDLTNLEADALKEAIKELLVNPKYTAKLKQFSQLYRDRPMTARDSVVYWTDYVVRYKGAVHMQSTLVHMNWLTSSNLDVYLILAVILVIVLKITKIVLKFFWRKCCGGKGKAEQSKQKS

SEQ ID NO: 6614 - protein, 523 aa, Zeugodacus cucurbitae
MRTSSAILALAFAFAFNSFSCGESARILAIFPFPGRSQFICVEPYLKAIALRGHELTVISMYPQTKPLANWRDIEVTEMRKHYDAVMAGIYKERYTYWSALNAFKPLISISLKQVLDSPAVQELLHSDEHFDLLILEPLRNEPLFGFAEHFKAPIIGISTYGMDPHLDEYVGNISPLSFTPLYTVPLTDHMNFWQRLLNLWWTTVERVHLHTIMLPYYEEVYKHYFPNSSTELKQLRKNMSLLLLNQHFSLSYPRPYVPNVIEVGGIFLPDKANPLPADMEHFISSSPLDVIYFSLGTNVRSKNLPKEKLEALLNVFGSLNVNVLWKFEDTELPGKPNNVYISKWFPQFDLLAHPKVKLFIMHGGLLGTIEAIHNAKPLIGMPVFFDQFLNVAQAVQSGFGLHVDIKTFTADNMKRAILEVLNNPKYTEKAKELSRQFHDQPMKPLDTAIYWTEYVLRHKGAPHMRATSKDLNFIQLNSLDTGLVLFGGLAGVLVLTLYIWCKLCAKLYAKLGNSNTKKRKRD

SEQ ID NO: 6615 - protein, 489 aa, Strigamia maritima
MLISKLFIIVFVSLTSLSQASNILVMMPIGGQSHKITFNSIITQLANRGHNITVFSPFIFKQNVKNIILKTATSEDTVKSILQFINTNPIILFSTFKNLITSCCKSSLENSEFKEIIVSNQQFDAVIITSFFNECTLMLSSLLSKVIIQVAGGPMFPWMFLPVTQPPSFVPNPLWPVTDKMTFLERTYNAINSISVKMMSHYHLLGDIESTVWQHYPKAPSIAEAEKRVAFVLQNSDPVLSGPNPSLPHIIDIGGLHCEDAKPIPRDLNDFIETSGDHGFILFSLGSNVKSKFLPDDKKQSFLKALARLNQTVIWKYEDDLKETPKNVLVRKWLPQQDLLGDNRARLFISHGGLLSLQEAVYHRVPIVGIPVFTDQPGNIARVVQLHIGVQLLYNDITEENVFNAITKILNDESYTRNVKKYSSIFRDQPEKPSEKAAFRVEYAIRHSGENLLLKANNSFNLFIFYSVDVILFFITIIVISCVIIKKLY

SEQ ID NO: 6616 - protein, 543 aa, Drosophila ananassae
MTPNRSTWFGCSLGGLLVAFLALQSMPQGSDGANILGVFTSHSPSHLIVHMSVMKALAEKGHNITVVSSLPPKVTHKSIKHIVVPLDPQSEKILNEGMADMAKQKPSIWNTFSNIFNSLSLLIDKQVDVLEDPRFQELYLNKGNKFDVVFVGFFFNSYQVALGARFNCPVIISWSGPPMLMVNSFLGNPELSSVPQMSISLAPGATMNFQQRLKNFVSTIGFNGLGLVLDHKYKKFYKRLWGNDKTMPSFEEAQKNVSLAFCNGHGISEGPIRPNVPGIIEVGGIQVKSKPDPLPEDIKEFLDKAKNGAILFSLGSNLKGDFIKPEVVKTIFKGLSKLKQQVIWKWDDLDNVPGKSANILYKKWLPQDDILAHPKLKLFITHAGKGGVSEAQYHGVPMLALPVFADQPANADKVEESGYGLKLELNTLEVEEFKATIKELIENPKYAQKLKAFSQLYRDRPMTAQESVVYWTEYVIRHHGAPHMQSPLVKMTFISSNNLDIYVLTGLILYIIFVVSKLFWKFVWRKLFGKSNKTTQKKKVKKQ

SEQ ID NO: 6617 - protein, 308 aa, Drosophila sechellia
MKKPIKKIIDVETPNIITVMGVYKVRILENAKKPVLLRYPKLSLMGLDLTESLLKEPKVQELLKQNRTFDGVICETFMNDAHYGFAEHFGAPLITLGSLGATGWTSDLVGTPSPPSMRKDTSLVLLNNHVSISNPRPYSPNMIEVGGMHVNRKAPKPLPQNILKFIEEAEHGVIYFLLGSNLNSKDLPEIKRKAIVETLRGLKYRVIWKYEAETFDDKPDNVFISNWLPQDDILAHEKVIAFITHGGLLSTMESIYHGKPVVGIPFFGDQFMNMARAEQMGYGITVKYAQLTASLFRSAIERVTSDPS

SEQ ID NO: 6618 - protein, 517 aa, Trichoplusia ni
MKLLILFGLTLLCGVESLKILVYFPLPVRSVGMLGQGIVRHLLDAGHEVTFVTVYPMKDVRPSLKQVDISSNKELVAKDESLMLSFMLENNVQDTDVLYIQTFFKENSRQTFTNENFTKFLQDTSQRFDLVLADLMESEVSAGLSVVYDCPYVWYYSMGAHWHVLRLIDEGKNPAYDPDYLTTTIAPFSFLQRVEQLWARIKYKALKTFITLPEEKKIYEEIFTPLLAQRGRTLPNYENVIYNASLVFGNEHNAVKHRPSTPQNFKYVGGIHIPDPVTPLPKKLQDLMDNAKHGVIYFSMGSFFKSKHLPQSLVRGLVKTFGELKETVLWKFEEDLTDLPSNLHILQWAPQASILAHPNLKFFITHGGLLSSIEAIHFGVPVITIPVYFDQFTNAEKAVKNGYAIRVPLSYDLPETLRPAIKSMLSDDIYKKKVTELSIIYHDRLVPPGKELVHWVEHVVKTRGALHLRSPALNVPLYQRLFLDLLAVILVILYIIRRIIKNLTTKTPKKTEKKKKN

SEQ ID NO: 6619 - protein, 541 aa, Vollenhovia emeryi
MRLITGISPIITILWILITTNLACGKRLLIITPTPSYSHQIVFRAICLALSKRGHEIVTLTPNVLNDPSVTNYTEIDFGFAYEKIDDSDISQSRWNLTQLAGLKTRLLTLGHIMAEDVLSHPDLAKYHANGTDVQFDAVIAEMIMTPAIYMLAHRFNAPLIGIMSMDLQNCHRFTLGSPVLPSHPSNWELESSTGLYVPFWSRLVNFVNTWWSIYSWFNNFASKQQQIAEKYFGNDIPHVIDVAKNMSLVLINQEPLLAYARPEIPNVVHFSGLHIAKTPPSLSKNLQAFLDDATNGFVYVSLGSNTKSKLLPQETLQIFADAFASLPYKVLWKFENDSFSVPPNVFISKWTPQQGVLAHPNIKLFIYQGGLQSTEEAVHYAVPLVGIPFVFDQVYQVMKMVSLGVARYLDIVQLTTSELRDAILEVADDKGYKDRMLALRALTKDKPYDSLENVIWWIEFIMRHNGAPHLRFNGVDTAWYQQFDLDVIVFLAITSFLVLCAILGAVGWVSTQLYIYFDLSNRCILRRYIRRIMNEKTKSA

SEQ ID NO: 6620 - protein, 516 aa, Zeugodacus cucurbitae
MNYSFNANSYWCKMFIRLLYLTLFGLSVFEQTHAANILAIFPFPGPSQYICVQAYLKALAARGHEVTVISAFPQKKPLGNFRDISIEEVLNGYEETIVNAIREEHNKWQELNLYYNFFTGVTLSVLKSPKVQELLRSNAHFDLLIVEALQMDAIYALAHHYNASLIGVSTYGADPTIDELVGNTSPTSYVPLPLSELSDRMSFWQRLQNVWHYLLHQLHMHLFYLPNQAAIYKQYFPNSTLDIYAVRKNFSLLLLNQHFAISFPRPYVPNAIEVAGMHISDRPNKLPTVIENFIKDAKQGAIYFSLGSNVKSKNLSKEKLATLMRVFASLPYNILWKFEATDLPNKPPNVYINKWFPQSDILAHPNVKLFISHVGLLSTTEAIHHAKPLVGMPVFFDQFLNMARIRHAGIGVAINYRSFTYDELRSAIVEVMDNAKYTQKIQQMSRRYHDQPMKPLDKAIFWTEYVLRHEGAPHMRVAAQEMNFIQYHSLDTLTVLVAGAILALILPVWFIYRNVQ

SEQ ID NO: 6621 - protein, 579 aa, Drosophila navojoa
MSRDKVQLAACAIILLVLPCRPIDGANILGLFSTFSPSHLVVHMAMMRALADRGHNVTIVSAIKPRLVPHENITLILAPMSEATLAEVNQFMESSTKEKPSMNGIFYRMLIKAAVMLDCQYEFLLHPNVRAIYERPQTKFDLLFLGFMFNDYQLGVAAKLGIPAVISWVGVPFTFIDDEVGNIYDPAYVPNLKVGVASSQRAMDFGQRLKNYCTWVFLKTIAFILDRRMENYYNGAFGADLQMPSYWDARRNISLLFYNYHSHSEGPVRPTVPQSIEVGGVQIKEQPDPLPSELAEFLDNAKAGAIFFSLGTNVKSGYFTPNVMEAFFKVLSSQPLRVIWKWDDLQHTPGNASNIYYHNWLPQDDILAHPNTKLFITHAGKGGIAEAQYHGVPMVAMPIFGDQHGNADNMVYAGFGLSVDWTTLTEASLAQTLNEVLQNASYRERVRSFSALYRDRPLTARQSVVYWTEYVLRHKGAYHLQNPALHLAFVARHNLDVYACLLILLAVSLTLLKLLLRCIWQQLRTLAPSKDKCKFFPINCVTRICSSDSRTALSVAVAIETSKTNANLRDFHSERTAKQ

SEQ ID NO: 6622 - protein, 811 aa, Amazona aestiva
  MOD_RES (19)..(19): Any amino acid
  MOD_RES (114)..(114): Any amino acid
  MOD_RES (128)..(128): Any amino acid
  MOD_RES (140)..(140): Any amino acid
MLVAVLLLFLCCLSPAAAXKLLVIPVEGSHWLSMKEVLAELNKKGHEIVVIAPESRLLIDSSEIYEMKSYPAPFKKEEMQEVLHSMSENAFSDDPFLTRFMNTWYHFKQSSSTXQALCRSLLYNKEMXKYIEESKFDAIXTDPLTPCGQIIALKFSIPTVFFLRSLPCAIDVHAAQAPDPPSYVPRLFSVNTDHMTFSQRVKNFLITLSETFTCNMVYSGFETLASDFLQKPITITQLLSHGSVWLKRLDFVFEYPMPIMPNMIFIGGINCGQKKPLSQACSAWRFCSARESHAMLCLIPARVSAGKLLVMPMDGSHWLSMRSLLAALSQKQHHIVTLAPEVTLNVKASEHYTLKTYPVPSTRAELGARMHAFAKDLFERRPFLQGITALYEKAQVISEFYVSSCSSLLHNKDLMQYLEGSKFDAVLTDPVVPCGQILALHLSIPSVFFLRGLPCSFDLQATQCPNPPSYVPRTFTDNSDHMTFIQRVENLLLKASESFLCNSAYLPFELLASDVLHRPVTMKELLSHGSIWLKRMDFVFEYPMPVMPNIVFIGGINCGKKKPLSQEFEAIVNASGEHGIIVFSLGSMVSEIPMNKAKVIADALGTVPQTVLWRYTGKVPPNMPKNIKLVKWLPQNDLLAHPKTRAFITHGGSHGIYEGICNAVPMVIMPLFGDQMDNAKRIESRGAGLTLNVLEMTTEDLSAAVQAVINDKKYKENIKRLSDLHLDRPIHPMDLAVHWVEFVMRHKGAPHLRPAAHDLNWIQYHSLDVVAFLIVVVLLSLFISLKCCLFCCRRCCCKKGRTRKPTKSKTH

SEQ ID NO: 6623 - protein, 492 aa, Homo sapiens
MVSIRDFTMPKKFVQMLVFNLTLTEVVLSGNVLIWPTDGSHWLNIKIILEELIQRNHNVTVLASSATLFINSNPDSPVNFEVIPVSYKKSNIDSLIEHMIMLWIDHRPTPLTIWAFYKELGKLLDTFFQINIQLCDGVLKNPKLMARLQKGGFDVLVADPVTICGDLVALKLGIPFMYTLRFSPASTVERHCGKIPAPVSYVPAALSELTDQMTFGERIKNTISYSLQDYIFQSYWGEWNSYYSKILGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 6624 - protein, 406 aa, Danaus plexippus
MDVVQKFIKDRSVKFDVVIVDWLYTELGVGFSSVFNCPLIWFSSMDVHTTVLALIDDYLNPAYARHHMSTEYSSSFLNRVKELWTISRTWLYHWWHLDEKERMFREIFGPASEERGIKLPHFNDVRYNASLMLGNSHIVVGEAIALPQNYWHIGGYHIKKTVEPLPKDLQKIMDTAKDGVIYFSLGSLLKGRKIPSAVKKRFLNIFSELKQEIIWKFDEQMTDLPKNVHIVTWAPQQSILAHPNCILFITHGGLLSTLETIKYGVPIIGIPFFADQFLNVNKVVAKGFGRRVDISENTPEELRIAIREVLGNTSYRTRVKELSSLFNADSDPGQRLVQGVELVVRTNGAPHLRSVALRVPFYQKLYLDVLLLVIGIVFGIIILISYACKYLRTFISRSNQGKKKLN

SEQ ID NO: 6625 - protein, 280 aa, Callorhinchus milii
MADDLANHAKYVLHTTLPKHAFFPHLLEPSVCYDLVLFLQEMEEFVQSSGEHGIVVFTLGSMIKNLTAERADVIAAALGQIPQKVLWRYAGEKPKTLAPNTKLYDWLPQNDLLGHPKTRAFITHGGTNGIYEAIYHAVPLIGIPIFADQPDNMSHMKEKGMAVVLNFNTMTTLDLVDALNTVINDPRYKENAIRLSSIQHDQPMTPLDTAVFWIEFVMRHKGAKHLRPASHSLTWYQYHSLDVIAFLCFCLAVALYIPIKCCMYCFRRCRSKLKRKGKKD

SEQ ID NO: 6626 - protein, 519 aa, Plutella xylostella
MWAFLCILGLVFSASDVDSSRILGIFPMASVSHQVVFRALTYELAKRGHELVVITPDPGLPKDRPNDNITEIDISHAYEGFKTLMAKGNPKRGVVITPHDMLKLNKFKVILNCAEEVMKNEELNKILNDDTKKFDLVIGEALYNFPMIYAKRFDTPMIWFRNFQPLGAASGHPFLYPVYFRDRYLNLTLIEKIQQLYIDVVLRLGAVAMSYYEHGLMKQYFGDETPSLDELRDRIDLMFINTNQVFETARPVPPNVIYLGGLHMKPVQPLPKDLKQYLDSSERGVVYVSLGTNVRIAEMDGTLLKEFVKAFDKMPYDVLWKYDGIELPWLPKNIKHSKWFPQRDLLHHPNIKAFVTQGGLQSTDEAIDAGVPLVGLPALADQWYNVERYVKHGIGKQLDLVTMRAEDLVAAVVDVVEDESYRENIQKLSKLVKDQPETPLERAVWWTEYVIRNKGAKHLRSPSFNISWSEFLMLDVVLALCGISLLVFVIFVTIVLFLVRKCKLCKTDVKKDTKKVKKN

SEQ ID NO: 6627 - protein, 591 aa, Caenorhabditis remanei
MKSLYIVANFYPNNSIFLVVIRSLLISFFVICLVTNMKIIYVILLFIGFIGSAESYKVLVFNPAYGASHSNFLGKLSDILIDGGHEVTMLIPVYLANKKNQIGSKKVKNIVEIGQDSRTKAIFEAGNIEHVVKSKIWTMDPEMMSHFSLIRSMNSAISHECEFIFQQTEILQKLRNESFDLAITESLFACPFGMFITHSIVSMTVFFAAVFDHIGIKTVINAESNLFKDAVKYAHGEPAAISYFPGLFSPINDKMSFFARIQNLIRMIFTHYLTVSRYQGELEAIKPYYNKTKSWTELISGVAFYFINSNQYLDYASPNLPKTVFIGGMQVVTNKKSTKLNKHWDSLLSVRKQNVLISFGSNAHSCDMPEEYKQSFLEVFASMPETTFIWKYEDENATLADHLSNVELTKWMPQNDLLADSRLTLFVTHGGLGSTMELAYQGKPALIIPLLADQPRNAHMLTRHGGSLQFDKTKLSNSEDLRRAIKEVLNDKKYTESARKLANILNSQPFSPKDVVLNHCNFAVEHGTLETLSSEGKNLNFFQFYSFDIFLGFIALVVIIFSVTLISLVILMRLLIRVVERIVLYQKKKIE

SEQ ID NO: 6628 - protein, 527 aa, Nomascus leucogenys
MLNNLLLFSLQISLIGTTLGGNVLIWPMEGSHWLNVKIIIDELIKKDHNVTVLVASGALFITPTSNSSLTFEIYKVPFGKERIEGVIKDFVLTWLENRPSPSTIWRFYQEVAKVIKDFHVVSQEICDGVLKNQQLMEKLKKSKFEVLVSDPVFPCGDIVALKLGIPFMYSLRFSPASTVEKHCGKVPYPPSYVPAVLSELSDQMSFTDRVRNFISYHLQDYMFETLWKSWDSYYSKALDGLLLCCPGWSAVVDLGSLQPLLPGFKQFSCLSLQCSWDYRQPPGRPTTLCETMGKAEIWLIRTYWDFEFPRPYLPNFEFVGGLHCKPAKPLPKVLWRYKGKKPATLGNNTQLYDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRPAAHDLTWFQYHSLDVIGFLLVCVTTAIFLVIRCCLFSCQKLGKIGKKKKRE

SEQ ID NO: 6629 - protein, 203 aa, Ancylostoma ceylanicum
MATIPHASRFHFLSTDLISGNVHLFKWLPQTDLLYHPKARAFITHAGYNSVQEAIHAGIPMVCLALFGDQPKNAKVTEKLGISRNLKKTELTAEAIEAAIRDVLENERYNKNAKKLARMVQRKPVSPSDLLVRWTEFLAEFKTLDNLKPAGNKLNWIQYHSIDVLLFLASLVSLVIFIFIKILKFVAMKFCRCLKHKEKQKQI

SEQ ID NO: 6630 - protein, 549 aa, Bactrocera latifrons
MNNNFGHTIHIKMIYQKFFLPIIILRSLSWNLAVVDGAKILGLFAHPSESHFAVMRSLMLELTKREHNVTVYSSHRLNERLERLREIIVEPEFPFWKQFLEITGSQEGGLLKASKLTERTIQQSLATTGANAVNYFLSNEAVKKLLNLPVNEFDYDLIIVDLFYTEALLAVGHFFDKPTIGILNTNFESYMDRVLEQMVPAACSPISYETYKPEVGYWNRLGVIRNCMSRRKQFIKDNWGAQESVMRKHFSQFKGVNELNIGTLQAELTILLLNSHVPLLRPRPLLLNTVAAGGMHIRPPRELPWPLRRFLDESRAGVIYMNLGNEQLCTDVPKHIMQILLNTLGKRKERVVWTCHDHTALKNLHTNIMVQHAVPQADILAHPHVHIFLMNGDLLSTQEGIMRHVPMISVPIFRNEVRNAELTVQLGVGIHLNHNNLTETALNWALQTIKEDSTYQLTIRQVAATFRDRPLGAVETCMYWMDYVLRHKGGADLKTFGGNIPFSQLHLFDLFIYYFAVALLSVGVLAAIIYGIIIIMRKREIGKMYSKLS

SEQ ID NO: 6631 - protein, 532 aa, Trichogramma pretiosum
MEARRGAAATFWLLLLMSASLQQIQGLRILMATMGGTKSHTVPFAALGKQLQLRGHNVTLASGFRGTVPPNSTLRELVSVRLEEYITNYTATWDLVGSRIRNEWPLSPWDAMRYGWESCDSLLGDEYSVGLLQNPEGDPRLAWDVALVDGAFPECLLGVLHRGADADPPVPTIMLNTVALYTGSLSRQGNPTPWSLRTYFGKAFTQDMNFFDKLRNAFYMGSLEFMHWIMTTKYIQPILRKHLGNQVPDVRELVSEVPLTLQNSHYAVADAQPFLPNVVNVACIHCVQPAPVNEALDKFLEAGFVFVSMGSSVKESGMPRELIDAFVHVLSSLPYNVVWKWDGGFIPNLPPSVRVGPWWPQQDLLGHRGLRAFVSHGGLLSLHEAAYHGAPTLVLPVFCDHDGNAAQAAKLGYALVMEFETFTAAEFRENLLKVASPDPSNPYRLAAKKRSELLKDVPMSAVNMSVWWVEHVARHRGADHLKSSARHIGLLQYYCFDVLGFYLTVLCASYWSVKRFIGKFRSRRRKLKLKES

SEQ ID NO: 6632 - protein, 1124 aa, Cimex lectularius
MSPVLIIVMFINFSSGANILGFFYFPVPSHHNVFRPILNELANRGHNVTYVSPFPYKPASANMRHIMIENHRDEFSGVINIRNWASYSAIEMSFFLARFTKDLNDKMFSSSGVQEIIHSDEKFDVVLSSSMLFQEPVAALVHKFKSIGIDIHPVGDVVDVNELSGLPSNSEYMLDYKANFGKPIWEFTYRDRLYNMFILIATTLSQYYRLFFMQKQVDKYFNYTGWEDRPPIGKLVANKSLVLINSHHSVGYSYPKAPHVKEIGGVNVLPVKPLPKDLEDFMNEAKHGVIYFSLGTNFNSSTETSSDEQQIIFKVLSGLKQKVLWKWDGVQRPGIHENIKFSKWFPQGDILAHKNTKLFITQGGILSLFEAVCHAVPLIVVPVLGDQPKNSDVVVAGGFGIRLNFNNLTETSLRWAIDKVLNDETYTINAKRRSELFHDRPRAPLEEAVYWIEFVIRNGNVLQPKSALLPFYQLHNLDIIFTMVVIITVLIYIVKLSRSLFLKGKKSPQVFKKKKRCPENRCQYVKISFHAMTTWGLTKVVTTIFELMLAVSLQLTVRRLKLIVMIDRFRRPPPTRFTISRFSASWEFSDVVVVIKVDAQFGTAMRLIIILFLTTCLEYALAARILALFPFPAKSHHNVFRPILVELAKKGHHVMFVGPIPVEQPPANLKQLLLPNYLKDLTEQMNLIDFGKLSSPVIPFWLNEMGLFLTEKVLQSEELQGLIHSDEKYDVIMTESLFFQEPLAAFMHKFNAIGIDVNPHGESAWINELAGLPDNPAYMIDYKSEFTDNMNYLERLHNAYITYSTLLVCYLGQWRFQWLTDKYFNYTGSESRPPLRKFMSDKALILLNSHYSVGYPYPKSPHVKEIGGINIQPNKPLPKDIENFMNGAKHGVIYFSFGSNIEISTLLNSDLVDTFMNVFRKLNQRVLWKWESDNLPAAPKNVKLSKWFPQQDILAHKNTKLFITHGGLLSVMEAVHNAVPLISVPFFGDQVKNAIQAENAGYGIRMNFENLTEHNLLLAINEILNNPSYVTEVKRRSQLFRDRPNSPLEEAVFWIEFVIKHKNALQPHSARLPFYQLHNLDTLLPFFLIVMFILVVILKLLKRLILCICHKMKKKPIEAKKKKH

SEQ ID NO: 6633 - protein, 502 aa, Drosophila willistoni
MATMGGTKSHKIPFWELAKGLIVRGHNITFLSGFPADFHLDGLHEVTPAGLVEFIHNYTNWDLLGSRMAGEMPIKPWDGLRYAFESCDAMLGDAETKELTNRSFDLAILDGAYPECLLGMVHQYKIPFMYINTVGFYTGSLSVAGNPISYAITPNFYSRFTDNMSLYERAINTGMQIGQNILHSYVMRRTYRIVRDHLGENIPHPYEMSRNVSFILQNGHAVVSYPRAFNPNVAEVACIHCKPARALPKDLEEFINASGASGFIYVSMGSSVKAANMPESLRRMLVKTFARLPYQVLWKYEGSAADMQDLTPNVKLSRWLPQQDILGHKQLRAFVTHGGLLSMFETVYHGVPVVTMPVFCDHDVNSAKAEVDGYAIKLDLETLSTNQLYKAIMKVIHDPRYRNAARYRQNLLLDQRSTAMETAIYWTEYVLRHKGAYHLQAQARNLSWWQYYLLDVVALYLLSLYVLVLLLKRLDFRTEKVRSLHVTGPSSPTATKKKAKKL

SEQ ID NO: 6634 - protein, 527 aa, Monomorium pharaonis
MKPIAEVTFWITCFLYIATPIETAKILAIIPIPSYSHQIPYRPLWITLSRRGHEVVLLTTDPINDHSLTNLTEINLQENYKYIRKLNFVKNIKIHTWLSTARTQIWPMIYKTAETIYEHPEVRKLYVSNSNEKFDVVIAETFTSPCFYALAHRFNAPLIGVATLGLNNNNYYLFGAPVLPSHPSAWEMEGDTGFNLPVWQRIKNFIRQWYHIYCVLNYFYPEQQAIAEKYLGKNIPDISDIERNMSIVFHNQQEMLSFVRPTTPNIFTFGNFHISKKSAALPKNLKEFITDAPNGFIYVSLGTNVPVSALPEHVQIIFRDVFASLSYKVLWKHDSDLPNKTDNIHIAKWFPQQSILAHPNIKLFIYQGGLQSTEEAVYYTVPLLGLPVLADQTTQVNKMVSLGVAKSLNIIDLTKEKLNESITEILSNKRYKQRMLEVKMLNEDKPYNLLEHVIWWIEYVIRHKGASHLRTSIVHDPWYQKQEMDVIAILSIVIFVTLLWTLVIIYKLLKLIFNLTKMSVVVKKKIN

SEQ ID NO: 6635 - protein, 522 aa, Caenorhabditis brenneri
MNNMHVLFFLLLVGPTFSLNYLVFCPLYAHSHHKFLAKIADTLSDAGHNVTFFAPIILRKYENVKYLDSTKDIVYLQPSKKLESLGYSADYSKFWSEDATAIQFVPAIKAFTRMFQQLYEDLKEDLSVLNELKTRNFDALVFEFLCPTAFPIAEYLGVKALLPSLSMTHHPLMSRLIGEPSSPAILPSMISSFGDDMSFSERLQNTIGDIFFTLFVHYPPMTSFGDHSKLIDFEDMTVRSPFMFMNANPYLDYPRPLLTKSVLIGGISVNATHMKQEKLSDKYNEILKKKEKNVLISFGSMIFSKDMPLAYKETIVKVIESFPDVNFIWKYEEEDVSFAKNLSNLHFSKWVPQTALLADSRLSAFITHAGLGSVTELSYMGKPAVLVPIFADQLRNSKTLARHNGSITLSKYDLSDFDKLKNAVYSILTEKRFKDSAELLAQQLSDQPISPQTLLVKHAEFAAKYGELPNLDPCSRQMSFISFYMIDIIVFISAIVIVTLGVLLIVVRWTSRFFVHLKYKSE

SEQ ID NO: 6636 - protein, 518 aa, Culex quinquefasciatus
MTSARILLVVAVLALAGTAQSAKILGVIPSGGKSHHFVGAAYTKALAEAGHDVTVIAAFREKNAPKNYREIVMDDLYKTLLKFMENPFEFPEIPPLMHLYMMYTEFGKFSSEFTLNHPEVKELMESGETFDLVIVETFLTEAIYGMAQHFNASLVTYSTLGNILWTRELTRSPAPTSHVANFILNYVDSMTFWERVWNTIVDWSDRLMYNTLHLPVQKQLYEQAFPNAKISFEGQMKNVSLVLLNSHFSLSSPRPYPPNVIEAGGIQIEKVKPLPEDLKKFLDGAKDGAIYFSMGSYLKSEQFPIEKRDAFIKVFSRMKQRIVWKFEDESIPNLPKNVLIKPWMPQNDILAHPNVKVFITHGGLLGGTEALFHGKPVVGIPIFGDQTMNVQRAVKTGYGVELLYKDITEKNVENALNKVLGDPKYAKTAQLISQRYHDKPMSAKETALFWIEYVLRHRGAPQLRSPALELSFFQYLALDVYGVLATITLAVSLILYWAVKSFLRNVCGTKPKKSKKVD

SEQ ID NO: 6637 - protein, 483 aa, Homo sapiens
MLNNLLLFSLQISLIGTTLGGNVLIWPMEGSHWLNVKIIIDELIKKEHNVTVLVASGALFITPTSNPSLTFEIYKVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 6638 - protein, 531 aa, Xenopus tropicalis
MGATGSSPSCCFFRRFFILLALGCADGGRLLVVPQDGSHWLSMRVLVDRLAQRGHYIVVAIPEVNMLFKDLDNYKVKTFSSPYSKDVLENRMRRMNQEIFVDRILTEKITFWYESMSNATQWVVSACQHFLQNSTLIRELEKEHFDAMLTDSVFPCGEIVAEHLSIPSVSFMRGTIFGMDQIASQTPSPPSYVPRMFTVYTDNMSFSQRVKNFLIHSLEHIVCHIFYYPYAQMASDFLKKEVTAMSLFSRTSIWLMRYDFVFEFPRPIMPNVILIGGINCAKQKALPQEFEKLVKSSGEHGFVVFSFGSMVSEIPMNIAMDIAEALRYIPQKVFWRYTGKAPPNLGDNTHLVKWLPQNDLLAHPKARAFITHAGSHGVYEGICNAVPMVMLPLIGDQMDNAKRIESRGAGLILNVQNLIPDDLSNAVMAVIDNPSYKENIQRLSSLHRDRPVQPLDLAVHWVEFVMKHKGAPHLRPAAHDLNWIQYQSLDVMAFLLAVLLTTLFISLKCSTFACRCCCKRNTKPKRKTKSE

SEQ ID NO: 6639 - protein, 693 aa, Orycteropus afer
MLNKYILLLFLQINLLGTAHGGNILIWPMEGSHWLNVKIIIDELIKKEHNVTVLVASGALFITPISKSSLTFEIYEVSFGKERIEGVIKNFVLTWLENRPSPSTIWKFYQEMAKVIKDFHTVSREICDGVLQNQKLMQRLMKAKFDVLVSDPVFPCGDIVALKLGIPFIYSLRFSPASTVEKHCGKVPYPPSYVPAVLSELTDQMSFTDRVRNFISYHLQDYMFDTLWKPWDSYYSKALGSHWLNIKIILEELIKRNHSVTVLASSATLFINSSPDSSINFELIPVSFKKSNIDALIEHIIMLWIDHRPTPLTLWSFYKELGNLLKNFFVINLQICEGVLNNSKLMSRLQKGGFDVLVADPVTICGDLVALKLGIPFIYTLRFSPASTVERHCGKIPAPASYVPAALSELTDQMTFGERVKNTLSYPLQDYIFQSYWGEWNSYYSKVLGKPTTLCETMGKAEIWLIRTYWDFEFPRPYLPNFEFVGGLHCKPAKPLPKVLWRYKGIKPTTLGANTRLYDWIPQNDLLGHPKTKAFITHGGTNGIYEAIYHGVPMVGVPMFADQPDNIAHMKAKGAAVDVNMNTMTSADLLNALRTVINDPSYKESAMRLSRIHHDQPVKPLDRAVFWIEFVMRHKGAKHLRPAAHDLTWFQYHSLDVIGFLLACVAIAIFLVAKCCLFSCQKFGKTGKKKKRE

SEQ ID NO: 6640 - protein, 514 aa, Bicyclus anynana
MYHLLKIFCIISVIGTSKPARILAVYPLPSISHQVVFRPLMLELAKRGHEVVVVTPDPAYPKGQSPQNLTEIDIHDLSYKMWNDLLETGMGQTRMTFVELKIVLDTITKIFEKQMNSQDVQKLIQDESKSFDLLFTESCVRPALSFGYRYNVPIIEFSSLGSIFGSIYGTGAPTNYLVYPSPSRNRVYDLSLWEKVSAVYNEYKIDKVLEEHEEVENKMVRGIFGSNVPDLSELKKNVQLIFLNVNPIWDFNRPVPPNIIYLGGIHQNPNKELPKDIKTYLDSSVNGVIYMSFGTNARPSLLSAEKLKIFTNVFSQLPYDILCKWDKEELPNRPENVRISKWLPQSDLLKHPNVKLFITQGGLQSTDEALNAGVPLVAIPFLGDQWFNAEQYVKLNIGIYLDLETITEDNLKNAINSTIHDKAYRENVVKLHNIMRDQPQTPLERAVWWTEYVLRHGGATHLRAAGAHMHWTEYYAVDVVIFLLTVALAIVIGVIFAVRYAMSLKDIKIKIKRN

SEQ ID NO: 6641 - protein, 519 aa, Anopheles gambiae
MILGLVILLLFQQCRWQLSAGANILCLTPVPSPSHHIWNRVWIEALAARGHNLTVLSADVDERTAPPNITYIHLEHAYSDLHTELDLFQMASHSALTGIKDLYVWGTAMCRGVLRSKGLQVIQAYPDDFRFDLIIADITCGPCLFPLIHKFHHPPLIGVTAYNNPQFTADFVGGHKHYAYVPFFTLNYDSDMTFYQRFYNWVLHNVDHFYRHHVFLPRIEQMVRNHFRYPGMPSLEQMEHNTVLLLANFHYSVDFAESIGPNHIPVGGLQVRPANHLPDDLATFIAAGREGSVLFSLGTNVRSADLEMERIHMFLEAFRQLPEYNFLWKFEELPSFEVPANVLIRAFLPQNDVLAQPNVKAFITHGGMLSTHEATWHGVPMVGIPFICDQYRNLHKSVTAGVALRLAHDSLSVEQIAAALREILTNTSYRDAMKRRSALLRDQPEHPLDRAVWWIEWVLRHPDGKAIQSPTKHMRFWQYELYDIKLALILLTVLAVCCCKRICTRSDRRSYRNVNKKSN

SEQ ID NO: 6642 - protein, 521 aa, Papilio polytes
MMNFSFKCIITYVLILFGIKCGGYKILAVFPIPAGSHRILGNGVVNHLLKAGHEVTYITPFPENKTVPNLRYISVIDNINHLNVTLINLKNLMTRDIEMDQDNIFNMLMNLTRNTLKSENVSELLNDPTENFDLVLAQWTFNEVFSGFAAAFNCPYIWFFPYEASFTALSLIDEATNPAYTANIEMRDIPPFTFWQRFKLLKFQITKTWRNYFYQRYIENEVFDNAFKPILTKKNRTLPDYEVLRLNASLIFGNYHVSMGQAIRLPQNYIPIGGQHIDEVVPVLPKELKNIMDEATNGVIYFSMGSNLKSKDLPDSIKQGLIKIFSGLNQTVLWKFEEPVPNLPKNVHILQWAPQLSILSHPNCILLISHGGLLSMNEAIHFGVPHISIPVFYDHLYNADKSVSRGIGVKVDLTDNLAEDLKEAIHEMLNNSMYRERMKEASFIYHHRLAPPGKVLVHWVEHVIATKGALHLRSPALLMPWYQKIYLDLVLLLVLGIILTLWILRRLYYIKMQYKVKAKML

SEQ ID NO: 6643 - protein, 527 aa, Stomoxys calcitrans
MRLIYLPGILLGLCAMQCVFLVDAARILAVFPSPSKSHLIVHTSVAEALAAEGHNVTVISAFPNVLKNTHFSKYITIAGKPLDQSFTTEMVNKPQPFYKKMRQMLTFVFDHANETMNHPQLQEFLQTHGPGDFDLVIVGYFMNDFMLGLGAHFQCPVVISFMIQPIGPINEIAGNPFEVSYVPSLLMDVRPPMTFAARVKNFIAIGFERIIMGGFMCYKNKQFYGYNFPADRYPPLEEVYKNVSLILTNHHFSQGPIRPNVPALIEIGGIQIKEQPDPLPAELAKILDNAKEGVIYFSFGSNVQGSHLSKEKAKIMFDVLSKLPHTVLMKWGDSHFPGQAPNIIYKSWLPQDDILAHPNVKLFITHGGQGSVVESQYHGVPMVGIPFFGDQPANMAAVEKAGFGLALQYTQLTEVDFRNTILEVLNNPQYRENVQRFSKLYRDRPMTPRQMVRFWVDYVIRHKGAYHMQSPAVHMTWWQLHSLDVIAFLMAVTFGVFGLLVGLCRCLCCRGGKKATAKTVNKSKKNK

SEQ ID NO: 6644 - protein, 530 aa, Octodon degus
MSRMLRALLLLLLQLCCYFNTAKCGKVLVWQMDFSHWVNAKVILFELVQRGHEVTVLRPSSSVFIDQNHPSGIKFETFPTSVTAEGLKIFFRQLVDNIIFKVPKDIYSQDFSLLQKFFWEGSDICQSICKDAVLNKKLLTKLQESKFDIFLADPIFAGGELLDELLKIPFVYTFRFYPGYTYEKYCAGLLFPPSYVPIIMSRLSGQMTFMERVKNMIYLLYFDFWFQTFNEKKWDQFYSEVLDKPTTLRQTMAKAEMWLIRSYWDLEFPRPTLPNTDFVGGLHSKPAKPLPKEMEDFVQSSGKHGIVVFSLGSMVYNMTEDRVNVIASALAQFPQKVIWKFIGKKPDNIAPNIQLYEWIPQNDLLVHPKTKAFVTHGGANGLYDAINHGVPMVGMPLFGEQHDNIAHMKVKGAAVPLDYLTMSTTDLVKALKAVINNPSYKENVMRLSTIHHDQPVKPLDRAAFWIEYVMRHKGAKHLRPLAHNLTWYQYHSLDVIGFLLACVLTITFLVIKCCLFCYQKFVKIEKKKKE

SEQ ID NO: 6645 - protein, 584 aa, Bactrocera dorsalis
MSMLDNNTPHTAFLLLTACCLPALISSANILGFFPTFSTSTLFYHCRIAELIAENGHNVTVIGTIANARPKAPYRYIQIETPREKLEKLRPFEWRNRTAYWDFLNMLSNRLLLSDMTLSQPLMKDWIKNAKESDFDLLIFGYFLNDFQMGLASLYKCPIIISITTGPAFWINRLVGNPAEGSYVPSALTPFTQPMNFFESWFNFWIVLWERTYFSRVLNEENEGYFCLHFNCQNIRMDDVRRNISLVFTNNHFSQGPIRPNVPTMVEIGGVQIPERRIPLPQHIADHINKAVHGVIYINLGKGANCTNLPRELLDSLHDVLVESQRYVLWRWADCGKPREDSKILYTRWMPQNDILAQKKVKLFITHGSMSSLGEGQYHAVPMLGVTYSSELVGNVKFLAQFKLAERIDAYKTNKDEIRSKLFNMLNDQSYQERAALYSLLYRDRQLTPRETVLYWVNYVLRYGGTPHMRSPAAEMTQLQMLGLDLIVFTFSTIFLMWKFRGFLWNCLTGRMFGNIRKFLRRYLFGKDYEVVIEKYSNIRYDEAVVDAARECQIRPQTVKDPDAPRVVPVKTARQRKFAGRRKR

SEQ ID NO: 6646 - protein, 514 aa, Ostrinia furnacalis
MRTPMLSALLLLLFASQAWSYNVLCIFPTPSKSHNHLGKGIVDALLDAGHQVTWGTPFPSKTSNKNLRMIDLSSTVALSADIDMTQPRFRNAGPDFLKSFARNISISALSSQELRDALTKQQFDAVVTEWFFSDYDCGYAAVQQAPWILLSGMTMHPHLEMLVDEVRSIQTHPLLFNDFPVPMTLWQRMINSFIFGMMTISNWRDQPDNDAYYQSAFGPLAKARGLSLPAYQDALHNVSILFVNTDPAVDRPRSVPANVISIAGYHIDANPGPLPKDLQTILDSSSKGVIYFSMGSVLKSSAFPEHLIADLLKLFGELPYTVLWKFEKELAGAPKNVHVRAWFPQASILAHPNVKLFITHGGLLSTLEAANAGVPILAVPMFGDQPSNAARSVRAGVARKVDFSHHMADELRKELNEMLSNDSYLKTAQSVSRLFRKRPVAPSKLISHYVEVAIESKGAYHLRSPSKLYAWYERYMLDQLAIVGAILYLIVKLIMTAVNVIKRKVSGGKKQKRS

SEQ ID NO: 6647 - protein, 251 aa, Myotis brandtii
MVGLTDRMTFLERVKNTMLSVFFDLWIRDYDIHFWDQFYSEALGRPTTLCETLGKAEIWLIRTYWDFEFPRPYLPNFEFVGGLHCKPAKPLPKVLWRYTGKKPATLGANTQLYDWLPQNDLLGHPKTKAFITHGGINGIYEGIYHGIPMVGIPMFADQHDNIAHMKAKGAAVEVNMHTMTSADLLKALRTVINDPSYKENVMRLSRIHHDQPVKPLDRAVFWIEFVMRHKGAKHLRPASTTSPGSSTTLWM

SEQ ID NO: 6648 - protein, 531 aa, Lingula anatina
MMSPVRTPVVSLLVLLSLWTLSHVAPCSCARFLAMPGIGKSVTLVFHNLAKELHKRGHQVYVIVGSNFPIPDSTKDGSVNYLTFKTDKEYILGSEEFQRNDVKDMIQSDGDMVTNFRLVRTASEFFTSQCAEMLEDQELFAKLSSLKFDVAVIGAYPFLANCQILPYKLDLPVISITSFTSLLGQAGLPLLPSVIPSLFTTFTEHMDFMERVQNFVITLVSNFIFTPSIPAELVHRHVPHKPFKTFNEFLRDSILWLVISVNPALEPIPTLPNVILLGGMGVKQPAALPDHLEAFVQKFKSQGVLVVSFGSVVKYLPTEISKRFLGVFSKLKYGVVWRYSGEDLGEIPPNIKLMSWLPQSDLLAHESVKVFLSHCGNAGSYEALFNGVPVLAMPIAGDQPHNAERLVKRGLAIKMSVATFSPGELLENINILASNSTYQSNTKRYARILRDYPMSLVDQAVYWIEHVVRFGGSHLQSPGAQLPWYIFYSLDVIGFLLSVVVLGVYCIKILCRACRRKCDQNPATGGDKKKQ

SEQ ID NO: 6649 - protein, 1184 aa, Atta colombica
DQPVYKTRLALPADYDNVMTFMCDAFYKDDPTMVNIGLSKQEPASSLLQIMYNEVREGMTLIVEEEEDECIIGAVVNAGSCPWDPDKFVEFARCECGPARDVIEFDAYVTGKPNLWERYCVLKIFECSYLAVRPDFRNQGIARKLVLDSWYLARDCGYRLFRVDCDNRYLARIAEGFGWKRVCVIPFHEYVRDGELVFKYIKEPHTEVEIYIDQVSRCKDYCQPYKTCDKITSSPNNLTCSERLLIITPTPSYSHQIVFRVISLALNKRGHEIVTLTPNILNDTGITNYTEIDFGFIYEKIDDTDMSQIRWNLTQLAGLKTRLLTLGHNIAEDALSHPDLVKYYTNRTDMQFDAVIAEMIMTPAIYMLAHRFNAPLIGIMSMDLQNCHRFTLGSPVLPSHSSNWELENLTGLNLSFWRRLINFINTWWSIHSWFNNFAIKQQKIAEKYFGNNIPHITDVAKNMSLVLINQEPLLAYARPEIPNIVHFSGLHITKAPPSLPKNLKAFLDSATNGFIYMSLGSNTKSKLLPKKILEIFANTFANLSYKVLWKFENDSYHVPPNVFISKWTPQQGVLAHPNIKLFIYQGGLQSTEEAVHYAVPLIGIPFVFDQVYQVMKMVSLGVARYLDIVQLTGSELYDAIIEVIDDKGYKDRMLALRALTKDKPYDSLENVIWWIEFVMRHNGAPHLRFNGVDIAWYQQFDLDVIVFLTITLFLVLCAILAIVGWVSKKLYNTYYNDISNHYVCRTNRPLAVVRCVSHVAYGIGCFVYIATPIETARILAIISIPSYSHQIPFRLLWTTLSQRGHEIVVLTTDPINDPNLTNLTEINFKSHYNLITKLNFIKNIGTYTWINILNKQLWPLCNEITENIYKHPKVRKMYELDSDTKFDVVIVETIKSPGLYALAYRFNAPLIGVTSTGLYNNNHYLFGAPVLPSHPSTWEMQDTIIDFNLSLWQRIKNFIRLWYHIYCTLNHFYPEQQAIAEKYLGKNIPDISDMERNISFVFQNQQEILSFVRPQTSNVLSFGNFHISKKLAALPENLKEFITDAPNGFIYMSLGTNVQISSLSKHVQSIFQDVFASLPYKILLKYDSELPNKPDNIYIAKWFPQQSILAHPNIKLFIYQGGLQSTEEAVYYAVPLLGLPILADQYTQIKKMVSLGVAKCLNIMELSRENLNASIIDILYDEGY

SEQ ID NO: 6650 - protein, 642 aa, Trichinella nativa
MAYLKMTNPLIIVRFAAHSAHEKQRKTGLCHRVSQANQRAEMFTFNHTFKADTFWILILNALLIYFVQSLKIIIFTPDSPNAGREALNKLAQELAFRNHDVFTFRTLLLPEQPYLVVQRPHKVTEFKLQIDLPTEWILHLRAFGNASIWTTEYGDQKYLHSLWKAQVEACSTTLNSDFLDRLRQITPDVCIIPSDDPCALGIVHALKLPFIYYDSDGLQDETILSVRPQLFLQGLPPSSRSTLPGRMSLFQTILNLFLFSSAHIRDTYIPLLHCCLASEKFKLLEWPILQLFKNNSQLGVEFAKLWSMKQIRAEALAVFVNTDWLLEDAHGLYPPKIIPIGGFHMDLPRPLFRPYNESIDKASDGVIVVSFGNRVNSSAVPLSVARIFLQTFQKLPGCRIFWRIDSSTIDGISPEQVPSNVNLTQYLPQVDLLGARKTRMLISHGGAQSIMEAVHAGVPVLGIPLISPTYQTLRKLEARGMALILDKSNLTAQNLLTAILAVLRNKKEEFFRYTLAAKQISKMFKDRPISPIDNTIHWIEFVGRYKRGSFFIYEKDILFSITSLTHAMFFSVVIAAFSLAYYYWMFGRKQCTIAFEDSNSKATSTDSEIDSSERKEDISDETIPARRETRSTKVSTNLRKKN

SEQ ID NO: 6651 - protein, 542 aa, Drosophila ananassae
MTQSRSTWLGCSLGSLLAVLVLVLQTMNQEAEGANILGVFPGHGPSHLIVHMSVMKALAEKGHNVTTISTIVPKVTHKNIKQIVVPLITPEEEKLLNSGISGMAKEKGSIWTTMKVMVGSMSMMVEKQVELLEHPRFQELHQNKDNKFDVVFAGFFVNSYLVGLGARFNAPVIICWSGAPMLWVNKFLGNPELSTVPQMQIGVAQGEVMTFQQRIQNFVSTLSFDALDAYLEIKYKHFYNRVWGSDKSMPSYEEAKQNVSLVFCNSHAISEGPIRANVPAVVEVGGIQIKNKPDPLPQDIKEFLDKAKNGAVLFSLGSNLKGEHIKPDVVSTIFKALSSIKQQVIWKWEDLEKTPGKASNILYKKWLPQDDILAHPNIKLFITHAGKGGVSEAQYHGVPMLALPVFGDQPGNADKLALSGYGLSLDLNSMQVEEFKEAIKEITENPKYAQKLKAFSQLYRDRPMSAQESVVYWTEYVIRHHGAPHMQSPLVKMGFMASNNYDIYILAILVLYILVKINKIFWLFIWRKFVAKNTQKTKLKQN

SEQ ID NO: 6652 - protein, 531 aa, Dinoponera quadriceps
MKLITGIPPIIVALWFLIMSDLAHSKRLLIITPAPSYSHQIVFRALCLALHKRGHEIVVLTPNILNDPTLANYTEIDFGFEYEKIDDTDFSQIRWNLTQLGGLKTRLLRLGHDIAEDVLSHPDLVKHYANGTGAQFDAVIAEMIMTPAIYMLAHRFNVPLIGIMSMDLQNCHRFNLGSPVMPSHPSNWEIENLTGLHLPFWRRLINFVKTWWNIYSWFNNFANKQQEIAEKYFGKDIPHIVDLAKNMSLILIDQEPLLAYARPEIPNVVHFSGLHIMKSPPVLSKDLKNFLDGATNGFVYMSLGTNVKSNLLPKGMLQTFTNAFASLPYRVLWKFEDDNLETPPNVFISKWIPQQGVLAHPNIKVFIYQGGLQSTEEAVHYAVPLIGIPFVFDQVYQVIKMVSLGVAKHLDIIELTTSELRDTVLEIASDKRYKDKMLALRALTKDKPYDSLENVIWWIEYVMRHNGAPHLRFNGVDTAWYRQFDFDIIVFLAIASFLSLCALLGVLMQVSRLLYKYHDRISFAKKKMKLM

SEQ ID NO: 6653 - protein, 329 aa, Anopheles sinensis
MTFMERVKNTLYWGFDMLYRQQVFMPNENQRMKRVFPGANLTHVKLLERRSELVLVNSDPAIDFYQLLPPNVVQVGGLHIKRAEEMPAMMKQFIARASRGIIVFSFGTNVQSEMLGTEVNRQLLELFRSMPEYGFIWKHANAEKLLMPPNVLMTSWVPQSALLADGRTKLLVSHGGLLSLQEAAWNGVPVIGVPFFADQFSNVRRIEVAGIGIGIPSTKLNAETLKEAMDKLLSDPSYRARAKELSGRFRTQPETPLDRAIFWIEKVIAGKGLRYLRSPTRDMAPYQVYGLDMVAVVLLIALGYYLIFKRHSKPAQAPDSPDGAKAKTE

SEQ ID NO: 6654 - protein, 530 aa, Monodelphis domestica
MMSNKRISALLLLQLWLFSCGSCGKVLVWPMEYSHWLNMKTILDELIVKGHEVTVLTPSASVLMDPNDSSALNFEVFPVQTTQEDIAFLAEKWITFWIYELPNLSLIEYVDSLQENFFQFSSFVKQNCESAVLNKELVKRLKEARYEVILGDAVCPCAELIAEILEIPLIYSIRLTFGNTYEKYCGGLPSPPSYVPLPLTELTDKMTFIERLKNMFFTLYFDFWFQSFDLKEWNQFYSDVLGRPTTLCETMGKAEMWLIRTYWDFEFPRPYLPNFEFVGGLHCKPAKPLPEEMEKFVQSSGDHGIVVFSLGSMVKNLTDEKSNVIAAALAQIPQKVLWRYKGKKPATLGPNTKTYDWIPQNDLLGHPKTKAFITHGGTNGIYEAIYHGIPMVGVPMFADQPDNIAHMKAKGAAVEVNFNKMTTADLLNALKTVINDPSYKENAMRLSRIHHDQPVKPLDRAVFWIEFVMRHKGAKHLRPAAHDLTWYQYHSLDVIGFLLACVATVVFIVAKSCLFCCRKFGKTGKKQKRA

SEQ ID NO: 6655 - protein, 426 aa, Daphnia pulex
MQATIERYCRAIYEDPVFHQLMNSKERYDLIILDGFSNDCTLLLAEVFDVPFIYLNCFPPSPWLLYAIGSPLALDHFPNPAGTRDKMDLWQRTFNVVTSVFAVYFHRWLVLPEIDRVASKVLRKNNLTSVAAIENRYLSLILSNTHFSINFQLPTSPAVVEVGGLHLGEARNEIPKDLVSFLDGSGDAGFIIVSFGSMLRGDGLPKDFRRLFLSVFARLPQRIVWKWEDQSKLGESEELIPSNVKTISWLPQKELLSHRNARLFISHGGLLSKQETVFHGVPAIFLPVWADQPINAQKAEDDGYAIRLCWDELTEEILYDAIQAILTNPRYAKRMQQVSALMHDQIDKPMDRAIYWIEYVIRHQGAPHLRNASRDLMLPQRALLDVMCIIFIFTFSMIYVIYRLCLFCSTLYRWKDMMIGLHKKDD

SEQ ID NO: 6656 - protein, 531 aa, Ancylostoma ceylanicum
MNGLGQTFLILLLCTQWVVAYKMALFVLDMSNSQLLFNKRVAETLRDAGNDVTLVLISPIEDRDISHVKIKSGVKVHTVPIPVGLSKAKMEENQENYVFKEESGAGASQTMSVKAAKFVQICEETLKNKGFLKWLETEKFDLAFAHMFDVCTVGLVHAARIPSWIWLNSGSIMDWVAYTVGVPIIPSYVPPMMMDVAGEMTFWERTKSLIGHGLMKFFWRRWIADPETELFRRLIRPDFPHLIELSSKCPLVMANTNDLYDMTRPLLAKVVNIGGVGMELADAKPLPKNFEAIMSKGDGAVLFSFGSVTAAHKMPIEWKKALLESFRLLPKYQFLLRYEKDDLNENLPPNVHLFKWLPQSDILRHPKTKAFITHGGYNSVQEAILTGTPLIAIPLFGDQPKNARLIERHGIGMILQKGEISVHTVTKALAKVTGNSRYSANAKRLSRMVDRKPVSPSHLLVKWSEFVAEFQTLENLEPAGNKLNFFQYHSLDVIAFLISITAIVLFILFKVVKFAGCRIFSFCKQKKQKAE

SEQ ID NO: 6657 - protein, 515 aa, Pieris rapae
MGNLILFFVVITAWNFTESARILGVFPTPSISHQVVFRPIMHALAKRGHDVVVITPDPAFPKGKAPPNLTEIDVHNESYIHIDKLLSVHRGRKNDFIEQFTKILEGMPIIFESQLQVPEVQKILKDEADSFDLVFIESCVRAALAISHVIKAPVIQISSLGISAPQYALAGAPIQPFVYPTPIQQRIYNLTLLEKLQELLSFQKIIRHIYATDYLDYNVAKKYFGDIPKFEELFTNTKMLFINEHPLWADNRPVPPNILYIGGVHEVPEKPLPNPLKKYLDSSKNGVIFISFGTNVRANMLSPEKIKVMVDVLSKLQYDVLWKWDNETLINKSENIVISKWLPQSDLLRHPKVKLFITQGGLQSTDEAINAAVPLIGVPMLADQWYNVEKYVRHGIGVQIDFETLTHEIFKNAIDSVINDSSYKENIIRLRSMMRDHPMKPLDQAIYWTEHILKHGGDHLQPPNFGVYGMYEYYELPLVLTISFCLLTLVCLFVWIFVILLKFLRKLTFGKVKTS

SEQ ID NO: 6658 - protein, 536 aa, Chinchilla lanigera
MASIVDITMAKKFVQLLVFNLTLTEIVLSGNVLIWPTDGSHWLNIKVILEELTQRNHSVTVLTSSTTLFISSSPDLLVDFEEIPVSVNKSYLESLIEHMIIMWMDHKPTPLTLWAFYKELGKLLEAFFLINVQLCDRVINNLTLMARLQRGGFDVLVADPVTLCSELLALKLGIPFVYTLRFSPASTVERHCGKIPAPVSYVPAALSELTDRMTFGERVKNIFSYFLQDYIFHSHWREWDSYYSKTLGRPTTLCETMSKAEIWLIRTYWDFEFPRPYLPNFEFVGGLHCKPAKPLPPEMEEFVQSSGEDGIVVFSLGSMVKNLTEEKANLIASALAQIPQKVLWRYKGKEPATLGPNTRLLDWIPQNDLLGHPKTKAFITHGGTNGIYEAIYHGVPMVGVPMFADQPDNIAHMKAKGAAVEVNMNTMTSADLLGALRAVINDPSYKENAMRLSRIHHDQPVKPLDRAVFWIEFVMRHKGAKHLRVAAHDLSWFQYHSLDVIGFLLACLATAMLLVTKCCLFSYHTFMKAGRKMKRE

SEQ ID NO: 6659 - protein, 399 aa, Drosophila obscura
LSCVSAYNYLVVLHTAARSHYHVGSALAKGLAAAGHQVTIVSPFELKKPIKNIKDVSVPGILAAMQGNIANLLTSSKEPIVKQIVNFHHMGLNITDYLLSQPAVVELINSKQTFDAVITEVFLNEAHFGFAEHFNAPLIGLGTFGAISWNTDLVGTPSPPSYVPHALLKFSDHMSLVERVANLAFVTYEYLFLNFYYLPHQEAIYRKHFPNNKQDFYQMRKDTALVLLNQHVSLSFPRPYSPNMIEVGGMHINRKRQPLPKDIEEFIVGAKQGVIYFSMGSNLKSNFLPLEKRQALLDTFSQLKQRVLWKFEDTELPGKPKNVFISDWFPQDDILAHDNVIAFITHGGLLSTTESIYHRKPFVGIPIFGDQFLNMARAEQNGYGVTVNYEELTAPRLLA

SEQ ID NO: 6660 - protein, 530 aa, Neodiprion lecontei
MPLHLIVLVLTLIASDLHCGNGARILGVFPMPSISHQVIFRKLTLELNKRGHELVVLTPDPVNDTTLKNYKEIDLHFLYDSLDLGSHIDIRGKIDFVDIFKYYEALSCFHTNEVFNHPEFRKLYAPNSGENFDLILLETFVYPAFLSLAERFKAPIIGIASAGLQLSVQYDIGNPILPSHPSNWNKDMRDFGAWVPWERLDNFIKAWRHIYYYRTEFLPKHQAIAEKHMGIEIPHLGDIHKNISLIFVNQQGPISFARPNLPNIIEIGGFHVSESIKPLSMDLQKILDNATQGFIYMSLGSNVKSNMLKEETRNEFIAAFSELPYKVIWKFEDEVLPKKPDNVIAMKWVPQQAILAHPNLKVFIYQGGLQSTEEAVSHAVPLIGLPVFGDQDMNVDKMVSLGVAKKLEITAVKRDDLLEAIRTIALDKGYKQRMLTLRSLLNEKLRDSLENAIWWTEHVIRHRGAPHLHSSTSDEPWYQRQDMDIVAFISAIFVITLISSLVILYKSLMYCLNALTRNFTRSVGKDKKGN

SEQ ID NO: 6661 - protein, 694 aa, Blattella germanica
MMVLQEFLDGATEGAIYFSLGTNVRSDAMTREKIQIFNDVFSQLSEFRVLWKYEDDNLPEMPSNVMICKWFPQQDILGGLQSTEETIRTQVPVLGFPFFGDQDLNMQMKYSEISQDHPQTSKERAVWWTEYVIRHKGARHLRSGIIDISWFEYFMLDVLTFILISSILIFWAINRVVQLLVNGGHNYYIYDTVHSALILGVFPIPSISHQVVYHGLLRELNSRGHEIVIITPNPLNNSSLKNYREIDVSNLYIGWRERFNFLKSREMGATRKDFAGEMMDTGKDLCTGIFENSEFKTFMETNKGLVFDLVIMEWLVTPCTCGLAYHFAAPIVGISSLGILYPGYESIGNPVHPIYYSDSLYPALKNPSIWEKFHRMFYYLWFKWQWTAVLQEQDKIARRFINSSLPYLGDLERNVSLVFTNVATSNHFVVPKVPTLIELGQMHFQEIKPLPKDLQEYLDAATKGAIYFSLGTNVRTECMSQEHLQIFNDVFSQLSHIRVLWKYDGDYLPGKPSNVKISKWFPQQDIFAHPNLKAIVFQGGLQSAEEAIRAQVPVLGFPILADQDLNMQMIVDNGIGEMLYFEELTREKLLSTLKKIIYDPKYKLNMQKFSKITQDHPQTSKERAVWWTEYVIRHKGASHLRAGTMDVSWFEYFMLDAVAVIFISIILILWGIYRVITIIMRILNSSKKMSVKGD

SEQ ID NO: 6662 - protein, 517 aa, Strigamia maritima
MKLPRTLSLMLVLFVQLTEAYKILCLLPLASQSHKNLFDPLINELAGRGHEVTVVAPYKLAQPIANINEIQIENIITSESTQLISNWVKYSNYHPLFTASYYKPFTIIGCKAYFENAQVKQLLKSGKQFDVVIVNALLNDCALATAPLLGKYIIMHSPTCLIPWNPVFVPQPPSYVPNIFLPYTSRMNFFQRVNNVVTNIGFNFMYNYHLLPAVQDEITKHVAENPLVHQAHQAVSLTLTNSDPVLISARPSMPNIVNVGGLHCTSANPLPSELEDFVKKSGNDGFIYFSLGSNILIKDLENEIKDHLLNAFSKLKQKVIFKCEEELNNLPPNVKLVKWAPQQDLLGHPKIKAFITHGGLLSLQESVYHEVPVVAIPLMGDQPSNVARVVELEIGLKLDFHSISTDSLLEAVDKILSNSYKDNVKKYSRVFRDHYQHPVQRAAFWVEYVVRHDGAKHLRSPGEDLNLFQYLLLDILALLLLCFVSVLWVMLSVGKCVLARILPCGKKTKKLTVKKKQ

SEQ ID NO: 6663 - protein, 526 aa, Agrotis ipsilon
MNGRVVPILLLALFLLGRAAPARILAVFPTPAYSHHSVFKVYIRALVERGHEVVVIKSTNRISYTDELPLYSNEDDDRDLRRNITEIDASLSQDYFKRLMKQAGVFRKRGLVADSGTVTAHNYVSLVRMISDQFDLPDVKSFLDKRQHLKFDVLITEAFIDYALVFSHLFGDIPVIQISSGYAVAENFETMGAVSRHPVYYPNLWRDKFSGLNVWDMINEIYVELRLQNEFSKLADEQNRLLKRQFGADTPTVQELRNRVQLLFVNTHAVFDNNRPVPPSVQYLGAMHLVDKRPKPLFGMVRELLDNATEGAVYVSFGSGISTDEMESEFIEMLLRTFRALPYTILWKYDGFLTNLPPNVFIQSWFDQYNLLHHKNVRAFVTQGGVQSTDEAIDALVPLVGMPMMGDQAFNTNKYIELGIGRVVDTVHVDAFQLTEAITDVAQNPTFRKRLNELRHFIRHQAVSPIHKAIWYTEHVINTSNGGGTMLKTKAANVNYSDYIMSYIFVPLITFTVMNHLRQLLRINVM

SEQ ID NO: 6664 - protein, 545 aa, Symbiodinium microadriaticum
MAQPHRHYGLRKTFGNAPCFLDSSHFFAVRNMETQTQSSRSFAFIFPLAAGHINPSLAIARFLVQQGHGVHYLCREQMREAIEDTGAVFHSDIETQPELYAGRAPSMWGALGSLQEEHGMKGESLSQARLKLRELAVELMLPGTLRWLEKIKAQAVLCDPLINLEAPLAARVAGIPCVSLLTVAGPGGQEVAWGGVLQALGTSAEKVLQERREFQGLQDCIERLKKTYGIHLAVEDGVKPLGVFRSCLMSTLTLVTTAEFLADPMSPEVSKAYTGHDFVYLGPMLDKPGAKRAGGHKLDAAMHSGADTDATALNLARDARAEGRPLVLVSLGTIITGDHADYGWGARFVVDGQQVGISGRELCQAAWQAAFDVFGQWDPSSTQSPLILAALGPQADALEGLKVPPNAFCSPTLPQVDLLRLGVDVFLTHGGQNSFTEALSMGVPLVVCPGFADQPVNAAKAESLQIGLKVDRPMRPLEHAQADRAAYRKTAADALTKVAQDPSFKEHAMNCARALSACGGVSLASRILLDLATSKLPLQLAQAGA

SEQ ID NO: 6665 - protein, 531 aa, Drosophila simulans
MVLPAEKILLLAIAIGALMGSSQGANILGLFTSISPSHLIIQMSAVKVLAENGHNVTVVTVLKPVVNHKNITVIQVPLSREEAQIMSDKIGVMSKNDNSNMALSLLRMSEQMDFMIRKTAETLMNDRVRDLYLNRGNKFDLVLSGYFMNDYQLGFAKKVNAPVIVVATMPPNQLLNPLIGNPLEVAYVPSISDSVEKGKGMSFRQRLAGYSSSLFFEIFNFVTQRRSKKLYKKVYGNDPNMPEYSEMLKNTSLVFFSSHAASEGPIRPNVPSAIEIGGIQIKDKPDPLPQTIAEFLGNATNGAILLSLGSNVQGKHLNPETVVKMFNVLSKLKERVIWKWEDQENTPGKSANILYSKWLPQDDILAHPNIKLFINHAGKGGITESQYHGKPMLSLPVFGDQPRNANAMVKSGFGLTLSLLTLEEQPFQEAILEILSNPQYAERVKSFSTLYRDRPMTARQSFLYWTEYVIRHHGAAHLQSPLLHMNFIAANNIDIYFLIFVILISVLVLIKFLVKFIYRRFISKPKKVKTN

SEQ ID NO: 6666 - protein, 425 aa, Drosophila serrata
MEAQFVSDYFYNCSKFVLEDPGVQELIRNTSAQYSMVVLEASHTDALYGFSQIFNAPLVGIAAYGSAWNIDFLAGNSAPSVYEPMSALGYSPGLSLLEKWHNLIFITEERLVERFIYLPRQIDLYKQHFPTISTSLHDLRRRFSLILINQHFSMGRVRSNVPNLVEVAGMHLHSPPEPLDRELQQFLDEAEHGVVYFSMGLQMMDRWLPSEMLTTMLTAFKKLKQRVVWKTNDPRMGNKSTNVYAKGYLPQRAILKHPNVKVFITHAGLLSTIEATHYAVPLLCIPIFFDQFQNSDRMEKMGVARSLDVGRFTPEMMVEAIEDMSLNPIYKQKALELSDRFHDQPMTPIETAIWWTEYVLRHKGADYMRIAEQEMSLMQYYNVDVVSVLFGRIGLSAMILIFLGWKLVSLATRNLEYRFNVPMVR

SEQ ID NO: 6667 - protein, 519 aa, Drosophila virilis
MHSICAWKLLLLFSLFSVNSSTHALKILGLFPHPALSHFQFFQPLMRRLAEAGHNVDVVSPFRDLNPPTGYKDYALPSANLNDKIGFDMFEDVAMPYLMPFTEFFILHGYGKAACNSTLNSAALAQILRHPVGYYDVIVLEQFNTDCMMGVAHQLQSPVVAMSSCALMPWHYERMGAPIIPSYMPALFLGESQHMQFAGRLANWLTTHALNWLYGWYSVPAADALLRQRFGAGMPSTGELVKNTSLMLVNQHYSLSGAKPLPPNVIEVGGLHVSQAKPLHDALQQLLDKAKHGVIIISWGSQLKANTLSGAKREGLLRALARLPQQIIWKWENVTLPEQPPNVHIMKWLPQRDLLAHPNVRLFFTHGGLMGLTEAVASGVPILGMPVYGDQHLNVAALVERGMAVRLDFERLREQTAFEALSQALDAKYKRQAQKIAAAYNERPQLALETALWWVQHVAETGGAPLLQSGAVRLNRFVYYSLDVYVALACALLLFLAIATEIWRRCCKRKQPVQKPKRS

SEQ ID NO: 6668 - protein, 508 aa, Tribolium castaneum
MCLVLVLVLLSPLVAHSANILGVFMFPSISHQIVYQPIWRELSLRGHNVTVVTPDPLNDPTLTNLTEISVRFTYDFLKENRLQDVMSKDANPFQTFKTIFKLMDKILEAELESPPMAQLLKSEQKFDLILFECFHPALYGLSGRFKAPIIGVSSLGLLTAGYDAVGNPTHPVLYPDVMLNFHSKELGIWEKIQTVFFNLWSRYYYHQVITPRAHELATKYFGEVPYVGDLERNVSLFFLNVNPFMYAPRPNVPAIVEMGQMHIKPPKPLPEDLKKILDSAPQGAVYFSLGSNVKSVNIPEKLRKTIMGALAQLPYLVLWKFEADHLPGKPPNVVIRKWLPQQDVLAHPNIRAFVTQGGLQSTEEAISRKVPLVGMPFMGDQPMNVQKIVDLGIGVGVDPATLTEDQLKKSIIEVAENKKYKRKMEEVNEILFDKPMSGLEKAVYWSEYVIRHGGTRHLRSPTADISWFEYLLVDVVGVLVAILAAILYASYKLAQLSMEFRRQKIKVN

SEQ ID NO: 6669 - protein, 591 aa, Bicyclus anynana
MILDKNIEFYREEAAGKMFKKMLWLVSILFTLSEINAYKYLVVNPLPVKSHSILGDALVDHLVDAGHEVTYIAVFAPQKISPRVTHIDISDNLKFSPEKELNLKSIMDGKVMTNSLFTYVPVMLEIGKATLGNPNVQKLMADKNQRFDAVIAEWNYHDVYVGFAALFNCPLIWFSSVEPHWMVLQLIDEIPNPAYSTDMLTTDYTPPLTFNQRVVELYTQFFTRFIQIFYLSGLEHDVYNEYFAPFIRDRYNTVPPFEELRYNASLMLSNSHISMNIPIRLPANVITIGGYHIKPNIKPLPENLQKVMDKAKDGVIYFSMGTNLRSNHFPDQVKQDLLKMFGKLKQTVIWKFEEDLPNRPNNVHIVQWAPQQSILAHPNCLLFITHGGLLSTTETVHFGVPIIGIPVFADQYVNVGRAVKKGFAQRVDLSYSLAVDLEKAIRNVLFDSSYTTRIKELSAIYHDRTVPPAKELVHWAEQVVKTKGARHLRSPAFMMPWYQKMYLDLILVSLVVLLKFLIRFNYSTIATLDFYDLPKMLSYPTNIRFVHTATDQASQNQYKQDSCVVYYRRRLAARRGPSKFRLLVLVLGNLI

SEQ ID NO: 6670 - protein, 558 aa, Camponotus floridanus
MRLITATSSIIMILWILTMSNLTCSKRLLIITPAPSYSHQIVFRALCLALNKRGHEIVTLTPNILNDSSLINYKEIDFGFVYEKIDDTDLSQTRWNLTQLGGLKTRLLKLGHDIAEDVLSHPDLLKYYANETNVQFDAVIAEMIMTPAIYMLAHRFHVPLIGIMSMDLQNCHRFNFGSPVLPSHPSNWELENDTGLNIPFWKRLKNFIKTWWLIQSWFNTFAFKQQQIAEKYFGKDIPNIIDVAKNMSLILINQEPVLAYARPEIPNIVYFSGLHIKKTPPLLPKNLKDFLDGAVNGFIYMSLGTNVKSKLLPKGMLEVFTNAFANLPYKVLWKFESDDFHVPSNVFISKWIPQQGVLAHPNIKLFIYQGGLQSTEEAVHYAVPLIGIPFVFDQVYQVMKMVSLGVAKHLDIVQLTTPELRDTILEIAGDKRYKNKMLELRALTKDKPYESLENAIWWIEFVMRHNGAPHLRFNGVDTAWYQQFDLDIILSHGMGETNFPIQFPDGSHKDLFMKRSSRVKAGSSRDSRKTTEEDESSSSDSDNAIYARITAVKRYQNN

SEQ ID NO: 6671 - protein, 530 aa, Galeopterus variegatus
MVSEKWASAFLLLQLCCAGCGLCGKALVWPSDMSHWLNIKNILDELADRGHEVTVMSPSYTILIDHRKPSALNFEVFHVPFDRKNTEDKSDELLNLILNVLPSLPFWQSAIKLNDFFIGLTGNFKLLCESVVYNKTLMKKLLEANYDIMIIDPVTPCGELVAELLAVPFVITLRVSVGGNMERCCGKLPAPPSYVPVPMVGLTDRMTFLERVKNTMLLVFFNFWMQDYDFHFWKQFYSEALGRPTTICEILGKAEIWLIRTYWDFEFPRPYLPNFEFVGGLHCKPAKPLPEEMEEFVQSSGEDGVVVFSLGSLVQNLTEEKSDLIASALAQIPQKVLWRYKGKKPATLGANTRLYDWIPQNDLLGHPKTKAFITHGGMNGVYEAIYHGVPMVGIPMFGDQPDNIAHMKAKGAAVEISFNTMTHADLLRALRTVINDPSYKENAMRLSKIHHDQPVKPLDRAIFWIEYVMRHKGAKHLRPAIHDLTWVQYHSLDVIGFLMACVAISIFLVTKCCLFTCQKLGKTRIKTKRE

SEQ ID NO: 6672 - protein, 444 aa, Bradyrhizobium elkanii
MKALLVSSPMMGHLHPVLGVGRILIADGWKVMGLTSSYLRDRVEKIGAQFRSFVPAADIDTRDAAKLFPEIMTAAPGAQQLRLILEQGFANFMLAQYESIKIVMQEFPPDIIIGDHLMLGVLPMLLGPRAQRPSVALLGTTYLLSRRDDGAPNDAGIRPARNDQQLREYASLFQTYEQSVFGPAGRCVNEYLAQIGSRPLRLNLYDAMVELPDIYLQLTVPRFELPRRRLPSSVHFVGPLPITPNQAPVPSWAYELDGSRKVVLVTQGTLTNNDFSELTLPTLEALANERDVLVMVTTGGRPIDALGGRLPQNVRVAQYLPFEWALSKADAFVTNGGYGSVNQALSYGVPIVAAGTAADRGDVGVRVAWSGVGVNLATNAPTAEQLRPAVRSVLDDPRYRQRAASLAEDIREIDTPSEIRWLLRQQISLHSQDGLRPKAGAAKA

SEQ ID NO: 6673 - protein, 514 aa, Temnothorax curvispinosus
MWKVIYKMFIVLSLWFLLANDITNAERILVITPAPFYSHHVVFRALCLALNKRGHELTVITPQPIKDSTLKNYTEIGLDLHEINKYYYLVSQLPMIEFLKFFWKLSHQVSIKIFEDLKFKELYRHDSNEKFDAVILESLGCMSLSTMAYRFNAPLIGIISVNIHNYHRYIFGSSIYPSHPSNWEFNILPEENPSIWQRLWNFIDTWCLIHYWINNYITVEQEIVKKYLGNDIPYIVDIMKNMSVMLVNENPILAYPRPEQPNAIFFNGIHIQKTPPSLPKDLGQFLDDAMEGFIYVSFGTITTCHDLPKETLKNIVEVFSKLPYKIVWKFDCELPEKLDNAFISEWFLQQGVLAHPNIKLFIYQGGAQSTEEAVHYAVPILGIPTMSEQENRVRRLVSLGAAIYIKFNELTKERLDSAIYQILNDKSYKEKMMYLSSLFKNQPYNSTENLIWWVEFVMRHKGVNHLRFSDSDKPWYQRYDIDIIALLATALFIIECVIALTIIQIIRFTLNNIV

SEQ ID NO: 6674 - protein, 313 aa, Cryptotermes secundus
MCVSLVSEDLEQFVSGADMGFIYVSMGSSVLTAKMPDMLRHMFIRAFEQLPYRVLWKWEAGEGSIADLPDNVRLGRWLPQQDILGHHKIRAFVTHGGLLSMFETVYHAVPVVTMPVFCDHDANSAKAVIDGYALKLELQELTADKLVWAINQVIHDSRYRDEVRKRSKLLRDQPEHPLNRAIYWTEYVLRHKGAYHLQSPAKEYCFVQYYLIDVALFCLIAGYICAKLFIKLNSVMIRLIVSHITNQQSSNEDGVTKMKSEANGFSSGSAEITLRRNGNIVSNSNSVSVERTISNGESHKIGACLTNGIKQRR

SEQ ID NO: 6675 - protein, 523 aa, Bactrocera oleae
MKCLSQLKIVFLLCTQLCYFESLHGAKILAIFPYSGRSQYICVENYLKALAARGHEVTTISAFPQKKPVQNFRDVPIIYEKTLFEDFAVDSIMPTISKWEELNWGIEFLTMPTRKVLEHPEVQKWLENGVKFDLLIVEVLQQDALYALSHHFNASLIGVSSFGTDMRIDELVGNTSPLSYVPSILSTYSDHMSFFQRLDSLYTHVVEWVHNHFVIIPLQYEIYKEYVSNPTADFMAVRNNFSLLLLNQHFSLSIPRPYVSNAIEVAGWHIDHKSSVLPADMEAFINANPNGAIFFSLGSNLHSKNLSKEKLAIILNVFASLPYNILWKFEVPELQGKPKNVYINKWFPQADILSHPNVKVFITHGGLLSTIEAIHYAKPIVGIPIFYDQHINVARAEAKGFGLGVDLKNLNTNVLKDTILEVLNNPKYSQRAHELSHRYHDQPLKPLEKAIYWTEYVLRHKGASHMRVAAQDLNFIEYHNLDAIAVLFGLPLLALVFMLWTSCRLLNLITEKLIGQKRKVKHD

SEQ ID NO: 6676 - protein, 226 aa, Equus asinus
MELAFYTAEHTWPAGPLARTLQQALRMAPGKVLWRYTGKKPDTLGPNTRLYDWIPQNDLLGHPKTRAFITHCGTNGIYEAIYHGVPMVGIPVFSDQFGNIARVKAKGAAVEVDLHAMTTSDLLNALKAVVNNPSYKENAMKLSRIHHDQPMKPLDRAVFWIEFVMRHKGAKHLRPASYDLTWYQYHSLDVIGFLLACVATIMFLVTKCCLFCYWKFGKTGKKKKRE

SEQ ID NO: 6677 - protein, 539 aa, Daphnia pulex
MKPIENFLWLMIVLCHFFTACYGGRILVLLPLGSKSHKLAVMPVLEALAQRGHNLTIVSGFESPEKMTNIHEIQITSIDVILEKVVNWYDTERGDDETQLKTMMTALPYTSTFIYDEMMSNPEFQSIMLKRSVDLVIVDGIVSELTFPIIEHLRVPFVFHCSSFGPWTTAAMEAMGTDSDYASIPFPQTGLDDKMTFAQRLTNIRKAQSFHSLRQAHIFDTIDAYVKKDFPKARPSGDFMKEASLVLINSDITTDWPRSLPPTVIPIGAVHARPARELTLPLQTFADEAEAGFIVLTFGSIIKMTAMPHDSLQTFLKVFSRIPQRVVLKWEGEIPEDVPSNVMMVNWLPQQDLLGHPNAKIFITHGGMLGTQEAIYHAVPLIGLPFGNDQHTNLAMATKQGFGLKIDWEHLCEKLLYDSIVKIINEPTFKANASRLSGLMRDRLVPGTELAVYWIEHVLRHGDTKHLQVSSKYVPLYQKYLVDVVLFLAVILVVMLTSSYYTVRFLISKCRQRNNPVKSKTKNKSCVFSCVQYTKNLFA

SEQ ID NO: 6678 - protein, 529 aa, Ceratotherium simum
MSMKWISVLLLLQLSCYFSPGNGGKVLVWPTEYSHWINMKIILDELVQRGHEVIVLTSSASILVDPNKASAIKFEIYPTSLTKDDFEVLFRKLIDKWSYLPKDTFWTHFSLLQEIIWEYSDCIEKLCKEVVFNKKLLTKLQESRFDLIFADAVGPCSELLAELLKIPLMYSIRFSPGHRIEKYSGGLPFPPSYVPLVMSELSDQMTFMERVKNMIYVLYFDFWFQTFNEKRWDQFYTEVLGRPTTLSELMRKAEMWLIRTYWDFEFPRPFLPHFEYIGGYHCKPAKPLPKEMEEFAQSSGENGIVVFTLGSMISNMTEERAHVIASALAQIPQKVIWRFDGRKPDTLGPNTRLYKWIPQNDLLGHSKTKAFITHGGANGIYEAIYHGIPMVGVPLFADQPDNIARMKTRGAAVRLDFNTMSSTDLLNALKTVINDPSYKENAVKLSRIQHDQPMKPLDRAVFRIEYVMRHKGAKHLRPASHDLAWFQYHSLDVLGFLLACVATAIGIITKCCLFCCQKIAKMRRKEKRD

SEQ ID NO: 6679 - protein, 513 aa, Aedes albopictus
MLHSTGKYLIALVLVSLPSTIHCDNILFLQTTPSRSHHIWNKQIFNRLYDNGHNLTILTFEQEQSIPGKSFFYVPKLYARIMAEFAAEDSAGSAMGPVGNIINMYSFYEKASRILAQEPAIQHLLNYPELFKFDLIIHDFTMGQFLLGFVQRFGNPPLVSVSAFNLPSYTMHLADIPIRFTTLPNYACEYEQHMSFMERIANTFYWLLDSYHRQFRFMASEDGRARELFGSNTTSVKNIEKRSSVVLVNSDFSMDYHQALPPNVIPVGGLHITRPEKIPQIIADFMDIPSKGVILLSFGTNVQSEGLGKNVNEAILKTFTNLPDYNFIWKHGDPESLEPVPPNVLVQKWVPQGAILSDPRTKLLIGHGGLLGLQEATWYGIPTIGIPFFADQLQNVDKLVRGGGGLRLFLDELNENSLKRAIDSVLSDKRYHQNMEARSRLFRNQPQPPLERAVFWIEKVLENKGLPHLMSPGQDIPFYQLYGIDLICATLLIIAGVHILCKMALSFSFNKQS

SEQ ID NO: 6680 - protein, 514 aa, Priapulus caudatus
MNIVAMATAACVLATLLAVLRTTDAGNILMVPVGAGRPSSHRFVMEKAATVLAENGHSITWLLGNEHPPVAFGASVTYASRPATHVDADALIAEGNVGVGYILNMLNQFVDACAMLLNDRRTFDELRRRKFDLMFLDAADLCGFAMADGIGVPYAAIVSTGTAGVLFSEAPAMLSFSPSLVLPYTNRMTFAQRFKNTLVHVFFKVVGHVTFVRRLEGVARRAGFLADSSIEAVARRTNMHFVVGDFSFDYPIPVMPNTKHIGVITAGKPLPLAAPLQEFVQRSAARGVVVISFGSAVNSAGGDVVRKIAAAIADLPYFFVWRLRAADAPPLGDNVKIVDWIPQNDLLGHAKVVLFVTHAGPNSVWESVYHGVPMLALPIVADEYGNAARVVHHGVGKQLDFYGFTADEFRSGVIELITNRTYAERAAFKSRQLRANTGASSEGFLWWTNHLLETKGATYLRPASVELNFFQFYLLDVFTFLAVIGAIFVLCVWKLGASLYRRRIENRNAKTKLQ

SEQ ID NO: 6681 - protein, 519 aa, Bicyclus anynana
MHYMLQCILIALATLFGTINTYKLLVISPLPGKSHAILGEAMTEHLSNAGHEVTYVTVYLPEKPIPRVTVVDLSDNMKLFNSGAMSLQAVMDKTHTGNSFFVFVPMLMNMSRDTIAHPNVQKLINDKNQQFDAVIAEWMFNEVYAGFAGVFNCPFIWFSTVEPHWMVLRLVDEVTNPAYSVDILSDSVPPLTFTQRVKELGLLTAGRLIQALWVSRLENNLYDEYFVPVIEKRHNTVPSFETLRFNASLLLSNSHVSMGVPARLPANVITIGGFHIKPNVKPLPEDLQKLMDNAKHGVIYFSMGSNLRSKHFPEIVRQDLLKMFSKFKQTVIWKFEEDLPNTPSNVHIVQWAPQQSILAHKNCILFITHGGLLSTTETMHFGVPTIGIPVFADQFVNVARAVKKGYAQKVDLSYSMAADIELAINKLLDNPSYTTRVKELSQIYHDRPVPPARELVHWVEHVVKTRGAPHLRSPASMVAWYQKLYLDLVLVVVAVVLVLKRVFIYLKSILIAKRKEKTN

SEQ ID NO: 6682 - protein, 313 aa, Eumeta japonica
MAIRSYVGLLPTKTPWPSYRSFVMGSRYLNLTAKEKVYGNRFLASRAREWMMSFPKSTALGHNLRGRPSAALPKQRMSPVCFERCLRGVRSNFSTRPMAAFWRFGIGVLQCSYASRVSVYGGCSLCCVPCPFAVPIPDELPQRFGKQRQPLPFHDQSSAKLSDLQKLMDNAKDGVIYFSMGSNLKSKFMPEKMKREFLETFSKFKQTVLWKFEDVLPDLPSNVHIIKWGPQQSILAHPNCILFVTHGGMLSTTEAVHFGVPIIGIPVIGDQHNNVKKAVRKGFAMKVDLSYDTPKELKSAIEEVLSNPRSVDF

SEQ ID NO: 6683 - protein, 504 aa, Myzus persicae
MLPCVVFCLVLCITTNVTRAANILVFMPLPIKSHVRGFQPLFEELSNRGHNVTVVSSFPLDRPVANYTDIGPFVDKTRGRNVMDLVSMNFVTSVQLKWRISIQLSEMVMSHRKMKQFVQSSSNSFDLIMVETFGQEYAVAMGHKFNAPVINLAPAMIWASISKWLHVPSTFSYIPDACTQSTSDMGFIERLKNSITGFMQLYVENYLYLPKTKEVMDTYLKYRGWESRPPLEHMLNNISLTLVNSHNAIGISRAYLPGIIEVGGMHIKDPKPLPKNLQTFLDTANEGVIFFSFGTLVNLNDLPKAKLKVFISVLGRLKQKVIIKWIPDDNNVKLSQNIMTGSWFPQRDILAHPNVILFITHGGLHSLEETVCNAKPIVGIPFFAEQNFNMKIVEEKGYGKLVNFFEITEESFGNAIEEVLSNVTFKEKAIIQSLVYKDQPMKPLDRAVYWVEYVIRYGGAGHLKSDSIGLNDLQYFLFDISLIVLLSFGLIAWLCYFLFVKIMS

SEQ ID NO: 6684 - protein, 524 aa, Ceratitis capitata
MKKYTPLTSLLLLLVINASFFESLNGAKILAIFPFSGRSQYICAENYLKALAARGHNVTVISAFPQAKPLQNFNDVPIVFESHDWSDIILDGNFPSISTWEALDLGIDFLTSSTRKVLEHPEVQKWLTNGDTFDLLIVEALEQDALYALAHHFKALLVGVSSFGTDIRIDELVDNVSPLSYIPAVTSHFTDHMNFYQRLESLYISVLDMLHYHYKILPLQYDLYREYVKNPTTDFMEIRKNFSLLLLNQHFSIGLPRPYVPNAIEVAGFHISHKPKSLPTDMEEFINASANGAIYFSLGSNINSKNLSKEKISILMKVFAALPYNILWKFEAPELPGKPKNVYISKWFPQADILAHPKVKLFITHGGLLSTIETIHYGKPIVGMAIMYDQFINMVRAEAKGFALSINFGEFTAAGLKSAILEVLQNPKYAQRAAEISRLYHDQPMKPLERAIYWTEYTLRHHGAPHMRVAARDLNFFEYHSIDTITVLFGVPLCLLVFTLWLMYKLMKIIARSWNVQNKKEKVN

SEQ ID NO: 6685 - protein, 484 aa, Loxodonta africana
MLNKIILLLSLQISLLGTTHGGNVLIWPMEGSHWLNIKIIIDELIKREHNVTVLVASGALFITPTSETSLTFERYKVPFDSERIQKVITSFVLTWLEHRPSPSTIWTFYQEMAKIIKDFHMVSRAICDSVLQNQKLMEKLNKSKFEVLVSDPVFPCGDIVALKLGIPFIFSLRFSPASTVEKHCGKVPYPPSYVPAILSELTDQMSFTDRIRNFISYHLQDYIFDTLWKSWDSYYSKALGKPTTLCETMGKAEIWLIRTYWDFEFPRPYLPNFEFVGGLHCKPAKPLPKVLWRYKGVKPATLGANTQLYDWIPQNDLLGHPKTKAFITHGGTNGIYEAIYHGVPMVGLPMFADQPDNIIHMKAKGAAVDMNMNTMTSADFLNALRTVINDPSYKENVMRLSKIHHDQPLKPLDRAVFWIEFVMRHKGAKHLRPAAHDLTWYQYHSLDVIGFLLACVATVIFLVTKCCLFSFQKFRKAGKKKKRE

SEQ ID NO: 6686 - protein, 220 aa, Amyelois transitella
MEAYIMMPIMISSFVDVFAELPYNVLWKWHTEDVPRLPKNVKISKWLPQRDLLMHPNVKLFITQGGLQSTDEAIEAAVPLIGIPMLGDQWYNVEKYVHHGIGVRLDIETIDADKFKDAIDTVINDKSYHDNIRKLKSLMYDQPQTPLEKAVWWTEYVLRHGGRHLRSPAANLPWTVYYEIELLFYLLLFVIGARFLLVYLLFKLYKFVRGWLSKRKLKTN

SEQ ID NO: 6687 - protein, 788 aa, Plutella xylostella
MTKENKINWKCDVCVSKKVPVCTTSSTPQTSTASSSKTNILTKTPADYHVTTRKKQNESNTQNETSFVTESNLRAILKQEITAAIKSSIKELVMAELQNINQQIGSFHESMTFFNQHFEDLKANLEEKSTHIKVLQEENLNLKSTVNDLTSRLCLVEQQMRESNIEINGIPEKNSENLSTIVNKIAKSVDCQLKDDDVLHVTRVAKLNKENPRPRTVVAKLRSTRHRDALIAAVSSYNRKNPGNKLSTHHLGYDGASSPVYVAEHLTPTYKALHAEVRKKAKELSYKFIWLIMLVFVIFPGKSLSILGESFVRHLLNAGHEVTYVTPSPMKNKPKNNFHEVDVSEGVDKLFVEICNITFLLENTHFESDEEEIMHLGLEVAEMTLTNPNMLKLLNDKTQKFDVVVGDYLASELVAGIAYYYDCPMIWSYSMGVDSAILKLVHEPTNPSYIPDYISLNIPPMSFTQRVGELWTLIRNTWVKRHSVMPRELAFYKKFYKPLLAMKGKPLPAYEDVMYNASLVLVNSHQASGGLAAIPQSVKLIGGHHINGPVAPLTDDLKEIMDSSTNGVIYFSMGSIWKSASMPITLRDNLVRMFGSLKQTVLWKFEEDIPNLPKNIHTLKWAPQHSILAHENCMLFITHGGLGSSTEALHFGVPILGVPISFDQFLNINRAVSKGYALSVKLSYNLHNDLKVAIDTIATDPSFKSNAKALSEIYHDRPVKPAVEIPHWVRHVVRTRGAPHLRSPALMVPWYQKTYLDLVALFLLVVLSLFLLAKKLMFTVKSAKVKSN

SEQ ID NO: 6688 - protein, 511 aa, Tribolium castaneum
MKPVLFVFGTNLLFSIAQCARILGVFPAPGYSQFILAEVLMKEIANRGHEVTVISPYKPHNAPPNYKTIETSDVIENSDGLDLYELDNESLFKNILTTYEFGNIITEFTLKNKEVQKLLHSDVSFDLVIVEQFFNDAMKGFARHFNAPLVLFSSMGLTEWNKEYMGIPALPSINAISYTSYTNRMNFFERIRNLIGTIFDYCYRKWVFYPIQREYLSRYFPNSIDFDEIINNASLMLLNSHFTTSENVLLPFNMIEIGGFHVSQNPLSKDIQKILDEATDGAILFSLGSNLQSSDLTPKILNTILSVFGKLKQKVLWKFEKDLSEKPSNVFISKWLKQADILAHPNIQLFITHGGMLSTTEAIFNGVPILGIPVFADQKMNTARAKRAGFANVMSLKDLTEGKFLSLINETINEPKYSENARKMSNLMRDRVVRPLDLAMYWVEYAIRNEGVRFETPVLKMYWFQVYMLDILCFVIFNLLVIYLSVKYLCSFMLPKKCKTNSKVNDRKKRQ

SEQ ID NO: 6689 - protein, 524 aa, Neodiprion lecontei
MKYLCKLLLIVFCLLSSTRHVNSARILAVFPLDTTSHFIMFDVVVKSLADAGHQVDVYSHFAQKRAYPNYTHTSIGDISQTTAKLGLTYDVIDSYRGTKDALIELAGNMGCQLLGHPEMQKLIKNPPTNPPYDLVITESFYGSCWYAFGRHLKVPLVALSSRSLLTFYNAPIGNPQNTAFVSEITDGSILYMNFWQRFKNTFSALWRNHEFNCHTEVQSDIVKKYFGPHMPGVRELEKDVALILVNSHHVLTGIRPLTPAVVDIGGIHVSDDDTALPTDLGKWLDDSRHGFIYFTFGSMIRIESFPKAMLAELYAGFAKIAPVRVLMRIFAPEDLPPNMPDNVLTMRWVPQIKVLKHKNIRAFVTQGGVLSLQEALTFAVPIIGIPIIADQPVNVKNCVERKIAVMLDYKNLTAEKFVEAVNATIYDPRYKQNVVAASEKFLDRPLNARDTAVYWIEYILRHGGDSLRSPALKLTWWQVALLDVYGCIFIAVLTVLYLARLILSTLLRQIIYVAKKIPTSKKTN

SEQ ID NO: 6690 - protein, 1037 aa, Pieris rapae
MAWLIWFTGLAVLCAVQPYKILVPVLLPGKSHGILGEGLVRHLLNGGHEVTYITPYPPKPQKNLTVIDVSENIKGITGVCNVKKMMDGETELQSLYILMDIMVEIDRLTYKSDVMQKFLSDHTQKFDLIIAEWLFIDLNAGISAVYDCPLIWLSSLEPHWMALRLIDEMPNPAYVSHLSSNNAPPLSFWQRLEELGNQIYGSWLHYFYMAPRENKLYEQYIVPHVKSRNKPVPSLNELRYNASLMFGNSHVSLGEATRLPQNYIPVGGYHIETDVKPLPEDLKKLMDNAEHGVIYFSLGSHLRSEDLPEAVTRELLQMFGELKQTVIWKFETDLPNKPKNVHVVHWAPQQSILAHPKTLFFISHGGLLSTTESVHFGVPMITIPVMVDQFANAERVVRKGIAIKVNLSYTMVKDIRNAIKTMLADPTYTKTAKSLSFIYHHRPISPGEEIRHWVDHVVKTNGAMHLRSPALHVPWYQKLYIDLLAVILVPLVVLIYLAKKYTAVDKNNSKTNKKYNLYFQTMELWTVCLLAAILTITNIEAYKILVVITLPGKSHGILGDGLTRHLLKAGHEVTFITPYPPKPQNNLTVIDVSDNSKVLTGGVLNIHNMMKKDVDLQSAYMLMDISIDIGKATLMNPAVQKLLSDPSQKFDLIITEWLYQELYAGFAAVFDCPYIWFSSFEPHWMVLRLIDEMPNPAYVSDSSSNNAPPLSFKERIEELISQLHGLWLFYLYIAPRENQYYETYLVPHIRNKSKEVPSLNELKLNASIMLGNSHVSLGSATRLPQNYIPIGGYHIENDVKPLPQNLQMLMDSAGHGVIYFSMGSNLRSEDFPESVTKGILKVFGGLKQTVIWKFEKDLPNRPKNVHIIHWAPQQSILAHPNILFFISHGGLLSTTEAVHFAVPMICIPAMVDQFANVNRAVRKGFAIKVDLSFTMDKDLEIAIHTMLSNPKYTVKAKELSFVYHHRPLLPGDDILHWVDHVVKTNGAIHLRSPALHMPWYKKLYLDLLAVVLVFFSAIIFITKKVLSLNKNKKTKTN

SEQ ID NO: 6691 - protein, 518 aa, Ostrinia furnacalis
MVKLTNLSLLLMLSFSSAYKILVVFPYPGKSHTILGEGFVKHLVKAGHEITYITPIPIKNPPKGLRQIDVSSNKEIFEVMSHVLSFEMVLKKEIDLTDMRSLVRIVYDIANQTLWNDNVQKLMHDPNEEFDLVIAEWLYTELYCGFAAVFNCPFIWSSSMDPHGLVLELIDEHPNPAYTTNHVSSFEAPFTFLQRVEELWGIIYMKYVKWAYLNDHENQIFREGYGPAVTKRGRKLPSLYEVSHNASLMFGNSHFSSGRPVRLPQNYIPIAGYHIDDEVKPLPKDIQDIMDSAQHGVIYFSMGSMIKSSSMPDGIKQGFLKMFGSLKQTVIWKFEEVLPNLPKNVHILKWAPQQGILAHPNCKLFISHGGLLSTSEALHYGVPIIGIPMFADQFMNVDRAIKKGFALRVNIAEDMTDHLKAAIEEILGNPKYRERMKELSFIYYHRTAKPGQEILHWVDHVVKTRGALHLRSPALGVPFYQKIYLDLLALIIVATTLLYLIVKRLISKSVMTKKVKKN

SEQ ID NO: 6692 - protein, 484 aa, Miniopterus natalensis
MLEKIILVLSLQISLLGITLGGNVLIWPMEGSHWLNIKIIIDELIKKQHNVTVIVYSGALFIDPTYNPSLTFEIYKVPFGKERMEEMIRNFILTWMGNRPSPSTIWRFYQEIGIVLQDFHALCREICDGVLKNQKLMEKLKKSKFEVLVSDPVFPCGDIVALKLGIPFMFSLRFSPASTVEKHCGKTPYPPSYVPAILSELNDQMSFTDRIRNFISYHLQDYIFHTLWKSWDSYYSEALGRPTTLCETMGKAEIWLMRTYWDFEFPRPYLPNFEFVGGLHCKPAKPLPKVLWRYKGKKPATLGANTRLYDWIPQNDLLGHPKAKAFITHGGTNGIYEGIYHGVPMVGVPMFADQHDNIAHMKAKGAAVEVNINTMTSADLHDALKTVINEPSYKENAMRLSRIHHDQPIKPLDRAVFWIEFVMRHKGAKHLRPAAHNLTWFQYHSLDVIGFLLACAASAIILVTNCCLFSCRKFGKTGKKKKRE

SEQ ID NO: 6693 - protein, 531 aa, Cavia porcellus
MAPGKLASAVLLLLLCCAGSAFCGKVLVWPCEMSHWLNLKTLLEELAKRGHEVTVLSTSNNLFIDYNRHSAFNFEVIPVPTDKNLAENRLNEFVELAVNVMPTVSLWESGRLLQQFFIDVTKDMGLACRSTVYNQSLMKKLQESKYDVLITDPVLPCGELVAEMLGIPFVNTLRFFTGYTVEKYCGQLPAPPSYVPVPLGGLTTRMTFMERVKNMMFSILFDFWIQQYDYKFWDQFYSEALGRPTTLCEIMGKAEIWLIRTYWDFEFPRPYLPNFEFVGGLHCKPAKPLPKEMEEFVQSSGEDGVVVFSLGSISKNCQNLKSFNIAEKIKSQIPFKVLWRYKGKEPATLGPNTRLFDWIPQNDLLGHPKTKAFITHGGTNGIYEAIYHGVPMVGVPMFADQPDNIAHMKAKGAAVEVNMNTMTSADLLGALRTVINDPSYKENAMRLSRIHHDQPVKPLDRAVFWIEFVMRHKGAKHLRVAAHDLSWFQYHSLDVIGFLLVCVASAILLVTKGCLFFYQKFINTGKKIKRE

SEQ ID NO: 6694 - protein, 542 aa, Salmo salar
MGWGKSVPVVKQGLRLGPGHRLGLLVLLCCLALCPGPIQGDKVLVMPVEGSHWLSMKLLVKELAARGHEMVVLVPETSILIKSSDYHRTEIFKVPFNKAQLDKNINKLKDDMFRNTPKVTDIFMNVQGLIDFTDMQVKGCEGLLYDKPLMQRLRGEGFKMMLTDPFLPCGSIIAESFNIPAVYFLKGIPCGMEDRAAQCPNPPSYVPRFFSGNTDHMDFLGRVKNMLMYSLESYLCTVMFASFDELTSRYLEKDMTYRELLGHGAIWLLRYDYSFEYPKPTMPNMVHIGGINCGKRDPLPEDLQEFVDESGEDGFVVFTLGSMVSQMPEEKAKQFFDAFSRIPQRVVWRYTGVVPKNAPANVRLMKWLPQNELLGHPKVKAFITHGGTHGTYEGICNGVPMVMLPLFAEQGDNVHRMVVRGVGEMLNLFDITSEKLVEALNKVINDKSYKEKMMKLSAVHKDRPIEPLDLAVFWSEFVMRHGGAEHLRPAAHDLNWIQYHSLDVFTLLLTIVLIVVMVTVKCCKVCFRKCCGTKRTMKKKSA

SEQ ID NO: 6695 - protein, 519 aa, Aethina tumida
MKLVLFVVILVVTPFKPCDSARILGVVSFPSYSHQVVFQPVWRELSLRGHQVTTIITDSINDTSLTNLTEIVIKEAYTSLKKHNLLDADATHGFIKMIDTMINMAEDLLNVQYSHPQVQRLIHNRSELFDLVIFEALSPTVVYAWRFDCPAIGLSSLDAGDLLHNVMGNPTNPIANPDPRLKIQDDDNLTFKERLYSVVTSWFSLVVGVFKITPMVDKIQQKYFGESVPPFFKLIDKVEMIMIATNPIFHATRPLNPNTITIGSGIHILPPKPLPNDVKAFLDGAKEGVVYFSLGSNVKGNLMLEDTKKAIYKAFSELPYKFLIKVDWVNLTVPENVKVGRWLPQQDILRHPNIKLFITQGGLQSLQEAVTNAVPLVSIPFFGDQQMNLKKIVKRGFAVKLERTNITTESMKWAIQEVITNPKYKLKAIEMQDLMYDEPMTSLERAVWWIEYVIRHKGAPHFKSNAAKLPLYQYFLLDVIGVVLVSLIVVNYILYKIIQLTIRVAFRLVKGKLLKKKKE

SEQ ID NO: 6696 - protein, 1745 aa, Tribolium castaneum
MKLTLSLLVFVLISTVNSAKILGVFPVPGRSHYILASSLMRALAEKGHDVTVISCFGEKIPPKNGTYRDIVATGVFDEMQKEMNSKNMSMFEIGGASPLLNAFFMAVLLPEMTEKALKHENVQKFINSDEKFDVVIVEQFANDAQKALSTHFGAPLITFSTLGANYWVNPLVGNPSPPSYIPDLMSDYSVPMTFVERLENSLVYVMNELLYNFYIFPKQNELMKKYIPRAPAHINDVLYNSSIILMNAHPSINQPVPYVPNMVDIGGFHVKPPKKLPQDLQEFLDGAKDGVIYFSMGSNLKSADLPNDKRDAILKTFAKLKQKILWKWEDENLPGKPPNVKTAKWLPQQDILAHPNVKLFITHGGLLSTTETIYHGVPILAVPIFGDQKLNARSAVKGGYGVHLPYEELNEETLTNSINEVLSNKKYKENVQKRSKLFHDRLVSPIDTLTYWVEYVVRHRGAPHLRVAALDLPCYGVNSAKILGVMPVTGRSHYILVSTLMRALAEKGHDVTVISCWGEKNPPKNGTYRDIVVTGAFEEMQKLMSGADMNLFDMDSQNPLVGAIFMATMFPAMTEITLKHENVQKLINSGEKFDVVIVEQFANDAQKGLSTHFGAPLVSLSGVGANYWANALVGNPSPPSYIPDIMLDYSVPMAFCERVVNSFVYVFNELLHKFYIFRKHNEIMKKYIPNAPAHISDVLYNNSIILMNSHPSINQPVPYVPSMVDIGGFHVKPPKKLPQDLQEFLDGAKDGVIYFSMGSNLKSAELPNDKRDAILKTFAKLKQKVLWKWEEEDLPGKSPNVKTAKWLPQQDILVPFDLAPKMLVKMKTTFLLLVLVLISCYEANSAKILAVLPVAGRSHYILASTLMRALAERGHDVTVISCFGEKNPPKNGTYRDIVVTGAMEELEKQMSSDDVNMFEMEGINLFINALFMAFMLPTMNEATLKHENVQKFINSGEKFDVVIVEQFGNDAAKALSTHFGAPLISLSAVGASYWTNPLVGNPSPPSYIPDLMSDYSVPMTFCERLVNSLVINQPVPHVPNMIEIGGFHIKPPKKLPQDLQEFLDGAKDGIIYFSMGSNLKSADLPNDKRDAILKTFAKLKQKILWKWEEDDLPGKPPNVKTAKWLPQQELLVLISYYGVKSAKILAVLPVAGKSHYILASTLMRALAERGHDVTVISCWGEKNPPKNGTYRDIVMTGAMEELQRHLSSKDSNMFTRKGVNVFVDVFFATMIIYRFNELTMKHENVQKFIRSGEKFDVVIVEQFANDALKALSTHFGAPLISLSAMGASYWTNPLVGNPSPPSYIPHFSAKILGVFPVPGRSHYILGSSLMKALAEKGHDVTVISCFEEQNPPKNGTYRDIVITGAVDEMTKQMAKMNMFDRESTNPFAGAVFMSFRLPAMTETTLKHENVQKLINSNEKFDAVIVEFASEAFATRASHWINPLVGNPSPPSYIPDIMLDFSVLMTLYERLVNSLVYVFNELLLNFVVYPKHNELMKKYIPNAPSHISEVLYNHSIVLVNSHPSVNRPVPYVPSMVDIGGFHIKPPKKLPQDLQEFLDSAKHGVIYFSLGSNLKSAQLPLEKRNALLQTFAKLKQKILWKWEDEDLPGKPPNVKVAKWLPQQDILAHPNVKLFITHGGQSSTTETIYHGVPILGIPIFGDQKINAKSVARDGCGLYVAYSEITEEKLTESINEILHNQKYKENVQRRSKLFHDRIVSPLDTAIYWVEYVIRHRGAPHLRVAALDLP

SEQ ID NO: 6697 - protein, 501 aa, Eurytemora affinis
MMNVASASNILLFHNLGTKSHLHMIFPIIDQLLENGHSVTGVFYASAGVEHNNYTELVIPDLYGAMIDRVSDLYTGNQNKGRTFLDPSHLITMFSEWENIITGGTRMFQTPAFKSLASSNFDLVLTFNPWGFYFGDLFDCPVIVFSPPGAFPSHTQLLGNPFNPSYQPVLTNDFSDPTSFLQRAKNFAMYHVMDLIFRRFADSVVTSSMRKQIGYQGPTMFEIAERRLALILSNSHFITHTPQPLLPNVVDVGGIHINSKQKPLPKDLKKFLDLAVNGAVYVSFGSAIRTSLMSAEKITILMDSFKYLNVPVILKWDENLTDVTDNIFVRQWLPQQEILSHPNVKVFVTHGGLLSVMEALHTETVMVGIPLATDQFANLGRASKHNIAKQLNWDDLTTESLVAAISNAMKNNSMKSSMRKLGRLFRDEKESPLERAVWWIEFVLRNKGASFFKPESLNLFWYQYYLLDVLLVLFLTPFLSILVLVKLILLYSSNTQKEKVD

SEQ ID NO: 6698 - protein, 563 aa, Zeugodacus cucurbitae
MVISRIRDREPLICPNYEITTKIFIKMIFRVFFLSIIILYSVSWNLVVIDGAKILGLFAHPSESHFAVMRSLMMELAKREHNVTVYSSHRLNERVENLREIIVEPEFPFWKQLLEVTGSQAGGLLKARELTEWTMQKSLAHTGATAVNYFLSNASLKKLLNLPINEFDYDLIIVDLFYTEALLAVGHFYGKPTIGLLSTNFENYMDRVLEQMVPTTCSPICYENYQPDAGFWKRLGVIRNCLSRRNQFTKDNWGAQESVIRKHFAHFKGVSDLNIATLQTELSVLLLNSHVPLLTPRPLLLNTITAGGMHIRPPRQLPWLLRRFLDESRAGVVYMNLGNEQLCADIPTHIMQLLLNSLGKRKERVVWTCHDHSALKDLPANIMVQHAVAQADILAHPHVNAFLMNGDLLSMQEGIMRHVPMIGVPIFRNEVRNMELAVRLGVGVHLNYDNLTETSLSWALQTIKEDSKYQLTIRQVATTFRDRPLGAVETCMYWMDYVLRHQGGADLKTLGVGIPSSQLHLFDLFIYYFAIALLSISVLAAAFYGIMILMRKREIGKMYSKLS

SEQ ID NO: 6699 - protein, 279 aa, Ursus maritimus
MGKAEIWLIRTYWDFEFPRPYLPNFEFVGGLHCKPAKPLPKEMEEFVQSSGEDGVVVFSLGSMVKNLTDEKANLIASALAQIPQKVLWRYKGKKPATLGANTRLYDWIPQNDLGHPKTKAFITHGGTNGIYEAIYHGVPMVGVPMFADQPDNIAHMKAKGAAVEVNINTMTSEDLLTALRTVINEPSYKENATRLSRIHHDQPVKPLDRAVFWIEFVMRHKGAKHLRPAAHNLTWFQYHSLDVIGFLLACVATAIFLVTKCCLFSCRKFGKTGKKKKRE

SEQ ID NO: 6700 - protein, 516 aa, Anopheles sinensis
MGPGVILKGALLLLCGSLVIADGYKILFLVPFPGPSHWLMLKHFIRELTERQHEVTCITAFKFGEPLPNYEEIYIDPPYPIRETFPVEGLFASSQTSDFDKLFMYWELGLNTSRHGLETENVRRFIARRDLHFDLIIAEQFFQESWLMFAHKFNAPIVTISTYGYSDFFDRMMGLQTPWSFVPHMVLSYEDDMSYAERTYNALLSLFDYFYRTIVYLPDTNRLAQKAFAELAAERGPLPSVEELQQSVSVILVNSHPILNAPRPTIRGLVDIAGAHIRAPKPLPDELRQFMDEAPHGVIYFSLGAYMQSSVMPVEKRDTILKVFGTLQQRVVWKFEDDTKIGNVPPNVMIRKWAPQNDILAHNNTILFISHGGQFGTFEAMHHGVPTLFMPFFGDQNRNADRAIRMGFARKMLFVDIAEESFGGNIAAMLADKRYYSRAKEISRLFTDRIVEPMDESIYWIEYVARHGGAAHLKSKAVELYWFQYYMLDVFLLPPLLIWLVFRSSKGRRYGGRRRR

SEQ ID NO: 6701 - protein, 538 aa, Drosophila ananassae
MKFILLLLLLGVECPGIRAANILGVFGAHSPSHTIVNMAVMKALADRGHNITVVLTAMPKMKAHENITIILAPRTPKRIQDIKDHVAKASQRKQSLWKSMVLTILQSEFQIEGQYEFLMHPNLRNLYEKPQTKFDLVILGMLANDFQLGIGAKLNCPVILTWVRIPMLFADFVVGNIADPAYVPTMTVGLEPGQKTMGFGLRLTNFLKYTFSSIFNEVMAYKMNQYYVRAFGNESDPDFPTYSEMKRRISLLFYNYHAPSEGPIRPVVPQSIEIGGIQVKEQPDPLPKDIAEFLDNARDGAIFFSLGSNVDTNTFSPQVIEIIHKVLSKLTQRVIWKWHDLDDTPGNASNIYFGKWLPQDDILAHPNTKLFITHAGKGSVAEAQFYGVPMVALPLFGDQPSNSEILAKSGFGRWLDVHTLTEEDFEKTVLDVMENPTYRKAIGKFSSLYRDRPLTARQSVVYWTEYVLRHQGAYHLQSPLIQMDFVARNNIDVYGIILFLGVVASLTILAIFKWVFRKVSRVFHGKNNQQKVDKLKHN

SEQ ID NO: 6702 - protein, 462 aa, Fibrisoma limi
MQTVLFIMVPIPSHYNANYGLANWLQQHNYRIVYAGTPSLKQHVEEQGFDFKELTYLIEYFPAGIRTKLHHLWRSLRDSSHLRTRYRDYRTTLQSLQALCDQVRPDYILIDEHLSYYYYLLHDKAPNVFFIHSKPPTQPLPAIPPLEYAVPLQNNLLGRLRAWAMWQPYLLRRHIGRLQRRAIFLGKNDMYFVERHARRNGLDPSTIAMRNNALYDLVKGVQRLHIVPRCLEYPWYKPAPNEHFFRRPYERHDARFASTNWQSIEPILDKRAREGHRLLYVSLGTLSKKHADLCVHFLNQVIEAVRPLHGVQVIMVTNKLDIHPTENTPPHVHLMPSVPQQRLLLYCDLMLTHGGMNSVTECLVAGVPMLVYPLNLTSDQPGNAARVRFHGLGLAGTLRRASSMRLRQQIEALLGDPAYHERVELLGQQFAAEIREQERSILPVFGYQPTPSLTSPHPVTAD

SEQ ID NO: 6703 - protein, 528 aa, Papilio polytes
MVMFTLSICHLTMTPIVLYFIFLLFPYIESARILAVFPFPSISHQVVFRPLTHELARRGHDVTVITTDPAFPKGQAPKTLTEIDIHDLSYSRWNKLLSNIGDGVIDFTKLQDMMKTFIFSVYEEQVKTESVQKLLTDKNEHFDLLLVEASLRCTLGFSHVFKAPVIQISSFGAFVDNHHIMGTPIHPLLYPSIFRDRFYNLTLWEKIIQLKKEWDLWRLVANHDMDDELYKRLFGPDIPSLDELYNNVQMLFLNMHPIWENNRPVPPGVIYMGGLHQNPEKELPKDLKSYLDSSKNGVIYFSLGTNVKPSNLPSRKLEAILNVFTRLPYDELWKWDNNDLPGRPRNIKISKWLPQSDLLRHPKIKLFITQGGLQSTDEAITAGVPLIGIPMLGDQWYNVEKYIHHKIGAKLDMDDLTEDKLEAAIVNVINDKSYRENILRLRSIMRDQPQSPLERAVWWTEHVLRHGGARHLRSPAANISLTQYLELELVFTLAIILIILLFVICVILKSIWRFLRFKLHPENKSKKC

SEQ ID NO: 6704 - protein, 568 aa, Stegastes partitus
MQPELPVELKHTHARAHIKPPPDNRHHLLSQQVSLQHREEAMSSGVWFPTLGLVAWLCCLSLGSVQGGKVLVMPVDGSHWLSMKLLVKELTRRNHEVVVLVPESSLLIQGSEGYKTEIYKVPYTKAQLDENFNELRDGVFLKPPEFADVFVNVQRLVNFTSLQVTGCESLLTDEPLMSQLRAQKFDVVLTDPFLPCGSMLSHMFSIPVVYFLRGLPCELDIKANQCPSPPSYVPKFFSGFTDSMTFPQRVGNLAMTVMENYVCKMIYGHFDVLVDKYFGGGLTYKGLLSHGAIWLLRYDFILEWPRPLMPNMALIGGINCAKKAPLPADLEKFVNGSGDAGFIVFTLGSMVATMPEEKAKQFFDAFRQIPQRVVWRYTGALPKDVPDNVKVMKWLPQNDLLAHPKAKVFITHGGTHGIYEGICNAVPMLMFPLFGDQRDNVHRMVVRGVAEQLTIYDVTSEKLVTTLKKMTQDQSYKKRMVELSERHLDRPVEPLELSVFWTEFVMRHKGAAHLRVGAHDLNWFQYHSLDVICFLVLIVVTVQWLSLKCCLFCTRKCCRIGTTKRKSE

SEQ ID NO: 6705 - protein, 527 aa, Monodelphis domestica
MSKKWVSILLLQLCFFSYGSCGTVLVWPMDFSHWINLKTILEKLTEKGHGVTVLVPNVRYIIDSADSSGLNFEVFSVPFGKEEADEFLRNVLFKMIYELPNLSYWEAAWGFYETIVYFSKNVKLTCEAVVFNQTLIQKLRKAGYDVLVSDSGLPCGDLIAEMLQIPLVHSLRFTMGNVYEKYCGALPCPLSYVPVTLSQLTDKMTFMERVKNSLMSFLFDFCWYSFDKNWEQLYSEALGRPTTLCETMGKAEMWLIRTYWDFEFPRPYLPNFEFVGGLHCKPAKPLPEEMEKFVQSSGDHGIVVFSLGSMVKNLTDEKSNVIAAALAQIPQKVLWRYKGKKPATLGPNTKTYDWIPQNDLLGHPKTKAFITHGGTNGIYEAIYHGIPMVGVPMFADQPDNIAHMKAKGAAVEVNFNKMTTADLLNALKTVINDPSYKENAMRLSRIHHDQPVKPLDRAVFWIEFVMRHKGAKHLRPAAHDLTWYQYHSLDVIGFLLACVATVVFIVAKSCLFCCRKFGKTGKKQKRA

SEQ ID NO: 6706 - protein, 543 aa, Drosophila pseudoobscura
MTEQRGTLLGCSLGGLLLAFLALQSLPQSTEGSNILGVFTSHSTSHFIVHMSIMKTLAEKGHNVTVVSSVPPKVTHKSIKHIVIPLSEEEEKLIHGGMVDMVKQKPSIWTTMKSIFTSLAGLINKQVDTLEDKRFTDLYNNKDNKFDVVFVGFFFNTYQVGLSAKFNCPLIVSWMSQPMLMVNEIIGNPELSSVPQMSISVPAGKAMNFQQRLTNFLSSTGFRLLGKFLHFKYQGFYKRLWGDDKSMPSLEQAMKNVSLVFCNSHGISEGPIRPNVPAVIEIGGIQVKSKPDPLPEDIKQFMDNSKNGVILFSLGSNLKGDHFKPEVVTTIFKTLSSLKQQVIWKWDDLQTTPGKSANILYKKWLPQDDILAHPKLKLFITHAGKGGVAEAQYHGVPMLTLPVFADQPGNADKVVENGYGLRLELNSLEAKEFKETIKEIISNPKYAQKLETFSKLYRDRPQTAQELVVYWTEYVIRHHGAPHMQSPLVHMGTVASNNLDIYALVILALYLIFLVNKIVWKFLWKKCTGKSKKTAQNKKAKKQ

SEQ ID NO: 6707 - protein, 378 aa, Saccoglossus kowalevskii
ETKAFIQDTNILERLNAANFDLILANAFNPGFALIVDTWRVPFISVSTMRALPMIDDLLHGLPSNPAYVPAVKTGYSDEMTFPQRLGNTFAYLASAAMFEFLLLKPFKSIQQRHNIRPELSYRSLCRNSELVLFCSDFAFDYPRPMMPHAIYIGSLTARTPDPLSQEWTEFVESAVEGIVVFTLGSQANIGEDLEKATKFVKAFARLPQKVIMKYEGNPPNGLGENTKLSSWIPQNDLLGHPNTKAFISHGGINGVNEAIYHAVPFIGMALSAEQSENVERLVNKEMAISLDSKSFTEDDVYNAVKKAIEDPRYKDNAARLSSIQRDTPMPPGDTAVYWVEHILKFGGDHLKPASLELNLVQYLLLDIAVFLLIVAAI

SEQ ID NO: 6708 - protein, 530 aa, Echinops telfairi
MCMKWISVLLLIQLSCCFNCGTCGKVLVWPTEYSHWLNIKTILDELIQRGHEVTVLVSSSSILIDSNKPSSIKFEVYPTALTKDEMELLFMTWIKKWTYEAPKDSFFAYFSVIQESIWGYSDIILRLCKDVVLNKKLMVKLQESKFDVLFADAVSPCGELLAELLNIPFLYTVRFTTGYSYEKYSGGLLTPPSYVPVILSELQDRMTFMERVKNMIYVLYFDFWFQQVNEKKWDQFYSEVLGRPTTLSETMRKAEMWLIRTYWDFEYPRPFLPHFDFVGGLHCKPAQPLPKEMEEFVQSSGKHGIVVFSLGSMIKNITEETAHIIASALAQIPQKVLWRYDGKKPSALGSNTRLYKWLPQNDLLGHPKTKAFITHGGTNGLYEAIYHGTPMVGMPLFADQADNIAHMKAKGAAVSLDIDTVTSTDLLNALKTVISDPSYKENAMRLSAIHHDQPVKPLDRAVFWIEFVMRHRGAKHLRPASLDLTWFQYHSLDVIGFLLACVAIFTFLVVKCCLFGCQRFFKSGKKKKSE

SEQ ID NO: 6709 - protein, 560 aa, Helobdella robusta
MISVTFTFSFIVPHLLALLNFTEASGILLIPIPVNSHVGSLNVIGWALAKRGHHVHMLLDVSFKAPPGWPNFGVTYHRYGGKSSEVMNIEKFNQDMTMNFMDHDPKMSYVLEQSQIVNSVLHRELLTDNDELIDKLKSLKLDIAVVDCLPMINYFYLIPHKLGIPWITYTDALDPSMVPTPWLPSFYTPILAGKSLNASVFVNRLYNVALMVWQMITSPFDMPISDKLLDEYRKFKDFRNLNELVRKSAMFFTTHNLAMDKIMPHTANVAHVGGLTIEIISSSSSSPSSSSSSPSTMSKYESFLSAEGSDGAVLVSFGSLVSSFPDRYTKLFLDVFSQFPKLRFIWKTNGTEPHSKLPPNVLISDWLPQNQLLSRKEVVLFITHGGNNGQFEALYHGVPMLTIPLFGDQPKNAQRIVEKHFGEMLDFRKLSVEEMTKKIRMIIEDPTYKSNITKASEIFRSQPQSASERAAYWTEHVIKYGCDHLQPPGKELFTFQYLLLDVILLISFVIFFVLYILYGVWRILVDCWKGRNSTLGRGEVDDDGGHSHCASCRGIYKKVE

SEQ ID NO: 6710 - protein, 524 aa, Chrysodeixis includens
MYHIAIFCLTIVIALAYYIEAARILAVFPTPAYSHQSVFRVYIRALAERGHEIYVIKPSTRIAYTDPVADIELRGNITEIDASMSEEYFGKLIKASSVFRKRGVISDASTVTAHNYLNLVRMISDQFELRDVKQFIDHRKEYRFDVLVTEAFIDYPLVFSHLFHNLPVIQISSGYGVAENFETMGAVSRHPIYYPNMWRDKFRDLNVWETINEIYMELSLQNEFSKLADEQDKMLKDQFGADTPSVHELRNRVELLFLNTHAVFDNNRPVPPSVQYLGGLHLVKQNHLQANYATLNGFVKEFLDNSTQGVVYVSFGSGIVTTDMDVEFRDMFLQVFASLPYNVLWKYDDIIPISKLPTNVFTQAWFDQFEVLKHPNVKAFVTQGGVQSTDEAIEALVPVIGLPMMGDQAFNANKYTELGIGRALNTHTVNAKQLIEAIVDVAESSNYRKKLLQLRHFIRHQAISPLQKAIWYTEHVITNKGKTMLKTKAANVSYSDYVMLNLCIPFVTVFVMNHLRQLLRINLF

SEQ ID NO: 6711 - protein, 543 aa, Drosophila yakuba
MIEYGKIGFLIIFLLGTQTPSGDGANILGVFSTPSPSHVIVHMAVMKALADRGHNITVVTQMKPRLAAHENITVIIVPPTEERLKLMEEHLAEKSNAKLSFWANIAKGIVQSSYQMDGHYEFMTHPDFKEIYENPKTKFDLVFLGLMANYFELGIAAKLNCPVIVSWVGIPLPFLDSLVGNVHDPSYVPTVNVALKAGQNTMDFGLRLVNYFKHTFLIALNTFLDFKMKQFYERAFESELEFPNYYETKRRISLMFFNYHSPSEGPIRPTVPQSIEIGGIQVKEQADPLPMELAKFLDTADEGAIFFSLGTNVNTNTFRPVTVDILYNVLSKLPQKVIWKWKDLKNKPGNASNIFFSNWLPQDDILAHPKTKLFITHAGKGGVAEAQYHGVPMVALPIFGDQQGNAEIMAKFGFGRWLDILTMTKEELEETIHDVLESPTYRNTIGKFSSLYRDRPLTARQSVIYWTEYVLRHQGAYHLQSPLIHMDFVARNNLDVYGVLILVILSISVLLVVTAKVLFRKILNVTNGYSNHRKAVSIKLKNN

SEQ ID NO: 6712 - protein, 693 aa, Microtus ochrogaster
MLSNVLLWSLQISLLGVSLGGNVLIWPMEGSHWLNIKIIIDELIRKEHNVTVLVASGALFITPSTSPSLTFEIYPVSFRKEKIENVIKDFVLTWLENRPSPSTMWTFYKKMARVIEDFHMVSRGICDGVLKNEKLMAKLAKGKFEVLLSDPVFPCGDIVALKLGIPFIYSLRFSPASTVEKHCGKVPFPSSYVPAILSELTDQMSFIDRVRNFISYRMQDYMFETLWKPWDSYYSKALDGSHWLNIKILLEELIQRNHSVTVLATSETLFINSSPDDFMHFEEIPVSYKKSNIDEIIEHMIALWLDHRPTPFTMWTFYKELGKLLETFYQVNIQICDGVLNNPTLMSRLQNRGFDVLIADPVTICGDLVALKLGIPFVYTLRFSPAFTVERHCGKIPAPISYVPAALSELTDQMSFGERVKNTISYPLQDYIFQSYWGRWDSYYSRVLGRPTTLCETMGKAEIWLMRTYWDFEFPRPYLPNFEFVGGLHCKPAKPLPKVLWRYKGKIPATLGSNTRLFDWIPQNDLLGHPKTRAFITHGGTNGIYEAIYHGIPMVGVPMFADQPDNIAHMKAKGSAVEVNMNTMSSADFLNAVRTVINDPSYKENAMRLSRIHHDQPVKPLDRAVFWIEFVMRHKGAKHLRVAAHDLSWFQYHSLDVIAFLLACVASAIFLVAKCCLFVFQKFAKTRKKTKRD

SEQ ID NO: 6713 - protein, 519 aa, Anopheles darlingi
MIASGVAWLLVSLSLTVDGANILCLMGVASPSHHIWNRSIMDALAQAGHNLTILSADVEKNQPDNVHYIHLEEIYPTLYTGPESLDLLVMANENQFVSVISFYRDFVVHECAGTLKSKGLQAVLNYPDDFQFDLVLHDFTCGPCLLGLLHKFNYPPLVSVTAFNNPPYSTEVIGGHKYYSYIPFYSLSYDTDMNFLQRVHNTLLGLTDMVYRNFISNPRIDRMMREYFPYPDLPYAPELHQRSKLMLVNAHYSIDFPETTPPNLIPVGGLQIKDPSPLPQDLEQFMNASRKGAVLFSLGTNVRSDQLGPERQRIIIEALRQLPDYHFLWKFETELDIPLPKNVIIRPWLPQNDILAHRTTKAFITHAGLLSTHEATWYGVPFVGIPFIADQHRNLERCVRKGIARRVPFQTLTTAGLKQALVDVLEDPEYRTRMAAQSALFRDQPEKPLSRAIWWIEWVLRHPHETQLDSPVLKLGFFKTNLIDVIFFLGSLPIAILLVCLRICRRPNPVKVKGDKKRN

SEQ ID NO: 6714 - protein, 513 aa, Plutella xylostella
MIILYLFASVAVNLVFPTNSARILGVFPTPSVSHQVVFRPLTQALAKRGHDLVILTTDPAFKPGETPANIREIDLHDESYRIWRTEVLNTVDGKTDDPITLIELAIKINAKLIEKQIETKEVQELIKSKAKFDLILVEACARPALIMSHVFKAPVIQVSSFMAVPPNYQVFGSPAHPILYPEWTRNKIYNLTVWEKLSGAYDDLRIHYIWRKNEHFENEMIKRQFGPEAPTVAELADNVDMLFLNVHPIWEGNRAVPPNVIHMGGLPQKPHKELPEDLKQLLDSSKHGVIYMSFGTNVIPSQLPPERIQVFCKVFSRLPYDVIWKWDQDELPGRPGNVRIYKWVPQSDVLRHPNVKLFITQGGLQSTDEAISAAVPLIAFPMLGDQWYNAEKYVHHGIGMKLELESITEEVLEDSVKTVIGDESYHANLVRLRSLMLDQPQPPLSRAVWWAEYTLRHGGAKHLRSPAANISWAEFLMLDVLGVISGCVLVLLAKVVVVVRLVVAWKRSKVKQS

SEQ ID NO: 6715 - protein, 530 aa, Oryctolagus cuniculus
MVSVKWASSVLLLQLCCAGCGFCGKVLVWPCDMSHWLTIKVILEELAERGHEVTVLTHPHTLLIDHWNPSALNFEVVDVPFVKENTKKNHAAMQKLPLNVSPLLLPWQSIIKLSDLLRGMNKSFKLFCESVIYNQTLMKKLQETNYDVMLIDPLKPCGELVAELLAVPFVITLKFSVGGNMERNCGKLPSPPSYVPVTMVGLPDKMTFLERVKNAMLLVFSNLWIQGGDFQIWNQFYSEALGRPTTLCETLAKAEIWLIQTYWDFEFPRPYLPNIEFVGGLHCKPAKPLPKEMEEFVQSSGEDGIVVFSLGSVIDNLPEEKADLIASALAQIPQKVLWKFKGKKPATLGANTRIYDWIPQNDLLGHPKTKAFITHGGMNGIYEAIYHGVPMVGVPLVNDQHDNIAHMKAKGVAVEVNLHTMTSADLLSALRTVINDPSYKENAMKLSRIHHDQPMKPLDRAVFWVEFVMRHKGAKHLRPAVHDLSWFQAHSLDVIGFLLACVAAVIIFVTKCLLFYCQQFGNTGKKKKKE

SEQ ID NO: 6716 - protein, 523 aa, Spodoptera litura
MNKWTLIILGLVFLSNVCAYKILVAFPYPGKSHSILGEGYVRHLLEAGHEVTYITAHPYKKPHPNLKQVVIASVIEKFEFAQSLDFKKMLSNEVDFKDMFGIYELMVVIANRSLTHENVQKFMMDPNEKFDLVIAEWLYHHLYAGFATIFNCPYIWSSSLEPHPVVLDLIDEVGNPAYFPDHMSPITPPFTFMERISELWNLIYLYRVLWSVRDTEEKAFRDSFGPAAAKRGITLPALYDLKYNSSMMLANSHYSLGDPQRLPANYAAIGGYHIEDEIPPLPKDLQKIMDSATDGVIYFSMGSMVRSETLPMELKRQLFYVFSKLKQTVIWKFDGDLENVPKNVHMVKWAPQPSILAHPNAKIFVTHGGLLSTTETIHYGVPIIGIPLFSDQFLNVKRAIRKGFALEVPLGYDTPAKLEIAIREILSNPKYREKVKELSFIYHHRETKPGKTLVHWIEHVIETKGAPHLRSPALHVPLYQKLYLDLLALIILGLVIIKCIVKSLFSSKSDNKKKSEDKKKKRS

SEQ ID NO: 6717 - protein, 521 aa, Condylura cristata
MGEQRAVLIIGFLLPGLLLSEASRILTQSNLGGSHYLLMDRVAQILQDHGHNVTMLHHEGSFISDYSKRKVSYHEVSWTTTETFEKEFRKNIGSILTENFRGRETFESHMRIIGLHGAQCDYLLKRKDLIDYLKNENFDLVFVDGFDFCSFLMAEKLGKPFVALNACSFNILNAGLPSPISYVPAMNSLLTDHMDFWGRVKNFLMFFDSQIKRSKIYSTFDNTIKKNFPEGSRPVLSHLLQKAELWFINSDFALEFSRPLHPNTVYIGGLLASSEKPVPQEFENFIAKFKDHGFVLVAFGSVVDKFLTQEFLMEMNSAMASLPQGIIWKCKDCHWPKDNKLAANVKIVDWLPQNDLLAHPHIRLFVTHGGMNSVMEAIEHGVPMVGVPAGGDQPDNMLRVQAKKLGLYIHVDQLTAETLVLKMKQVIGDQRYKSAAVAASVIRRSHPLTPAQRLLGWTNHILQTGGAAHLKPHVFEQRWYEQYLLDVSLFLLVVTLGAVGVCVKLVGLVVRLLRGGKLKKM

SEQ ID NO: 6718 - protein, 533 aa, Harpegnathos saltator
MRPISDIAPIIVALWLLTVSDLAQSKKLLIITPAPSYSHQIVFRALNLALLKRGHEIVALTPNVLNDPTLANYTEIDFGFEYEKIDDTDFSQTRWNLTQLGGLKTRLLRLGHDIAEDVLSHPDLVKYYANGTDTRFDAVIAEMIMTPAIYMLAHRFKAPLIGIMSMDLQNCHRFNLGSPVMPSHPSNWEVENLAGLHLPFWKRMVNFVNAWWRIYTWFSSFANQQQKIAEKYFGKDIPHIVDVAKNMSLVLIDQEPLLAYARPEIPNIVHFSGLHISKIPPPLSKDLKDFLDGATNGFVYMSLGSNVKSKLLPKGMLQVFVSAFASLPYRVLWKFEDSNFNVPSNVFISKWIPQQSVLAHPNIKCFIYQGGLQSTEEAVHYAVPLIGIPFVFDQVYQVLKMVSLDVAKQLDITKLTTSELRKTVLEVAGDKRYKDKMLELSALTKDKPYDSLENVIWWIEYVMRHNGAPHLRFNGADSAWYQQFDLDIIICLSIALFLALCVFLVVLVQGSRLLYKYHDRIPRFAITKKVKLT

SEQ ID NO: 6719 - protein, 477 aa, Aedes albopictus
MKALANKGHEVTVISPFPQQKPLKNYRDVTTTQVWKAVEPIVANLLDIAKKGVIESIKNTYDFGHRITNSTLTDPTVIDLLASNETFDLIVLEIFMNDAMIGFCHHFNAPCIGVSTFGASKWTTDLVGTPSPPSYVPNAFLGFSDRMSFKERLLNTLMSATEIVVDTFVDRPAQIEMYQKAFPGQKPPFAELKKKAISLVLLNNHFSLSYPRPYVTGMVEVGGMHVNRVPKPLPDNIQSFLDTATDGVIYFSMGSNIKSKDLPLEKRDAFLKVFSKLKQKVMWKWEDDNLPGKPDNVFVQSWWPQDDILAHPNVKLFITHGGLLSTTESLYHGVPVIGIPVFGDQHLNMAKAERGGYGLSVAYAEISEAKLSNAINTILNDPQFKANALAISQRYRDQPLKPIELAVFWAEYVIRHKGAPHIRSAAMDLSLVQYHNLDVLGLLIGLPIFILHLLVKLVCRKKSPKPSNKKDERKKRN

SEQ ID NO: 6720 - protein, 483 aa, Myotis davidii
MDRVSQILQDHGHDVSFLQQSDLHFPPGFKKENTYQTVHWSPPEDFQQEFKKNLDFFTKEALLGRNPLSNLLNIMKLFATQCSDLLRTDLMGSLKNESFDLVVVDGLDLCAFLIAEKLARPFVAVLGTTFGVTNFGLPEPVSYVPDFHSSLTDRMDFWGRVTNSLMFFISSLRQWYIHAQFDSTIRENFPEGSRPVLFHLQQKAELWFVNSDFAFDFARPLLPNTVYVGGLMAKPVEPIPQELEDFIAQFGEAGFVLVALGSIVNVAQSQQALEQMHRAFAQLPQGVIWKCSPSHWPKHVQLAANVKIMDWLPQTDLLAHPSIRLFVTHGGMNSVMESIQHGVPMVGIPLFVDQPGNLVRVEAKHLGVAIPIEQLEAETLALKMKQVIGDKSYKSAAVAASIIRRSHPLTPAQRLVGWIDHILQTRGAAHLKPHAFQQPWYEQYLLDIFLFLLGVTLGTVWLCGKLLGLVARGLCGAGKMKKA

SEQ ID NO: 6721 - protein, 514 aa, Chilo suppressalis
MYKHISVILLILSFSCAYKILLVFPFPGKSHSMLGEGYVRNLLKAGHEVTYITPILMKSESKQLRQIDVSSNLQLALENLLNIESLLKGEVDLGDTSMAMAMSDDIANHTLWNPAVQRLMMDPKEQFDVVVAEWLFTELYCGFAAVFDCPLIWSSSMDPHELVMTLIDEIQNPSYTATHKSGMEAPFTFFQRVKGLWEIFYVKYLKWSASGVANKIFNEGYGPALTMRGRLLPSLQEVSHNASLMLGNSHVSTGRPVRLPQNYIPIAGYHIEEEVKPLPEDIKKIMDEAKHGVIYFSMGSMLKSATMPDKLKKGFLKMFGELKQTIIWKFEEELPDLPKNVHMLKWAPQASILGHSKCVLFITHGGLLSTTEATKSGVPIIGIPMFADQFINIDRAVRRGFAKKVTLDYNCPNNLKTAIEDIVGDNRYRQKARELSFIFHHRPTSPAAELVHWIEHVVKTNGAPHLRSPALDVPFYQKFYLDLAAVIFMILVVLNKLISAVFRKKSEQKKQKTK

SEQ ID NO: 6722 - protein, 542 aa, Stomoxys calcitrans
MKRTGKFLSTFLFIACLAWHITPSNGANILGLFTSHSPSHLIVHMSLVKVLAERGHNVTVLVSQKPKVTHKDIKVILIPPTDEVEQLLNQEVSAMSQRKNSMFTTMKNMFGSLGILINMQADMLKDPRFTVLYDNPDTKFDLIIAGVFMNDYQLGVAAKLKVPIVLSWMGPPTVMTDGMVGNPPEISYVPNMNMAVKVGEKMTFMQRISNFFMNGFFKVIMTLLDIRMNNFYKNLFPTDGSFPSLSDMKKNVSLVFCNSHFSEGPVRPNVPAVVEIGGIQVKDKPDPLPKDIANFLNGANDTGAVLFSLGSNLKGSSIKPETATYIFNVLSKLKQKVIWKWEDLEHTPGKSPNILYQKWMPQDDILAHPNMKLFITHAGKGGVVEAQYHGVPMLALPVFADQHGNADKLTQAGYGLQLELLSLTEDSLRQNVLEILNNPEYRRNVQQFSRLYRDRPMSARESVAFWVEYILRHHGAAHMQSPLVHMNFIESMNLDVYVFLLAVTYVLYRVFRLAFCFLCTKVCKKFSCSKTKPKKTPKVKKQ

SEQ ID NO: 6723 - protein, 535 aa, Caenorhabditis brenneri
MKLTIIFIFSILIELTCCYKVLVFNPAFGASHSNFLGKISDILIDAGHDVTMLIPVSMPSKKDLVGSKKVTKIIRIDQDPRSKQMQEEFKTEEMIKKQIWKLDADITVFFSMIKNFSLASGYQCEHIFQQTAILDELKNEKFDLGITESLFICGFPLFDHIGVKTVINADSVLYLDVVKYALGEPASTSFYPGLFSKFIDKMNFFERTRNLLGYAFSWYFSWTRFQGELEAIKPYYNKSLSWEDHINGAAFYLINSNQYLDFASPTLPKTVFIGGMQVNTKKHGKVELEKEWDNLLSIRKQNVLVSFGSNAFSSDMPSEFKKAFLEVFKSMPDTTFIWKYEEENATLADHLPNVKLTTWMPQNDLLADDRLTLFITHGGLGSSVELAYQGKPALVIPLMADQPRNALMLTRHGGALELDKFHLDKPSQIRHAIKTVLNDPNYKKNAEKLASILSSQPHQPKDVVLKHCDFAVKFGDLKTLNSEGRNLNLLQFYSIDIALAALAVTILLLLLLSLIISCVIKKMYSLSSNVKSKID

SEQ ID NO: 6724 - protein, 521 aa, Plutella xylostella
MILRVCFVALAILATSVNSARILAIYPVASVSHQVVFRALTLELAKRGHELVVFTPNPALPKDRPKDNVTEIDMSESYQLFFKLFMHTFEPVRGVIFPAKQMSEYESLKMMIAFVEEVYKMEEFKKIISDKTQKFDLIMAEALFVSPLMLSKIFDAPTIWFSSFYGSPNAYETVGAPGHPMLYPNYFRGKFVNLSLWEKIYETYLEFQFWYNTRRVLSYEESLVKKYFGEEAPSIDELKNNVDLLFVNANPIFEGNRPVPPNVIYLGALHMQPLKELPNDLKTFLDNSKRGVVYVSLGTNVRFETMEPSLIDVFVKAFEAMPFDVLWKFDGQNIPNAPKNVKIQKWFPQRDLLTHPNIKAFVTQGGLQSTDEAIEAGVPFVGLPALGDQYFNSDQYVRLGIGIRLNFETLKPEELVNGVNTVVNDKSYRENVKKLGVLMRDQPQTPLERAVWWTEYVLRNKGAKHLRSPAANISWSEYLMLDVVAALATAVLLFLAAVGIVWRTVCKIFRKKVKVNKNKKE

SEQ ID NO: 6725 - protein, 521 aa, Galleria mellonella
MGKWLGLFFAVAAFSNICDAYKILVVFPLPGKSHNILGVNIVNHLLKAGHEVTYVTPFPVKNPHPKLQQLDVSDNFDLMDEKMLNVKALLNKEISFSNPIKMFTFTIELFEKTVQNPNVVKVFNDTNQKFDAVISEWMYNDAYSGIATLFDCPFIWLSTIEPHWIILSLIDESTNPAYVPDSLSSNIPPFNFKERVSGLFFQLLSSAFKTFYLNGVIEREFERLLGPYLTKRGKAIPSFSDVNYNVSLVLGNSHVSLGQAIRLPQNYIPIGGYHIDPDVKPLPEDLKKLLDNAKNGLIYFSMGSNLKSKDLPDELKRGFLNIFSNLKQTVLWKFEEAIPDLPKNVHIVQWAPQPSILAHPNCILFITHGGLLSTTETVHFGKPIIGIPVFGDQFTNIERAVNKGFAIKVTLSYTMLDEFKVAIDEALNNPKYSNKAKELSAIYHDRPVSPGKELVHWVEHVVRTRGAPHLRSPALHVPFYQKFYLDLLGIIAAILSVIVIVLKRVLKLKCKKKENLKKKKN

SEQ ID NO: 6726 - protein, 669 aa, Leptinotarsa decemlineata
MSTLWLYVLLCFRYADSAKILGFFSFPSVSHQIIFQSIWKELSLRGHEVTVITPNPLSDTSLKNLKEIDVRSAYEVLSKKNFSGIMGTSTSPLFKVFFIHDMLISITEAEIQQKSVLELMALDENHFDVILVQSLHPLMYFTGAKFRAPIIVSKHCNTHSLSSRVMMSTTWLYFLLCFWFGDSAKILGFFPYPAISHQSPFQALSRELSLRGHEVTAITPNPLNDPTLKNLTEIDVRFVYDILARRNMTVQMGKGFSTYFKVMFLHETILALVDAELQQKNVAKLLTYDESHFDVLLAPAIHPLTYLFAAKFRAPVVGVSSFDIFLEFHDAVGNPTHPIISPEIVYNGFDKELSFVERVKSVLFHIWYRAIYYWHILPEADKVTRKYLGEDVPYLGDVIKNTSMFLVNVNCILHKVRANVPNVIPMSQMHIRKKKPLPKVSNWFGKFCSGYYFCQFDFAGHPNIKVFITQGGVQSLEEAIANEVPVIGLPFISDQSANVKRMMDRGAGLGLDPNTLTKDDLRNAILEVATNSQDLAPGKSTVQKCLAKFKRDKMSTEDDARSAPKRLLPTKLSKKYKKQIKKAKSILLDEPLVGVEKAVWWIEYVLRHKGAPHLRSEAADMSFFEYFMVDVLAFLSICVLLASFIFIYSMRVLVKLGLSISESPKQKSA

SEQ ID NO: 6727 - protein, 522 aa, Papilio machaon
MRLIIIVLVTTILCTLNLSEAYKLLVVFPIPGKSHSILGNAFVRHLLNAGHQVTYITPIPMKDVNPSLRQINVESNKNCFAAEEVLDIQKLMRKEVDMKDIPTVFTMMFNIANATIQHENVQQLITDPTENFDAVIAEWMYSELYSGFSAVFNCPLIFFLSVSPHNMALSLIDQIPNPAYTADHIKSNTIPPFPFWTRVQELLTLLNWKIHRWWVNDRNVNSYDKAFKLAVMRRGRTLPPLEEMKYNASLIFGNSHISTADGTPLPRNLIEIGGYHIDSKVEPLPEDLKKILDDAKEGFIFFSMGSMLQSSKMPKTIKSGLLKIFGQLKQKVIWKFELSVPDKPNNIFMLDWAPQQSILAHPKCVLFITHGGLLSTTEALHYRVPIIGIPMFADQFININRAAAKGIGRRVDLNYDTPKNLKLAIEEILGNSSYRDRVNELSYVYHDRAISPGAEITRWIHHVIKTKGAPHLRSPALLVPWYQKLYLDLIFLIIIINAIFSMTIIRLIGYMKHDINLSKKQS

SEQ ID NO: 6728 - protein, 533 aa, Caenorhabditis remanei
MRCLFPTLFLVLLTSQPILSYNYLVFCPLFAHSHHKFLAKIADTLTLAGHNVTFLVPVIVREYENIKYLEHTTDVVYIQPDEELEKIGEDADYSMFWKADFGIFSFVPAVQRFNKMFEQFSDNLRKDLSVLDKLKDRKFDAMIFEALAFCAHQNRVNFSQFPAIHDYLGIKAIFPSWSMTHMTELSKSIGEPASPSFVPTTVSPFGDQMTFQERLLNTIGDLSGFLLAPPAMRSYKYPHQVLDIEEIKSKAPFVFVNSNPFLDFPRPTLSKTIAIGGISVNVTQMREEKLSEEFDDILKKREKSVLISFGSILRSSEMPDEYKYTIVRVIKSLPDVTFIWKYETKDIKFAKNLPNLHFSKWVPQTALLADSRLTAFITHAGLGSVNELSYLGKPAILIPIFADQFRNAMMLARHNGSITLVRKDLGDFEKLKKSVDAILNDESYQINAKTLSHQLESQPFSPHDLLVKYAEYGARFGEIPSLDPYHRKMSFVSFFMIDIILFLSVILIGFVALLVFVVRLILRTILIRKLKIN

SEQ ID NO: 6729 - protein, 523 aa, Apis cerana
MRNKVQSQFILRTMICNIAKLFFLLHVLIIANKSECYKILSIIPTPSYSHQIPYQRLWLELHARGHEIVVITTNPIPNISLPNFTQIDISHSYNCLKEVDFIENRFEHVSWLKIMENYAMPLYTCFLNEVFNSSEVKKLYVPDNAVKFDVLLAEFFYGPAMCAFAHRFNVPLIGLVLPSHEYTWEMEANTGTNLPFFKRLNNFVTMWSFLYRINYEVFFFQQKLAEKYLGPLPLLTDIMKNISLIFTNQIDILSPARPKLPNMISFNFFHVSDNPPPLPKDLEEFLDDAEEGFIYFSLGTNVRSSRLPKEIVHMFCNIFAKLPYKVVWKYEQDLPEKYGDIYIKNWLPQQSILAHPKIKLFIYQGGQQSTEEAINFGVPLIGFPILADQDYLAKRIEALGMGKYFDIRTITSDQFENAIKEIITNEKYKNRVLDIRTQIRETSQDVKKIAWWTEYVIRTKGALHLRSTLAWEPWYQRYDTDIIIFLTIVIFIIFLIVISIIVNILMYFYKKMDTSIHRKDKIH

SEQ ID NO: 6730 - protein, 520 aa, Drosophila ananassae
MLTEESIFSATSNVLRSIRSEALHFVRMRILTLLLGIILSLGYSNGYHFLMVLNSPGRSHFNVGQALAKGLVNAGHEITVVSVFPQKKNIPGYHDINVPNIIAAMKGDIAALWDSINKPLTQKLIDHYQMGFRLTRGLFVDPNFQDLIKSNRSFDAIICKTFYNDAHYGLAEHFNAPLIGLSTGGGLTFITDMVGSPAPASFVPHIMLPFNDHMSLYERFMNVAFLAFERLLLDYYYLPGQEKLYKEFFPENKHNFYEMRRNASLVLINQHVSLLPEKIERFLNESDHGAIYFSMGSNLKSKDLPPSKVEEILTAFRGLKQRVLWKFELDDLPNKPENLYISDWFPQTDILAHPKVLAFVTHGGMLSTTESIYHGKPVIGLPIFSDQFFNMAHAEQAGYGIMLDFKNLKAKDFGAAIESIVSDSTYTEVVRGMSFRYRDQQQTPLENAIYWVEHVTRHQGAAYLKSAAQRLNWWQYHNVDVFAIMFAIFIVLLILPFFILRLTKRVFCVNGKKVQKFKQN

SEQ ID NO: 6731 - protein, 526 aa, Neodiprion lecontei
MSRHLITVILVVIICQQGFASRILGVFPATSISHQFVYRQLTLALRERGHELVVITPDPINDPTLKNYTEIDVHFLYEDANKIVNCVSPPNKTTWLEKVQDLAEKFMLMSQRILSHSVVKKVYAPNSGEKFDLLIIEMLFWQALLPLAKRFDVPVIGVSSFGLSLHLQHRIGNPVMPSHPVHWDAEIKVLGKLSLWQRLWNLVYAWRLVHFIETDCLPRQQMIARKYFGNDIPDIADMEKNISLVFVNQQAPISFVSPNVPKIINIGGFHVSKHIETLSQDLQKTLDEATHGFIYMSLGSNFKSTMLSNKTRGEFLAAFSQLPYIVIWKFEDILPGRPDNVITMKWAPQQTILAHPNIKAFIYQGGLQSTEEAVSYAVPVIGLPILGDQYTHVNKMVSLGVGKKLGILTFNRMDLVEAIRSVTTDVNYKERMLKLRDLMEDKPYDSLKNAVWWTEHVIRHKGAPHLHSTTADDPWYQRQDMDLIFIISTVIWIAFSITLFVLYKLLVYSINCSKDNRQLMSKKKRA

SEQ ID NO: 6732 - protein, 486 aa, Chinchilla lanigera
MGPGKWACAVLLLQLCCAGCGSCGKVLVWPCEMSHWLNIKTLLEELVKRGHEVTVLTPSHSFFIDYRKPSAFHFEVIPIPTDKNVSENVINEFIELAVNVMPTLSFWQSGRLLQKFFLQVTEDLRLLCTSTVYNQSLMQKLQESKYDVMITDPVEPCGDLVAEMLGIPFVNTLRFFTGYTLEKYCGQLPAPPSYVPVPMGGLTSRMTFMERVKNLVLSFLFDFWFQQYDFEFLDQFYSEALGRPTTLCETMGKAEIWLIRTYWDIEFPRPYLPNFEFVGGLHCKPAKPLPPVLWRYKGKEPATLGPNTRLLDWIPQNDLLGHPKTKAFITHGGTNGIYEAIYHGVPMVGVPLFGDQYDNVAHMKAKGAAVEVNMYTMTSADLLGALRAVINDPSYKENAMRLSRIHHEQPMKPLDRAVFWIEFVMRHKGAKHLRPLAQNLTWYQYHSLDVIGFLLALVAIIIFLVLKCCLFCFQKFAKVGKKKKRE

SEQ ID NO: 6733 - protein, 280 aa, Cavia porcellus
MPAPGQLSSLFSWPTSDLSVTAHPVSQAVEPWTAQQILSSQELEDFVQSSGEHGIVIFSLGSMVMNMTEDKADVIASALAQIPQKVVWRFDGKKPATLGPNTQLYKWIPQNDLLGHPKTKAFITHGGTNGIYEAIYHGVPMVGIPLFWDQGDNIAHIKAKGAAVRVDFNRMSSTDLVNAMKTVINDLSYKQNALRLSRIHHDQPVKPLDRAVFWVEFVMRHKGAKHLRVAAHDLSWLQYHSLDVIGFLLASVATVIFIISKCCLFCCHKFAKVERKEKKE

SEQ ID NO: 6734 - protein, 533 aa, Anopheles sinensis
MWCRRVNIVALLLALTMPILAHGARILAIFPSPARSHQIVYQAFMRGLIDRGHQLTVMTTDPFATDHPNVTVIDWSYSYRIVNENFDVVDMKQRNMNFYQIATQLRTLTKLFLEAQLAHPDVQALIHSRDEHFDAVIVEYYQFTPMYAFAELFNAPMIGITSIDSMGTCHEAMGNVMNVVAHPEMNHKFTRDLTFLQRVEAVVSNLVIKYHIMPTDFVAFDRMIEQNFGSNMSRSADLIRRIDFLLVNAEPSIGYIRPILPNSVQIGFMHIQPPKALPADLKAYLDRSEHGVVYFSLGTLIRSDSLNQRNLNLFLAVFKSLKYDVLWKHDADLDLNGTTNIRMERWLPQQDLLAHPNVKVFVMQGGQQSMEEAIDRHVPLVVIPFNFDQFGNADKVVERGIGRSVWMERLTEESLREAILEVARNKRYKRNIARLGRLVRDQPMRPVEKAVWWTEYVIRHGGVDHFHYPAAQMPFLQYHYYDVVGAGLLLLAVLLGALYFVLKRIVRFLLSQLGSAIAFGQGRLEKALKLKAL

SEQ ID NO: 6735 - protein, 527 aa, Cyprinodon variegatus
MRSRVWFPPAGLLALLCCLGLGPVQGGKVLVMPVDGSHWLSMKILVKELGRRGHDVTVLVPESSLLIQGSESYKTEVYKVPYTKEELDENFNKLREGLFDQKPGLADLFVNVERLVTFTSLQSLGCEALLDNEPLMNQLRKEGFDILLTDPFLPCGSVLAHIFSIPAVYFLRGLPCELDIKANKCPSPVSYVPKAFSGNTDRMTFPERVKNMMMSFLESHICTVMYRHFDELVSKRIKDGMSYKELISHGAIWLLRYDFVFDWPKPLMPNMVLIGGINCAKTAPLPEDLKEFVDGSGDDGFIVFTLGSMVSDMPETKAKVFFDAFRQLPQRVLWRYTGKVPKDMPKNVKLLKWLPQNDLLAHPKAKLFMTHGGSHGIYEGVCNAVPMLMLPLFGDQGDNVHRMVSRGVAEKYDIFDLKTETLVPALKKVINDKGYKERMVKLSQIHLDRPVEPLDLAVFWSEFVMRHKGAPHLRVAAHDLNWFQYHSLDVIGFLLLVFVTVLWVTLKSCLFCTRKCCGKRGGKKKSE

SEQ ID NO: 6736 - protein, 1005 aa, Anopheles darlingi
MADRKPSLNVVLCTVALLAWTGGFSTPRYAEGANILCLFAVPSPSHHIWNRVLVDALAAKGHNLTIVSPDVEKKVKPNITYIHLEKTYDAIHEGATAIDFYEMAQSGVLESMFIFYDYAISMCTGILNSEGYRTISNYPDDYKFDLVVYDYTCGPCLMALYVKFGQPPLVGVTAFNIPPYTTDLIGGHKYYAYVPYYTLDYDSKMSFFERVNNAIIHWIDDYYRNYVFLPRTDRMVREHLTNSTFPYLGDLDQKMMLMLVNSHHSVDFPEPIPKNMVEVGGLQIIPPKPLPNDLEAFIKAGKKGSVLFSLGTNVLSKDLGEDRIRSLLQAFRQMPAYNFIWKFETDLPFELPANVLIKKFVPQNDILAHPHIKAFMTHGGLLSTHEATWHGVPMIGIPLIADQYRNLGKSVRAGVAEKIDLWDLSTEKIRNTVLKVLETPKYRHAMKERSSLFQDQETPPLERALWWIEWALRHPNAKTIQSPTLQLGPWRSELYDVKLGIVARVQAANILCLTPVPSPSHHIWNRVWIEALAARGHNLTVVSADVEHKPIPNITYIHLEHAYSDLHEELDLLQMANRGALFGIRDLYTWGVAMCKGVLRSNGLRTIRSYPEDFQFDLVIADITCGPCLFPLIHRFGYPPLIAVTAYNNPQFTTDFIGGHKHYAYVPFFTVNYDSDMDIGQRFYNWLLHNIDHLYRHYVFLPKIERMVRNHFRYDGMRQLAEMERNTTLLLANFHYSVDFAESIPPNHIPVGGLQILPVKPLTAELKDFIASGPEGTILFSLGTNVRSADLGEGRIRMFLQAFEQLPQFHFVWKFEERPSFHIPDNVLIRKFLPQNDILAHPNVKAFITHGGMLSTHEATWHSVPMIGIPFICDQYRNLHKSVTAGVALRLDRDSLSSEKIRQTVLQLTGNASYGDKMRQRSAMLRDQPEHPLARAVWWIEWTLRHPNPAAIQSPTKHMSVWQAELYDVKLLLLLTFGLIAYQAKRIFARYTRNRTVREVGKKFN

SEQ ID NO: 6737 - protein, 528 aa, Tupaia chinensis
MGSEKWVMILLLLCCAGCGFCGKVLVWPCDMSHWLNLKIILEELIARSHEVTVIIPSHTFLIDYRKSSALNFEVFHVPQGKEFTDDISKKFMDLAVNVLPNLPSWQSAIKLNNFFAGYNQQFKLLCESVVYNQTLMKKLQETNYDVMIIDPVVPCGELLAELLAVPFVITLKSSIGGNIEKYCGKLPSPPSYVPVHMVGLTDRMTFLERVKNTLSFVFFNLWIQYYDFHFWKQFYSTVLGRPTTLCETLGKAEIWLMRTYWDSEFPHPYFPNFQFVGGLHCKPAKPLPKEMEEFVHSSGEDGILVFSLGSFIYNLTDEKANLIASALAQVPQKVLWRYSGKKPATLAANTRIYDWIPQNDLLGHPKTKAFITHGGINGIYEAIYHGVPMVGIPLFSDQPDNIANMKAKGAAVEVNWNTMTSADLLRALRTITNDPSYKENAMRLSRIHHDQPMKPLDRAVFWIEFVMRHKGAKHLRSAAHDLTWFQYHSLDVIGFLLGCAAIAIFLVAKCFLFFCHKFGNIRIKKKRD

SEQ ID NO: 6738 - protein, 509 aa, Cryptophlebia peltastica
MHFHILFLCAISAVNGARILAVLPTPAYSHQSVFKVYIQALAERGHEIVVIKPTTKVNYATRNVTEVDATLAENYFKNLVKQSSVFRKRGIISDSTTVTAHNYMGLVRMIRDQFDLPAVKRLINNRKNEHFDLLICEAFMDYSLIFSHLFGDLPVIQISSGYGLAENFETMGAVSRHPKYYPNMWRDRFRDLTVWETINEIYMELTLQNEFSKLVDEQNKLIRSQFGRKSPSIKELRNRVQMLFVNTHSVFDNNRPVPPSVQYLGGIHLHRNEPVPLDDFMKRYLDGATQGAVYVSFGSSINTKDTDADFKYMLLQTFKALPYKILFKFETDDEELNSQLPYNVLVQTWFNQPEVLKHKNVVAFVTQGGVQSTDEAIDAGVPMVGLPMMGDQSFNTDKYVELGIGLALDTATVDSNQLTEAIKTVINDPLYRKNILELRHNIRHQPITPIRKAVWYTDYVINLKNSKNIFKTKAANVDYNEYYMTNMIIEFVTYTIMNQFKNLLKMIYA

SEQ ID NO: 6739 - protein, 519 aa, Eumeta japonica
MTARVWASLAVACLLVCTNESSKILVVFFFPEISHNILGNGYVRHLLHAGHEVTYITTRSFQKPSPMLHQIHVQYPEYSSERIHFKLEAILKHEVLFKDYLSIFNGIHDMSKYFLNQRDVQKLINDPEQTFDLVIVEWMYTEVHCGFSALFRCPLIWATLTEPHWMLLRLVDEMPNPAYVPDFNSYNSLPLSLLERADELWTQIKILYEKSVVEPKNDLLYEEVFSAAGKKRGIILPPLREVKFNASFVLSNSHVSLGDAVRLPQNFIPIAGYHMDPKPEPLTEDLKKIMDTAEDGVIYFSMGSNLKCKFMPDKMKKEFLETFSQLKQTVIWKIEETLPDLPKNVHLMQWAPQQSILAHPKCVLSITHGGLPPVTETVHYAVPIIGIPVFADQFNNVNRAVSKGFALKVDLSYDTPKKLGTAIQEILNNPGYRERVKHFSLVYHDRPVPPGKELVHWVEHAIKTRGAPHLRSRALSTPWYQKTYLDLAALIMAIICCLCFTVKYFLGTRKSSIDTKKTK

SEQ ID NO: 6740 - protein, 513 aa, Leptinotarsa decemlineata
MKLLVIISTLVGLCESARILGVVPTPSFSHQVAFRPLWRELAKRGHDLVVITTDPENDPTLNLTEIDISSAYELWEEAEIVRLLEELKYQPLKLSNHIKWVSFQVCDHELGNPKIQALLKNESEYFDLVIVEFLHPIMLAFAERFHCPHIGVASMELPTFLHNIIGNPVHPIAHPDVMLPFEGELTFFQRVMSCVFNFMMYINSFIPMEEDQIVERHFGKNMPPIRDMMLKFSMMFINVDPAFNLRPLGPAFVSIGGGTHLGSAKPLPKNLQEYMDGAEYGVIYFSLGTNVKSSLVPPEMQKLFLDTFKELPYRILWKFDEHNPQDVPANVKIMNWVPQQDILRHSKVKAFITQGGLQSLEEAMFSHVPVIGIPFIYDQEKNVHKMMTRGLGIELDKNKLTKESFKAAILEVINNPRYKEKAVELAKLSRDQPMTGLEKAVWWTEYVLRHRGAPNFRNPVLDMPFYQYYLIDVIGFLIGLIIIFWFTCVKIVSSFRYIFVSCLHFSTVKRKIQ

SEQ ID NO: 6741 - protein, 486 aa, Myotis brandtii
MPMKWISVLLLLQLSGHFSPGSCGKVLVWPTEYSHWINMKTILDALVQRGHEVTVLTSSASILVDPNKPSAIQFEIFPTSLTKDDMVYFFMRLINKWTYDLPKDTFWTHISLMQEMFWEGSDLIEKLCKDVVLNKKLMTKLQESRFDVVLADAIGPCGELLAELLKIPFVYSLRFSPGYKIEKYSGGLPFPPSYVPVVFSELSDQMTFMERVKNMVYVLYFDFCLQTYNQKKWGQFLNEVLGKPITLFELMGKAEMWLIRTYWDFEFPRPLLPHFEFVGGLHCKPAKPLPKVIWRYDGKKPDTLGPNTRLYKWIPQNDLLGHPKTKAFITHGGANGIYEAIYHGIPMVGLPMFADQPDNIVRMKTKGAAIRLDFNTISSTDLLNALKTVINDPSYKENAMKLSRIHHDQPMKPLDRAVFWIEFVMRHKGAKHLRPASYDLTWVQYHSLDVIGFLLACVASATFVITKCCLLCYQKFAKPGKKKKRE

SEQ ID NO: 6742 - protein, 526 aa, Cephus cinctus
MARIVIVLMVSLIFLLNRIDSARILGIFPHPSHSHQIFFHSLTSELSRRGHELVIFTPKVTNDTSLVNFTEISLVEAYAAGWKEIVNYSSYRELWVFFDACYRAGVLFSESILSHPEMEKILNPQSDKKFDLILIQIFYVDALHALSSILNVPMIGLTSLAPIGIHHHTMGNPPLLSYIPDVMGGQPVNMNFWQRIINIYCYGRQIFEFNFIHLKKQERVLKKYFGNNAPDIRDVSKNISLLLASTQYPIYHPRPDMPSVKLIGGLRFYKSTPREKMSPRLQNILDNAKEGFIYFSLGSNVKLSQLSEENRNVFVHVLAELPYKVIWKCDLDDLPIKAKNIFLEKWVPQQDILAHSNILLFLYQGGQQSTEEAINNGVPLVGFPVFSDQRSNVNNVVSLGIGQKIELSSMTKESMKKTVLEVIQNPRYKKNVIELRNYINDRMNHPMEEAIWWTEYVIRHKGAPALRNRYQDVPWYQMEGLDILIFFIILLYALLYSMYLVTRCIISKIFLRARSSRNLDRNWKSD

SEQ ID NO: 6743 - protein, 449 aa, Spodoptera litura
MEKIKMFWLAVCLMLACAEASKILVVFPLPSRSHGNLGDGLVKHLLNAGHEVTYITPFPYKNAPPTLRTIDVSKNFDIMPMDIMSIKSIMDSPMFLHSIGFMLYMMIDLNRHTIQLEEVNKLLTDPKEEFDLVIAEWMFTDIPAGFASVFDCPLIWLSSVEVHWMILQLVDQPTNPAYTVDIMSTYTPPLNFWQRANELWTQVKINFLQYVLQELKKIMDNAKHGVVYFSMGSNLKSKDMPEELKKSLLQMFGTLKQTVLWKFEEKMDNLPSNVHILDWAPQQAILSHPNLAVFITHGGLLSTTESVHFGVPIIGIPVFADQFLNVVKAVNKGFAQRVDLSYTMADKLREAIIEVTSNKRYAEKAKELSFIHHDRPVKPGVELVHWVNHVINTRGAPHLRSPALHVPFYQKIYLDLAVFLVILLLVGRLLVKKAYRAVLSKSKAKTKTH

SEQ ID NO: 6744 - protein, 523 aa, Spodoptera exigua
MERAKVFCFLISIILTCGDAAKILVVFPMPSRSHGNLGDGVVRHLLNAGHEVTYITPFVYKNPPPNLRSIDVSATFDIMPIDMTIKNIMDRTINIENVGSLVYMMTEMLKKTVETESVQKLLSDPKEEFDLVVAEWMFSDVPAGFAAIYNCPLIWLSSVEPHWMILQLIDQPTNPAYTVDIMSIYTPPLNFFQRVNELWTQLKVKFLNFVWLDGVQEKAYNQLLAPFIAKRGRQPPSFDEVRHNASMILSNAYVSTSVAQSLPQSHKFIGGYHIEDKETALPEDLKKIMDNAKNGVVYFSMGSNLKSKDMPEEIKRDLLKMFGTLKQTVLWKFEEKPEKLPSNVHILQWAPQPAILSHPNLAVFVTHGGLLSTTEAVHFGVPIIGIPVFADQFMNVAKSVNRGFALRVDLSYSLAAELKDAINEVTSNPRFAEKAKELSYIHHDRPVKPGVELVHWVNHVIKTRGAPHLRSPALHVTFYQKMYLDLAVVLVLLFLAGRVLLKKICAAVCSKKECSAGGRKKNN

SEQ ID NO: 6745 - protein, 810 aa, Bicyclus anynana
MALSLCPGCFYVQKVPCGSSIHRWVSRLENSLYDEFFVTAIKKRHNTAPSFEALRFNASLLLTNSHVSMGVPAVLPANVIPIGGYHIKPNVKPLPEDLQKLMDNAKHGVIYFSMGSNLRSNQLPEVVKQELLKMFGKLKQTVIWKFEEDLPNRPSNVHIVQWAPQQSILAHKNCILFITHGGLLSTTETMHFGVPIIGIPVFADQFVNVAKAVKKGYAQKVDLSYSMAADIELAIIKLLDDSSYTKRVKELSQIYHDRPVPPARELVHWVEHVVKTRGAPHLRSPAFMVAWYQKLYLDLVLVLKMFKKTQWLTLVLFTLCEINAYKYLVVSPIPGKSHSILGDAIVEHLAKAGHEVTYITAFTPEKVSPRVTIIDTDNYKNFPPDVGFNLNSFMNGTVTTNNFMTFAPFMLSVSRATLGNSNVRKLLADKNQQFDAVIAEWMFNEVYAGFSAVFNCPLIWFSSLEPHWMVMQLIDEIPNPAYSTDMLTTDGIPPLTFRQRVVELYTQIVGRLIQTFWLSGLEHDIYNEYFVPFIRDRYNTVPPFEELRYNASLMLSNSHISMNTPIRLPANVITIGGYHIKPNIKPLPEDLQKLMDNAKDGVIYFSMGSTLSSKHFPDEIKQDLLKMFGKLKQTVIWKFEEDLPNRPNNVHIVQWAPQQSILAHKNCIVFITHGGLLSTTETVHFGVPIIGVPVFADQFVNVGRTVKKGFAQTVDLNYALAASLEKAIRNVLDNPSYTTRVKELSAIYHDRTVPPATELVHWAEQVVKTKGARHLRSPAFMMPWYQKIYLDLILVLLVVLLVLKYVFIFI

SEQ ID NO: 6746 - protein, 1064 aa, Pogonomyrmex barbatus
MWKMCVFSIMTVLCVMMQYNAIYAKRILFISNFPSYSHQITYRGLLLELNRRGHEIVSVTTNPIKNSSLTNYTEIDLNYFYNGLPEFKKLPYPTITAANIAFPILAVERILWTAGHFMNREVFKNPEFKKLYMPGSNEHFDAVIVAQGTTFSLNALAYRFNAPLIGISSLDMYNNLRYTFGSLILPSHISNWQTNTPVEHNMSFWRRLVNFYEVWMQMYAWVNKFVPVEDALAKKYLGEDLPHISDIARNMSIYLVNRHPAFLHGKPEQPNVIYFHGLHIAKTPDPLPENIKQFLDDAKKGFIYMSLGTNVKWKELPNYKRILEVFVDTFCALPYKVIWKYDSDLLPWKCKNILSSNWFPQQSILAHPNIKLFIYQGGLQSTEEAFYYGIPLIGIPILWDQRYHVRNVVKLGIGVRLEYNNVSKEIIETTIHEVINNRRYKDRMEHTSKLYKDGPYDSLQNAVQWIEYVMRQNGTSFLRNSLCDEPWYQRYDWDIIGFFAIILFIASCISMWALYQILQFHARIISNSLYKYTKSKTHYLERQNGKMREVTCTMFVVLFLCILLTSNTASAKRIFVIMVAPFESHLIVHRSLCLALHKRGHELVVLTTHPIKDSTLQNYTEIAISQHVAINERFKRISQMPLIEFLKDIARLANKYVRLLFKNPDFIKFYNSNEKFDAIIIEQISCYVINVLAHKFNAPLIGILTLGLHNYHRYIFGGPILSSHPSNWEFDVLSEEQPSIWQRLWNFIDTWRTIYFYINEAIGDGDEIAKEYFGNDIPKIADIMKNMSLMLVNEHPIYTYPRPEQPNVMFFSGIHIQKTPPSLPNDLGQFLDNATEGFIYVSFGTTCITCHFLPKEMLENFVQVFSKLPYKIVWKFECELPRKLDNVFISKWFLQQGVLAHPNIKLFITQGGLQSTEEAFHYAVPLLGIPIISEQGNRIRRLVSLGVAKQIKLHEITQENLNSTIHEIINNKSYKERMMYLSFLFKDRPYDSLENVIWWIEYVMRHKGINHLQFSESDKPWYERYDMDVIAFLSIILFIMNCAIALIIIQIIHFILRKTILPSR

SEQ ID NO: 6747 - protein, 525 aa, Anopheles darlingi
MRCTNVWIVAVLACVGVSQAANILFMSGVPSPSHYIWLRPLINEMGRRGHNVTVLSADIEKHPPANVTYVHLENFYSHMYNTSMKQKLDFFNMANESPATMLRFFDEFGLDLCEAALKSEGMHSVLDYPKDFKFHLFVSDFMIGPCITSIILHRFKGLPYIPSSPYNAPSTAAAVLGAYAYSGLVPNHVYDAPEEMSFLQRVKNLYYDLYEMILHETFLHPEADRILRKLYPDAPSTTSFYRNVRLSLINVNPVIQYKEPMMPNMISVGGLQIQKPKPLPADLRQVVEGATNGFILFSLGSNARSDLLGPERIINIMTAMERLPQYRFLWKFESDESKLPMAVPKNVYIRAWMPQNDLLAHPNIKLFITHSGLLSTQEAIWNGVPIIGFPVFADQFRNINYCVDAGIGKRLSIQNFQAAQLVAAIKEVLGEPKYAKRMAHVSHLFRDQPESPLERAAWWCEWVLRNPDSDLLQSRAVHMSWFRKYSYDVILFVLAVVLLLAIAIWKVAAIVSKLQVGRSAKSKGD

SEQ ID NO: 6748 - protein, 536 aa, Athalia rosae
MLRFFFIATVILFLISTLRVGNGARILGIFPVTSISHQVVFRGLTLALNKRGHELVVVTPNPVRDPTLKNYKEIDLSYLYDNRKNLDSLQFKTNTNWLDIFWNDLENLFYVYTHKILRTPELKELYSPDNDETFDLVLIESLFFPSLLALATRFDAPIIGITSLGLSANIHYSIGNPVLTSHPSNWEINLDAHGSPTLWERIKNFVTVWKHIYYYRTYHMRKQQEIAEEYFGKDIPDIRDIEKNISLVFVNQQTPISFVRAHVPKHIEIGNFHVSREIVKLPKGLQKILDEATQGFVYMSLGSNVKSNLLTNRTRDEFITAFSKLPYKVLWKFEDDDLPGKPENVVTMKWIPQQGVLAHPNLKVFIYQGGLQSTEEATSHAVPLIGLPVYADQYMQVGKMVSLGVAKKLDIGNVRSEDLVVAIRAITSDNGYKQRMLNLRSLLKDKPKDPLENAIWWTEHVIRNRGAPQLHCSTADEPWYSRYDMDVIAILSAGSVIATFLMLAMFYKFLVYGISLAGINSNGSKESSLIEKKKRN

SEQ ID NO: 6749 - protein, 521 aa, Helicoverpa armigera
MEKMKICWVLFSIMLAIGDASKILVVYPFPSRSHANLGDGIVRNMLKAGHEVTYITPFEFKNAPPSLRQIDVSNLIDLMPKGLLTIKALMDGNNISLNIAFMTYMVTEIFKGMILNENVQKILTDPNEKFDLVIAEWMMSEIPAGIGAVYDCPFIWISSVEIHWILLRFIDQAPNPAFTVDIMTTYTPPLNFVQRAIELWNQVKLTVLNYVILDRIQDNVYSTYLAPIVEKRGRKAPTLDELRYNVSMIFSNAYVDTSSALSLPQSHKYIGGYHIDEKVKPLPEDLQKLMDGAKNGVIYFSMGSNLKSADMPDELKATLVEMFASLPYTVLWKFEEVFPNLPSNIHILKWAPQQSILAHPNLRVFITHGGLLSTTETVHFGVPIIGIPVFADQFINVHRAEIRGFAKRVDLSYTMAGELKKAILEVVSDKRYAEKAKELSFIHHDRPVKPGDELIHWVNHVIRTRGARHLRSPALGVPFYQKMFLDLAVVLTIVLALSYILLKRAWRYFRSGKSKSSKKNN

SEQ ID NO: 6750 - protein, 522 aa, Bactrocera latifrons
MLTQFFFRLLLSAYISLNALQQTNAANILAIFPFPGPSQYICVQAYLKALAARGHEVTVISAFPQKKPLQNFRDISIAEVLDGYEETIVDVIKEERNKWQELNLYYDFFTSGTLSVLKSPKVQELLHSNEHFDLIIVEAIQLDAIYALAQHYNALLIGVSTYGTDPTIDELVGNTSPISYVPLPLSQLSDRMNFWQRLQNLWHHLLHQIHMHIFYLPNQAAIYKQYFPNSTADIYAVRKNFSLVLLNQHFSISFPRPYVPNAIEVAGMHISQRAGKLPTDIANFIRDAKQGAIYFSLGSNVKSKNLSKEKLEILMRVFASLPYNILWKFEATELPNKPPNVYINKWFAQSDILAQPNVKLFISHAGLLSTTEAIHHAKPLIGMPVFFDQFLNMERIKRAGIGVFVDYKYFTYDELRSAIVEVMENPKYTQTIQHMSRRYHDQPMKPLDKAIFWTEYVLRHGGAPHMRVAAQELNFIQYHSLDTLLVLVGGAMLVLLIPSWFVYRNVGRLLLGDRGKIKLKHN

SEQ ID NO: 6751 - protein, 526 aa, Apis florea
MIPNFVRLSFLLYVLIYANESECYKILAIIPTSSYSHQIPYRQIWLELQAQGHEIVLITTNPIPNINLPNFTQIDISHSYSCLKEIDFVKNRFEHIGWLKIIEKHVIPLYTCFLTEVFNSTEVKKLYSPDNPVKFDVFLAEFFYGPAMCAFAHRFNVPLIGLSSLGLISLNEFILGGLVLPSHEFTWEMEANTGTNLPFFKRLSNFVTMWSFLYRTSFDVFSFQQKLAEKYLGPLPPLMDIMKNASLIFINQIDVLSSARPKLPNMLSFNSFHISKNPPPLSKDLEEFLDDAKEGFIYFSLGTNARSSCLPKELVSMFCNIFAKLPYKIVWKYEQDLPEKPGNIYIKDWLPQQSILAHPKIKLFIYQGGQQSSEEAINFGVPVIAFPILGDQDYLVRRIEALGMGKYFDIRTIVSDQFENAIKEVITNKEYKKRVLDVRTQIRETSPDVKNIIWWIEYVIRTKGALHLRSTLAWQPWYQRYDTDIIIFLTIVIFVIFLIIISIVVKILTYFYRSKNIFTHQKHKIY

SEQ ID NO: 6752 - protein, 520 aa, Amyelois transitella
MIRYQILVLCVIINLFANNVNSARILGVFPVPSISHQVVFQAYAKELAKNGHELVIITPNPLKEKNANITEIDVSASYQEVKKIMNNDPHKMFRRGVVQDPSPEILTELYSFVTHMFIDQFNQPAVKNLINNKEHFDLVVIEAFLEYPLIFSHLFKAPTILLCSFYGFSKVYDTVGAATRHPIFYPHIQRTKYRDYTFWDRVRETVTEFRLMYSESLVEQYQNKALKDNYGPDAPTVHDLQNNIDLLFLNSHPIITNNRPVPSNVVHLGGLHLQPVKELPQDLKQYLDRCHLGVVYVSFGSNVRPANMDEDLLNTFLTAFNKLPYNILWKFDGDNLKNVPKNVKIQKWFPQRDLLGHPNIKAFVTQGGLQSFDEAVDVAVPLIGIPMMNDQWHNVNKFVELGIGLELDALTMNADDIVIAVETVIKNDSFKKNMERVRTIWYDQPQKPIERALWWTEYVLRHGGGRHLRAATANVTWREYWMIDVLAFLLVIFILAVFILVITVRKVLKLFVGKSKVKVN

SEQ ID NO: 6753 - protein, 530 aa, Oryctolagus cuniculus
MRCEKWVSTVLLLQLCCAGCGLCGNILVWPCDMSHWLNLKTILEKLTERGHYVTVLISSHTFLVDYSESSALNFEVVSVPNNQDSALNELYDFLELAANVLPTLPLWQSAIKLQEFLANMTENMKLFCENVVYNQTLMKKLQETKYDVMVIDPVIPCGELVAELLAIPFVNTLRFSMGDIVEKYCGQLPVPLSYVPVSMGALTDRMTFMERLKNVILSIFFNFWLHQYDFQVWDQLYSKVLGRPTTLCETMGKAEIWLIRTYWDFEFPRPYLPNFEFVGGLHCKPAKPLPEEMEAFVQSSGEDGVVVFSLGSMVKNLSEAKANLIASALAQIPQKVLWRYKGKTPATLGSNTRLYDWIPQNDLLGHPKTKAFITHGGTNGIYEAIYHGVPMVGVPMFADQPDNIAHMKAKGAAVEVNMNMMTSEDWLSALRTVINDPSYKENAMRLSRIHHDQPMKPLDRAVFWIEFVMRHKGAKHLRVAAHDLTWYQYHSLDVIGFLLACIAAAIILVTQCCLCVYHKFGKTGKKKKRE

SEQ ID NO: 6754 - protein, 531 aa, Symbiodinium microadriaticum
MASRGVIVTYYVHEQFRKVVEATGANWRQMQRPHDLTEEQATKYLPGLDKTACLFPASAVPVAAAILPFLLSDMENLHPRPSLILYDPFLPQGLVVARHLHIPSASLLTYTGPGVVSCQASVSLQWETNPAVQRAAQEIEQMYGVDIFEHGLVGEFYSMERNTVATFERLFAPPSSSLQKDRLSNVPFRCVGPMIASEEARISHAWASAEQLDKKLPWNTIDEARRQSKHVVYLSMGSVATSSFWGRKFGPTAESNGLQAFSGKEFVQFVLNSAFEAFRHEEDILVVAAIGPQIDALDGLPPAPDNFILQEVVPQLQLLQTCDVFITHGGANSLHEALGFALPLVVVPMFGDQPFNADALADTGAAISFKFPSETLSAPALRLAIRQMLDPGNSFRLAARDLNHEMARSGGVARAVDFILFGDDAADAHAKFEMLFFASKSPSSVSTQIRALCGLESVSQVSKVEKSADPAGPSLVRTLSSDTPTLILLDIPDSGGFYVGKMAKELDGSGVQAMIDGWKGKSLERKQLSKS

SEQ ID NO: 6755 - protein, 531 aa, Athalia rosae
MRANKVFPAIALCVVLNYFMDCGSAARILAIFPTPSISHQVVFRGLTLALNKRGHELVVITTDPVKDPTLKNYREIDLNYLYDSFGEIDFVGMRRSMNWPDMLAQLEAILHHQTRQALENPEVKKLHAPENDEKFDVVLMELLFWQALTPLVTRFNAPLIGMVSMAPSTQVHYRIGNPILSNHPSVWELDKDIHESPTLWRRLKNFVNLWKYLYYFETDFLTKQQKMAEEFFGEDIPDVRDIERNVSLILVDQQTTISPVRANLPKIIQFGGFHVSKKVQTLPKDLKKILDEATSGFVYMSLGTNVKSNLLSNETRGEFMKAFSKVPYKVLWKFEDDELPGKPDNVVIMKWTPQQAVLAHPNLKVFVYQGGLQSTEEAIHHGVPLIGLPTIGDQDMNVNKMVSLGVAKKIEITTLRSEELVEAITTIAPDESYKKRMSNLRSLLGDKPNDAMETAIWWTEHVIRHRGAPQLHSTMADEPWYRRYDMDLIAIVSAGSVIVLLAFLFISYKFLVYGIRLLTKVFVANEKKKRN

SEQ ID NO: 6756 - protein, 516 aa, Papilio xuthus
MKFFVVLLLVIIGDFVKSANILAVYPCPSISHQVVFRPITLELLKRGHKVTVVTSDPMYPKGGHENLTEIDVHDRSYAALKKYFVSHVTGSNWDLLNQVKGILDLLSVSFEELMKTKEVQDLINSKEKFDLILLESIYPQGLAISHTFKAPTILISSFGPYVDSYNIMGIPTNPILYNHMFRQRLYNLTLLDKLTEFYNQLVIHYELKKREEIENDLLKKYFGPDIPSLGVLKNYADMLFINIHPVWEGNTPVPPNVIHMGGLHMKKPKKLTQDLQQYLDASDNGVIYFSFGTNVQLSLLPQNKIEIFENVLSQLPYNVIWKRDTESVFIKSKNVKIYKWLPQADLLRHPNIKLFITQGGLQSTDEAITAGVPLLGIPMLGDQWYNVEKYVYHGIGQRLYFEELTEEKLKNAILDVAEDNRYKDNIISLRSLMLDQPQAPLNRAMWWIDYVLRHGGAKHLRAPAANITWTEYLELDLMLFIACSFLILFGFTFSLLRILVSIVSSKIKLDNKLKNE

SEQ ID NO: 6757 - protein, 514 aa, Hyposidra talaca
MYYIIVVLLWLAEQCHGANILAVMPTPSYSHQSVFKVYLESLAERGHTITVIRPTTRVFYDNKFNGNLTEIDATMSELYFSELIEDSSVFRKRGVIADSKTVTAANYIGLVHMIRDQFKLPAVKKLIEQRHRLQFDVLITEAFLDYPLVFSYLFGNLPVIQISSGHGVAENFETMGAVSRHPLYYPNMWRDRFINLNVWETINEIYMEMRLQNEFSLLAEEQTKLMAQQFGDGVPSVQNLRDRVQLLLINTHPVFDNNRPVPPSVQYMGSLHLHKKTVSPLNNYVQNFLDNSTRGVVYVSFGSSISSKDMTPEFLDMLIDTFRLLPYDVAWKMDVVPDVNNLPENVLIQHWFDQFSVLQHPNVKVFVTQGGVQSTDEAVDALVPLVGVPMMGDQFFHTNKYAELGIGRAVNTLTVNSLQLMRAIVDVATSAVYRNGLRHLRHIIHHQPITPLHKEIWYTEHVIRYGKTNNTWLKTKAANVSYSDYFMAYIIFPLITVVAMNQLQQLMRMTFFSI

SEQ ID NO: 6758 - protein, 522 aa, Bactrocera dorsalis
MGRIIYIILALAVLAFVPRLTESAKILAIFPFTGPSQYICVQLYLKSLAARGHEITSISAFPQKTPLKNFRDITLKDEYKDHDEFIITAIEEMSATKLTQLRTLFDYSIMGSLPVLKNEEFQQLLRSDEHFDLIIIEVFSQDSLYALGEHFKAPMIGVSTFGADVIVDQLVDNVSPLAYVPAPSGTNLDVMNFWQRLDNLYTNTMELLYTHLVIIPEQQRQYEKYFPNATLRLTDVRRDFSLLLLNQHYSFSWARPLVPNAIEVAGMHVENKPKKLPMDMEAFINASARGAIYFSLGSNVKSASLPKQKLQEIMTAFASLPVNVLWKFEKTDLAGKPKNVFINKWFPQMDVLAHPKVKLFITHGGMHSQIEAVHHGKPVVGMPIFYDQYLNVEKAVYKGFGVGINFRNFTSTEMRDAILEVLNNPKYTERAREISASFHDRPMNPLDTAIYWTEYVLRHKGAPQLRVAARHLNFLQRHSVDTMAVLFGIPLLLAIFITRRIYSLLLIVFLSKDRSNNKKKSE

SEQ ID NO: 6759 - protein, 552 aa, Cyprinodon variegatus
MRQSVVLVLFLLSMALEDRAAAEKVKDSAETPKLVKPDKVKDTNTTVKSSSSPKFLGNLLVIPMDGSHWVGIKALAQELGRRGHRVTVVIPEHNLRMGPGKYYDTIFYPVPYDKEHVINLLSSHKDVLEKSVQPFMEKIKARFTQIGKTSNFLHTTAESLLFNTSLIHHLAEQKFDAVLTDPMVPTGSFIARKLGVPVINLLRGIPCFMDLKAAGCPAPPSYVPRFFTGLTDKMNFKERTINTLVALLEPLLCRILYWHFDQTAYKFLGEKVGVAEILSDSDIWLHRIDFTLDSPRPLMPNTILVGGINCKLRNPLPEDLVTWISGEHGFVVFTLGSMLSELPEYITSTFLEAFRQIPQKVIWRYTGKVPGKIPENVKMMKWVPQNDLLAHPGVRAFITHAGSHGAFEGLCHAVPMLMVPVNAEQPDNAQRIASRGAGVVLDITSITTESLLQGLNEVINNPRYKENIRQLSALHNDRPMDPLDLSVYWTEYVMQHKGAKHLKAAVHDLNWFQYYCLDIVALLATVLLVTVTLIFKCLKLCFRKLGRKKKQE

SEQ ID NO: 6760 - protein, 498 aa, Danaus plexippus
MDKLLLLSCCVVASHCSNILVVFPVPERSHRVLGESIVKILLEAGHEVTWVTPFPRDIKWSKLDYIDISSALIHETETGNNDDHGPSISELRLNIQQLGSRYAGLALRHPALQELMVNTTVRFEAVVAEWYHSGLLAPLASVFDCPLVWYTPEDISWQTYGLVHGDSSLDFMASTLQSPSYSLPERLRYLWSKLCFGVRNYFHISATELPEYEACYLRAFQSRRRVLPNYEELVYQGSALLINSHPPLGHKIPLPLNAKFNIAKLLDGSKAGVIYVNLESHVTSGEVSHHVIQELIEIFGVVQQTVIWKSEEIQWSLPQNVFMMKNPPQNIILNHTNTIAYINHGQMLSIVDAINFGVPVIGIPLLEDHIVNMDSVVKRGCGIKVDYTNEFAWKVKDAVNRILKMSSYREQSNKDKLIFRNRVATPQSEVLHLMQLVLDSDGAGHLQSSTLFLSVMERHNLDIIILVLMFFWFLNRAWSLFGAYFVWGEDDSDDKKYQ

SEQ ID NO: 6761 - protein, 554 aa, Daphnia pulex
MAGITYATTTLLTASICYCLVTAATAYNILVLSPITTPSHTNVLKPLVMALADQRNHSVTYWNGLKPPSAFNSTSGNLRVLHSSPGDLVDINSDHGIRFRHRNSPFRLFFDIPQRMATYCTAVFNDPIFHRLMMLNGTADGQQQEERYDLLVIEGVFNDCALLLAKALDLPFVYFNCMSPTPWLLDAVGSPLALDHFPHPGFSYTDQMSLWQRAVNALSGVMIVYFHRWVVMPTVDRVAANILGPGRNLTPVWDIEDRYLSLLMTNSHFSINYQFPMLPAVVQIGGLYCAPPKPLPQELESFVEASGDDGFILVSFGSIVKGSQVPDGIRFLFLSTFARLSQRVIFKWEDQPGENVSIPSNVKLLPWMPQQDLLGHPKIRLFINHGGLNSKQEAVYHGVPFIALPLFADQPINAQKAQDDGYAIRLDWDTLTEEILYDAIQRILTDPRYALRMKEVSALSRDEMTSALDRAVYWIEYVIRHGGAPHLRSASRQLSLHQRGFIDVMLVVVSIAFLVAYVAICMCRRAFLLLALAARKQQHDTPTRRMMGSAKKVD

SEQ ID NO: 6762 - protein, 530 aa, Loxodonta africana
MSTKWISALLLIQLSCYVSSGTCGKVLVWPTEYSHWINIKTILDELIQRGHEVTVLTSSASILIDPNTPSAIKFEVYPTSLTKDDFEFLFMKWIRTWTYDLPKDTFWTFFSQIQEIEWEFSDFIEKLCKDIVFNKKLMMKLQESRFDVVLADVIGPCGELVAELLKIPFVYSVRFTYGYTFEKYSGGLLTPPSYVPTALSGLNDQMTFLERVKNMVYGLYFDFWFQSFKEKKWDQFYSEVLGRPTTLYETMGKAEIWLIRTYWDFEFPRPLLPHFDFVGGLHCKPADPLPKEIEEFVQSSGKHGVVVFTLGSMVSNTTEERAHMIASALAQIPQKVLWRFDGKKPDTLGPNTRLYKWIPQNDLLGHPKTKAFITHGGTNGIYEAIYHGVPMVGIPLFADQPDNIARVKAKGAAVSLDMNTMTSADLLNALKTVINDPSYKENAVRLSAIHHDQPVKPLDRAIFWVEFVMRHKGAKHLRPASLSLTWYQYHSLDVIGFLLACVAIATFLVIRCCLFGYQMFYKAGKKKKRE

SEQ ID NO: 6763 - protein, 405 aa, Branchiostoma floridae
CALLLSDSNLVDQLRTSQYSVVISDPFFPCGAILSAHLDSRVPHIAVLRLDPFFLDVKATGVPLPLSYIPFIFSDYTDGMTFLQRLQNVVLSTVAPVIARRNVNMNYNELVRRYIGEEETIQSVTSRTDLWLYRTDNVLDFPRPSMPNMVQVGGLNVRAAVPLTEDIEAFVQSSGDDGVIVVSFGSMVKTMSTERQEVFAAAFARLRQKVVWRYVGEKPAGLGNNTKLLAWLPQNDLLAHPKTRAFITHAGSNGLYEALHHGVPMVCLPLFGDQPANAARVVARGLGVKLDFSTVTSDQLYEAILLVVTNNSYRETAARLSRLHRDQPQSPMERAVWWIEHVIKHGGLPHLRARAVELPWYQYYLLDVAAFLLAGCVAVLGTVWYSCTFFCRKCCTKGGGKLKSQ

SEQ ID NO: 6764 - protein, 518 aa, Trichoplusia ni
MENLKWMLFSVLLCLYGTEAYKILAVFPLPSRSHGILGDNMIKHLLDAGHEVTYVTPYLKEKPHPNLHQVDVTDNRKIMNENTLDIKMLMNGTLSFEDPDVLFGMMFGMTEATMTNPNILELMRKGKFDVVIAEYMFIDLYSAFGPVFQCPLIWFSTIEPHWMILNLVDGPLNPAHSADYTRHRVAPFSFYERVTELWDLVVALYKTSHSYNDKVKGVYEKSVVPILKEKGIPVPDYDEVRYNGSLVLGNSNPAIGDQVPLPQNYKHIGGYHIDKNVKPLPENLQKIMDSAKNGVIYFSLGSNIKSKDLPAETKEGILEIFRGLKQTVLWKFEEVLPNTPKNVHIVQWAPQPSILAHPNLVLFITHGGLLSLTETVHFGVPVIAIPVFADQFQNAKRVESKGYGKEITLTENLHKDLKPAIDEVLGNPRYAAAAKDLSKAFHHRQTKPKDDINFWVDHVVKTRGAPHLRSIALPIPLYQRYFLDLLALVFLSLVTLILIVRRILCSLTKKTNTKVKKN

SEQ ID NO: 6765 - protein, 520 aa, Zeugodacus cucurbitae
MHLPSLILMATALLCAANVQAYRFLAVLHTGARSHHIVGSALMKELARRGHQVTVISPFPLKKPMENYVDIETPRIKAAMDSTASNLLLTVERSVIENMRNFHEMGLNMSRTFLEEANVKALLASNQTFDAVINEIFLSEALFGLSEHYNIPLIGLGTFGAHPWNTDMVGSPSPPSYVASAMLPFSDRMTLWQRVANFAYNIFERLLLDVYYLPKQAAIYKKYFPNNKRDMYEVRRNAALVLLNQHVSLSFARPYVHNQIEVGGMHINRKRSPLPVDLERFINESKHGIIYFSMGSNLRSKFLPLEKRQAILETFRGLKQRVLWKFEDPQLEGKPDNVYISEWFPQDDILAHPNVKLFITHGGLLSTTESIYHGKPFIGIPIFGDQFLNMNRAEAGGYGIRVDYTSFTKDKFKAAIERMVSDESYAKRAAAVSATYRDQPMNPLDLAVYWVEYVVRHKGAKHLHCSGQDLNFIQYHSIDTMLILFGGISLVLLLFMLLIRAVWGWLQFALARKDIKEKVH

SEQ ID NO: 6766 - protein, 541 aa, Coturnix japonica
MLSRSVSAHRKMTLRLCSPLAAWIFIILIPGLSEGGKLLVVPMVGSHWLSMKEVVQKLAERGHEVVVLKPEVSWHMGEKHKHAYTVKTYPGSTKLEELDDAFKVYLATHLKSKPFPLNILALYNISVDVFSTFFLQCKELFDSTETLQYLNQSGFDAILTDPVLICGATVANYLSLPSVFFMRGFPCNLHYEATECPSPLSYVPRLFSFNSDHMTFFQRVENTLIALLEQFYCNGYYRAAIQLSSEVLQRDVSLIDLLNSASIWLLRYDFVFEYPRPVMPNMVFIGGINCEQKKPLPKEFEAIVNASGEHGIVVFSLGSMVSEIPMKKAMEIADALGTVPQTVLWRYTGEVPPNLPKNVKLVKWLPQNDLLAHPKTRAFITHGGSHGVYEGICNAVPMVLMPLFGDQMDNAKRVESRGAGLTLNILEMTSKDISDALKAVINDKKYKENIQRLSDLHLDRPIHPLDLAVHWVEFVMRHKGAPHLRPAAHDLNWIQYHSLDVFAFLLAVVLLSLFISVKCCMFCCRRCCFKKGRKSKKSKTH

SEQ ID NO: 6767 - protein, 502 aa, Drosophila yakuba
MKRSPVSLSLLWMGYTGIFLLADSPAPVEAHHILGVFVNVHRSQLMVHLAVCRALLQKGHHLTLVTTWPLEEQEIRGNVSHIFIPWKQPAEEGSTSDLIGRLERMFKRLEHSGDLLDLPEWKTFLSNPPQTPYDLLLLGYHFNDHLLGLAAHFNCPVAIVSTQQPTGFVNSLMGNPEERWYVPQPYDGHQRSGMSACVFGIWEKFIEMMARRVLARIYSLHFPEPRYPSFETMRRSVVLALSNHHMISEGPIAPLIPSMVDIGGIVLEQQLSKTPLELPAGNRSLIIFSLGTRFTWRKSTEELVQTFTKAFSQFPDYDIYWTYDGPNGSAISLDYPHLKVAKWWPQSQLLQSGRARLFITHGGKGSLSEALFHGVPMLGLPLIGDQRANLRRMQSRNWGLTLSTHNLTHLELAKGISRMLTNSSYSETILKASQVYRDRPMNSSDLATYWIEYIVRHKGAKNLYNPARQLNMIEYHSIDMYFMVYGFLMLTIAMLRKVNRLL

SEQ ID NO: 6768 - protein, 525 aa, Danio rerio
MRTLPVPAQGLLALLCLFSFESVQAGKVLVLPVDGSHWLSMKILVEELSNRGHEMVVLVPETSILIKKSGKYSTKTYPVSFTHDDLAENLKEIQNSALEKAPKLTDIVVNFRNLLQFLTMQSKTCEGLLYNEPLMKSLREMGFDAMLTDPFLPCGTIIADSFSIPAVYFLRLIPCRLDEAAAQCPSPPSFMPRYSSGFTDKMTFPQRLVNTLLTVVEGFLCRSMYESADELASKYLQKETTYAELLGHGAVWLLRYDFAFEFPRPQMPNMVQIGGINCVKRAPLTKELEEFVNGSGEHGFVVFTLGSMVSQLPEAKAREFFEAFRQIPQRVLWRYTGPVPENAPKNVKLMKWLPQNDLLGHPKVRAFVTHGGSHGIYEGICNGVPMVMLPLFGDQGDNAQRLVSRGVAESLTIYDVTSEKLLVALKKVINDKSYKEKMMKLSAIHRDRPIEPLDLAVFWTEFVMRHKGAEHLRPAAHDLNWIQYHSLDVIGFLLLILLTVIFVTVKSCMFCFRKCFKKSQKKKKA

SEQ ID NO: 6769 - protein, 532 aa, Xenopus tropicalis
MRLLCTLEYSVYRVFALLFLGRVQLIEAEKLLAIPLDGSHWLSMRILVESLGQRGNQVVVLAPHSNIHIHPSENYILRTYPVPYSKELLKEQMVKSANDVFTKRPLLDKITNMYQRITNVTGIVFSACQHLLHSKEIMQELQESAFDAALIDPFFPCGMIVAEYLHLPSVYLLYGLPCGIDRLATQCPSPLSYVPRHFTGNTDHMSFPQRLKNALLWPVDTFLCNLLYSPYAQLASEFLHREMTILQLYSQTSVWLMKTDFVFDYPRPLMPNMVFVGGINCVGEQHLNQEFEKLVNSSGEHGFVVFSLGSMVSEIPMNKAMDIAEALKSIPQKVFWRYTGKAPPNLGENTHLVKWLPQNDLLAHPKARAFITHAGSHGIYEGICNAVPMVMMPLFGDQMDNAKRIESRGAGLTLNVLHMTPEDLSNAVRAVINNPVYKENIQRMSSLHLDRPIHPLDLAVHWVEFVMRHKGAPHLRPAAHDLNWFQYYSLDVIGFLLAVLLTALFISLKCCTFVFRRCFKRNSKKQRKSKSQ

SEQ ID NO: 6770 - protein, 713 aa, Symbiodinium microadriaticum
MVTPARKFGFIFPMASGHINPSLPVARTLVEEGQEVHYLCREQMKDAIEDTGATFHSEIEALPEMYEGRNVDIFGCLSDLQKEYGLEEDPLFVAMFKIREIMQEMMLPGILRWLEKVGVDVVVICPLMNKEACWAAQILGIPCVGIMTTAGPGSLRSATLEWMEKMGYTTERCLKERRAYQPLLEAVDRLRAKYGLEIELDEEMAPVGMSVVAKQSALTLVTTVDFLADPLSPELEKIYEEAQTEFVFVGPLLDKAGAKRAAGHKFQKEASSTQGLEPPAETAPIDPVALIRKAREAGRKVIFASMGTVITGDSPEVGWANHMSVDGVFQGLTGKELCQAAWGGLFDAFGTDSADAGPLLLVSLGPQPDALENLVAPANAACLPVMPQVDILKEGVDLFLTHGGQNSFMESLSTGSPVVVCPGFADQPVNAQKAVQLGVGLQIERPMCDLSEASQVAAKYRCDVAAALQQVHGNPEFKTKANECSSKMQSAGGVRRATDLILQDVARAFVEDWGAYGRRLPNRRTGFVSMPLLIIIDIQRPGVPIVLTRFFMNLHIGHALSGNPHLALGCTGDSNQGVQVSCGESTRRPPKKSLEAALTPFIFWISEGSCVFGLPWEMTEQGQEEIAGRQRLWSALRFQPLAGEFKTVLAGFPSSLCASFVQFYGSKATGTADMKASPNVIKIGQRVILGLQALQAFIEDHGARHTRKAQDDL

SEQ ID NO: 6771 - protein, 531 aa, Melanaphis sacchari
MLPSVFFCSVLCITTTITRASNILVFMPLPIKSHFRGFQPLFETLSNRGHNVTVVSSYPLDHSVANYTDIGPFIDKTRAKNVMDLVRMNFITSVQLKWRIGIQLSEMVMSHRNMKQFVQSNSNSYDLVMVETFGQEYAVAMGHKFNAPVINLAPAMIWTSISKWLHVPSTFSYIPDACTQPTTNMGFVERLKNTITGLMQLYVENYLYLPKTKEVMNTYLKYRNWESRPPLENMLNNVSLTLVNSHNAIGISRPYLPGIIEVGGMHIKDPKSLPKNLQTFLDAANQGVIFFSFGTLVNLNDLPKEKLKIFINVLGRLKQKVIIKWTPEDSNVKLPQNIMTGSWFPQRDILAHPNVILFITHGGLHSLEETVCNAKPVVGVPFFAEQNFNMKIVEEIGYGKLVNFFEITEESFENTIKEVLSNEMFKEKAIIQSHVYKDQPMKPLDHAVYWVEYVIRYGGAGHLKSDSIGLNDLQYFLFDVLLILLLSIGLIAWLCNFIFAKCIYLVKLSLDSCTTPSTPDTTTSQIKTLMD

SEQ ID NO: 6772 - protein, 410 aa, Epinephelus coioides
LIARGHEAVVLVPESSLLIHGSESYKTEIYQVSYTKAELDGKFAELQTGVSLKPPAITDLFIDVQRLTNFTSIQVKGCESLLINQPLMSRLKEGGFDVVLTDPFLPCGSVLGHMFSIPVVYFLRGLPCELDIKANQCPSPPSYVPVFFSGNTDIMTFPQRVKNMLMSFFELYLCKVMYASFDDLVSRYLGDNMTYKDVLSHGAIWLLRYDFVFERPKPVMPNMVFIGGINCAKKAPLPADLAEFVDGSGDDGFIIFTLGSMISNMPTEKAKQFFDAFRQIPQRVLWRYTGVVPEDIPKNVKLMKWLPQNDLLAHPKARVFTTHGGTHGIYEGICNAVPMLMFPLFGDQGDNVERMVSRGVAEQLRIYDMTTETLLAALNNIIHDKSYKEKMVTLSQIHLDRPVPPLDLAV

SEQ ID NO: 6773 - protein, 525 aa, Ceratitis capitata
MARVSLVILALVCFAFVPSRVQAAKILVVFPFTGPSQYLLVQPYLKTLAARGHEITSVSVFPQKTPIKNFRDITLKIEEADHDEIVIAAIEEMSRGKMQQLNLVKEYVLPATLSVLTNEEFQQLLRGNEHFDLIIVEVFCQEALYALGSHFKAPMIGISTFGADVVNDQLVDNVSPVSYVSAPSGQYLDCVDFWQRLDNLYINTVEWLYDLFVILPAQQRLYETYFPNVTLDLSEVRRDFSLLLLNQHYSYSWPRPLVPNAIEIAGMHVEHIPKKLPADMEAFINASPKGAIYFSLGSNVKSAYLPKEKIKAIMDAFASLPVNVLWKFEKTDLPGKPKNVFINKWFPQQDILAHPKVKLFITHGGMHSTIEVVHHGKPIVGMPVFYDQHLNIQHILKKGFGVAVNFKNFTSGELRDAILEVLNNPKYAESAREISARFHDRPMKPLDAAIYWTEYVLRHKGAPQLRVAARHLNFLQRNSVDTMAVLFGIPILLVILIGCILYKLFKAIYRNANNTKTNLKKRKNE

SEQ ID NO: 6774 - protein, 537 aa, Perigonia lusca
MTHLSLVVLLVAATFVGGTNGGNIVAFLPTPSYSHQSVFKVYLEEMARRQHVVYIIKPNISTVKFEQPTAGKGKIIEIDSTLKESSFVKLLKESRVYRKRGLVADVSTVTADNYINLVQMVANQLQLPHVRSFIEKNIVDETGRSLRFDVLITEAYIDYPLILSHLLHNLPVIQISSGHGVAENFETMGAISRHPLYFPNMWRTKFVNVKSSASSSSWNFITQLYAELKLKYEFTNLADRQSVMFRDTYGDDTPDVYTLRNNVQLLLINVHPWLDNNRPVPPSVQYLGGLHLVNVDEYSAQIINSAVKKFLDSSDKPVVYISFGSGIEVANNMDMEFFNMLVSTFDSLKTQYNFLWKYESDQHLDKIPTNVLVQKWFEQQAVLKHKNITAFVTQSGIQSIDEAIDSLVPMIGLPLMGDQAFNANKIRELKLGCVVDTVSVDTAGLVRAIKDVAENPVYRHNLRRLRHSIRNPMISPLQKATWFTEHVITRKFNSNLKPQSANTSYSQYYMCHMITSILFVVILNQLRYIIQLYEAFN

SEQ ID NO: 6775 - protein, 523 aa, Spodoptera exigua
MNGCAVLILFFALTTGSAVSAARILAVFPTPAYSHHSVYKVYVRALVERGHEVVVIKSTDKINYRDLDYRNAGYNMRYNVTEIDASLSQDYFKKLMKQAQVFRKRGLVADSSTVTADNYMGMVRMISDQFNLPAVKRLIDEQSKFDLIIAEAFIDYSLVFSHLFDDAPIVQISSGYAVAENFETMGAVSRHPVYYPNMWRDKFRDLNVWDLINELYIELKLYNEFNKLVDEQNRLLKQQFGANTPTIQELRNRVQLLFVNTHPVFDNNRPVPPSVQYLGSLHLTDKHPKSLFGTVREVLDNATNGVVYVSFGSGISTDEMESEFIEMLLRTFETLPYTVLWKYDGYLSRIPDNVFVQSWFEQYDLLHHPNVRAFVTQGGVQSTDEAIDALVPMVGMPMMGDQAFNTNKYAELGIGRVVDTATVNAFQMINAITDVAENPSYRKKLAELRHLIRHQAVSPIHKAVWYTEHVINSSKKRDGGDTLLKTKASNVNYSDYIMSYIFVPLASFTVMNHLRQLLRINLV

SEQ ID NO: 6776 - protein, 220 aa, Ooceraea biroi
MVLIETFPRTILDVFYVSLGKIAPVRVLIKVPNPEKLPAGLPENIRTFRWMPQVKVLKHPNIRAFVTHGGLMSTMEAIFCGVPMIGMPLYADQFKNVEACVTRNVSVKLDVHKMTEKDMDAALNAILHDPRYMENIRNLSQRVHDQPLRPADIANYWIEYVIKYGDDVLRSPAMDLAWWQICLIDVAACFLFCVTAIITVAMFIICFVMKMINGNHHMFL

SEQ ID NO: 6777 - protein, 399 aa, Unknown
  Description of Unknown: Actinobacteria bacterium OK074 sequence
MSGFLFVVPPLVGHINPAVGVAAELTARGHRVAWACSDPALVRRLAGEQAAVFTCAGPALGPGGAERPPDLRGPQALKFLWEYYLVPLADAMAPGVAAAIEEFRPDTVVADQQAFAGALVAERLGLPWATSATTSAEFVDPLAGLPKVTEHLDGLLAALRGRIGDPAGSADPRFSPHLVLAFSVPELVGPDAVHGEQFRYVGPSVAARPSTTGFPWEWLDEGRATVLVSLGTANTDVGARFLGECLTALRERADRVQGVIVDPGGTLAPDTGHDKDVLIVPSVPQLPLLERVDAVVCHAGDNTVCEALWHGVPLVVAPIRDDQPVIAGQVTDAGAGVRVRFGRVTAPKLGAALDAVLHEPEARAAAERIGTAFRAAGGAPAAATHLEHLATGAPKEADQ

SEQ ID NO: 6778 - protein, 551 aa, Frankliniella occidentalis
MQHASPARAAAQQSVAVLVMALFTQCVSLAAPEVKTTAVGTARQPLRILSIMTFDTMSHHIWMSALTVELAKRGHLVTSIDIHRHGENPPTLNTTIIETAFKVFDDPKDRERWFAASVVKKIGMMQSLLEEDCKRDLGSPTMQRLLDPAFTGAFDLIIFDYMSDCTLGFAHRFNYPGMLAVSPFPISPWIDDLMYNPQVPSILAHTMQPFPHPMNLWQRTWTLFLHAHYKLTVWWRRPVQDSLIKRFFGDKAPRVEQLRQHVHVALVNENPVLEAARPLPQSLIPAGGMHVKPADLGRIPSDLRKWMDEAEDGFLFVSFGSIIKGKDIDLVKKRALVHSFAALAPVRVLWKIEPDAVGEEPVAANVRVEAWAPQNDLLAHPKLRLFVSHCGGLSVQEASYHGVPMLGTPFAVDQFVNLEKVVGIGMGRGMPYKEITKERFVNEIKEMLTNPRYLKAARHTRTLIHDQKETPLERAVWWAEYVGRHRGAPHLRSPSRDLYWHQVMMLDIAALLALAVLAVLLVAFLVVNCAVYFFRSSGQRGKEPLKRTKKD

SEQ ID NO: 6779 - protein, 463 aa, Bactrocera oleae
MFALKPIVVALWMLACATNYVESAKILAVFPFSGPSQYICVQSYLQTLAVRGHEITSVSAFPQKTLLKNFRDITIHIEQSHHDEAVISAIEEMSGGKLDLLQSVRDYTTMTSLLVWETEEFQQLLRSDEQFDLIIIEVFYQEALYALGQHFKAPMIGVSTFGADIIIDQLVDNVSPVAYVPTPTGINLDRMNFWERLDNLYSNTMELLYTHLVLIPEQQRYYEKYFPNATLRLTDVRRDFSLLLLNQHYSFSWPRPLVPNAIEVAGMHIDHKPKKIPTDMEDFINASSRGAIYFSLGSNVKSAFLPKHKLQELMNAFASLPVNVLWKFEKTDLAGKPKNVFINKWFPQSDILAHPKVKLFVTHGGMHSLIEAVHHAKPVVGTPVFYDQHLNVEKAVSKGFGVAINFRNFTSTELRNAILEVLNNPTYTEKAREISASFHDRPMKPLDAAIYWTEYVLRHKGAP

SEQ ID NO: 6780 - protein, 665 aa, Anas platyrhynchos
LLLSVLGLAAGGKVLVVPVDGSHWLSMREVLEGLKAKGHEVVVVAPEVSLYIKPSKSFVMKMYPVPFTQEEMDTTFQRTGQQVFEEGTFLERIVKTYEGVKNTSAIFLSTCEHLLYNKELIRYLEESKFDAVFTDPILPCGQILAEHLSVPSVFYLQQIPCGLEFEATQCPNPPSYVPRVFTDNTDRMNFLQRVKNVIFDIPNFFLCDVVFQPYSKLASEFLQRGKLLVVPIDGSHWLSMRPIVERLRQRGHEIVIVAPEINLRIDSSVHYTMKTYSVPYTREYVEAEFKKLGYRSFTPQPFLEKFSKVANITKMFFDSCKMLLSDKELIKYLEESTFDAVLMDPFFPCGQILAEHLSIPSVYLVRGLPCSLDFHATLCPNPPSYIPRFFTRYTDRMGFLQRVVNVIVSLSNSLTCSLFYSPYDILIKEFLQKEATLLEILSHASIWLMKYDFVFEYPRPVMPNMVLIGGISCTQEKPLSKVLWRYTGKVPSNLPQNVKLVKWLPQNDLLAHPKTRAFITHGGSHGVYEGICNAVPMVLMPLFGDQMDNAKRVESRGAGLTLNILEMTSEDMSNALKTVINDKKYKENIKRLSELHLDRPIHPLDLAVHWVEFVMRHKGAPHLRPAAHDLNWIQYHSLDVIAFLLAVVLLSLFISFKCCMFCCRR

SEQ ID NO: 6781 - protein, 521 aa, Vanessa tameamea
MSKWALVLVSFLSSLYLSNAYKVLFISPLPSKSHSILGEGVLNHLSRAGHEVTYIASIIPEKPIKGVSVIDVSDTLVTFLAGMMNLKSIMDKTQSNDLFNMMPALMNMSRNTINNDGVKTLLSDKTKQFDVIIAEWMFNEVYAGFSGIFNCPLIWLSTIEPHWMVLQLVDEIPNPSYNVDSLSSNVPPLTFSQRLLELGLQIFGKLIQIFYTSGVEQEIYENHFVPHIRNRGYPVQPIEELKYNVSLVLSNSHVSMGVATRLPPNFIPIGGYHIDPVVKPLPKDLQNIMDNAKHGIIYFSMGSNLRSQHFPTEVKQELLNMFAELKQTVLWKFEEDLPNLPNNVHILKWAPQQSILAHKKCLLFITHGGLLSTTESIHFGVPIIGIPVFADQFVNVARGVKKGFAKKVDLSYTMAKDLRVAIQEMIHESRYMTKIKELSFIYHHRTVSPGQELVHWVEHVIKTGGARHLRTPALMTPWYQKVYLDLAIILLIIIIAIKYIFRYICCSSGNKVSASYKKKQN

SEQ ID NO: 6782 - protein, 528 aa, Neodiprion lecontei
MSRYFLSATLILVVGFWHYGCASRILGIFPTPSISHQVVYRGLTLALRERGHELVIVTTDPVNDPNLTNYKEIDVHSLYDIFIQDVDWIATREKDTWSNMFDGFMSKLELECEEILEHPELRKLYAPNSGEKFDLMLIEMLFFPSLMPLATRFDVPVIGMASLGLSLNMQYAVGNPIMPSHPSNWDADEKIFGELTLWQRMKNFVRTWKYLYKYWTRYMPAQQALARKYFGNDIPDISDIEKNVSLVFANQQAPITYLRPNVPKIIDIGGFHVTKKIKPLSKDLQKILDDSTQGFIYMSLGSNVKSVMLANETREEFIAAFSKLPYTVVWKFEDEFLPNKPPNVLIMKWAPQQSILAHPNLKVFIYQGGLQSTEEAISHGVPVIGFPVLADQDIHVSKMASLGVGKKLEILTVKRDELIEAIQSVVYDTSYKKRMLDLRNLLRDKPYDSMENAIWWTEHVIRHKGAPHLQSTLVDEPWYQRQDMDIVFIISAGSLVALCFTLVVFHKLLICSIRAFNKLPSSKKDKLH

SEQ ID NO: 6783 - protein, 519 aa, Daphnia pulex
MKHRSIVLPLLVIAFAVGSCFGERIVVLYPLGSKSHFYAVMPIIEKLVERGHNVTVFTPFKGITKNVKNVREVILESLAKKIDEVDIDWFAMQKQGATQFFKMMFSSIELAALACEELITNPVFRQIVETREVDLFIVDGIGNEFTYPVIDKLGVPFVLHGASSAFPATLGALGAPIDYASVPIVFMDFDDKMTFFQRLINFSTGELIKLVRDHFVFKKLDAILQREFPGVKPIVQLEGEASLLITNTHPITNWPRSLPPTIIPIAALHTRPAKQLPSVLKTFADEAKDGFVVFTLGSFVSVSSMPKETVDTFFRVFAKLPQRVIWKWEADIPENIPPNIMMVDWLPQQDLLGHPNAKLFITHGGLLGIQESIYHGVPLLGLPFGNDQRANVARAARDGWGLKLDWDKINDQDLIDAVTHLINNPSAREKVKRLSLLMRDEILPGGEMAVYWIEYVIRHGGTIHLQLAAKDMPFYQRYLVDVTLFLVLIAAVFLIIAYKLIRSLSRNCRKEISRKIKTN

SEQ ID NO: 6784 - protein, 528 aa, Peromyscus maniculatus
MIKKFSQLLVFHLALTEIVLSGNVLIWPTDGSHWLNIKILLEELIQRNHSVTVLASSETLFINSSPDAFVHFEEISVSYTKSKIDEIIEHMIALWLDHRPTPLTMWTFYKELGKLFETFYQINIEICDGVLNNPTLMAKLQDQDFNVLIADPVTICGDLVALKLGIPFVYTLRFSPAFTVERHCGKIPAPTSYVPAALSELTDQMSFGERVKNTISYSLQDYIFQSYWRRWNSYYSRVLGRPTTLCETMGKAEIWLMRTYWDFEFPRPYLPNFEFVGGLHCKPAKPLPKEMEEFVQSSGEHGVVVFSLGSMVKNLTEEKANLIALALAQIPQKVLWRYKGKIPATLGSNTRLFDWIPQNDLLGHPKTRAFITHGGTNGIYEAIYHGIPMVGVPMFADQPDNIAHMKAKGAAVEVNMNTMTSEDLLSAVRTVINDPSYKENAMRLSRIHHDQPVKPLDRAVFWIEFVMRHKGAKHLRVAAHDLSWFQYHSLDVIGFLLACVASALFLLAKSCLFVFQKFAMTGKKKKRD

SEQ ID NO: 6785 - protein, 229 aa, Anopheles sinensis
MIPVGGLQILSPKPLAEDLQKIVDGARNGFILFSLGSNARSDLLGPERIRNILTAMERLPQYQFFWKFESDQSKLPMAVPKNVFIRAWMPQNDLLAHPNIKLFITHSGLLSTQEAIWHGVPVIGFPVFADQFRNINYCVNVGIAKRLSIHNFQANELVDAVKEILEEPKYTKKMKQVSRLFRDQPETPLERAVWWCEWVLRNPEADLLQSRAVHLNKKIKEGVIVKENT

SEQ ID NO: 6786 - protein, 527 aa, Cephus cinctus
MNLRIFIIPLLTSVVATSCNGFRILAIFPFTAKSHFVMFEELSKSLARAGHRVDVVSLFPLKENFPNYTDIVKLKWDFPTLVNNISIDFVEKEFRGNIISFIATVTGNQICKNLDHPDILKIVQNPPNDPPYDAFITEIFGAHCYMIIGHQLKIPIIGVSSSELYPWGHEMIANPRNLAFVPFELLPMTPPLSYWERMKNFLLYWWSYHEFNYYTRVQDDMIRKNFGEDAPGVRELERSVSMILANSHSSVNGAKPVTAGLIEVGGLHVRDDGPELPENLQKWLDESAHGFIYFTFGSMVRIETLPKETLAILYRSFGKIAPVRVLMKIAKPQELPDGLPGNVITQAWIQQLKVLKHKNIRAFITHGGLMGTQEAIHCGVPMIGVPLFADQFVNIHNYVEKKIALFLDYKAITEEKLDAAIDAILNDPVYLKSVRAISEKFRDRPLTPAETAVYWVEYIIKHGSQALRSPALDLTWWQEALLDVYVALVLALLVTVYAIIMIVGALVRLIFGKKRGSKRASRSKKNK

SEQ ID NO: 6787 - protein, 498 aa, Strigamia maritima
MFLQAIVLLFFSHEASCSKILCLLPVGGKSHEHILIPVVEELVKANHHVTCVWPHKFPKNIDNPNFRIIAMDQIEMRETTSMQNIFNLPSASPLLFFASFTDFTIVPCETFFKSKEVQLLIKRGVQFDLVLVAGFMNECAMTISHLIANYSVILSPNIIMPWTPVTCPRPSSFVPNMMLRYTDEMTLFQRFYNSFYFIAIRAINDFHLMPVFEDIAYKYVSKSSSVDTAIDKISLILTNTDPVIITPRPTMPNVVSVGCIHCETALPVPEEFEDFINGSGDEGFILFSLGSNVQSKYLPEEIKQRFIHVFSNLKQRVIWKYEGEIDHLSTNIKATKWMPQQDILGHSKIRLFITHGGLLSLQQAVYHAVPVIGIPLFSDQKVNMARVQQLQIGRTLDFANITVENLNYSINIILQDERYPVNMKKHSRILKDEMDEPAKRAVYWLEYVIRHSGGKHLKSYAERLNWFQYFLIDLLLFLVIGCFLIVTVIRICYKTCCF

SEQ ID NO: 6788 - protein, 525 aa, Drosophila willistoni
MRLAIFASIFSLIGCVGLCSAYNFLMVLNSAGRSHFNVGHALAKGLVAKGHEITVVSVFPLKKPIPGYHDVDVPNVIKVMQGDIAALWQSIQKPLTEKLMDHYQMGFRITRGLFEDPNFQKLLVSNSTFDGVICESFYNDAHYGLAEHFKAPLIALSTGGALTFISDMVGSPAPPSFVPHIMLSFGDHMTFYERLVNVLFLAYERFLLDYYYLPKQAEIYREFFPHNKHNFYEMRRNASLVLINQHFSLGFPRPYAPNMIEVAGLHVDDNQKPLPPAIEKFINESNHGAIYFSMGSNLKSKDLPAEKIAEILQAFRGLKQRVLWKFELDDLPNKPDNVYISNWFPQTDILAHPNILAFITHGGMLSTTESIYLGKPVIGYPIFSDQFSNMAHAEQIGYGIKLDFQKLNSKDLRAAIERITSVRSYSERVQAISQRYRDQQQKPLDNAVFWVEHVVRHKGADYLKSAGQRLNWWQYHIVDVLAVISISVILTLTVLFWALWKLLSKLLNEQWPSGPPFAILGYNKK

SEQ ID NO: 6789 - protein, 522 aa, Tribolium castaneum
MVSFSLMTFMAVINACTCANILMITMGGTKSHKIPFWELARGLIPRGHNITFISAFPSDFLLPGLEEITPTSFVFYVKNFTNWDLVGAKIRGEEPVHPFDMVRYAYEACDVLLSDPETKDLLYSQQSFDLLVLDGAYPECALGFVNHYNAPFIYINTVGFYTGSLSLAGNPAPYSVTPFLARPFTDAMSLLQRTVNTVWHLLANSLHSFMVRNMIQPIVRKHFGPDVPLVYDISRNVSFILQNAHATVTYPRPYLPNVAEIACIHCKRAKALPDDLEEFIQGSGSAGFIYFSMGSSVKAANMPEYLRRMLMRVFRQLPQRVLWKYEADEEMPDLPANVKLGRWLPQQDILGHPKIRAFVTHGGLLSMFETVYHGVPVVSLPVFCDHDSNAAKAETDGYALKLDLSKITAESLVWAIRKVIHDPKYREEVKKRQFLLRDQKETPLERAVYWTEYVLRHKGATHLQSPAKNMGVVEYYLIDVALLASCCTFIVWYLMKLTLKIIVMVLSGNLSFNLFRKKIKIE

SEQ ID NO: 6790 - protein, 526 aa, Drosophila mojavensis
MSPSDRRTSLTGLALMCLLSSATAYNYLLVLPTIARSHYNVGSALAKGLAAAGHQVTLVSPFPLKTPIQNINDLPVPNILKAMSGDLDSLLKKSEKPIIQQIIGFYAMGLRITEALLKEPKIQQLRKSNQTFDAVISEVFLNEAHFGFAEHFKAPLIGLGTFGAISWNTDLVGSPSPPSYVPHALLKFSDHMSLVERVINFAFINYEYLFMTLYYLPQQEALYAKYFPDNKQNFYEMRKNTALVLLNQHVSLSFPRPYSPNMIEVGGMHINRKRQPLPQDIEDFIKGAKHGVIYFSMGSNLRSKDLPMAKREALIETFGKLNQRVLWKFEEPNLVGKPANVFISDWFPQDDILAHENVILFITHGGLLSTTESIYHGKPFVGIPIFGDQFLNMARAEQNGYGRTVHYEELTAERLLAAIQQLLQDPHAKQLVNEMSARYKDQPQLPLERAVFWVEHVSRHKGARYLRSASQDLDFVQYHNLDAMFILYGGILFVLYCLMLFIRLVWRALQQFFMGRQAAQPKQKRH

SEQ ID NO: 6791 - protein, 813 aa, Symbiodinium microadriaticum
MANESPIRFAFAFGMASGHINPSLPIARALVKLGHEVHYLSREQMRAPIEDTGAHFTNELEECPELYEGRKEDLFGATEALKLEHGLEEDPMMLSWVKLAPISLELGLPGVLRWMQRLQPQVLVFCPMLNRDAFFAAKILGIPRVPLLTTAGPGSMVSVINQFLSWSGLSMPEIIERARKFPASAEAIRRLADMGVNYEAELELSAKSPGAIGCMVHSPITVVTTCEDMQDPVPPELEAAYSSQGAKFVYVGPLLDQQGARRAAGHKFAQFAHSDTEKAGDSPKDVLEELRDARDAGRLIVLASMGTVITGDSPDFGWAVKPVESQRQGLTGKQLCQAAWSGVFDAFGAKEGDLLEKTPLILVSVGPQKDALDSVKVPPNAICKPVLPQVDLLRAGVDIFLTHGGQNSFMESLAAGVPVVVCPGFADQPANAQKAAELQVGLQVTRPVPAEGEEDAATASYTTSVAEALRRVQQEPVFRTAAAECGRKITEAGGVQRTVDILLQTGRERWKPNDRGGVDYNVDSAVTGPGSVNFATVTEKFTLNSNTFALYNCMNVMRYTIEETIVKVAHMAPAAQSTASDHDLGETAPAVFYQYLIKHANGSLMAQTSQYRLPETDINFTSFIPGSLQTDVFAMAKRQGRWEGTGWRDCRTPQKGWNISFPEKKGDNLVAIATVQDLQVAALAVLTLLAWREETVGSDGFEHAGQFSMYWSLPLGMSAGYGKHGQMTCSCDTAPSRAPWLAASAPCNPCLERILRRRRRSRRALLCSPGTSCWPATGPRHLFRPESACLQRHLSKRKVPILPRCLEMKRELS

SEQ ID NO: 6792 - protein, 693 aa, Ochotona princeps
MLGNILLWSLQLSLLGTTLGGNVLIWPMEGSHWLNVKIIIDELIRKEHNVTVLMASGALFITPTINPSLTFEIYKVPFDKERIEGVIRDFVLTWLEHRPSPSTIWRFYHEMAKVMKDFHMVSREICDGVLKNQKLMEKMKKSKFEVLLSDPVFPCGDIVALKLGIPFIYSLRFSPASTVEKHCGKVPFPPSYVPAVLSELTDQMSFTDRVRNFISYRLQDYMFEALWKSWDSYYSQALDGSHWLNIRNIVEELIQRNHSVTVLASSTTLFINSNPDSSVTFEVIPVSYNLSKLDSLIEHMIMLWLEHRPTPFTMWTFYKELGKLLHTFFQINIQICEGVLNNPQLLAKLQKNAFDVLIADPVTICGDLVALQLGIPFIYTLRFSPAATVERHCGKIPAPVSYVPAALSELTDQMTFGERVKNTISYSLQDYIFQSYWGEWNSYYSKVLGRPTTLCETMGKAEIWLMRTYWDFEFPRPYLPNFEFVGGLHCKPAKPLPEVLWRYKGKTPDTLGPNTRLYDWIPQNDLLGHPKTKAFITHGGTNGIYEAIYHGVPMVGVPMFADQPDNIAHMRAKGAAVEVNMNTMTSEDWLNALRTVINDPSYKENAMRLSRIHHDQPVKPLDRAVFWIEFVMRHKGAKHLRPAAHDLTWFQYHSLDVIGFLLACLATSIILITKCCLCVYHVFGKTGKKKKRE

SEQ ID NO: 6793 - protein, 412 aa, Blattella germanica
MLWCTQGARILGLFPFPARSHKAIFSPLLRELATRGHDVVIYSPYPEIPPVANITDVVMAELDYRDHKRKESLYTLKDQGMMGKLVVLWKMGLHTCEKVLQDKEVQGILQSTEIHFDLILIEAFFNECLLGFAHKFRAPTVHICSHGGMFWMGDYVGNPNPHAYVPDVFFDFSDKMTFQQRVWNTLAALFARAGRELWYLPQQNTIMKNYFKYEDLPSVWELQTNTSAVMLNTHVAVNYPRPLMPNLLLVGGMHIKKPGKLPQDLQRYLDDAPGGVIYFSMGTNLQSSLMPESKVKAFLGAFSRLTEQKVLWKWESDSLPGQPNNVKLAKWLPQSDILAHPNIRLFVSHGGMMSTQEAVYRGVPLVGIPIFSDQLLNIRQASAAGYALHLDYENITEESVYWAIQQVLYVPK

SEQ ID NO: 6794 - protein, 525 aa, Drosophila persimilis
MEMQTKVIVLSLICLCSGQAAKILVLFPHASESHFAVMRTLVTELASREHNVTVYTGHGLGERLENVSETIIPEYPFWSNLQKHAAPKGNLADLGRLSIPTLRKSLAVVGANALDHFLSQEPLQKLLQQPPLDFDFDVIILDYFYTEALLALGQFHQKPIVGIVSTDFGNYMEAVQESMVPAACSPIDFEHYVPSLGFSARLGNIRECISRRKQFAKDHFGAQEQLIAKHFKVKSSVPELQANQLSLLLVNSHVPLMTPRPSLQHIVPAGGLHIRGPRELPWNIKRFLEEARAGAIYLQLGNEQPCGELPKLKLEALLGFFDSRKERFIWSCHDVKTLDGLPKNVMIQHAVPQIDILAHPRVNAFIMNGDLLSLQEAIVRNVPTLGLPIFQNERQNMELAVRLGVGLKLEQENVTIASLSWAVDRLLLEPQYQITIRDVSLEFRDRPLGALASAMFWVNYVARHKGGAAIRTRGVGISSNQLHLFDLFLFYFGVALFFVGLLVGLCLVAIFFWQKKISTKNTKLN

SEQ ID NO: 6795 - protein, 517 aa, Bombyx mandarina
MMIRRLTIAIAVCFCLGVDAYKILTVFPVPGRSHGILGDAVVRHLLEAGHEVTHITPFPKKDPPPNLVQIDVAANKAAFNEDYIDIKALMTKEFNLKDKNVLFSLMNNISSSTILNENVQRLLRDQSREQFDVIIAEWMFSDLYASFHAVLDCPLIWFSTIEPHWMVLRLIDEYPNPAYTSHFQDSFEVPFTFVERMSVLSSQLTWSLSLNTWVYDLEKYIYDNNIAPIIKKNGKPVPNYDEVRYNGSLLLGNSHVSLGDAIKVPINYKAIGGYHIGGNVKELPLDLQKIMNESKHGVIYFSMGSNLKSKDLPKEIKEGLLKMFSQLKQTVLWKFEENLSPLPENVHLLKWAPQQSILAHPNCILFITHGGLLSTTEAVHFGKPIIGIPVFADQFGNVNRAVQKGIARRVDLSFTMVRDLEEAVAEMINNSRYKEKIKELSLIYHDRPVTPGAELVHWVEHVVKTRGALHLRSPALHVPFYQKLYLDLLAIVLVTSIVLRFILKNIHCNVHFKDKIQ

SEQ ID NO: 6796 - protein, 484 aa, Pteropus alecto
MLINNILLLALQISILGNTLGGNVLIWPVEGSHWLNVKIIIDELIEKEHNVTVLVASGALFITPTYNSSLTYEVYKVAFGKEKIEDVIKGFVLTWMEYRPSPSTIWKFYQEIAKVIEDFHMVSREICDGVLKNQKLMENLKKSKFEVLLSDPVFPCGDIVALKLGIPFIYSLRFSPASTVEKHCGKIPYPPSYVPAILSELTDQMSFTDRIRNFISYHLQDYIFDTLWKSWDSYYSKALGRPTTLCETMGKAEIWLMRTYWDFEFPRPYLPNFEFVGGLHCKPAQPLPKILWRYKGKKPATLGANTRLYDWIPQNDLLGHPKAKAFITHGGTNGIYEAIYHGIPMVGIPMFADQPDNIAHMKAKGAAVEVNINTMTSADLLNALRTVIDEPSYKENAMRLSRIHHDQPVKPLDRAVFWIEFVMRHKGAKHLRPAAHNLTWFQYHSLDVIGFLLACVATAIFLVTKCCLFSCRKFGKTGKKKKRE

SEQ ID NO: 6797 - protein, 553 aa, Poecilia reticulata
  MOD_RES (315)..(315): Any amino acid
  MOD_RES (521)..(521): Any amino acid
MRKAYFLVLFLLSMAVEGRGAAGKVKDSAETPKLVKASKVKETDTIPEKSGSSSGFLGNLLVVPMDGSHWVGIKAIAQEMGRRGHRVTVVIPEINIRMGPGKYYDTITYPVPYDRDYMNFVMNSHKDILEKSAQPFIEKMKKLFSQIQKITNALHTTAESLLFNASLISHLAQQNFDAVLTDPMVPTGLIVAHKLGIPTINLLRGVPCSLDMKATGCPSPPSFVPRFFTGYTDRMNFKQRVINTLVALLEPLFCRLMFWHFDQIAYDFLEEKVSVAELFAESAIWLLRIDFTLEFPRPLMPNVVLVGGINCKVRXPLPEDLASWLSGEHGFVVFTLGTMVSELPDYITSTFLDAFSQIPQKVIWRYTGKFTSRIPDNVKIMKWVPQNDLLAHPGVRAFITHAGSHGTFEGLCHGVPMVLVPLAAEQPDNAQKIASRGAGIVLDITSVTTETLLKGLNEVINDPRYKENIQKLSALHTDRPIDPLDLSVFWTEFVMQHKGAKHLRPAFHDLYWFQYHSLDVXAVLATVLLVFVALTFKCLKLCLRKLSRKKKQE

SEQ ID NO: 6798 - protein, 520 aa, Spodoptera litura
MEKIKMFWLAVCLMLACAEASKILVVFPLPSRSHGNLGDGLVKHLLNAGHEVTYITPFPYKNAPPTLRTIDVSKNFDIMPMDIMSIKSIMDSPMFLHSIGFMLYMMIDLNRHTIQLEEVNKVLTDPKEEFDLVIAEWMFTDIPAGFASVFDCPLIWLSSVEVHWMILQLVDQPTNPAYTVDIMSTYTPPLNFWQSANELWTQVKINFLQYVWLDGVQERAFNELIHPLVLKRGRKPPTFDESRYNASLLLSNAYISTAASVALPQNHKFIGGYHIDDEVKPMSAELKKIMDNAKHGVVYFSMGSNFKSKDMPEELKKSLLQMFGTLKQTVLWKFEEKMDNLPSNVHILDWAPQQAILSHPNLAVFITHGGLLSTTESVHFGVPIIGIPVFADQFLNVVKAVNKGFAQRVDLSYTMADKLREAIIEVTSNKRYAEKAKELSFIHHDRPVKPGVELVHWVNHVINTRGAPHLRSPALHVPFYQKMYLDLAVFLVILLLVGRLLVKKAYRAVLSKSKAKKKTH

SEQ ID NO: 6799 - protein, 509 aa, Spodoptera exigua
MYGRVLILVSFFIAPVFTARILAVFPTPSYSHHSVFKTYIRALAERGHDVTVIKSTNKINYNELDDCYNITEIDASLSQNYFKKLMTQASVFRKRGLVADSTTVTAHNYVGMVRMISDQFNLPNVKHFLHKKQKFNIIITEAFMDYPLVFSHLFDNAPIIQISSGYAVAENFETMGAVSRHPLYYPNLWRNKFNKLNVLETINEIYEEIRLQNEFEKLAEEQNKMLKLQFGANTPTVQQLRNRVQMLFVNTHAIFDNNRPVPPSVQYLGALHLTNKKPRPIFGIVNEILSSASNGAIYVSFGSGISTEELEPEFIEMMLSTFEALPYTVLWKYDGHLSRMPENVFVQSWFDQYNLLHHANLKAFVTQGGVQSTDEAIDAIVPLLGMPMMGDQAFNTNKYTELGIGRFVDTVSVTKQELVEAIIDVVENPTYRQQLKKLRHLIRNQIISPLHKAVWYTEHVINSTSTDSMLKTRAANVNYSDYFMSYIFVPLALFTIMNHMRQILRTNLM

SEQ ID NO: 6800 - protein, 410 aa, Branchiostoma floridae
MEGFKEYCAHLLGDSSLMDRLRASQYSVVISETFFPCGAILSAQLDIPNIAFMRLDLHFLDEKATGVPLPLSYVPSILTDFTDDMTFVQRLQNVVLSTLVPVLARLGVSSYYDELVRKYIGEKETIQSVTSRAVLWLCRTDNVLDFPRPSMPNMVQVGGLNVGANNPLAEDVEAFVKSSGDDGVIVVSFGSFVETMSAERREVFAAAFARLRQKVVWRYVGEKPIGLGNNTKLMGWLPQNDLLGHPKTRAFITHAGSHGMYEALHHGVPMVCLPLFGDQPANAARVVARGLGVTLDFSTVTADQLYQAVLHVVTNTSYRETAARLSRLHRDQPQSPMERAVWWIEHVIKHGGLPHLRARAVELPWYQYYLLDVAVFLFAVCLAVLGTVWCSCLFICRKICRKSGGKLKSQ

SEQ ID NO: 6801 - protein, 506 aa, Apis cerana
MFNRKIILREEQKGQNECYKILAIISTPSYSHQIPYQPLWLELHARGHEIVLVTTNPIENINSPNFTQIDISVNYNSLRAIDFVKLRFEKVDWIETLEKYLLSLCSSFEVQVFNSTEIQKLYAPDSNIKFDVFLTEFLYMPAMYAFAYRFNASLIGLSSLGLLSINDFVLGGAVLPSHEYLWENEGNTGINLPFYKRLHNFVKTWRLLLHLNFNIFPKEQKLAEQYFGPLPPLIDIMKNVSMIFINEADVLTPGRPILPNIVRFSSFHVSENPDPLPKNLQKFLDDAKEGFIYFSLGSNARSSTIPKEIKRIFCNVFAKLPYKVIWKYEEDLPEKPKNVYIGKWLPQQSILAHPKIKLFIYQGGVQSSEETIRFAVPVLGFPILADQDYQVRRMEALGIGKYLEITTFTEDQLKNSIYEIINNKKYKERILIIRDQIKDTPYDTVKHLAWWTEYVVRTKGAPHLRSTLALEPWYQRFDMDIVVFLAIVTYILKKTVILSSTSARVS

SEQ ID NO: 6802 - protein, 505 aa, Trichoplax adhaerens
MVFHYFTSILVLMLISCYSGSLKASEIVAVSHHTYSHAIQLVQIGQELVERGHQFTLVVGSNVDFRHDHASTIRIRRYRTILNDSFVTDCIQQFVKGKQNLSSFCITMLNDDCECLLKDRQLLKEISNGTDILITDVTFRCSVIIEDMLKNIPYHVGFSASGFQDPIVSSLYRIPTPPSYIPMMILDFSTEMTFIQRLQNFFTYISADLLFDQIMDEGNQDLWMKYTKIPSLDRNYHIPLANILIMTTSFAIEYARPITPSVKVVGPIIPRQTSNNLTVDLYNFIYSTSSPEFIVISFGSHVPNFQLDIDYELLVLKLSKLPYRIIWKYSGQPLKNQPENVKIMSWIPQNDLLSNPNCKLFVTNAGMSSILEASYYGVPMLAIPLFGDQAGNAQRVQVAGIGKVLSLSEGTVNELLPSITNVIHDPIIKENSKRIASLMQYKTEKTISGIKEAANWIEYAQLHDNAKHLRVQAFDMPWYQRDSIDIWFSLVAIIIIFYIYFFYFE

SEQ ID NO: 6803 - protein, 404 aa, Panthera tigris
  MOD_RES (235)..(241): Any amino acid
MGVVNWHGNLKQVLVGAQHKLVIYGDDFKEKEISYQVIPWLPPEDYNKGLKNNFDFFIEEALGGRYTFGKFLKFMEQVGLQCSHFLRRSDIMDSLKNENFDLVIVENFDYCPFLVAEKLGKPFVSILSSSFGAIDFGLPNPLSYVPVLDSLLTDHMDFWGRVKNFLMFFDFTMKQRQIQSAYDNTIKEHFPEGSRPVLSHLLKKAELWFVNSDFALEFARPLLPNTVYVGGLMAXXXXXXXQEFENFIAKFGDSGFVLVALGSMVSTFQSQELLREMNSAFAHLSQGVIWKYKPSHWPKDVKLAANVKIVDWLPQNDLLAHPRIRLFVTHGGMNSIMEAIQHGVPMVGIPLFGDQTENLVRVEAKKFGVSIPLKQIKEETLAVKMKQVIEDKRYGTLWACGHLG

SEQ ID NO: 6804 - protein, 430 aa, Aethina tumida
MDYQSMLDPKLNSVCQNIGGSPNPILQSPNSVPANMAGTIIKRSSGYNNPPLVYSWRFNCPSVGVASMDAYFPYHYYMGNPTHPLVTPEWSTEIEDTDNMRLTDRINSAVTNVMIIILSHLLFNPLMEDLYHKHFGPNVPSLIDMTYNVDMLLIATNPIFHDVRPLNPHTVTIGSGIHITPPKPLPEDVKTFLDNAEQGVVYFSLGSNVKGNLMLEDTKKAIYKAFSELPYKFLIKVDWVNLTVPENVKVGRWLPQQDILRHPNIKLFITQGGLQSLQEAVTNAVPLVSIPFFGDQQMNTQKIVKRGFAVKLERTNITTESMKWAIQEVITNPKYKLKAIEMQDLMYDEPMTSLERAVWWIEYVIRHKGAPHFKSNATKLPLYQYFLLDVIGVVLVSLIVVNYILYKIIKLTLRVAFRLVKGKQLKKKKE

SEQ ID NO: 6805 - protein, 527 aa, Papilio polytes
MIRIFWIILLKVFLNKMVFPIKNVLFVVLCLIICADASKILVVFPFPAGSHCNLGDGYVRHLLNAGHEVTYITPFPKTNPNPNLRQISVADNVHAVNAQALNVQALMKHEVEMDQDLLFHMTVNVTKKTFENAAVQALLNDASERFDVVIAEWMFNEIYSGIAAVFNCPLIWSFPYEPNFVGLSLIDEASNPAYSANIQFSDIPPFTFGQRVFALWFQIMHRVKYFLFYQKIETDAYESIFKSIVEKRGRQLQPYNEFKYSAAMILGNSHVSLGQAVRLPQNYVPIAGYHIDDVKPLPEDLQQIMDNAKYGVIYFSLGSNLKSKDLPEHYKKNLLKMFGELKQTVIWKFEEALPKLPKNVHILQWAPQTSILAHPNCVLFITHGGLLSTTEAVHFSVPSIGIPVFFDQNFNVDQAVRRGISLKVMLSENCHIDLKNAIQEMLGNPKYREKIKELSFVYHHRPVPPGKLLVHWVEHVVRTNGAPHYRSTALLLSWYQKMYLDLLVLVLSVLFGTIYVIKMYTGRKMQK

SEQ ID NO: 6806 - protein, 527 aa, Habropoda laboriosa
MRSNISGLLFVACVLCAARYSESARILAVVPTASYSHQIPYRPLWISLSKRGHEVVLVTPNPIENYKAPNFTQINISQTYSILKAIDFVDLRFKGQTWFDFFDERLLDISNDFAESVLNNTDLRKLYAPDSNVTFDVVLAEFLFMPATYALAHRFNAPLIGLSSLGLVAANEHALGGLVLSSHEYRWEMEANTGSNLPFFKRVWNYVTLWRSVYIIYRDLFPKQQQIAEKYFGPLPSVLDMTKNISMIFVNEPNVLTPASPKLTNMLTFSSFHIDENPKPLPKDLQKFLDSAKDGAIYFSLGSNARSADLPKELQRMFCDVFAKLPYKVVWKYEEELVGKPDNVYAGKWLPQQTILTHPNVKLFIYQGGLQSTEETVHAGVPIIGFPVLADQDYQIGRMDALGLGKRLELLTVTKDEFESAIREIITDKKYKERVLYVQRVIKDTPYDLVDNLVWWTEYVIRTNGAPHLRTNLAWQPWYQRYDMDVVVFLTIIAFLIVSNMFNLIAKLIVYVYRRYQVSTGEKQKIS

SEQ ID NO: 6807 - protein, 510 aa, Capitella teleta
MSSNMSPLIFLFLLASSADAGKILLMPVNHGSHVNFFSLVGDVLQNDGHDVKILASAAQAKHATKHGISVISAGNVPKLLESQEATNMVFENTSFPIMQLVRIARLGREICEDVLSNEQLMKDLMDEDFDLILIDGLDPLRCMYVVPYRLGVKYITLTARHDPWSAKIPALPSLEGSQGGVVLGRGSSFVQRLKNTFMVLMTSIILPPSPVTDPDLITKYAPERPQTTFSQLFHDSEMWIINMETVCLDYPRLHAFHYQFISCLNCEPAKPLERKFADFADRATQGLIVVSFGSGIDRLPRLVIDKMLEAFSSLPQKVIMRYNGDITAPSNVMLSSWLPQNDLLGHKNTRLFITHAGNNGQQEALYHAVPMLSMTVFGDQQYNAERASDHGYGLTLNAKDFSEEELLWAIQEIISNPKYTNQIKQCSRIFHSMPKSQGTLLFWVNHILEFGGSHLKPTYMDMPLWRVLMLDIIAVLLLVAFVLSMCVCLSCKRLRMWCSPSPKKGKQKKH

SEQ ID NO: 6808 - protein, 446 aa, Loxodonta africana
MSTKWISALLLIQLSCYVSSGTCGKVLVWPTEYSHWINIKTILDELIQRGHEVTVLTSSASILIDPNTPSAIKFEVYPTSLTKDDFEFLFMKWIRTWTYDLPKDTFWTFFSQIQEIEWEFSDFIEKLCKDIVFNKKLMMKLQESRFDVVLADVIGPCGRPTTLYETMGKAEIWLIRTYWDFEFPRPLLPHFDFVGGLHCKPADPLPKEIEEFVQSSGKHGVVVFTLGSMVSNTTEERAHMIASALAQIPQKVLWRFDGKKPDTLGPNTRLYKWIPQNDLLGHPKTKAFITHGGTNGIYEAIYHGVPMVGIPLFADQPDNIARVKAKGAAVSLDMNTMTSADLLNALKTVINDPSYKENAVRLSAIHHDQPVKPLDRAIFWVEFVMRHKGAKHLRPASLSLTWYQYHSLDVIGFLLACVAIATFLVIRCCLFGYQMFYKAGKKKKRE

SEQ ID NO: 6809 - protein, 530 aa, Anopheles gambiae
MGETRSPLVPFWTVLLLAIGAGVHYAHGANILALMGVPSPSHHIWNRALVNALAARGHNLIVVSPDVERKPPPNVTYIHLEKTYDTIHEGATAIDFYEMGQSSILESMRIFYDYAISMCIGILGSEGYQTIMNYPRDTKFDLVLYDFTCGPCLLAVYDRFGQPPMVGVTGFNTPPYTTDLIGGHKYYAYVPYYTLDYDSSMNFYQRFYNAALHWIDYFYRNYIFLPETDRLVREHEKANDLPYLGTMDQKMMLMLVNSHHSVDFPEPIPQNMIQVGGLQIIPSKPLPADIDRFIRAGKKGSVLFSLGTNVLSKDLGPERIKAFLQAFQQMPAYNFLWKFETDLPYDLPPNVMMKKFLPQNDILAHPHVKGFMTHGGLLSTHEATWHGVPMIGIPVIADQYRNLAKSIRAGVAEKISLWDLTTEKIRNTVLKVLESPRYRDAMKVRSELFRDQSEHPLERGVWWVEWALRHPNAKTIQSPTLELGPWRSELYDVKACLVLAVLLVVYLLHKTGKALFAKASQPGKAKKKVH

SEQ ID NO: 6810 - protein, 523 aa, Zeugodacus cucurbitae
MKCLLPLKAVLLLCLITCRFEGLFGANILAIFPFSGRSQYICVENYLKALAARRHQVTSISAFPQQKPVQNFHDVPIIYEGTYFDDFLVDGNTPKVSKWEELNWGIEFLIEPTRKVLEHPEVQKWLANGVTFDLVIVEALQQDALYALAHHFNASLIGVSSFGTDIRIDELVGNSSPLSYVPSILSTFSDHMTFDERLESLYTHIVEWVHNHYVMIPLHQKLYTKYVNKPADDFETVRKNFSLLLLNQHFSLSIPRPYVTNAIEVGGWHIDRKPKALPAEMEAFINAGTNGTIYFSLGSNLHSKNLSKEKLAIILQVLGSLPYNILWKFEAPELHGKPKNVYINKWFPQADILAHPNVKLFITHGGLLSTIEAIHYAKPIVGMSIFYDQHINVARAQVKGFGLGVDFMNLNATQLRNTILTVLTNPKYAQRAQELSRRYHDQPLKPLDMAIYWTEYVLRHNGALYMRVAAHDLNVIKYHNLDVIAVLFGLPLLTFVFLVWVGCLLFKRLAEKLCDRVVKQKQY

SEQ ID NO: 6811 - protein, 628 aa, Symbiodinium microadriaticum
MSLLIKFQHRGVAALGRSTQFAHPKPGRGGARHGCRQHRARALHMDMPYLQEAQELYQRFSDAFQVESVEGPRSTVQQAEEVQTRKVYYRIPRVSLRVQGSEASPEPQRRWPKPQLTKLSPQTFALGLRIMAPMIQPMEQQITVEGPTIAIFNVAMIGHVNPTFALVQELRRRGCKVHYFLPPVAPIRAAAIESGAVVEGYLPEDPSDFVMEKCGIDEPLIHIVPEILEDDRAEFERSVWPLAQALLCGEHVIERCRQLGVSVVLYDPFLPLGLLAATKLGIQCASLVTYPGMGSLSGLMSSLEAEGRLERAAFIRRPYGKAIQEKFGVDLSCHLLTRRQFYTKTNFVTTCEDLIAELPALGEQNWADELRREFSFSAVGCLVSSSAPHVITARSDSFIPRVKSFGHSLPLAELSDQVAKGRRIIYAALGTMALSDRWSIDLGRISAANLPYGTTGKAFCQHVWKALLAAMEELGDDFFCVLSVGKQPDALDFLGSSEAEIFELVPSNVLIRGFVPQVEMLNNYASAFISHVGFNSLQESLMAGVPLVAIPQAVDQPANAFKVEQRGWGQAFFKPMETVTSTALAEALRRVCDESGGYRQAVQCARLELAGGAPRLAESVVSMALGGC

SEQ ID NO: 6812 - protein, 537 aa, Autographa nigrisigna
MFYFNMKITLKDIVLIISAIFLFILKTESAKILAVFPTPAYSHQSVFRVYIRALAERGHEIYVIKPSTRVSYTDPLADFELRGNITEIDATLSEDYFKRLVKESSVFRKRGLISDSNTVTAHNYLGLVRMISDQFDLPKVKQFIGRRDEYQFDLLVTEAYMDYPLVFSHLFNNLPVIQISSGYAVAENFETMGAVSRHPVYYPNMWRDKFRDLNVWETINEIYMEIRLQNEFSKLADEQDKMLKDQFGRNTPSVHQLRNRVEMLFVNTHAVFDNNRPVPPSVQYLGGLHLVEQKEPSYQFQNSHRFHLGGMVKEFLDNSTRGAIYVSFGSGIVTSDMDMEFLDMFLEVFAKLPYDVLWKYDGIVPISKLPLNVLTQAWFDQYQVLKHPNVKAFVTQGGVQSTDEAIEALVPMIGLPMMGDQAFNTNKYVELGIGRALNTNTVNTEQLIDAITDVAEDPHYRKHLLQLRNMIRHQMISPLQKAIWYTEHVINNKGRTWLKTKAANVSYSDYVMVYIFVPFVTISVMNHLRQLLRINLF

SEQ ID NO: 6813 - protein, 258 aa, Haemonchus contortus
MIRYVGGFAINDPQPLSKELDDLLNKRPATILFCMGSLAQSSEMPDQLKKVFIETFTSLPNITFIWKYEESDHSLFKNTPNIYTMKWVPQTDLLADQRLSLFITHGGVNSMLESMNYGKPMIVMPLFADQLMNAKSIQRRGLGIIVEKHLLTKEILTAAIQQVLNDKSIARQCSLVKSLLKDRPRQYREDILKYTRAIIEYGRLEHLQMISRNMNVFQYLCLDVVLFELCIVLIVLFSSVWLLRRLLSRMRAPKTKNE

SEQ ID NO: 6814 - protein, 525 aa, Neodiprion lecontei
MGRELVHLLIACLHFVYSSPQPAESYNVLLATMGGTKSHTVPFVALGTILKERGHNVTLFSAFTGPAANNALREFVPPVLEAYVGNYTAEWDLVGSRFRNELPLSPWDAMRYGWEACEALLQDETSLNSLRKPEGDPRARWHVAVLDGTYPECLLAILHKENVPTIMLNTVALYTGSITRQGSPSPWSITPYFGKAFTQDMNFIRRIVNVACLMTLEVMHWVMITGYLQPILRKQLGDDVPDVRDLIADVPLTFQNSHYTVADSLPHLQNVVNVACLHCRPATELSTELELFLRRGFIFVSMGSSVHAAGMPDALREIFIAAFSTLPYNVVWKWEGGKIENLPPNVRIAAWWPQQELLGHPNLKAFVSHGGLLSLHEAAFHGAPTLVLPVFCDHDGNAAQAEKQGYALLMDLASISATALREGILKVASPKSNPYRNAAIQKSILLKDLPIKPQDLATWWVEHVAKYRGAEHVKSTSRHMTTIRYYSIDVAAFYVSLVTILVYTLKKFTLRLVVAKGNIAKMKID

SEQ ID NO: 6815 - protein, 328 aa, Ancylostoma ceylanicum
MSFLERLYNVFINGSGFILANIYEYFEQSLFESKFPGFKNLHDLIKDKTDYMLMNTNEFTESTRPTLRSIQYVGGSATPDPQPLDEEFEWIVSRGAKGAILFSLGSLVKSSDMPVAVRKAFLDAFATFTDYVILWKDDTHVNSSYPNIYFRDWVPQVDLLADGRVKLFITHGGMNSMQESLLFGIPMITVPLFADQDSNAAVAAERGFSVNLSKFSVTKEKVIDAINKVLGKDGEESTYTQKVRQAARLLKGSPEEMRRAIKRLARISGTEPPLKHLKLDLDHLNNFQYYNIDIYLLLLSIVLVHLWICARVSMRIADFFTALKKKTD

SEQ ID NO: 6816 - protein, 274 aa, Bactrocera latifrons
MDRVLEQMVPAACSPISYETYKPEVGYWNRLGVIRNCMSRRKQFIKDNWGAQESVMRKHFSQFKGVNELNIGTLQAELTILLLNSHVPLLRPRPLLLNTVAAGGMHIRPPRELPWPLRRFLDESRAGVIYMNLGNEQLCTDVPKHIMQILLNTLGKRKERVVWTCHDHTALKNLHTNIMVQHAVPQADILAHPHVHIFLMNGDLLSTQEGIMRHVPMISVPIFRNEVRNAELTVQLGVGIHLNHNNLTETALNWALQTIKEDSTYQLTIRQVAA

SEQ ID NO: 6817 - protein, 521 aa, Aedes aegypti
MFRRLDFAVLINCLLLSLCPCNGARILGVLPSAGWSHYAIGEGIMKALSRAGHEVTVIGSNSWKQAPNNYRSIELKELMFDKQGSEPDLFQYRNDPYLKVLYLLYTMIGPSLSEVILTHPKVKTLMNSGEQFDVVIVECFVSDVLYGFAQHFNAPLVVFSPFGASLWANELIGTPYPFSQIPHTFLSYTDRMSFGERFINTLLWNVDSFYYRNIFLPRQEEMYKTYFPNAMQSLPQVMKNVSLALLNQHFSLSFPHPYAPNMIEIGGIQIDEPKPLPEDLQHILDNSKHGVIYFSMGSMLKGCRFPEEKRNAFISAFSKLNETVLWKYENTSLPNKPKNVFIRKWMPQSDVLAHPNVKLFITHGGLLGSTESLYHGKPMVGVPIYGDQRLNMARAEKAGYGTHIEYENLSEETISNAIRSVLDDPSFSSNAQLISERYRDKPMTPAQLAVYWIEYVVRHRGAPQLRSAILELSFIERNLIDVYSVMMLLVGTILASLCVALRKIMRFIGLLPKRIDKIKQQ

SEQ ID NO: 6818 - protein, 534 aa, Mesocricetus auratus
MASEKWVMTVFVVQLSCAAYGFCGKVLVWPSDMSHWLNQKAILDELVDRGHEVTVLKYSTLMMDQNRQSALHFENIPQSNGEKMAENQLNEIVNLAVNVIPKLPLWQGAAKLREFFLQLTSVFEDVCRSALYNQTFMNKLRDRKYDVLITDPVIPCGELMAEVLQVPFVNTLRFSMGYIMEKHCGQLPVPLSHVPVIMAELTDNMTFTERVKNMMLSLFFEFVLQQYDFAFWDKFYSETLGRPTTFCEIIGKAEIWLIRTYWDFEFPRPYLPNFEFVGGLHCKPAKPLPKEMEEFVQSSGEHGVVVFSLGSMIKNLTEDKANLIASALAQIPQKVLWRYSGKKPATLGSNTRLFNWIPQNDLLGHPKTKAFITHGGMNGIYEAIYHGIPMVGIPLFADQPDNIAHMKAKGAALNVNLNTMTSEDLLNALRAVINEPYYKENAMRLSRIHHEQPVKPLDKAVFWIEFVMRNKGAKHLRVAAHDLTWFQYHSLDVIGFLLLCVVTLAFIIIKCCLFTCRKFCMSEKKTRVNRKKKN

SEQ ID NO: 6819 - protein, 536 aa, Monodelphis domestica
MKARISMMSEKWVPALLLLQLCCFSCGSCGKILVWPMEYSHWLNLKAMLDGLIARGHEVTVLTPSATVLVDPNNSSALHFEVFPVQTNPEDLAFFFENWITIWSYEWSKLSLLEYGANMQEKFLHYSGIIKEHCESAVLNKELMKTLKKARYEVVLSDAMCPCAELIAEILQIPFVYSLRFTMGNTYEKYCGGLPSPPSYVPVPMTALTDRMTFMDRVKNMLFTLYFDFWFQNFDEKDWNQFYSDVLGRPTTLCETMGKAEMWLIRTYWDFEFPRPYLPNFEFVGGLHCKPAKPLPEEMEKFVQSSGDHGIVVFSLGSMVKNLTDEKSNVIAAALAQIPQKVLWRYKGKKPATLGPNTKTYDWIPQNDLLGHPKTKAFITHGGTNGIYEAIYHGIPMVGVPMFADQPDNIAHMKAKGAAVEVNFNKMTTADLLNALKTVINDPSYKENAMRLSRIHHDQPVKPLDRAVFWIEFVMRHKGAKHLRPAAHDLTWYQYHSLDVIGFLLACVATVVFIVAKSCLFCCRKFGKTGKKQKRA

SEQ ID NO: 6820 - protein, 484 aa, Echinops telfairi
MLNKIFLLLFLQLSILGTTHGGKILIWPVEGSHWLNIQIIIDELIKKEHNVTVLVASGALFITPTSKSSLTFEIYKVPFGKDRIEEVIKNFVLTWLTHRPSPATIWRFYQEMAVVIQDFHTVCREICDSVLQNPKLMERLKKGNFEVLISDPVFPCGDIIALKLGIPFMYSLRFSPASTVEKHCGKVPYPPSYVPAVLSELTDQMSFADRIRNFISYHLQDYMFDTLWSSWDSYYSKALGKPTTLCETMGKAEIWLIRTYWDFEFPRPYLPNFEFVGGLHCKPAKPLPKVLWRYKGQKPATLGANTRLYDWIPQNDLLGHPKTKAFITHGGTNGLYEAIYHGIPMVGVPMFADQPDNIAHMKAKGAAVDVNMNTMTSADLLNALKAVINDPSYKENAMRLSAIHHDQPVKPLDRAVFWIEFVMRHKGAKHLRPAAHDLTWLQYHSLDVIGFLLVCVATALFLVTKCCLFSCKKLGKRGKKKKRE

SEQ ID NO: 6821 - protein, 518 aa, Drosophila simulans
MSGWKAFCLLALLSLVDSSDSLRILGLFPHPAISHFKFFHPIMRGLAEAGHSVDVISPFEDKDPPQGYKDHLLPPSNLTDTISLEDFERPFNFLFHYIEFFILHNMGKEDCNTTLHSRALTKILKNPPGYYDVILLEQFNIDCAISVAHVLQAPVIGMSSCALMPWHYERFGAPLIPSYISALFQGQSQEMSFAGRLGNWITVHSLNLLYKMFTVPAGNALIRQRFGPGLPSTEDLVRNTSLMLVNQHFSLSGPKPLPPNVIEVGGVHISPPKPLPSDLQKILDNAPKGVILISWGSQLKASSLSAARRDGIVRAIGRLEQEVIWKYENDTLPNKPPNLHIRKWLPQRDILAHPNLKVFMSHGGLMGTTEAVSSAVPIVGVPIYGDQSLNIAALVQRGMALQLELKKLDENTVYEALTKALDPSFKARAKEVASAYNNRIQGPLETAIWWVEHVAETKGAPLIQPSAVHLPRFVYYSLDVYLVVALTLLLPVITFLGLIRMCKIREPKGDRKLKLKRK

SEQ ID NO: 6822 - protein, 534 aa, Caenorhabditis brenneri
MKFSIFILLILAELCSTYKVLVFNPAFGASHSNFLGKISDILIDAGHEVTMFIPVFVDGKKHLVGSKKVEKIVRLDQDPRVYQMHKEGATEELMRKKIWTMSSDISSMLGFVGNFSKSAAYLTEHMFQQTELLEQLRQEKFDLGITESLLLGAFALFDEIGIKSVINADSTLYMSGIKNALGEPAAIAYYPGLFSPVNDKMDFLGRIKNLFGYQFGMWFSTLKYDAEVAAFPKSYKGPREWKKQLDRVAFNFVNSNQYIDYASPTLPKTVFVGGMQVNTKKSGKATLSKEWDDVLGKQKTNVLVSFGSNAFSSDMPDKFKSSFLEVFASMPDTTFIWKYEEENATLADHLPNVKLTTWMPQNDILADDRLTLFITHGGLGSSVELAYQGKPAVVIPLMADQPRNAHMLTRHGGALQLDKELLEKPEEIRKAIQTVLTNPDYKKNAERLAKILEDQPQKPKDVVLKHCDFAVQFGALETLNSEGRHLNTFQYYSLDIALAFIAVLLIVLFVLHLIIKFVFRQLKRIFLSPKKKLD

SEQ ID NO: 6823 - protein, 531 aa, Athalia rosae
MLRHSLVLIVICLIGGIIRVGDGYRILGIFPAPSISHQVVFRALMIGLKEAGHEVVVITSNPMNDPTLKNYTEIDVSFTYKDFKVNHFENRANGIHWIDWFGTGHDVFVHMTDGIFSCPQVKKLYAPNSNEKFDLVIVEMHYWPGLFTLAHRFDAPLIGISSLDIPLNAHYAIGNPILSADIMNWELDFMVSGELSFWRRLQAFFTTWRHLYWYRNEYLTIQQGIAEKHLGNGIPHIAEVENNVSLVLINCQFPITFARPYVPNVIMMGGLHLAKQDQELPKDLKKFMDDATDGFVYMSLGTNAKSALMPNQTLDAIKSAFSRLPYKVLWKYEDDFLPGKPENVFTMKWLPQQAVLAHPNLKVFVYQGGLQSTEEAITNAVPVIGLPVLADQDSNVDKMVQLGTGKKLEITKLDADEMLQAITDVASDKSYKQKMIDTRTLMNDKSHNALENAIWWVEYVIRYKGAPHLHSTAADLPWYKRQDMDMIAFVTAAFVLILNLALFISYQLWKGTMFRNVKPAEEKIRKRKKIN

SEQ ID NO: 6824 - protein, 528 aa, Apteryx mantelli
MWRYQINAGLVLLLSFWSLAEAGKLLVVPQDGSHWLSMRVVVEKLWERGHDIVAIIPEASLLMKSSENFTIKTYSVPYTQESLDRYYHSIGKNCFLNPPLLEKITILLKNLSEMTTMFSSTCRHLLYDEELMKYLQDSNFDAIMMDPVLPCGPIIAEFLSLPSVYFMRGLPCGLDYKAAQCPNPPSYVPRLFTSSSDHMTFTERVKNLLIGFSEHLLCYLLYSKYENLASEFLHRDVTVLELFSTASVWLMRYDFVFEYPRPIMPNMVYVGGINCKQKKPLPKEFEAIVNASGEHGIVVFSLGSMVSEIPMKKAIEITEALGSVPQTVLWRYTGEVPPNLPKNIKLVKWLPQNDLLAHPKTRAFITHGGSHGVYEAICNAVPMVLMPLFGDQMDNAKRIETRGAGLTLNILEMTSKDISDALHAVINDKKYKENIKRLSDLHLDRPIHPLDLAVHWVEFVMRHKGAPHLRPAAHELNWIQYHSLDVIAFLLAVVLLSMFISLKCCLFCCRRCFRKKGRASKPTKSKSH

SEQ ID NO: 6825 - protein, 554 aa, Branchiostoma floridae
MFATVVPVLRYMIILTQKTSLLLLLVLSTSMSTGFHLFLAVVAILSQHVQAADILVATSTYNSPWMDVAKIAEALASRGHVVTVLAHASQKNDLMRKWPTLQYETFGDPEKPPSVKEFSKTVPQKLAFSSSGMLGLLTFGSTLSSALLDLGEEMLSDNQLLTKLKNSHYDVVLTYAGPSCGPLVAQYLDLPLVSTMRSFPTGQDIRATGVPNPLAYVPTVTSELSDRMTFLQRLKNVLVYFAATTMGQLVVDKSYDDLAKRTIGDSFTMSAALARTDVWLYQSDLMFDFPKPMMPNMVSIAGHMAEDVKPLSEELEKFVQSSGDDGVVLVTFGSLVAAMPADIADMLAAAFARLPQKVVWRYAGTPPPSLGPNTKTMEWVPQIDLLAHPKTKAFVSHCGYNGVAEAMYHGVPLVGMPLFAEQFDNIARMVARGMAVSLDIHTVTSEEVYRAITTVISDPSFKEKANQISTHLRDQPQSPMERAVWWIEHVIKHGGLPHLRSRAPELPFYQYYLLDVIALIVAVISAVLLSCWKCCSFACNMCKKGTTITKKKVN

SEQ ID NO: 6826 - protein, 534 aa, Callorhinchus milii
MQPGGTFKIMELTSLLAVFLFLPKASGDNVLIWPVEGSHWINLRPIIDRLIERGHNVTVPVPMGTLFINYTKPSPIKFIVFEASFTSHDIESIIQNFVDFWMYKYSHSSHWEIYQHIAAMKTNVTNWNRHVCDGILKNSKLMHNLEQSNFKVLLSDPVSYCGDLVALKLGIPFIYTLRFSLASAMERLCGQLPAPPSYVPAVMSELSEKMNFTERTKNVLYLLMYDLMSIWFWNAWDLYYSEVLGEPTTFCETMGKADIWLIRTYWDFDYPRPFLPNFVFVGGIHCRPAKSLPQEMEEFVQSSGEHGIVVFTLGSMIKNLTAERADVIAAALGQIPQKVLWRYAGEKPKTLAPNTKLYDWLPQNDLLGHPKTRAFITHGGTNGIYEAIYHAVPLIGIPIFADQPDNMSHMKEKGMAVVLNFNTMTTLDLVDALNTVINDPRYKENAIRLSSIQHDQPMTPLDTAVFWIEFVMRHKGAKHLRPASHSLTWYQYHSLDVIAFLCFCLAVALYIPIKCCMYCFRRCRSKLKRKGKKD

SEQ ID NO: 6827 - protein, 526 aa, Drosophila virilis
MSHLSNKTSFIGLALLCLLSSVAAYNYLLVLPTSARSHYNVGSALAKGLAAAGHQVTLVSPFALKKPIKNINDMPLPNVLKAMGGDIDSLLKKSEQPIIQQIIGFYDMGLRITEALLKEPLVVQLRQSNQTFDAVISEVFLNEAQFGLAEHFKAPLIGLGTFGAISWNTDLVGSPSPPSYVPHALLKFSDHMTLTERVINLAFLSYEHLFMKLYYLPKQEHIYTKYFPQNKQDFYDMRKNTALVLLNQHVSLSFPRPYSPNMIEVGGMHINRKRQPLPQDIEEFIKGATHGVIYFSMGSNLKSKDLPQEKRLALIETFSKLKQRVLWKFEEPNLPGKPENVFISDWFPQDDILAHENVILFITHGGLLSTTESIYHGKPFVGIPIFGDQFLNMARAEQNGYGRTVVYEELTAERLTKAIQQLVQDPHAKQLVEGMSARYKDQPQLPLERAVYWVEHVTRHKGATYLRSASQDLNFVQYHNLDAILILYGGILFVFYCLLLLIRRVWRALQNIFMGRQQKEPKLKRN

SEQ ID NO: 6828 - protein, 421 aa, Daphnia pulex
MLNGTADGQQQEERYDLLVIEGVFNDCALLLAKALDLPFVYFNCMSPTPWLLDAVGSPLALDHFPHPGFSYTDQMSLWQRAVNALSGVMIVYFHRWVVMPTVDRVAANILGPGRNLTPVWDIEDRYLSLLMTNSHFSINYQFPMLPAVVQIGGLYCAPPKPLPQELESFVEASGDDGFILVSFGSIVKGSQVPDGIRFLFLSTFARLSQRVIFKWEDQPGENVSIPSNVKLLPWMPQQDLLGHPKIRLFINHGGLNSKQEAVYHGVPFIALPLFADQPINAQKAQDDGYAIRLDWDTLTEEILYDAIQRILTDPRYALRMKEVSALSRDEMTSALDRAVYWIEYVIRHGGAPHLRSASRQLSLHQRGFIDVMLVVVSIAFLVAYVAICMCRRAFLLLALAARKQQHDTPTRRMMGSAKKVD

SEQ ID NO: 6829 - protein, 522 aa, Ceratitis capitata
MLLRSIPGLLLLALISFSAHQRTDCAKILAIFPFPGPSQYICVQAYLKALAGRGHEVTVVSAYPQKKPLPNFRDISLEEVLNGYEETIVDVITQERNKWQELNLYYDFFTGGTLSVLKSANVQKLLQSDEHFDLVIVEALQMDAVYAFAHHYKAPIIGISTYGTDPTIDELVGNTSPISYIPLPLSELSDRMSFWQRLENLWHHLLHQLHMHFIYLPNQVAIYKEYFPNGTADILALRKSFSLVLLNQHFSISFPRPYVPNAIEVAGMHISQKPNQLPAVMEGFINASKAGAIFFSLGSNVKSKNLSKEKIDIILRVFASLPYNVLWKFEATDLPNKPQNVYIDKWFPQSDVLAHPNVKLFISHAGLLSTTEAIHHAKPLVGMPVFFDQFLNMKRIKHAGIGVSVNYKSFTYDELRGAILEVLDQPKYTQNIQQMSQLYHDRPMKPLDKAIFWTEYVLRHEGAAHMRVAAQGLNFIQYHSLDTIAVFIVGVVLAVILPVWAIYGIVSGMVMRDSGGAKLKHS

SEQ ID NO: 6830 - protein, 495 aa, Danaus plexippus
MVFPVPGKSHSILGEGYVRHLLAAGHEVTYLTPIPIKNPPDRLRQIDVSENIKYMSEELFDVKKYMYKEVNLVHLELTELFDNLCYNTFKIDSVQRFMRDKDVDFDVVIVEWLYSELGVGFSSVFNCPLVWSSSLDVHTEVLGLIDGYTNPAYTKHFFSTDYSFTFWDRVNELWRVSRLLLYKWWHIDENDKMFREIFGPAAEERGIKLPHFNDVRYNASLMLGNSHIVIGDAIALPQNYLHIGGYHIKNVLEPLPKDLQQIMDKAKNGVIYFSLGSTLQGSKIPSNVKRKFLDMFGELSQNVIWKLDGKITDLPKNVHIVDWAPQQSILAHPNCVLFITHGGLLSTLETIKYGVPIIGIPFFADQFLNVNKVVAKGFGRRVDISENTPEELRFAIREVLGNTSYRTRVKELSSLFIADSDPGQRLVQGVELVVRTNGAPHLRSVALRVPFYQKLYLDVLLLVIAIVFGLPLVIYYTCKHLLLDGTKSNLNKKRN

SEQ ID NO: 6831 - protein, 717 aa, Trichuris suis
MHTSFHMPVHFLLLLLRLCSSQSKTIGLFMNTGPYSHDAMMQHIADDLYDKRYKVFLLQIRVFNFNMTLPKSKYVHPTLRYDYSGPETLAVMQEAQAQIWHGPVPLGGGTVNLKGVYAFQKLYEVQSAACQAALKSESYLSKIKAAHLDFIVIDYVLNECALGISAILKIPRVYLSNYPLIEVYSNTFGVPSNPSYVPAVLSPTSSRMTFVQRLQNVLIHTATIFIRASLIWRSQKLLHSVGHDAELRGEERKAIFYGTPLEFLLDGPRPLSNSVKYLGCLRCSRGDEIRTSQSQSWLPDKNMIIASFGTCASATRLPKQVLNSFITAFSQLKQYKVLLQMPGIEIHNSTWPSNVVAVQWIPLLDLLRSPSVKLLISHGGMSTTVEAVNNAVPMLGIPLQGDQMYNVGRLVEKGVADVLPISGLTAELLSKKLRRMLPITANDQTLNLKQKRAIKNYRGVVNYEEDLECESLEVFLRFKNEPFQKQDNRHPDLVLLPEYRQALSTFIAKIPKILVQQMTPGLIKCPAGLPQNSRVKRTLNGLNLWACLALLWMCVRLDIFFQNKAVSSQLKRCSGRDPFSSVTFLNCSGNVDRANTSTIAASPVLFKFFLLEYVLGQHVTQAVDKRFNSRVNMERRKIVLLKKMLSTYQTFERQKMKKNMTTAPAFWIDWAARHFSNQEKREAFLVLKYTDQFFSYFSFDVLFVSQLIFIIMFLLAV

SEQ ID NO: 6832 - protein, 534 aa, Drosophila grimshawi
MKAFAALLVLLICNNWQQLHGARILCLIATPEHNNPSWTQPFFEALAERGHLLTVVSTLADPSIPGITHIPVSNDYDVIKKHYVNEMGYYNNYWDIKQVLIWYEALLGTCQSAAEIDLVKMLEKVKHKYDLIIYDATYSMECLLSKFPKFRKVPVLALSGGKLTTDLMHLVQAENTINPATIPHFISHLPREMSHWQRIQNHVLYLTESFIRWAVVKPVLNGIHKHEYASPEVQLVLLNTHPVLDHVQNIPPNVIEVGGLHIRAESEPLSFSTQEFLERSSEGIIYINLPHIDLMYGVGLRAIENMVREYRQFGFLWNVNNVKDPTLSKNFHNLRTINVRDNMQQNILAQSNIKAFLTHGDNFGLQEAIYNAVPVIVLPLLMDQFNNAQRVKERDLGIQISVGDFSVDSLSEALKQIVRDKVYSKALHQAQFNFRTRQVKPVDQAVWYAEQLIGQPKLFEHLSVPKSLEYGYFITQSLEVLVYPLLFIIIFIINFILLIWNCKSGKKKTKQHQIAKKLKRKMRSDGTENELKKD

SEQ ID NO: 6833 - protein, 566 aa, Euproctis pseudoconspersa
MLIIFVLPHIKRDAVPLTSFDFSRATRCNLWNKQFNMDLKILTLVVWAWSLAMRRNVSAARILAVFPTPSYSHQSVFKVYVEALAERGHSIVVIKPKLSQLDRDKHAHDNITVVDATLSERYLEQLFGESPIYRKRGIIADSSTVTARNYMNLAQMISRQLELPNVKKFIAANSVITGGSTISHSTFDVLITEAFMDYSLVLSHLFGNLPVIQISSGHGLAENFETMGAVSRHPIYYPNMWRFKFGDLHLYELINEIYTELRLRSEFDLLAQKQSVLMKTQFGADTPDVNQLRNNVQLLFVNVHPVVDNNRPVPPSVQYLGGLHMHGARIRKLNDYVNEVLDNSTMGLVYVSFGTSVQANNIDNEFMDVLLDCFQRLPYNVVWKFDATTTRRLMPSNVYTQTWFDQYSLLNHKNVKAFVTQGGIQSIDEAIEALVPMVGLPVMGDQAFNVNRYAELGIMRALDTATVNANQLSRTIIDVVTDIKYRNNLRNLRHNIREQIVNPVHKAVWYTEHVIESKKYNSYLLKTKAANVNYSDYLMSQLYVPLITITIMNYLQQAVRTTFFSY

SEQ ID NO: 6834 - protein, 530 aa, Mustela putorius
MVSKKWISAIVLLQLCCASCGFCGKVLVWPCDMSHWLNMRIILEKLTERGHEVTVLVSPESFIIDYSKSSTLKFEVISMPYNKEEAEENLNAFLDMAANVMPTLSQWQSAIKLQEFFVQITGKLKLICESVVYNNSFMKKLQETNYDVMVIDPELPCGELIAELLKVPFVYTLKFSIGDTVQQYCGKLPTPLSYVPVSMAGLTDRMTFLQRVKNIMFSIFINFWIHPLDTQVWDQFYSEALGRPTTLCEIMGKAEIWLIRTYWDFEFPRPYLPNFEFVGGLHCKPAKPLPKEMEEFVQSSGEDGIVVFSLGSMVKNLTDEKANLIASALAQIPQKVLWRYKGKKPATLGDNTRLYDWIPQNDLLGHPKTKAFITHGGTNGIYEAIYHGIPMVGVPMFADQPDNIAHMKAKGAAVEVDISTMTSEDLLNALRTVINEPSYKENATRLSRIHHDQPVKPLDRAVFWIEFVMRHKGAKHLRPAAHNLTWFQYHSLDVIGFLLACVAAAIFLVTKCCLFSYQKFGKTGKKKKRE

SEQ ID NO: 6835 - protein, 464 aa, Branchiostoma floridae
MPFLYSHWMVEASIGQKLVDKGHTVTVVVEEDIVEKRRKQRPDFTFETFQDDGFGSRLRQFQDDSFGMSESISAYDELRLYMKAIEGANKHCEHLLEKGGQDSDLLRKLKTAHYSVVISDPVLRCGTIVAANLGIPHVANCPDDGTFIDKMAAGVPLPLAYVPPVKLELTDRMTFLQRVENTCFFGFSTITDTVLGFPRPFMPNMVQVGGLTVRAGVPLSEDLEDFMQSSGNDGVIVVSFGSIVKTMSKEKREMFAAVFARLRQKVVWRYPESMGEKPPGLGNNTKLISWLPQNDLLAHSKTRAFVNHAGLNGVYESLYHGVPMVCFPLFGDHPGNAARVVARGLGISLDFSTVTSDQLYKAVLHVLTNSSYRETAARLSRLHRDQPQSPMELAVWWIEHVIKHGGLPHLRARAMELPWYQYYLLDVAAFLFGICSAVLGTLWYSCSFVCRKVCCKRGGKIKSQ

SEQ ID NO: 6836 - protein, 540 aa, Bactrocera oleae
  MOD_RES (137)..(137): Any amino acid
  MOD_RES (333)..(333): Any amino acid
MKYWSDDRSLIAIVIAAILVISTGMQPVSGANILGVLLSPSPSHLIVHMSIMKTLAERGHNITVVSSLKPKVNHPKIHNIIIEPTEARQKEVNDELYDLGMKKQNPIVMMMKLLRADSIMVTLQLDVVKNKKFQSIXKNKYDLVIMGYFMNNFQFIVPAKLNCPMILSWTGQPMEMVNDLVGVPHEVSYVPSVFTPHKNGEIMSFGLRLLNFVSSGLLRFATNIMDISFEAYYKELAADDTTLRTYSQMKKNVSIIFCNSHFSGGPIRPMVPGMVEIGGIQIKEKPAPLPKIIDDFLNASKKNGAVLFSLGSNMKSSSIQPETVNIIYKVLQXEHNVIWKWENLENTPGNASNILYQKWLPQDDILAHPNLKLFITHAGKGGMVEAIYHSVPMVAIPIFAEQPTNAAKIVSSGYGVLVDILNLEENKFRDAILEVLHNPIYRSNVRRFSELYRNRPLTAGETVNFWVKYVIRHHGAVHMQSPLIHLNFVQSNSLDVILAILITLYLLWKLLKFICKLLYKLVRLAIGKQNAALSNKSKKE

SEQ ID NO: 6837 - protein, 512 aa, Strigamia maritima
MKVPYLFLTIFLCSEYIEGYKVLYLFPFASKSHKNIFDALITELARRDHEVTVISELSFSQPVKNVKEIIIKKSIDFQSADIQREVFGTIGYHPIFMTFAFPMFTLPICKSFFQNSDVKKLLKKGKQFDMVIVSGFLNECALATAPLLGKYIISQSPGFLIPWNGAFVPQPPSYVPHLSLSYTSEMSFFQRLNNLFTSVSLNLVHDYYIIPTFQSEIAKHIPENPSILEARNLISLHIDSADPVLTSPRPSMPNIVSVGGIHCKKAKPLPQELEDFVQSSGDNGFIYFSLGSNAQSRFLPEKVKTSLLAAFSKLKQKVIWKYEEELKNAPSNVKVIKWAPQQDLLGHPKIKGFITHGGLLSLQETVYNAVPVVAVPILGDQHSNIARVEELKIGYKVDFNNISEVSIFEAVNEILKESYKENMMKYSAIFHDRYQQPLEQAVFWVEYVIKNDCADCLKSVGEELNFLQYFLIDVIAFISIILLFVVFGLIFLVKLVMKIANKSKLVVEKKQQ

SEQ ID NO: 6838 - protein, 277 aa, Oesophagostomum dentatum
MLMNSNEFTESTRPTLRSIQYVGGATIPEPEPLDEDFDWILSRGSKGAILFSLGSLVKPSDMPLAFREAFVDAFRAFPDYSVLWKDDIEMNFTYPNIHFREWVPQVDLLADGRVKLFITHCGMNSMQESLLFGVPMVTIPLFADQDSNAAVAAERGYSVNLNKLSITREKIIDAINAVLGKPGEESTYTQKARQAARLLKGSPKEMRRTIKKLARISGTEPPLKHLKLDLDHLNNLQYYNIDVYLVPFCILFVYLWFCINIVMRVSDYFRASKKKTD

SEQ ID NO: 6839 - protein, 741 aa, Chinchilla lanigera
MRLIMVSNILLWSLQISLLGTTLAGNILIWPMEGSHWLNVKIIIDELIKREHNVTVLVASGALFITPTSHSSLTFEIYKVSFGKERIQGVIKDFVLTWLENRPSPSTIWRFYQEMAKVIKDFHMVSREMCDGVLKNEKLMEKLKKGKFEVLLSDPVFPCGDIVALKLGIPFIYSLRFSPASNVEKHCGKVPYPPSYVPAILSELTDQMTFADRVRNFISYHLQDYMFETLWKPWDSYYSKELDGSHWLNIKVILEELTQRNHSVTVLTSSTTLFISSSPDLLVDFEEIPVSVNKSYLESLIEHMIIMWMDHKPTPLTLWAFYKELGKLLEAFFLINVQLCDRVINNLTLMARLQRGGFDVLVADPVTLCSELLALKLGIPFVYTLRFSPASTVERHCGKIPAPVSYVPAALSELTDRMTFGERVKNIFSYFLQDYIFHSHWREWDSYYSKTLGRPTTLCETMSKAEIWLIRTYWDFEFPRPYLPNFEFVGGLHCKPAKPLPPEMEEFVQSSGEDGIVVFSLGSMVKNLTEEKANLIASALAQIPQKVLWRYKGKEPATLGPNTRLLDWIPQNDLLGHPKTKAFITHGGTNGIYEAIYHGVPMVGVPMFADQPDNIAHMKAKGAAVEVNMNTMTSADLLGALRAVINDPSYKENAMRLSRIHHDQPVKPLDRAVFWIEFVMRHKGAKHLRVAAHDLSWFQYHSLDVIGFLLACLATAMLLVTKCCLFSYHTFMKAGRKMKRE

SEQ ID NO: 6840 - protein, 522 aa, Drosophila grimshawi
MYRICSLLFVLFTGQALGADILMATMGGTKSHKIPFWELAKGLINRGHNITFLSGFPADFHIDGLHEVSPASLVEYISNYTNWDLLGARMNGEMPIKPWDGLRFAFESCEAMLSDPDTMDLANRTFELAILDGAFPECLLGLIYQHRTPFMYVNTVGFYMASLSRAGNPASYAVTPNFYSRLTDTMSLYERALNTGMQIGQNILHNYVMRRTHRILRDHLGSHIPHPYDMSRNVSFILQNGHAVVSYPRPFLPNVAEVACIHCKPARPLPKDLDDFISASGASGFIYVSMGSSVKAANMPESLRRMLVKTFARLPYNVLWKYEGNEADMQDLTPNVKLSRWLPQQDILGHSQLRAFVTHGGLLSMFETVYHGVPVVTMPVFCDHDVNSAKAEVDGYAIKLDLETLSTNQLYKAIMKVIHDPRYRSAARYRQNLLLDQRSTALETSIYWTEYVLRHNGAYHLQSPARDLSWWQYYLLDVVALYLVALCALVLILKRLDIRSDKTRSQHFPNILPATKKKSKKL

SEQ ID NO: 6841 - protein, 433 aa, Tribolium castaneum
MNRERKKQLLSLNDHSVFHTVHFLTNMGYAVTEEFYRNENVQKLLKSQEHFDLIILAQFVNEGLVGLAHHFNAPFVLMSSMPLFAWSKFFLTHPAPSSYVPNLLTPYSGHMNFWQRLCNSIYDVYSILYHQWVILPKHNQLIKKHIRGEPDVHNLLNNASLLLVNSHVSANEPTVQIPNVVEMGGMHLEEPKKLPEDLQKFLDGSKDGVIVFSMGSNLKSSDLPRDKRDAILRAFSKLKQNVLWKWEEEELPGQPKNVKLMKWMPQTDILAHPNVKAFVTHGGLLSTMESIYRGVPTIGIPIFSDQKTNMEIAVSYGYALLLPLQELTEEKLSSALDEILSNPKYRENVLKRSKIMKDRPIKPLDNAIYWIEYVIRHQGAPHLRYPGMDLNWFQRNLLDVGAFATIALLLILALIRLIVKLIFNKKVTKEKIN

SEQ ID NO: 6842 - protein, 250 aa, Papilio polytes
MILIILGENLIQEYFDLKNIMDNAKHGVIYFSLGSNLKSKDFPERMLKDLLKLFGNLQQTVVWKFEESLPNKPANVHILKWAPQQSILGFSAHPNCILFITHGGMLSVTEAVHFSVPFVGLPVFYDQNFNVAKSVQRGIAKKVALSMNLAEDLRDAIQEMLNNNTYNEAMKETSFVYHDRVPPGKELVHWIEHVVRTNGASHYRSTALLLSWYQKMYLDFIIMIFGFVCLFVYLIKYLCNKSKVQKIKSS

SEQ ID NO: 6843 - protein, 431 aa, Camponotus floridanus
MGSTAKIIFCMMCSSCIITSLLEAARILAIISIPSYSHQIGYQPLWTALSRRGHKVVVLTTNPVNEPNITNLTEVDFHYNYRLLKDLNHVKMMEHDTWINVERNLLFNVGNELTEDIYKHPEVRKMYAPDSDQKFDAVIIEVIKTPGLYALAHRFNAPLIGISSVGLYSHIYYLLGAPVLPSHPSNWEMKEVTGFNLSLWQRLKNVIEQWYHIYCVLNHFFPQQQAIAEKYLGKNIPNIVDMERNISIIFHHQQEALSFIRPKTPNVIVFGNSHVSKNTSALPKNLNKFLVDAPNGFIYMSLGTNAHMSHFSKHVLKAFCDIFASLSTKVVWKLDEELTNKSDNIYTAKWLPQQSLLAHPKIRLFIYQGGLQSTEEAVYNAVPLIGLPILADQYTNVNKMVSLGVAKYLNYRNISTEIVNSSITDLLNDKR

SEQ ID NO: 6844 - protein, 522 aa, Anopheles gambiae
MLKWTAVAVALLAALYAAKTPVEGAKILAVFPTSSRSHYIVGSALMKELARRGHEVSVINPFPQKKPLKNYRDIDVSGSEELVKDLVPNMFEMADQSVWESITMTYKFGQMLANYTLMHPNVAKLIKSNEKFDLIIMESFLNDAHLGFAHHFKAPCVALSTFGASRWTNDMVGTPSPLSYVPHPFLSFTDRMSFVQRIGNTLMTLMDTVLGQVLDLPVQSAMYEAAFPDPKPPLEELRRHAVSLVLLNNHFSLSYPRPYVPNMVEVGGMHVNRKPNPLPEDIQRVLDGAEHGVIYFSMGSNIQSSQLPVAKREAILRVFSRLKQTVLWKWEDETLPNRPANVIVKAWWPQDDVLAHPNVRLFITHGGLLSTTESLYHGVPVIGIPVFGDQYLNMAKAERTGYGLLLPYQDISEERLAHAIDRILREPSFKTVAQSISARYRDQPQEPLELAAFWVEYVIRHGGAEHLKSAGQELGFLQYHGVDVLVTIVGGPILFVYLLSKLLCGGRSKKNASTVNAKKKRN

SEQ ID NO: 6845 - protein, 1002 aa, Caenorhabditis briggsae
MRVLLYCFAVILLECFIVGSAKILVYCPSISKSHVILCAKYADVLHNAAHDTVLFIPSYSSALNNFDGAKHANVWRLHNVTHAYDAKLDSLANVMEDSHIGFLDRLTYDVDFWMEMCEDLARQHHRMQHLIDYGFDLALFNDIDPCNSAIIRSLNISKTVLLSSEAIMDKIAWDLGLPMLPSYVPSIEENPNHDRMNFLERMSNAYKYFQSLVVHYLQERRVLHIFRKYIADDFPPIMEMLKNVSLVFVNTDETFDIARSYSQKFVYVGMLGAENSANETLPKKLDEYFSKGKAGSIFVSFGTVTPFRALTQQVQQSVYNAVQKLPHYHFVIKTALDDISTAELFADVPNVDLVDWVPQSAILNHPNLKVFVSHGGMNSVLETMYHGIPMVIMPVFTDQFRNGKNVERRGAGKMVLRHLVVNETFFDVINEVLTDESYTTCAKRVSKLMKSRPFTSEERVTKWVDYVLDHETSEHFNLEINNLTLIQQYYIDILFVYTILPLFSLAKILTYCPSISKSHVLVCAKYADALHNAGHDSVLFIPTYAEALNTFDGAKHAKVWRMLNVTAAYDTKFDSYASIMEDTHIGFLDRMLNDVYFWMDMCEDILKQFHRLQYLADYKFDIGIFNDVDPCNPAIVKALNISKTILLSTEPLMDKIAWDLGLPILPSYVPSMEENPNHDRMGFFERMSNAYKYFQSIVIHYLQDWKMANLFRNYISPDFPSIMEIIRNVSVVFVNTDEMFDITRSYSQKFVFVGMLEAEKSKNETLPEKLNEYFSKGKLGSVFVSFGTVTPFRVLPERIQLSVFNAIQKLPDYHFVVKTVIDDTTTAELFAGVPNVDLVNWVPQTAILNHPNLKMFVSHGGMNSVLETMHHGIPMVIMPVFTDQFRNGKNVERRGAGKMVLRQTVANETFYETMNEVLTDERYTKGAKRTSQLMKNRPFTPEERVSKWVDFIMTHDTSEQFHLESNSFTFIEHNQLDIFFVFILLPLITFFVYRRFLKRKVN

SEQ ID NO: 6846 - protein, 524 aa, Spodoptera litura
MALAIFLLLGLLLSSSCEAYKALVVFGMPSTSHFHLGNGVVRNLLKDGHEVTYITPIEYKNAQPNLRQIDVSSNFDVLPTYQINLKHLMEAPTPSGHRKFVKLMLINLVVKTLEHENVQRLLNDTNEHFDVVIVEHMMADLSASYATIFDCPLIWVSPVEVNALSIGLIDVLPNPAYTTDAMALYTAPFTFLERLEELWMRISDSYNDYMVYEPTEEAEYQRLIVPQLQKRGRQAPPYSEVRYNATLVLGNSHVSTGIALGLPQNYKSIGGYHIEEEVKPLPEDLEKIMMNSKNGVIYFSMGSNLKSKDWPEEIKRDLLKLFGELKQTVIWKFEEELPNVPKNVHILKWAPQPSILAHPKCVLFITHGGLLSTTETIHYGVPTIAIPVFGDQFINVKKAVARGYALEVKLSHSIAAELKVAIQEMLNNPKYRQRVKELSYIYHDRPVKPGAELRHWVQHVVNTRGAPHLRSPALQVPLYQRLYLDLAALLLVVILVLKVLLRNLYHRIRPKKTNVNIKKKDKKN

SEQ ID NO: 6847 - protein, 538 aa, Ooceraea biroi
MRLITGISPIIAALWVLVTVNAAHSKRLLIITPAPSYSHQIVFRALCLALNKRGHEIVVLTPNILNDSSLINYTEIDFGFEYEKIDDTDLSQTRWNLTQLGGLKTRLLRLGHDIAEDVLSHPDLVKYYANNTNEHFDAVIAEMIMTPAIYMLAHRFNAPLIGIMSMDLQNCHRFNLGSPVLPSHPSNWELENFTGLNLPFWKRLVNYVNTWWSIHSWFNNFANKQQQIAEKYFGKDIPHIIDIAKNMSLVLINQEPVLAYARPEIPNIVHFSGLHIAKTPPPLPKNLKSFLDGATNGFVYMSLGTNVKSKFLPKGMLETFTNAFADLPYRVLWKFENDSFHVPANVFISKWIPQQGVLAHPNIRLFIYQGGLQSTEEAVHYAVPLIGIPFVFDQMYQVMKMVSLRVAKHLDIVQLTTPELRDAVLEVAGDRRYKDRMAALRVLTKDKPYDSLENVIWWIEYVMRHNGASHLRFDGVDSAWYQQCDLDLIVFLTTTVFVTLCAFLSLAGWGLMQLYKRCDKNNACEQLQTFTNGKVKAA

SEQ ID NO: 6848 - protein, 420 aa, Tribolium castaneum
MKTAASLLVLFLISTYGANSAKILGVFPVPGRSHYILGSSLMKALAEKGHDVTVISCFEEQNPPKNGTYRDIVITGAVDEMTKQMAKMNMFDRESTNPFAGAVFMSFRLPAMTETTLKHENVQKLINSNEKFDAVIVEFASEALYALSTHFGAPLVTFSATRASHWINPLVGNPSPPSYIPDIMLDFSVLMTLYERLVNSLVYVFNELLLNFVVYPKHNELMKKYIPNAPSHISEVLYNHSIVLVNSHPSVNRPVPYVPSMVDIGGFHIKPPKKLPQDLQEFLDSAKHGVIYFSLGSNLKSAQLPLEKRNALLQTFAKLKQKILWKWEDEDLPGKPPNVKVAKWLPQQDILAHPNVKLFITHGGQSSTTETIYHGVPILGIPIFGDQKINAKSVARDGCGLYVAYSEITEEKLTESILDF

SEQ ID NO: 6849 - protein, 322 aa, Blattella germanica
MKVLTILLLLVAYGEGAKILALLGVVSRSHHIFNKALTHALAERGHQITVLSPDKDEDVPNVTYLQIEGLYKTKDGFNYEQFVKQSTLALAFSTFDWVGGVCEKELESIAVQNLMKSTENYDLIITEATFSECLFGFIPKFGSPPVVAISGFGIPSWLSETVGTPNTPSYIPNSFLPYTEHMSFFERMYNTIVTTIMSFLYTKIHLPKMEALASKITSTNSMKFESDKLQVLPSNVKIGKWLPQSDILGHQKIRAFISHCGKMSTTESLYRGVPVIGVPFLADQWLNLQQMMAKGVAVKLDFMTLTKESVLSSVLEILNNKR

SEQ ID NO: 6850 - protein, 523 aa, Agrotis segetum
MNGRFVSLSAIFFFALLIEGGAPARILAVFPTPAYSHHSVFKVYIRALVERGHEVVVIKSTDRISYIDDNANDYDDNDNIRRNITEIDASLSQEYFKRLMKQAGVFRKRGLVADSSTVTAHNYLGMVRMISDQFSLPVVKRFIEQRHKFDVLVTEAFIDYPLVFSHLLGDLPVIQISSGYAVAENFETMGAVSRHPVYYPNLWRDKFAELNVWDMINEIYVELRLHNEFSKLADEQNRLLKQQFGADTPTVQELRNRVQLLFVNTHPVFDNNRPVPPSVQYLGGLHLVDKHPKPLFGMVGEILDNATAGAIYVSFGSGISTDEMETEFIEMLLKTFEALPYMVLWKYDGLLTRTPSNVFIQSWFDQYDLLHHTNLRAFVTQGGVQSTDEAIDAIVPMVGMPMMGDQAFNTNKYVELGIGRVVDTVNVNAFQLTEAIRDTAENPKYRTRLNELRHFIRHQAVSPMHKAVWYTEHVINHTGRGTMLKTKAANVNYSDYVMSYIFVPLATFTVMNHLRQLLRINIL

SEQ ID NO: 6851 - protein, 522 aa, Nilaparvata lugens
MQNPLLFVLLYIGSIECANILALVPVNSRSHFIVMEPLFKALASRGHQITVVSPFPQKKPLPNYTDIDISKWFPSKGKSFSIDFIKSNAGLQGLLCFKAIAGIGDVTCDVTYSDQRVSKLYNSTGKFDLVITEIFSSDCFVLFAEKFDVPLISFVTSVSLPWSNDRIGNPDNPSYIVNYINDFAHQMSFYERAINTATLIYIKLINYYHADLAHRKTVNKFFGDEAPEFHEVYNRRTALIFVNSHYTVNQPRPMVPNFVEVGGIHLQQSEPLPKDLQDMLDKAKDGFILFSMGTLVNCTTFSDHVLSSFMNTFITFGNLLVLWKYDGKLPNQPKNVITRKWMPQKDILVHKNVKMFITHGGLSSTLEAVNAGVPVLGIPMFGDQPANIMNLVRRGAGISIDYDDITTEKLTSSIREIIEDKSYKENAVKLSTLFKDRPQSAIDSAIFWTEHVLRHKGALHMRSAATDMPLYKLLLLDVTLIFLAIIIVICAGFYKITNYFLGLATSTKLREKSTTKIRAKRD

SEQ ID NO: 6852 - protein, 532 aa, Caenorhabditis brenneri
MISTRTVSFLSVSTVLCCLSSVSSLNILVHSPAYAASHTNFMARLADTLSEAGHDVTFLVPIAIDERRDKLGVKTTKDVIIVEQDEEMKSKLKPSNGSIEFLWIIDMDSSSIDTMLSWYNEIMILTCENFMRNKKVIADLKTRHFDVAIAEPFTICGLGLFEELNIKKTILVSSCAHYDFMLPHIGEPEDFSSVPTLSSKVGEEMSMTEKWENYRLVAETKASLAKLFDAETRIYREEFGKEVPDWKELMASASLYFTNSNPFIDYPRASIQKTVPVGGITVDLEKIKSEKLDEEWEEVLNRREKTLLISFGSNVPSAKMPAAWKAGIFNTVKSMPNVTFIWKYESDDVSFASEVNNIHFSKWVPQTALLGDRRLSGFLTHGGLGSTNELAHCGKPAVMVPIYGDQTRNANMLARHGSVIVLHKKELANEKLVKEAVHAILYDKKFMENAERIAEMLANQPTTPKQTVVKYTEFVAKYGPFPQMDPYARKLNYFQKTFLDIYITVFVGFLAFLISFIVLIRFVLSFTKLKKE

SEQ ID NO: 6853 - protein, 518 aa, Galleria mellonella
MKVLSFLFFAIVASSLCDAYRILVLFMVPGKSHGILGDGVVRHLLEAGHEVTYITPFPQKNPHPNLQQVDISKNAELMDEKMFDFKTILNNEAIFRNPIKMIQVMSGLFEATIQNPNVVKILNDTNQRFDAVISEWMFNDAYSGLATIFDCPFIWFSSIEPHGIILSLIDESTNPAYVPDSMSSTIPPFNFKERVSGLFAQLFGAALRFFYTDGIDGKQFYKIIGPYLTLRGKTIPSYYDVQYNTSLILGNSHVSLGQATRLPQNYKPIAGYHIKSDVEPLPEDLKKLLDNANNGLIYFSMGSNLKSKYLPDELKRGFLKIFRELKQTVLWKFEEPLPNLPKNVHIVQWAPQPSILAHPNCVLFITHGGLLSTTEAVHFGKPIIGIPVFGDQFTNIERAVNRGFAVKVTLSYEMVDELKSAIDEVLSNPKYKNRVRELSAIYHDRPVSPGKELVHWVEHVVRTRGAPHLRSPALHVPFYQKFYLDLLGLIVVAIIVIVTVIKLVIRSKKKEDLTKKNK

SEQ ID NO: 6854 - protein, 529 aa, Symbiodinium microadriaticum
MAKAHTFAFVFPMASGHINPSLGVARCLVERGHSVHYMCRPQMQAAIDDTGAKFHSEIDVQPELYVGREPDMIGAIASLQNEYGLTSQGYVRGRMLLKEIMSEMMLPGTLRWLQEIGADVVVCDPLINLEASLAAQLAGLPCASILTIAGPGAGQPAWQNILDAAGLTVEQMLEQRRQFQPLRECLQRLNARGLPLGLGDTLKPLGLLPAISLSQLTIVTTCEFLADPYPADMREAYDGAGANFAFVGPLLDKPGAKRAAGLRFDASLHKDNEHTASSEQDPVELVRDARKAGRKVVLASLGTMVTGDNNELGWRARPVVDGEPRGLTGKELCQAAWAGVFDAFGSDSSAAPLILVALGPQPDALDEMTVPPNAFCAPALPQVDVLRAGVDVFLQHGGQNSFMEALSTSVPMVVCPGFGDQIENAAKAESLGVGLKVDRPMGPVDKAASQAAAYREAAASSLRKVLSEPSYKDRALECARKLEAAGGVPRATELLLKLTEDKAPKAEEGKGQFPEAVANHAASVAAAGA

SEQ ID NO: 6855 - protein, 229 aa, Dendroctonus ponderosae
MGSSVKASNLPDYFRALLMIVFRNLPQRVLWKYEGDDLTDLPSNVLLGKWLPQQDVLGHPKLKAFVTHGGLLSVFETVYHGVPVVSLPVFCDHDANAAKAEADGYAIKLDLFTITPEGLLRAIKTVIRDPRYKTQVKHRQKLLLDQSEIPLEKAVYWTEYVLRHKGAVHLQSPSRHMGVIDYYSLDVVVFLALVLIGIYYTTKKLLRLMRILPKDEVSIDLPRKNIKVE

SEQ ID NO: 6856 - protein, 513 aa, Branchiostoma floridae
MGFLTPRSSAEKVLLVPPPVGDSHWMAMAKIGRALVDKGHTVAVVIPQDLMVKRRAEWPDFQFEAFQDQGTHVRLKEIQEKGLSTAGKLSIFEFANLFYAMSGDLMKHCSLLLGDSKLEHQLRASQYSVVISDPIFPCGAILSAHLDIRVPHIAVLRGDIYFLDEKATGVPIPLSYVPSIVTDLTDDMTFGQRVQNVIVSTLLPSVAQSIVSSAFDGLVRTFVGEEETIQSVTSRTDLWLYQTDDVLDFPRPSMPNMVQVGGLNVGEAAPLTKDMEAFVQSSGDDGVIVVSFGSMVKTMSTERLEVFASSFARLRQKVVWRYVGEKPTGLGNNTRLLALLPQNDLLAHPKTRAFITHAGSNGMYEALHHGVPMVCLPLFSDQPANAARVVARGLGVKLDFSTVTSDQLYQAILHVVTNTSYQETAARLSRLDHDQPQSPMERAVWWIEHVIKHGRLPHLRARAVELPWYQYYLLDVAAFLLTVCAAVLGTVWYSCSFICGKICCKSGAKLKSQ

SEQ ID NO: 6857 - protein, 406 aa, Ancylostoma duodenale
MGQSHINFIGNVADTLREDGHNVTLLIVEFDPDFKTSTGTRLVENIIRYSSPYHNSADWRTLTFKQGVVFNSIFGLNFIDLTKMQIYAYRVCKGFILANIYEYFEQSLFESKFPGFKNLHGLIKEKTDYMLMNTNEFTESTRPTLRSIQYVGGSATRDPQPLNEEFEWIVSRGSKGAILFSLGSLVKPSDMPVAVRKAFMDAFRTFTDYVILWKDDTQLNSSYPNIYFRDWVPQVDLLADGRVKLFITHGGMNSMQESLLFGVPMITVPLFADQDSNAAVAAERGFSVNLSKFAVTKEKVVDAINEVLGKDGEESAYTQKVRQAARLLKGSPQEMRRTIKRLARISGTEPPLKHLKLDIDHLNNFQYYNIDIYLLLLSIVLVHLWICASLSMQMAEFFTALKKKTD

SEQ ID NO: 6858 - protein, 818 aa, Branchiostoma floridae
MGIGPKLRCATLLLVFLGFLIRHRSSAEKVLLVHPTFYNSHWMNMAKIGRALVDKGHTVTVVVSEDIVEKRRAEWPDFQFEVFQDQGTQTRLREDHAHTTARTMSHLELIEEFVPGEGDLIKHCDLLLGDSKLEHRLRTSQYSVVISDHVFPCGAILSAHLDVRVPHIAVMRGDPLFLDETSTGVPVPPSYVPSLVTDFTDDMTFGQRVQNAIVSTLLPVLARRAAGSRYDGLVRSYVSEEETIQSVTSRTDLWLYRTDNVLDFPRPSMPNMVQVGGLNVRVVAPLTEIKRSNMGIGPKLRSSTILLVFLGFLIRSSAEKVLMVPPPCYHSHWMTLAKLGRALVDKGHTVTVVASEDIVEKRRAEWPDFQFEAFQDQGTQARIMELQDKAYSLVEILSVFEMREEIVAEFGELIKHCDLLLGDGKLQNRLRTSQYSVVITDPIFDCGAILSAHLDAPHVAVLRGDPFLDETSTGVPIPPSYVPSLGTDFTDDMTFGQRVQNVALSTFLSVVTRQDLSRAFDGLVRTYVGENETIQSVTSRTDLWLYRTDNVLDFPRPRMPNMVQVGGLNVLEAAPLAEDMEAFVQSSGDDGMIVVSFGSMFKTMSTEKQEVFAAAFARLRQKVVWRYVGEKPTGLGNNTKLLAWLPQNDLLAHPKTRAFITHAGSNGLYEALHHGVPMVCLPLFSDQPANAARVVARGLGVKLDFSTVTSDQLYQAVLHVVTNTSYRETAARLSRLHRDQPQSPMERAVWWIEHVIKHGRLPHLRARAVELPWYQYYLLDVSAFLLAVCAAVLGTVWYSCSFFCRKICCKSVGKLKSQ

SEQ ID NO: 6859 - protein, 703 aa, Operophtera brumata
MRLVAPHIEKRSRTPPSFEELKYNSSLVFGNSHVSMGQATRLPQIYKPVGGYHIEDTLKPLPEDLKKLMDEAKHGVIYFSMGSNLKSKDLPEQLKKDLLKVFGTLKQTVLWKFEEVLPDLPKNVHILKWAPQQSILCLLSTTESIHTATPIIGIPVFADQFINVRRAVSKGFAKQVSLSYTMAGELKEAIEDILTDPKYSQKVKELSYIYHDRPVKPGVELVHWVEHVIKTGGAPHLRSPALMVPWYQKIYLDLAALLLIALYILIKVLKLVKPLIFRKNVMLKLLVTTVLLSLCACDAFKILVIFPIPGKSHGILEDTMNIKAIMDKELNMKDYNFVQQLMVNISTSTIQDANVQRLLQDPKQNFDLVLGEWLFSEVYSTLAALYDCPFIWFSTLEPHWQITRLIDEHLNPAYNADILSDASLPYSFAERVNQLWVQIQGVLRYNVVPILRARGKVVPAYEDLVANSSLVLGNSHVSLGLAPRLPQSYKPIGGYHIDSKPSPLPENLQKLMDNSKHGVIYFSMGSNLKSKDIPLNLKQGFLRIFRGLKQTILWKFEEVLPDLPKNVHILTWAPQQSILAHPNCVLFITHGGLLSTTEAVHYGKPIIGIPVFADQFTNVQRAAEKGFGKRVELSYTMDAELKVQIDEILGACALDGTRDQDSRRAASTLPGTATALVPEDVSRSSGFSDTSYCDSDFTAGQNI

SEQ ID NO: 6860 - protein, 518 aa, Nestor notabilis
LVLFLSFWSLAEGGKLLVMPQDGSHWLSMRLVLEKLWERGHEVVAVIPDAALLLKSSQSFTIKTYSVPYTQEFVDNAYNSIGESSFKNPSLLDRIALFSNLSELTNMYSTSCRHLLYDEELMKYLQDSKFDAIMMDPVLPCGPIIAEHLSLPSVYFMRGLPCTLDYKATQCPSPSSYVPKTFAYTSDHMTFAERVNNFLLGISEHVLCDLFYLNYKNLASEFLRREVTMLQLFSQASVYLMRYDFVFEYPRPIMPNMVYVGGINCKQKQPLSKEFEAIVNASGEHGIVVFSLGSMVSEIPIKRAKEIADALGTVPQTVLWRYTGEVPPNLPKNVKLVKWLPQNDLLAHPKTRAFITHGGSHGIYEGICNAVPMVLMPLFGDQMDNAKRIESRGAGLTLNILEMTTKDISTALQAVINDKKYKENIQHLSDLHLDRPIHPMDLAVHWVEFVMRHKGAPHLRPAAHDLNWIQYHSLDVIAFLLVVVLLSLFISLKCCQFCCRRCCCKKGRTRKPTKSKSH

SEQ ID NO: 6861 - protein, 524 aa, Lissorhoptrus oryzophilus
MWVWTLFFVLPFFVTSHGAKILAVFMTPSYSHQIVYQPIWRELSLRGHQVTVYTPNPLNDKSLTNLTEYDLGFSYEVLKDHHFEDTKSPSENLKKVLECYKKVFENQMSHKYLQDLIKNVNNETYDLFLVEYIWQSYYAIKEIYNVPMIGLTSLPLTLLASDSLGMDKHPVLDPDIFVQFSFAETLKQRVFSWAYNWIYRIIVKPRWLGQFNAEIKKYFGERIKDVRQLAQEVSLVIGNYNFALQNIKPITPKYVPVSSLHVRPRKALPTDLAQFMDNLKNDVIYFSLGTNVKSSQVSKEKIQQILNVLGRLPYTILWKYETKNLPPNLPKNIIVRKWFPQQDLLGHPKVKLFITQAGIQSLDESILREVPMLIIPFLFDQKINADKCVKLGIAESINFADFTEDELETKINKLLNDQLYRKNIKEQARIITDQPMSSVDTAVYWIEYVIRHKGASHLRYKSVDIPFYQYYMLDVYLFVALISSLLFYILKRIAVIVALSYTAFKKLIVAKIFNWRYTEEKKIK

SEQ ID NO: 6862 - protein, 539 aa, Anopheles gambiae
MEHTRLLSAVVLLGLLLLGSAPPSQGARILGILPSVGRSHYIIGAGLMKALLDAGHEVTIVSPYPMKDAPAGLHRDILLPDLATSHGVSGPDLFQYKSAPNLMVLYLVYSEIGPQASEALLQHPKMVELMQSGERFDAVIVESFASEVLYGLAEHFGGQLFVFSPFGASMWTNELVGTPYPYSYIPHTFLSYTNEMSFWQRFTNALVGHADKLYYRCVFLPQQEAMYRRFFPNAKLTFQQTLESVRLAFVNQHFTLSYPHPYAPNMVEIGGIQIQPAKKLPADIQKYIDEAPHGVIYFSMGSMLKGRNFPEDKRAAFVNVFRGLKENVIWKYENDSLPDKPPNVLIKAWMPQSDILAHPKVKLFITHGGLLGTTEGLYHGKPMVGIPIYGDQELNLARAEQAGYGVKLDYDTLSEETIAAAIRTVLDGPAYGERARLISDRYRDQPLGPAKAAVYWVEYVLRHKGAPQLQSPSVRLSFVQYNLLDVYAVMGAIALSVLIGAGLMLRALLTSRANLRKKKAKPNSPIRQCAKDVGEEVGW

SEQ ID NO: 6863 - protein, 489 aa, Pediculus humanus
MNNFFYTFIIFLLCTFTLHVNYANGKNILVAFGNSGKSHFFMYEQYVEKLAERGHKITLLTGFNTTNIKMNENVKVIKFEDEIFNFVVDLTKYESTPKILMKYNEISYINEAGQRTCRNGLSNSNVKKFIESKKHFDVVVVEYFNTDCFSVLSHIFKAPLVGIFSSAPLPWHNDRMGNPDNPSYVAHTLSEFSSEMNFYARLKNSLSLFFSKTYYNMYSNGPTDKIIKRNLGKGIPKVKDIVSNTSLFLVNSHFSLFQSRPLVPSMVEVGGIHLRPPKNLPPDLQSYFDKSKDATNISTLSTKRKNAILKGFNNVTENVLMKWDADDMPEKPENVLLKKWVPQNDVLAHPKVKVFVTHGGLMGILEAVSNGVPMIVIPLFGDQFYNAAAVAEKGCGIVLDYFSLSGDRFLRALKTVLEDKKYSDNTKILAAKFKERPLSPMNTAIYWTEYVLKFKGAPHLRPSSKKLYWFSESLLDVHIFITVVLTYFN

SEQ ID NO: 6864 - protein, 376 aa, Rousettus aegyptiacus
MPCGELVAELLKVPFVLTLRTSLGGIKEKHCGKIPSPPSYVPVPMIGLTDRMTFLERVKNTMISVFFDFWIQDYDTRFWDQFYSEALGRPTTLCETLGKAEIWLIRTYWDFEFPRPYLPNFEYVGGLHCKPAKPLPKKIEEFVQSSGEDGVVVFSLGTIVQNLTEDKANLIASALAQIPQKVLWRYKGKKPATLGANTRLYDWIPQNDLLGHPKTKAFLTHGGINGIYEAIYHGVPMVGVSIVGDQHDNIAHMKTKGAAMEVNMNTMTSADLLRALKTVINDPSYKENMMKLSRIHHDQPIKPLDRAVFWIEFVMHHKGAKHLRPAIHDLTWIQYHSLDVIGFLIACVASAIFLATKCCLFSYQKFGKRGKKEKRK

SEQ ID NO: 6865 - protein, 650 aa, Peridroma alphabaculovirus
MHKHLLVLQLEFLAQKIVGMAKVLHDVGLLVVVDEYVLVIGRRHAQAVNGEHAVVPDAENSVYPLLAQEPLERRQIINYSAQVQPVGDTRHVDALTVGQPHKVLGMHRTSYSSARPTIYKRYCGSPKYCSLTLCTMSIRLAFGLFVCALAVVGGGSAARILAVFPTPAYSHHSVFRVYVRALAERGHDVVVIKPTERISYTDDNDDTVGNITEIDATLSQEYFQQLFKHASVFRKRGLVADSSTVTAHNYMGLVRMMSDQFELPAVKQFIAQKQRFDLLVTEAFMDYPLIFSHLFGHLPVIQISSGYAIAENFETMGAVSRHPVYYPNLWRDKFSDLNVWQMINEIYVEMRLQNEFSQLADEQTRLMKQQFGMSAPSVHELRDRVELLFVNTHPVFDNNRPVPPSVQYLGGLHLVHKTHKPLFGTIRQFLDNCTQGAVYVSFGSGISSDDMEAEFVEMLLRAFEQLPYGVLWKHEGFVPRLPPNVFMQSWFDQFDLLHHPHLRAFVTQGGVQSTDEAIDALVPLVGMPMMGDQAFNANKYTELGIGLVVDTISVTSNQLVDAITEAVENSKYRKRLTALRHLINHQPITPLHKAVWYTEHVIANRNTTTMLRTKAANVNYSDYVMSYIFVPFVTFSVMNHLRQLLRINVL

SEQ ID NO: 6866 - protein, 520 aa, Ostrinia furnacalis
MNLLGKFLLSAALCLSISEAYKILVVFPLPGPSHGILGDGVVRHLLNAGHEVTYVTPFPKDSKNPKLKQIDVSVDDAAMPKMNLKDILNKEQSAFDPNKFFDFTIGTHQRAIQNENMQKILNDPQQTFDVVVAEWMVCELYTGLAAFYGCPFIWVSTVEPHSTILSLIDDSLNPAYNPGLFSTTIPPYNFVERAKELLLSVANVVLKDVVLVRYYEQAAYDELYVPLLKKKGRPVLTYEEVRYNVSLVLGNSHVSLGQATRLPQNYKPIGGYHIDTNFKPLPEDLKNLLDNAKNGVIYFSMGSNIKSKDMPEELKRSLLKMFSGLKQTVLWKFEEVLTDLPKNVHIVKWAPQPAILSHPNCILFITHGGLLSYTEAVHFGKPTVGIPVFADQFLNVERIGKKGLGKRVDLSYTMADDLKIAINDVLSNPSYMTKAKELSLIYHDRPTPPGGELVHWVEHVIKTGGAPHLRSPALNVPFYQKMYLDLAALVVVVIIALRLIVKRLCNSCRKKKVSSEKKNK

SEQ ID NO: 6867 - protein, 519 aa, Drosophila busckii
KMFALKLCVLLSLISLLQGARILAIFPYPGPSQYINVVSYLKALAARGHQVTSVNAFPQKQPVANFSDIPVLEVFNSYEEIIQDLETPRSSWQENNFINDFFMNITKLVLQNANVQRELLPVGKAQFDLIIVEALRIDALYGFAAHFNAPIIGLSTFGTDWNIDELVGNTSPLSYTPLVTAGLSDRMTFSERVHNFVETTIAWLNWQLLYVPQQQQLYAQYFPHVAQQAPLQQLCKNFSLVLLNQHFSLSFARPYVPNMIEVGGLHIAHTPTALPQHMEQFIAGAGEAGVIYFSLGSNIKSKDLPPARRELILNTFASLPQRVLWKFEDDQLPNKPANVLISKWFPQPDILAHANVKLFITHGGLLSTIESIHHGKPLLGLPFFYDQFLNVERAKRAGFGLGLEHATMTAEQFKSSIVRLLSEPQFADTAAAMSARYRDQPMSPQQTAIWWTEYVLRHKGAAHMRVAAQDLSFIAYHSLDVLSYLLAICLLIVLVVALVLRKLFLLVTHSAANNKLKQH

SEQ ID NO: 6868 - protein, 530 aa, Frankliniella occidentalis
MEPARLLLPLALLALVAVPGPAAALRVLALFPLPAHSHFLMFKGVLEGLVDRGHEVVLFSHFPNKRPRANWTDVDTSRGRPSMVSTYSFDMVTAPKWGLPGYNERNSMAILSTIAGEGLCRDVFTLPDFDHLMKGGFGRFDLVLTEVFGSDCFAAVPYKLGLPVVSLSSAPDVSWLHERIGSVDNPSYIANVFGDYRGRMTLWERMHNAFSGLYLNHLFKYYMQDGCDPLVREFFGPGVPPLRELVRNTSLVLLNRHVSIHAARPVVPNLVLVGGLHVREPPGALDADTRAWMDGAQHGVVFFSLGSLIRAATMPARIRDALLGAFAELPQRVLWKYEDDGLVLPPNVRVAKWLPQLDILTHPKTVLFMTHGGLMGTLEALHSSVPMLGLPLFADQMSNMHLYKSLGIADQLDPHDHAAMTKAVVLAKLRNMTGDAGYRERAREIASLFRDRPRRALDEAVWWIEYVVRHRGAPHLRPLGADLPLYQYLLLDVAAVVLAAAVLVGSLIALAVRRALQGATWSSPTKMKLK

SEQ ID NO: 6869 - protein, 537 aa, Linepithema humile
MKLITSTLPIIVILWILATSNLASSKRLLIITPAPSYSHQIVFRALCLALNKRGHEIVVLTPNTLNDPSLTNYTEIDFGFEYEKIDDTDLSQTRWNLTQLGGLKTRLLKLGHGIAEDVLSHPDLMKYYENRTNQQFDAVIAEMIMTPAIYLLAHKFNAPLIGIMSMDLQNCHRFNFGSPVLPSHASNWELESKTGLNVSFWRRLVNFFNTWWHIYSWFNNFANRQQKIAEKYFGKDIPHVVDVAKNMSLILINQEPLLAYARPEIPNIVHFSGLHILKTPPSLSKDLKSFLDNATNGFIYMSLGTNVKSKLLPKKALEIFINAFADLPYKVLWKFEDNNLRVSPNIFISKWIPQQGVLAHPNIKLFIYQGGLQSTEEAVHYAVPLIGIPFVFDQVYQVMKMVSLGVAKHLDIVRLTTPELRDTILEVAGDKGYKDRMLKLRALTKDKPYDSLENVIWWIEFVMRHNGAPHLRFNGVDAAWYQQFDLDVIVFLTIVTFSVLCILLVITKRVLISLYTRYEMGTRCAFRKFVTKKLKSK

SEQ ID NO: 6870 - protein, 428 aa, Caenorhabditis brenneri
PDIFQQTTILDELKDEKFDLGITESLFICGFRKLYPTNIMNKTYISIPALFDHIGVKTVINADSVLYLDVVKYALGEPASTSFYPGLFSKFIDKMNFFERTRNLLGYAFSWYFSWTRFQGELEAIKPYYNKSLSWEDHINGAAFYLINSNQYLDFASPTLPKTVFIGGMQVNTKKHGKVELEKEWDDLLSIRKQNVLVSFGSNAFSSDMPAEYKKAFLEVFESMPDTTFIWKYEEENATLADHLPNVKLTTWMPQNDLLADDRLTLFITHGGLGSSVELAYQGKPAVVIPLMADQPRNALMLTRHGGALELDKFHLDKPSQIRHAIKTVLNDPNYKKNAEKLASILSSQPHQPKDVVLKHCDFAVKFGDLKTLNSEGRNLNLFQFYSIDIALAALAVTILLLLLLSLIISCVFRKMYTLFSNVKSKID

SEQ ID NO: 6871 - protein, 519 aa, Plutella xylostella
MTPIAKLIFLCVFTCIASVSSGARILCVYPVPFHSHQAVFNALSEALARAGHQVVALTPLPHPAPPPGLTQIDVHQLSYRLWEEGYKKFQHDNGGFGVDFITTWTQLSPVLHKIVESQIETPEMQAIIKDPKQHFDVILVEAVIPLSIMVAARFKAPVIQVSSFFGGNDNFMAMGVPVHPIIFPEFGARKTWKFSFWDKISSVYDFIRMRRFESSIRATENAIIRKHFGENAPTVEELQKNIHMLFLNVHQIWDNNRPVPPSVLYMGALHVKKPKLIPENFKKYLDASKNGVIYVSLGSKFLFSDLPDEDVRVFMKVFADIPYDVLLKWNGGDLPNKPPNVRLEKWIPQNDILHHPKIKAFVTQGGLQSTDEAIAANVPLIGFPVIGDQWYNAQKYEQFGIGIELDIKNVQEEKLRNAILSVASEKSYRENITRLSEVMREQRQGGLEKAVYWTEYVATRGALHLRSPLADAPLVDYFMLDVIAAAFASVLIAITVILVLIGGIFKSFRRETHVKVKRN

SEQ ID NO: 6872 - protein, 529 aa, Drosophila busckii
MARLLFVLFAALLISGSQSANILGVFTSLSPSHLILQMSMAKVLAEGGHNVTVVTAMKPPIMHKDIHLVQVPTSEQTMQELNSIIGSMAGRDNSNMLVSLFKSLGQMTFMFDLMRDTMAHRLVRNLYEQQSTKFDLVIIGSFMNNYQIGLAHKLKAPVVLISPMPANPMFDLMIGNPTSLSYVPITPTNLEPGQGLSLMQRIKNFVGNYAFKIFIYIIENNNKRYYSELYGDDPSMPDYAELTKNVSMIFCNSHGLSEGPIRAAVPALVEVSGLQIKDTPDALPQEMAEFISKAKHGAILLSLGSNVKGEHIKPDTVTKMFNVLSKLKQRVIWKWEDLSNVPGKSPNILYSKWLPQDDILAQPNLKLFITHAGKGGITEATYHGKPMLALPVFGDQPNNAEKMVKSGFGLSLSLLTLEEQPFQQSLDEVLNNPMYADKVKAFSALYRDRPLTARQSVLYWTEYVLRHHGAQHMQSPLVHMGIIAANNLDVYALLLALLIALLFLAKCFIKFVYKKCTGKAKQVKKAKKH

SEQ ID NO: 6873 - protein, 515 aa, Vanessa tameamea
MILKYLISTILLVNICYGYKVLVVFTLPGKSHGILGEGYVRHLLKAGHEVTYVTPFPEKNPPKNLRYIDVSENTKCLNMGIFDIKVIMDKEINLQDQNVIIPIMDNFWECTLKKEALQRFLYDQNEKFDAVVVEWLYSELGSGFATVFNCPLIWSSSMDPSTFVLSLIDEHLNPAYTVHHMSKDYSFSFLDRVYQLWSVARVRYYKWANSNNENELFKQLYGPIVAKKSRELPEFDEVKYNASLMLGNSNIVAGDGIALPQNYKHIGGYHFKEEIEPLPKDMKEIVENAPHGVIYFSMGSNLKSSNIPDKLKRELLDMFSEFKETVIWKLEKTIPDLPKNVHISPWVPQQSLLAHPKCVLFITHGGYLSLLETLRAGKPIIGIPFFADQYLNVNRAVAKGFAKRVDFDENVIPLKEAIKEILENPSYQQRAKELSVQFNDRIVPPGKELVYWIEHVIKTNGAPHLRSAALHVSWYKKMYLDLLSVTVIALMMIFVIIKYLFTFMQVDTHQKKKVH

SEQ ID NO: 6874 - protein, 1065 aa, Drosophila serrata
MRCFLNFLPFLLTMALVGQACGYSYLMVMHTASKSHHVVGEALAKGLIAAGHEVTIISPFAQKKPIKNLIDIDTPNTIKIMEAYKSRILQNMKKSLVLRYPLMHGMGLDLTEVLLVAPEVQELLGRNRTFDAVICESFMNDAHYGFAEHFGAPLITLSPLGATGWTSDLVGTPSPPSYVPHFLLPFDDHMDFWQRAQNLGFQAYEYIYHNWVYLPKQEAMYKKYFTNNKQDFYKMRRDTSLVLLNNHVSLSNPRPYSPNMIEVGGMHVSRKDPKPLPKDIREFIEGAEHGVIYFSLGSNLKSKDLPEEKRKAFVETLKGLKFRVLWKYEDDNFADKPANVFISKWFPQDDILAHEKVIAFITHGGLLSTMETIYHGKPVVGIPFFGDQFMNMARAEQLGYGITVKYGQLTASRFRSAIDRITSDPSYMQRAKAMSSQFRDQKETPLERAVYWVEHVTRQRGAKYLRSASQDLSFVEYHNLDVLAAFFAIFSLVLVSLVLLIRFIAIKVKGSKAKTLKQKTQISPINCLEFVSRRTVRMKPTGGQTSFLGLLLLCLLSCVSAYNYLVVLHTAARSHYHVGSALAKGLASAGHQVTLVSPFELKKPIKNIKDVTAKGIIASMEGRMTNLLESSKQPIIKQIVEFHKMGIEITDTLLSDPGVIELMKTNQTFDAVICEVFLNEAHFGLAEHFKAPLIGVGTFGAISWNTDLVGTPSPPSYVPHAMLKFSDRMSFVERVANLAFATYEYLFLNFIYLPRQEVLYRKYFPNNKQDFYDMRRNTALVLLNQHVSLSFPRPYSPNMIEVGGMHINRKRNPLPKDIEAFIEGAEHGVIYFSMGSNLKSKTLPLDKRQALIDTFAQLKQRVLWKFEDTNLPGKPDNVFISDWFPQDDILAHDNVIAFITHGGLLSTTESIYHRKPFVGIPIFGDQFLNMARAEQNGYGVTVNYEELTAPRLLAAIQRLIQDPEATQKVRDMSDRYRDQPQKPLERAVFWVEHVSRHKGAKYLRSASQDLNFIQYHSLDTMLVLYGGIAFVIFCIMLLIRRIFRFLQELFIKNDTPKQKPKVKRN

SEQ ID NO: 6875 - protein, 516 aa, Diuraphis noxia
MFAAVPPRLLSLLLLPMVLSPPPAALAANILAFMPIPLKSHFGGFQPLFEELASRGHNVTVVSSFPLVNRSVPNYTDVDVTPEKGLHEVNITELIDLNFLTSVTNRWFLAHILSAQMEHANLIDFLKSEDNSFDLVMVESFLQEYTVAIGHKYNAPVINLSPAMVWVSISKWLHIPSTFSYVPDCCIGVTDDMSFTERLKNTIVGLVEMFVEDYLYIPMIKAKMSKHFAYVGWESRPTLEQMLNNVSLTLMNAHHAVGVCRPYLQGVIEVGGMHIREPKSLPKDLQDYIDSATNGVIYFSFGSIINLSNLPKEKLSIFLNVISRLKEKVIIKWVPDKSIKLPQNIKVGSWLPQNDILAHPNVKLFITHGGLHSIEEAVYNAKPVIGIPVFADQHSNLRRVEKIGYGKFITFDQLTEESFGNAIEEVISNPTFKDKAMIQSRVYKDQPMNPLDRAIYWIEYVIRNDGAQYLKAGSLELNTAQYFLFDVTLFLLLLTVIFTWLGYRGIVKVSSKRKAN

SEQ ID NO: 6876 - protein, 530 aa, Nilaparvata lugens
MGFKNKFITILLSMVMVTSSYAGNILCIIVFPAYSHQQPLLALSEKLARRGHNLTVLTTDPPKKPIPNYTYIDMSSAYKNLKEMDEKFGFNLQREMSAAEIFKKLPQVFSELCDYELGLPQVQAFIGKAASMKFDAVLIENQYYSSFHGLTHKLGSPPVIGVHTFVPWSALDEFMGVKVNPSYMPHIFSHHSDSMTFLERCFNTFLYWYNWYLVEYELFPYQEAILKKYFGTNTPSAREMEFNKSLLLVPADLSVAYPMSIPPNYVRTGTFHIQPSPEPLPKDLKQWIDGAEQGIVYFSLGSNMQGTSVPQEKREIFFKTIRRFPKIRFFWKYEAESPLSNVPSNLLIRKWFPQQSILVHPKCRIFISQGGLQSTEEAIYYAVPLLVIPLFADQPHQAAKIEKEGAGLSLLLSRLTEDNFYDAISSMLTDPKFKSNMNRLSSLSKDQMVPALDEAAWWVEYVIRHKGASHLRPQNLNMNWIQVQLVDVYGAIVAAALFVLYIIYKLIKSIVALIPSGKSKKGKKAKSKRS

SEQ ID NO: 6877 - protein, 528 aa, Mamestra brassicae
MGHLHIVHWRLTMNGAIAALFLCLVMVHQQHAVRILAVFPTPAYSHHSVFKVYIEALAERGHDVVVIKSTDRINYANRNGLRGNVSEIDASLSQEYYGRLMRHAGVFRKRGIVADSSTVTAHNYMGLVRMMSDQFDLPIVKSFIEEAHKHKFDLLITEAYIDYPLVFSHLFGDLPVVQISSGYAVAENFETMGAVSRHPVYYPNLWRDKFSGLNVWETINEMYVELALQNEFSKLADEQNALLKRQFGESTPTIQELRNRVELLFVNTHAVFDNNRPVPPSVQYLGALHLHDKRPDSMYGMVREFLDNATTGAIYVSFGSAISSEDMEPEFIEMLLRVFEKLPYSILWKYDGYMNRMPANVFVQSWFEQYNLLHHKNVRAFVTQGGVQSTDEAVEAIVPMVGMPMMGDQAYNMNKIVELGLGKVVDTVRVNAEQLIEAIVDAAESPKYRKRLRELRHMIHHQPMTPLQKAVWYTEHVIESRRRVVPTMLKTRAANVNYSDYIMSYVFVPFIMFTVMNHLRQLLKMNMV

SEQ ID NO: 6878 - protein, 530 aa, Drosophila melanogaster
MVLRVEKFLLLAIAIGAVMGSSQGANILGLFPSLSPSHLIIQMSAAKVLAENGHNVTVVTVLKPVVNHKNITVIQVPLSKEEAQQMSDTIGAMSKNDNSNMALSLLRMSDQMDFMIRKNAETLMNDRVRDLYLNRGNKFDLVISGYFMNDFQLGFARKVNAPVIVLATMPPNHLLNPLIGNPLEVSYAGISNPAEGSKAVTFQRRLSSYMQSLGFGVFSHLSERRNRNWYKEVYGNDPKMPEYSEMLKNTSLVFFSSHAASEGPIRPNVPSAIEIGGIQIKDKPDPLPQNIAEFLGNATDGAILLSLGSNVQGKHLNPDTVAKMFNVLSKLKERVIWKWEDQENTPGKSANILYSKWLPQDDILAHPNIKLFINHAGKGGITESQYHGKPMLSLPVFADQPRNANAMVKSGFGLTLSLLTLEEKPFQEAILEILSNPQYAERVKSFSTLYRDRPMTARESFLYWTEYVIRHHGAAHLQSPLVHMSFIAANNIDICFLIFVILVSVLVLIKFLVQFIYRRFISKPKKEKTH

SEQ ID NO: 6879 - protein, 536 aa, Danio rerio
MPLCSTSFGGMKRTLFVPALGLFAFLCLFSSESVQAGKVLVMPVDGSHWLSMKILVEEMSSRGHEMVVLVPETSILIGKSGNFTTKSFRVPYSFDELNAHVDHIRKTAIEKAPRFIDIVGALGNLIQFTNMQVKACEGLLYDEPLMKSLRDMKFDALLTDPFLPCGSVIADYFSIPAVYFLRGIPCRLDEAAAQCPSPPSFIPRFFTGYTDKMTFPQRMINTFMTVFEKYLCHQLFASFDELATRYLKKDTSYAELLGHGAVWLLRYDFSFEYPKPQMPNMVQIGGINCAKRAPLTKELEEFVNGSGEHGFVVFTLGSMVSQLPEAKAREFFEAFRQIPQRVLWRYTGPVPENAPKNVKLMKWLPQNDLLGHPKVRAFVTHGGSHGIYEGICNGVPMVMLPLFGDQGDNAQRLVSRGVAESLTIYDVTSEKLLVALKKVINDKSYKEKMMKLSAIHRDRPIEPLDLAVFWTEFVMRHKGAEHLRPAAHDLNWIQYHSLDVIGFLLLILLTVIFVTVKSCMFCFRKCFKKSQKKKKA

SEQ ID NO: 6880 - protein, 1087 aa, Neodiprion lecontei
MSWRVIFIVFTLLASDWHFGDAARILAVLPTASVSHQVVFQKLMLELNKRGHELVVVTPNPVNDPTLKNYTEIDISFQYSDKDTLPNIINLRGNVDWFGLLKVFEPMLSKHAVQIFEHPELKKLYDPNSGEEFDLILMQMFITPAFMSFAARFKAPMIGIVSASLQTSVQYAIGNPILHSDPSNWQLDMKSPGSSWIPWRRLDNFIQSWRFIHYHRTVILPKYQKIAEKYLGIDIPDLHDLEKNVSLIFVNQQGPISFAKPNVPKVIEIGGFHVADKIKPLPKDLKKVLDEATQGFVYMSLGSNIQSNMLPEKARKDIVTAFSKLPYTVIWKFEDDTLKNLPENVIILKWTPQQAVLAHPNIKVFIYQGGLQSTEEAVSNGVPLIGLPVMSDQDMNVRKMVSVGVAKMLEITNINEKDFFEAVRTVAGDDGYKQRMLNLRSLLKDKPYDMLENAVWWTEHVIRHRGAPHLHSTTADEPWYQRQDMDIIAFLSAMFVILSILSVFIFYKCVILSIRLASHPTVEKSKKLQLSKQMYLRMIVGSRNQHRQLGMEVCKISSNMPRWTFFTALMLLGCGLDCGDGARILSIFPAPSISHQSVFRKLTLELNKRGHELVVVTTDPIKDSTLKNYKEIDISFLYKEKNYIGSVVDFRGKIDWYSRLSMLETIMSSQVTQIFSFPEFKKLYEPGSGEKFDLVLMEIFFSPAFMALAERFKAPLIGIASANLQLGVQYGIGDPILPSHPSILEMNVKGGDSWIPWQRLQNFIYSWRIIHYYRTVTLPKHKELAEKYLGIEIKDLHEMEKNISLIFVNQQKPISFVRPNVPKVIEIGGFHVSDKSKPLPKDLQKTLDEATQGFIYMSLGSNIKSNTLSKKTRDAFITAFSELSYKVIWKFENDELEGKPDNVIILKWAPQQAILAHPNIKLFVYQGGLQSTEEAVSHGVPLVGLPVMGDQDVNVNKMVSLGVAKKLEITDITKDDLLDAINTVARNASYKQKMMNLRSLLKDKPQDSLKSAVWWTEHVIRHGGAPHLHSTTAEEPWYQRQDMDIIAFLSAAFVITLILTNLILYKCVIYSIRAFAVHSVDKKKKRS

SEQ ID NO: 6881 - protein, 521 aa, Spodoptera exigua
MKRMQTYWLALILLLVYAEASKILVVFPLPSRSHANLGDGIVRHLLNAGHEVTYITPFAYKNAPPNLRTIDVSSNFEAWPVHLITIKTFIEKADSFANVNMMILMVNTIMEHTYQNKDVATLLNDPKENFDAVIVEWILNEAIGGIATIFDCPLIWMSSVEVHWKLLSLIDQPLNPAYSVDMMSTSQPPLSFTERVSELWTQIQVTIMDYFIFDKMQDEVYQKYVVPAVKQRGRVAPSFYDMKYNASMILANAYVSTAIPHTMPQNHKYIGGYHVDEVVKPMPQDLKKIIENSKHGFIYFSMGSNLKSKDWPEEVRVSLLKMFGSLKQTVLWKFEANMTDLPPNVHILEWAPQQAILSHPNLAVFITHGGLLSTIESVHFGVPIIGIPVLGDQHLNIRKAVKNGFALKVDLSYTMADELKKAIVEVTTNKKYAEKAKELSYIHHDWPVKPGVELVHWVNHVIKTRGAPHLRSPALHVPFYQKMYLDLAAVLIILFLAGRVFLKRAYAAVFSKTKANKKKTH

SEQ ID NO: 6882 - protein, 486 aa, Papilio xuthus
MAVFINIYKFFIIVIICHECVCYNILVVTPMPVISHAILGNSFVKLLLNAGHKITHVTGIPYNISHPNLRRFEVDYYLESIPNMDSSRAFGRIIRELFISSLREKDVNMLLRDTKERFDLVVAEWMFNDLYAGLSALYDCPLLWFSATESHWMMLRLLEDTINSQDKTSKYIPPFITSYIIQDMYLYNLEKEAYENIFTPLMDLRGKSLIKFEESKYFGAQILVYLNVLPHEAKNWPRKFKPIAGYHIDRQVEPLPKDLQSIMDNAKYGVIYFSMGSNLNSQDILDGYNEILMEVFSNLRQVVLWKHDLKFSHLPSNVHVLKWAPQQSILSHPNCILFMTQGGALSSIEALHFGVAILGIPIIADQFTNIERAVDQGYAKQVDFPYSTGEDIRDTIEEMIRNPRFRNKVKELSRKYHNQSSPGTDLVRYVRKVIRAGITKYSAPYETLYLKKIFINLGLWGIILLTSLRFIFKNFIRLRRSKKLNA

SEQ ID NO: 6883 - protein, 530 aa, Octodon degus
MSRMMRALFFLFLLLCCYTSTGSCGKVLVWQMEFSHWMNTKVILVELVQRGHEVTVLRPLSSVFIDHNNPSGIKFETFPSSVTPEENKKFFRQWIDNWIYNVPKDTYWKYFPLLQDIYRDFSNLCERNCKDAVLNKKLLTKLQESKFDVILADAHFPCSELLAELLKIPFVYSLRFNPGYTYEKYSGGLLFPPSYVPIVMSGLSGQMTFMERVQNMICTLYFDFWFQTFNEKKWDQFYSEVLGRPTTLYKEISKAEMWLIRSYWDLEFPRPTLPNTDFVGGLHCKPAKPLPEEMEDFVQSSGEHGIVVFSLGSMVYNMTEERTNVIASALAQFPQKVIWRFNSKKPDNLSPNIRLYEWIPQNDLLGHPKTKAFVTHGGANGIYDAINHAVPMVGIPLFAEQHDNIAHMKAKGAAVVLDFTTMSTTDLVNALSTIINNPSYKENVMRLSTIHHDQPMKPLDRAVFWIEYVMRHKGAKHLRPLAQNLTWYQYHSLDVIGFLLACVLTIVILVVKCFLLCYQKFSEIGKKKKD

SEQ ID NO: 6884 - protein, 548 aa, Neodiprion lecontei
MSRYLISVTLILAIGDLHQVYAARILGIFPMPSLSHQVVFRGLTLALRERGHELVVVTPNPINDPTLKNYTEVDVSFLYDIFNKETDWIAGRNEDTWLGVLRRITPIFMMMTEGALGHSEVQKLHAPNSRENFDLMLIEMLYWPAYLPLAKRFDVPVVGMASLSLSVYMQYGIGNPIMASHPSNWDCGAAVLGDLTFWQRLKNFVRTWRFLYWYRTDYMQKQQEIARKYFGNDIPDIGDVEKNISLVFVNQQTPITFVRPNIPNIVGIGGFHVSNQSEPLSKDLQRTLDEATQGFIYMSLGSNVKSATLSKETRGEFIAAFSKLPYIVIWKFENDFLPDKPDNVFTVKWAPQQSILAHPNIKAFIYQGGLQSTEEAVSYAVPVIGLPVFADQDTQVDKMVSLGVGKQLEILTVNRVNLVETIESVVTDSSYKERMLKLRDLMEDKPYDSLENAVWWTEHVIRHKGAPHLHSTTADDPWYQQQDMDLIFIISSVISIALITALVVLYKVLVHSVRLLNRNHLPFDQKDKVVRMFLSLQKVEMSDKLLRT

SEQ ID NO: 6885 - protein, 518 aa, Amyelois transitella
MMKKTAYILLVLTTLSHICDGYKILTVFPMAMPSHQILAKGVVKALLEAGHEVTQLTPFPDKNLPPNLSQVDLSAVDMSFATQRLNVTTVLDGQDAANLFEFKPFIEMTNRNVFQDPNLQKLMGDTSQTFDVVIAEWMFSDTYTALGYLFSCPFIWFSTVEPHSVIVSMIDENTNPAYVPSLMSSNVPPYDFINRVKELFMQIMTWGFQTIYFSRHYNEVYAELLVPHIIKRGKPVIPLDDIKYNASLVLGNSHVSLGLPTRLPQAYMPIGGYHIDPEVPPLPKDLQNLLDNAKNGLIYFSMGSILKSKDLPDVLKKDLLETLGSLKHTVLWKFEEVLPNLPPNVHIVHWAPQQSILAHPNCILFITHGGLLSTTEAVHFGKPIIGIPVFGDQFNNVDRAVKKGFAMRVDLAYNMKDKLKAAINEFLRDKRYTEKAKELSFIYHDRPVHPSKELVHWVEHVVKTRGAPHLRSPALDVPVYQKLYLDLLALVLVVLYVLKKIMVKIFSSKKVAKKQKKN

SEQ ID NO: 6886 - protein, 507 aa, Aethina tumida
MIFKSVFCVVTVLQLCEGAKILGIIPTPSYSHQLAFQPIWRELSLRGHNVTVITANPLNDPKLINLTEINISTVYDCIKRNNVWDLAANKNILFLINSFIELMRDWSEVILSHPQVQQLIKDPNFNFDLVFYEALSPVSLAFAYKYKCPAIGMASMDVPFMYHQAMGNPTHPLVSPDYNLKIEDTENMSFFDRFTAVFSDFVGNVLVRVLFTPVLNDVHKKHFGEDFPDVYDLFNLTDIIFTTTNPIFNNIRPVNPNTFTIGGGLHIQKPKPLPNDLKQYLDGANDGVIYFSLGSNVKGSLLTEQSKTAIMNVFSQLPQKVLMKCDWENITIPQNVKVEKWLPQQDLLRHPNIKLFVTQGGLQSLQEAITNGVPIVGIPFFGDQYSNVFRSVKKGFAVRLNKDDITEESFKGAVLEVLNNPKYKETAIKMGQIMYDEPMTSLEKVIWWTEYVIRHKGAQHLKSNAPRLPFYQYYLLDVIGIVLLSFLVLIYVLYKLFCVLSFCGAVY

SEQ ID NO: 6887 - protein, 529 aa, Fundulus heteroclitus
MELRLSVCVLLLLCAPRSSDGGKILVWYTEASHWINMKPVLETLVDRGHQVTVLVPSASMFMNSSEPSRFQYEPFDVSVSVKDVEQMFEQMIHLFINEMDHLSTLEIYFRFVDLISNNFKVSLKFLDGVMKSERIMKKLKEGNYDLLFADPIYPGSDLTADLLGLPLVFSLRFSIAHNVERLCGQLPAPPSFVPGAMSKLTDKMDFSERLWNVLFYALQDVGMERFMWKELDKYYSDITGTPTSACKMMGNADIWLLRTYWDFDFPRPLLPNFKFVGGIHCRPAKPLPKEMETFVQSSGDAGIVVFSLGSMVKNLTIEKANTIASALAQIPQKVVWRYSGQKPQTLGSNTRIYDWIPQNDLLGHPKTKAFITHGGTNGIYEAIYHAVPMVGIPIFGDQPDNMVHMEAKGVALTVNLNSMTAESLRDAVNTVINNKSYKENMMRLSRIHHDRPMSPQDEAVFWIEFTMRNKGAKHLRVQAHELTWYQYHSLDVLTFLLTLNLLLIFVLFKTCSFCFRRCCGRKTTKRKAE

SEQ ID NO: 6888 - protein, 554 aa, Leucania separata
MSLMNKFSYDPHIKLSARRELGHRSVRFLHAPHPLEQFVMFRFVVFVAAIASVRSARILCMFPTPAYSHQMVFRSYTQALIERGHTLTVITPTPLNAKNSANLTEIDISNSHTHYKQLVDQSKLYKKRGIIADVESVNHRNYLGLVRMVSEQFRNERVGELLRADRDTNRFDLIVTEAFIDFPLILSHFYDAPVIQMSSGHGLAENFETMGAVSRHPIYYPNVWRDTFPSSSNVWQMANELYRELVLYREFALLADEEDKMLKRQFGRHVPGVRALRNNVQMLLLNTHAMFDNNRPVSPSVQYLGGIHLKKQSNIMNSHLSQFLDDSTMGVVYVSFGSGVHALDMDDEFLHVFLSTFRSLPYNILWKADSVNDTLLPGNVLVQKWFPQQDVLNHRNVRVFVTHGGIQSTDEAIDAQVPLVGLPLMGDQFFNVAKFQELGIGRALNAHTVDAAELIEAILDANENPAYKRNLARVKRIILDQPMKPLEKAVWYTEHVIRHGGAAHLKTRASNVAWYEYLMVNALVPVVVSAFIGCFGTYSKYTLGLSHIYYYAIF

SEQ ID NO: 6889 - protein, 437 aa, Eufriesea mexicana
MRFDGITWFNSLEIRFFDMCADFARNVFEDPQMKKLYAPDSNAKFDVFLTEFLYMPSLYAFAHRYNIPMIALSSLGTAAINEHVFRGVVFPSHESTWEMEASTGPNLPFTKRLSNFLIMWRMMYIFHRDVFPTHQRIAESYLGPLPSMLDIMKNVSAFFIDQSDILTPARPKLANVVTFTSFHISENPDPLPKDLQEFIDDADAGFIYFSLGSNVKSADLPTELRRMFCDVFSKLPYRVVWKFETDLEEKPANVYSSKWFSQQTILAHPKIKLFITQGGLQSTEETIHFGVPVIVFPVIGDQDYQASRVDALGFGKRLEITTVTRDEFESAIQEVITNKEYKERIIRIRSLIRDTPYDLVENLIWWTEYIVRSDGAPHLRSSLATQPWYRYCDMDIVVFLTTVTSFVILTAISLIVRIIASLRKSWPPTVHQKQKIS

SEQ ID NO: 6890 - protein, 574 aa, Eumeta japonica
MKLLLLLSLVYASDAYRILVVFPMPGKSHSILGQGFVDTLSQAGHEITYITPFPIDKPATNVRQINISSVVGNMPADALKITKLVKSPFRAHMTALVGPMLATGTLENENLQEFLADTTQEFDVVIVEWFLTNVLSGFATLYKAPLIWFSPMDPQWQVLQLVDEPSNPAYTPSMIIKAVPPFDFFERANELFMQLYVQLWKTIAYFLMERPTFNKHFLPAFEKRGMTPPSYNEIVYNGSFMFFNTQPVLGIGYRLTQNTRYIGGYHIDPDTKPLPENLKKIFANARNGVIYFSMGFNLKSKDMSEYTKRGLLEMFGTLKQTVLWKFEDELRDLPPNVHILKWAPQPSILNSEEADGPAARNIPRPVSSLDIISNPKTVLFITHGGKLSTIETIHYGVPVIGIPIFGDQFANMDQAVHKGYGIKVDYEEDLAKPLKATLDEMLSKPSYSETAKLMSALYHDVIASPRQELVHWVEHVVRTQGAPHLRSIALHVPWYQKIYLDLIAVIGVLLYIVKIILCWACQLYSSKKQISTRKAGNVLVAPLRLGVFLGGSDYLLSGGSHVRVPLESAIKNQL

SEQ ID NO: 6891 - protein, 535 aa, Danio rerio
MTINMHLGVIFCLVVGVVCSAAVDQKLSRKSSWTGKLLVVPMDGSHWTGVKAVAEEMGRRGHTVIVVIPEISMRLGPGKHYITKKFPVKYDQKLFNEVLTEHVHEVTNPGHSRLKTVTSTMANLLKMFNMMASTSESLFQDKELIKFLRDENFDAILTDPALPMGAVLAYNFSVPAVYMLRGMPCALDATATACPNTPSYIPRFHTGNTDRMSFGERVMNVLMSILEQVACKVMYWSFEEVTPNFLQRDVSLTEILSTGAVWLMRYDFTLEFPKPLMPNMQFIGGINCGVKNPLMKEVEEFVNGSGEHGIVVFSLGSLVSSMPKEKADIFFKAFSMIPQRVLWRYTGEIPNNVPENVKLMKWLPQNDLLGPPKARAFITHGGTHGIYEGICHGVPMVMLPLFGDQADNVHRVATRGVGVILSIHDITVETLLDALNSVINNSSYKQKMQKLSAIHNDRPIQPLDLAVFWTEFVMRHKGADHLRPAAHELNWLQYHSLDVIGFMLLIVLIVTLAMLKCCSLCWRCCCRKTQKRKED

SEQ ID NO: 6892 - protein, 416 aa, Penaeus vannamei
MRPRPLQRPSSGGRWKLRAVIAVSAAPGASLLFLPPAKLPQRGHQVTIASLHARRPANGSRLRDLGTLDAGRRAQGDRGFDVFRMREASGGKDVNSQVMKKVVRHLPEYCDAFLRDPALQAAWAERPDLVLLPAFMNECGLAFVQVQAPFIYVTTSGLTPWTADLLGNPENPAYVPNQYLPYDTHMTLWQRTLNTLVRFISPHLRSQLVLSRLDGVVQRFLGDPTVSLSEVEKNVSLVLVNSHYSLGHPRPLLPNVVEVGAMHCRPARALHDAQLRRFLDASDAPAVFFSLGSAIRSEQLPASVRDTLVRAFARLPYRVLWKWEGAAVPGLPPNVLTRPWFPQQDVLGHERVRAFLTHGGLSSMQEAVYHGVPVVGLPLMSDQHLNVRQAVTLGLGRELTLETMTEDDLVEAITAV

SEQ ID NO: 6893 - protein, 518 aa, Culex quinquefasciatus
MDRSRVLVLFLVAVLCVPSSDGANILAIMTVPSPSHHIWNRVWMEALVDRGHNLTVVTQDKDNSRANLTYVLLENVYPTLFKDGATNYVEMAKESAFRTVFSFLDYYDSVCEGALASKGLDVIRAYPKEFKFDLVIYDYGCGPCLLPLLHKFNYPPLVSLTPFNNPPYSVDVVGGHKQFAYTPYFALNYDSKMNFQQRAYNTLLCLLSSAYRNWYIMPQLDRKVRSFFQYPDMPHLADLEQRTQLMLVNTNPALDALEPLPPNVIAIGGAHIKDPEPLPADLEKFIASSRDGAVLFSLGSNVRSDQIGEERQRMFIEAFRQIPQYHFLWKFESKLNLDLPPNVIIRKWMPQNSILAHSRTKAFITHSGGLSTQEASWFGVPLIGMPFFMDQIKNCQRAVSAGVAERLNFNDLSVERIRTTVLKVLQTPSYKENMMRRSQIFRDQETKPLDRALWWIEYALRHPNVATMKSPTLELGAIRANLWDVYALYVAIVFAAYKLVTGVLGSMGRKRVKQMKRD

SEQ ID NO: 6894 - protein, 346 aa, Diabrotica virgifera
MGNPTHPIVSPDVMLNFSGKLSFLEKVQSFLYNIWYRMFYYWYALPKADKIARKHFGEEMPYLGDLERNISLLLINVNPIIHNVRPNVPNIIEINQMHIKERKPLPKDIQEYLDSALQGVVYFSLGSNVKSANLTEKIRKEIVAGLGELPYKVLWKWETDYLPDKPNNVMTKKWCPQQDILAHPNIKVFVMQGGLQSIEEAITLEVPLVGMPLITDQHANVKRIVELGLGVKVDYKTLTKAIFKDAVMEVAQNPTYKEEVKKAKSILLDQPVKGVEKAVWWIEYVIRHKGAKHLRSPAADMSFFEYFMVDVILFLLICITLVLYSVYKLMTVLRSIFRSLKRIKQQ

SEQ ID NO: 6895 - protein, 287 aa, Drosophila sechellia
MITSSNQLEGQYEFMMHPNFKEIYENPKTKFDLADPLPKELAKFLDNADEGAIFFSLGTNVNTNTFRPDTVDILYKVLSQLPQRVIWKWEDLKNKPGNASNIFFGNWLPQDDILAHPNTKLFITHAGKGGVAEAQYHGVPMVALPIFGDQQGNAEIMTKSGFGRWLDILTMTENELKETIYEVLENPAYRETIGKFSTLYRDRPLTARQSVIYWTEYVLRHQGALHLQSPLINTGFVARNNLDVYGVVLLVSILLIVTSKFLLRKILNVASGYSNRRESLARKLKSN

SEQ ID NO: 6896 - protein, 395 aa, Musca domestica
  MOD_RES (372)..(372): Any amino acid
MAENIIKYYKTGLNLTEIILTEPSVRKLMASNHTFDAVICEVFLSEALYGFSEHFNAPLIGMGAFGAATWNTDMVGSPSPPSYVPGTGMKYTNHMSLKERIGNLAFVTYDRLIMDLYYLPRQAALYKKYFPHAKRDMYEVRRNAALVLLNTHVSLAFARPYVPNQIEVGGMHINRKPKPLPEDIAKFINESEHGVIYFSMGSNLKSKNMPQAKRDEILKAFRNLKQRVLWKFEDPILEGKPDNVLIRDWFHQDDILAHEKVKVFITHGGLLSTTESIYFRTPVIGTPIFGDQFLNMANAEKEGYGLVLDYQTWTADKLRQALNRILSDSSFQQRINEISDRYRDQEMLPMEKAIYWVEHVVRQNGARYMHCXRNYGLRIISMSRNKSMTSLVSTF

SEQ ID NO: 6897 - protein, 488 aa, Bos taurus
MSKMSMKRLSLLLLLQLTCYFSGGSCGKVLVWPVEFSHWLNIKTILEELVTRGHEVTVLISSASTIPNSSKPSTMKFETFPVSLTKTDYENFIERLLEEWTYVSKDSFWSYLSTVRTLFWEFFDTTLSICKDAVSNKKLMTKLQESRFDILIADAVGPCGELLAELLKIPFVYSHYTSPGHIIEKNSGRLPLPPSYVPVMLSELSDRMTFMERIKNMFYTLYFELFFPTYKEKKWNQFYSEVLGRPTTLSETMGKADVWLIRSYWDFSFPRPQLPNVEFVGGLHCKPAKPLPKVLWRYDGKKPDTLGPNTRLYKWLPQNDLLGHPKTKAFITHGGSNGVYEAIYHGIPMVGTPLFADQADNIARMKSKGTAVRLDLETMSTRDLLNALKEVINNPSYKENVMRLSAIQHDQPMKPLDRAVFWIEFVMRHKGAKHLRPAIHDLTWFQYHSLDVIGFLLACVATAIFVITKCCLFCCLKFAKLGKKEKRD

SEQ ID NO: 6898 - protein, 522 aa, Zeugodacus cucurbitae
MCRIKSIVISLWILACATNSLESAKILAVFPFTGPSQYICVQSYLRTLASRGHEITSVSAFPQKNPLKNFRDITLQIEQSHHDESVINAIGEMSESKLDQMKMVKDYILLTSLVILKNEEFQKLLHSDEQFDLIVIEVFCQDSLYALGHHFKAPMIGVSTFGTDVVIDQLVDNISPVAYVPAPSGKNLDRMNFWQRLDNLVAYTIELMYNHLVIIPEQQRYYEKYFPNATVRLADVRRNFSLLLLNQHYSFSWPRPLVPSAIEVAGMHIDHKPSKIPDDMEAFISASTRGAIYFSMGSNVKSAFLPKHTLQEIMNAFASLPVNVLWKFEKPDLAGKPKNVYINKWFPQPDILAHPKVKLFITHGGMHSLIEAVHHGKPIVGMPVFYDQDLNVQKAVSKGFGIALNFRNFTSTELRDAILEVLENPTYTERAREISAIFHDRPMKPLEAAIYWTEYVLRHKGAPQMRVAARHLNFLQRHSVDTIAVLFGIPLLLIIFITRGAYKLIVKFFTCKEPANKKRKHD

SEQ ID NO: 6899 - protein, 506 aa, Dendroctonus ponderosae
MRQLVWCVVIFQIFVSVSLGANILAIIPTASFAHQMPFRPLWRELAKRGHNITLVTTDPMDDLSLKGVKEIDIGYGYQIMEKHQVFDTISNDSKSFIEMGRAFVRAFNETNNKFFQSPEGQNLIHNKDNHYDLLMVEAQLPAMMVFSWWYQIPFIGLSSMDCALQYHDTAGNLVHHLVTPDPNMQVQDTFWDRLKSFLYIWIYRALLNFTTFPKEQRILQQYFGANVPTIPEIQNNMSMLFVATNPIFQPIRALMPNTITVGNGMHIGESKPLAPEIQRFLDEAEEGAIYFSLGTNVKSRYLNASAKSELLKAFTGLPYRVLWKTDEQFDDLPANIKAQKWFSSQPDILLHPNIKLFITQGGLQSMQESLNANKPMIGISFFGDQHSNVDRMVQLGFGLKVHKHNITEETVREAIGEVISNFKYSDKAKEFGDIFRDAIAPNVETAAWWTEYVLRHKGAKHFRNPLLDMPLWKAYMLDVFGLICLFIFVFIRLLSLILHSISRNIC

SEQ ID NO: 6900 - protein, 518 aa, Bombyx mandarina
MSKSLFLFLCIASLLCFCDAYKVLVVFSLSGKSHSILGYGIVKHLLKTGHEVTYITAFPEESSDPNLTQIDVSSNMVALPKSYKESLNLKTVLEGKAVPLDFDIIHNLMNAVEMNTYQIENVSKLLNDPEQKFDVVIAEWMFTEICVGYAAIFNAPLIWFSSVQTHWIITKLIDESLHPAYNAEAIAHSIPPFNFFQRAHNLWTQLQVFYHLTKGRQETLYANEIVPIIKKRGLVPPSFNDLLYNSSLVLSNTHVSYAAATRLPQNYKPIGGFHIDEEVKPLPEDLKKVMDGASNGVIYFSMGSNLKSKEMPDMLKKELIKMFSDLKYTVLWKFEEEFFDLPENVHMVKWAPQHSILAHPNCVLFITHGGLLSTIESIHFVVPIIAIPVFGDQFINVEWSVRKGFGKRVDLSYTLAEDLKAAIEEVFANPRYKEIAKETSLIYHDRPVSPGAELVHWVEHVVKTKGALHLRSPALFVPLYQKLYLDVLVVILVFLIVLYKTARCLFFKEKITNKKKNN

SEQ ID NO: 6901 - protein, 484 aa, Mustela putorius
MLNKNILLFSLKISLLGITLCGNVLIWPMEGSHWLNIKIIIDELIKKEHNVTVLVASGALFISPASKPSLMFEIYKVPFGKERIEGIIKDFVLTWMENRPSPSTIWRFYQEIARVLKDFHILSREICDGVLKNQNLMDKLKKSKFEVLISDPVFPCGDIVALKLGIPFMFSLRFSPASTVEKHCGKVPFPPSYVPAILSELSDQMSFTDRVRNFISYHLQDYMFDSLWKSWDSYYSEALGRPTTLCEIMGKAEIWLIRTYWDFEFPRPYLPNFEFVGGLHCKPAKPLPKVLWRYKGKKPATLGDNTRLYDWIPQNDLLGHPKTKAFITHGGTNGIYEAIYHGIPMVGVPMFADQPDNIAHMKAKGAAVEVDISTMTSEDLLNALRTVINEPSYKENATRLSRIHHDQPVKPLDRAVFWIEFVMRHKGAKHLRPAAHNLTWFQYHSLDVIGFLLACVAAAIFLVTKCCLFSYQKFGKTGKKKKRE

SEQ ID NO: 6902 - protein, 528 aa, Ooceraea biroi
MRAVVYVLYVILFLLSLSANAGRILSLSVVPFLSHQLIHRTLNLALHKRGHELVIVTTAPLKDPTLKNYTEIDVSYGFSIITEYNDAKWKISQMESCRQVFTITTEFMGTIWDNPEFKKIYRRDSGEKFDAIMIEPISDLSLYSMAHRFNAPLIGLTPMGFHNFQRYIFASPMLPSHPSNWEVNTLVEGYPSFWQRLQNFIDVWGYLYAWSHHVVMARKRVEKYFGSDTPDPMDIAKNMSIVLVNENPLFAYARPEQPNVIYFSGSQIQKTPPTLPKDLRRFLDDATKGFIYVSLGTTVSCHNLPTEIMGNFIEVFSKLPFKIVWKYECDEFPGKLDNIFISKWFPQQGILAHPNIRLFIYQGGLHSTEEAVHYAVPLLGLPIMFEQASRIQRLASLGAAIFLKLNELSKERLNTAIHQILNDKSYKERMAYLSKLSKDQPYDSFENAIWWIEYVMRHKGISHLRFSESDKPWYQRYDMDIIGFLAVIAFIMSLIFLYTLFRILRFCYGYYHLLYKNVQYLNTKLKMQ

SEQ ID NO: 6903 - protein, 2722 aa, Tribolium castaneum
MKPVLFVFGTNLLFSIAQCARILGVFPAPGYSQFILAEVLMKEIANRGHEVTVISPYKPHNAPPNYKTIETSDVIENSDGLDLYELDNESLFKNILTTYEFGNIITEFTLKNKEVQKLLHSDVSFDLVIVEQFFNDAMKGFARHFNAPLVLFSSMGLTEWNKEYMGIPALPSINAISYTSYTNRMNFFERIRNLIGTIFDYCYRKWVFYPIQREYLSRYFPNSIDFDEIINNASLMLLNSHFTTSENVLLPFNMIEIGGFHVSQNPLSKDIQKILDEATDGAILFSLGSNLQSSDLTPKILNTILSVFGKLKQKVLWKFEKDLSEKPSNVFISKWLKQADILAHPNIQLFITHGGMLSTTEAIFNGVPILGIPVFADQKMNTARAKRAGFANVMSLKDLTEGKFLSLINETINEPKYSENARKMSNLMRDRVVRPLDLAMYWVEYAIRNEGVRFETPVLKMYWFQVYMLDILCFVIFNLLVIYLSVKYLCSFMLPKKCKTNSKVNDRKKLLFILQTTVLFSATTCARILGVFPASGYSQFILAEALMKEIASRGHEVTIISPYRPKTAFFNYTTIQTSDVLHSDDGFDLFELDNKSLFKNILTTYEYGNLLTEFTLKDKGVQKLLHSNESFDLVIVEQFFTDALKGFATHFNALLVLFSSVGLTEWNKHYMGNPVLPSTNTIVYTGYTNQMNFFQRIRNLAGTIFDYCYRTWVFYPIQRKYAEKYFPKPVNFDGIINNASLMLLNSHFTTSENVLLPYNMIEIGGFLVTQNRLNNDTQKLLDEATDGAILFSLGTNLKSCDLAPNTLRTILKVFGRLKQKVLWKFEKDLPGKPKNVVISKWLEQADILAHPNVRLFITHGGILSVTEAIFNGVPMVGIPVFVDQKMNMARAKHARIANVISLKELTEERFFSMINETINNPTYSENVKKMSKLMKDRVVRPLDLAMYWIEYAIRHKGVRFETPVSKMYWFQVYMLDIFCFVIFNLLITYLLITGYSQFILGEKLMVELSQNGHNVTVISPYEPKTPIENYTTISTSGILQQYESVNWFQFESFTFVTSIMGSHKSGLKITEYTLANPKVQELLQSGVNFDLVIVEQFFCEALFGFAKHFNAPLVVFSSIGPSEWNNNQMGNPHLPSYMPMTKLTYNSQMNFYQRIKNTAAFLFDATYKRYVTYPIHDKLLKKYFPKSMDLEDVLYNASLMLLNSHYSITEPFPLVPGMVEIGGFHVSNSEALPKKLETFLDGAKDGAIYFSMGTNIKSSNLNPNLIQDIVDMFSQLKLKVLWKFDKTIPKLPPNVLVEKWFPQNAILGHVNTKLFISHCGLLSTTESVYFGVPMIAIPVFGDQKMNAAKAEHFGFALTIPYPLLSGETLRQGISEVLSDSKYVENVKLRSRLYHDRPVKPLDLAMFWIDFTIRNKNGTTLRFAGIELKWYQLYLLDITAFCVLIIIAMAIVGKYVIRKFNWKRLQTRMKLFLAIFQVIFVCNAKGAKILGVFPTPVRSHHILGHSLLSALAEKGHEVTLISPYEEKNGPGNKNYKHISLTGFDRKPIYINLKDSAFDIFLKLPLIKMIKFELAEDTLNHTNVQLLMDSDETFDVVIVEEFTEEALKALAVHFKAHLVVLSTVCSNPSVETSVGNPQPFSYVPYHLSSYSKSMTFHERVVNTLLHIYDQLLNHFYIYPKHEQVIKKYLPNAPPLKSIIYNSSIVLVNSHLSLNQPLPRVPNMIDIGGFHIKAPQKLPQDLEEFLDSAKDGAIYFSLGTFLQSSKLPAEKRNIFLKVFSKLKEKVLWKWEDDTLPGRPPNVKVAKWLPQQDILAHPNVKLFITHAGILSTTEAIYSGKPLLAIPVFGDQKTNAQNIHSNGFGLFLPYNNISEDDLTVKLNELLKNPKYARSARKRSEIFHDRLVKPMDTAIYWVEYVVRHGGAPHLRVAAVEFPCGSKILGIFPTFVRSHYYLANTLMNHLAEKGHRVTVISPFLDENPAKNNSYQNVVLTGLDDLKDTVNMFDYVNTNELLFIVLSIKKSLEMTELVLNNTNVQYLLQSNEKFDLVIMERFVNEAYVGFAEHFNCPYIVLSTFGTNPWINVLTGNPAPPSYIPNPSMPLSSKMNFWERQLNTLMYIYVHFLHNFYAFPGQKLLYEKYFNASTNFYDVLYRPSLVLLNSHPVTNQPVPYVPNMIDIGGFHIKPRGKISKDLQIFLDEAKEGCYMMKLSTSLLFLFLGLICGTKSARILGIYPLPGRSHYRLGSALFRELAERGHDVTVISPFGEKDPPKNGTYRDIVLDGIFEGDEKHKGKQWNMFKREGLNPFVGAYVVATMASKFMGVILNHTKVQELLHSDEKFDVVITDNFLSDAFKAFAMHFDAPLIVINPVGPNFWINPLVGNPSPPSYIPDILLNYYHPMTFCERMVNTLIYGFNFLLYNWMVFPRHNEYVKQFIPRGGDLNDILYNTSLVLLNSHPSLNQPVPLVPNMIEIGGFHMKPAKKLPDDLQDFLDKSEEGVVYFSMGSNLQSVLWPIEKREVFLKTFSKLKMKVLWKWEDDELPGKPPNVKISKWVPQMDVLAHPNLKLFITHGGFVSSVETAYHGKPMLAIPIYGDQRNNANFAYKNGFGRYITYGNLTEENLLATINEMLDNPKYSENAKIRSQIFHDRQVHPMDTAVYWVEYVIRHRGAPHLQVAALDLPWYKYLLVDVIFVVVMALSSLIFVTWFVLKKVCKKICAKKNTQKVKTN

SEQ ID NO: 6904 - protein, 313 aa, Daphnia pulex
MMGNWPSPWQLDAIGSTLGFDHYPNLILNFGDEMNLWQRTINTLSGLVALYYWRWNVMTVVDRIASETLSIDNLTTIEEIEQRYLSLFIFNTHFSLNYQLPPTSSVIQAAGLNCAPPQPLTQDLESFIDGSGDDGCIILSFGSILKGVDLPDDVRRLFLSTFSRLKQRVIWKWEDESKLGKDDFIPPNVKFMSWLPQQDLLGHPKVRLFITHGGLNSIQEAVYHKVPLIILPVFVDQPINARIAQNVFYDAIQQILSDPSYKERIDKLSAVMQDQMESPMDRVIYWIEYVIRHEGGSHLRTSSQRHLEKYANY

SEQ ID NO: 6905 - protein, 502 aa, Drosophila melanogaster
MKRSPISWSLLWMGYTCIFLLADSPAPVESHHILGLFVNVHRSQLMVHLAVCRALLQRGHHLTLVTTLPLEEQEIQGNVSHIYIPWQQPKEEVSSSDLILRLERMFRRLEHSGDLLDLPEWKMFLRNQPNTPYDLLLLGYHFNDHLLGVAAHFNCPVAIVSTQQPTGFVNSLMGNPEERWYVPQPYDGQQRSGISAWVFGMWEKFMEILARRVLARIYRLHFPEPQYPSFETMRRSVVLALSNHHMISEGPIAPLIPSMVDIGGIVLEQQLDKTPLEISAGNRSLIIFSLGTRFTWRKSTKELVRTFTKAFAQFPDYDIYWTYDGPNGSAISLDYPHLKVAKWWPQTQMWQSGKVRLFITHGGKGSVSEALFYGVPMLGLPLIGDQRDNLQRMQSKNWGLTLSTNNLTHWKLAKAITRMLSDSSYGETILKASQLYRDRPVSPSDLVTYWIEYIVRHKGAKNLHNPARQLNIIEYHSIDVYFIVYGLLILTIAILRKVNSLL

SEQ ID NO: 6906 - protein, 526 aa, Ceratitis capitata
MVRILFVILALACFAFMPSRVESAKILAVFPFRGPSQYILVQPYLKALAARGHELTVISAFPQKTPIKNFREITLKFEQVANHEELVSAAIEEMAGTKVQQLNLLKQYSLSSTEVALTNEEFQQLLRGNEHFDLIIIEALYLDALYALGSHFKAPMVGICASAADLAVDQLVDNISPVSYVPAPSGQQMDRLDIWQRLDNLYVYTLEWLYNRYVLIPAQQRLYERYFPNATLDLSEVRRDFSLLLLNQHYSYDLPRPLVPNAIEIAGMHVEHIPKKLPADMEAFINASPKGAIYFSLGSNVRSALLPKEKIKAIMDAFASLPVNVLWKFEKTDLPGKPNNVFINEWFPQQDILAHPKVKLFVTHGGMHSTVELLHHGKPIVGMAVFYDQHLNVQRAVSNGFGVAVNFQNFTSGELRDAILEVLNNPKYAERAKELSARFHDRPMKPLDAAVYWTEYVLRHKGAPQMRVAARHLNFLQRHSLDTMAILFGIPILLATLLTYILYKLLFALYSNVNNTNINLKKSKNE

SEQ ID NO: 6907 - protein, 446 aa, Ceratotherium simum
MSMKWISVLLLLQLGCYFSPGSGGKVLVWPTEYSHWINMKIILEELVQRGHEVIVLTSSASILVDPNKLSAIKFEIFPTSITKHDILGFALKLTNKWTYDMPKDTFWTYFSLMQEIFWEYSDIMEKFCTDMVLNKKLITNLQESRFDLILADPIGPCAEPTTLSELMKKAEMWLIRTYWDFEFPRPFLPHFEYIGGFHCKPAKPLPKEMEEFVQSSGENGIVVFSLGSIVSNMTEERANVIASALAQIPQKVIWRFDGKKPDTLGPNTRLYKWIPQNDLLGHLKTKAFITHGGANGVYEAIYHGIPMVGVPLFADQPDNIERMKTKGAAVRLDFNTMSRTDLLNALKTVINDPSYKENAMKLSRIQHDQPMKPLDRAVFWIEFVMLHKGAKHLRPASHDLNWFQYHSWDVLGFLLACVATAIFVITKCCLFCCQKFSKRGRKEKRE

SEQ ID NO: 6908 - protein, 524 aa, Capitella teleta
MKMLAAAALLIGSVFCVCRGANIIVIPTNIHSHHLYMSQLAADLTTYAHRVSILLPSNAKPPEMLRGTKVNVMTFQSPGKTSAMNSEEFSRHLIALAFSKSFVGTISTMREMATMGDKQMETDCEGRFQLIPQIKAQAFDFAIVDGQDLFCTPLLPYALEIPFALVSISIAPLQFRVPALPSFTPAFMSSLSDRMHFWQRTINTVQSLLMMAAYNLQLNGVHFAEKFAPERPPISPSGLARKASLLFLMNDLAIGYPFPLMPNVVPMADIMARPAKALPEDIQLFLDGASDGAILMSLGSVVNHVPDDVIDVFCRAFGQIEQKVLWKLPGNKDCRGMSPPNIMTSSWLPQNDILAHQNLKLFITHGGLNSVIESIYHAVPMVAIPVALDQPGNAARLSDKHLGVRMSIAEDFTTEKLVSNIREVMSNGSYKHAMHHACRVLRDRQESPGKRVSYWVDHVMQLGDAHLRTGAFDLNICQFLMFDVLAFLAVAVLVCAGCLVKVGCCVGKRCCCPPARQRKKSKVE

SEQ ID NO: 6909 - protein, 781 aa, Cyprinus carpio
MTGLWLLLSLFFLGSAQAGKLLLIPSDGSHWLGMKHVVEELGRRGNQVVVVIPEASLKTVRAGKVLVVPVDGSHWLSMKILVEELSRRGHEMVVLVPETSVLIGKSGNYTTKYFCVPYTLAELNANLDHIKNNAFEKPPQLTDIFVNLGNLMRFTDMQVKACEGLLYNESLMKSLRETGFDVVLTDPFLPCGTIISDSFSLPAIYFLHAIPCRLDEAAAQCPSPPSFVPRFFTGFSDKMTFPQRVRNTLMTVFQKYQCHQLFASFGELASRYLQKDTTYKELLGNGAVWLLRYDFTFEFPKPQMPNMVQIGGINCAKKGPLTKNVRRMVRALTVPALGLLALLCLFSSEPVRAGKVLVAPVDGSHWLSMKILVEELSRRGHEMVVLVPETSVLIGKSDNYTTKSFRVPYTLADLKANLDNIEKNAFEKPPNLSDIVENVGNLIQFLNMQVKACEWLLYDETLMKSLRETGFDVVLTDPFLPCGTIIADSFLIPAVYFLRLIPCLLDEGATQCPSPPSFVPRFFTGFSDKMTFPQRVRNMLMTIFEAFLCRKLFAGTDELASRYLQKDTTYKELLSHGAVWLFRYDFTFEFPKPQMPNMVQIGGINCAKKGPLTKELEEFVNGSGEHGFVVFTLGSMVSQLPEAKARVFFEAFRQIPQRVLWRYTGPIPENAPKNVKLMKWLPQNDLLGHPKVKAFITHGGSHGIYEGIFNGVPMVMLPLFGDQGDNVQRLVSRGVAETLSIYDLTSEKLLVALRKVINDKSYKEKDDRAFSIHRRDRPLSL

SEQ ID NO: 6910 - protein, 478 aa, Anopheles sinensis
MGQRVRITTIAAVILGVTYGVNFACCANILCLMGVPSPSHHIWNRALVNALAANGHNLTVVSPDIELKPTANVTYIHLEETYNAIHEGSTAIDFYEMAQAGVVESLKIFYNYALSMCVGILGSKGYRTIMDYPSDYKFDLVLYDFTCGPCLLAVYDKFGQPPMVGVTGFNNPPYTTDLVGGHKYYAYVPYYTLDYDTNMNFFQRFYNAAIHWIDYFYRNYVFLPETDRIVREHHKAMDLPYLATLDQKMMLMLVNSHHSVDFPEPIPQNVIQVGGLQILPPKPLPADIDRFIRAGKKGSVLFSLGTNNDILAHPHIKGFITHGGLLSTHEATWHGVPMIGIPLIADQYRNLAKSIRAGVAEKVDLWEVSTEKIRNTVLKVLEQPKYRKAMEARSNLFRDQPDTPLERAVWWVEWALRHPNAKSIQSPTLELGPWRSELYDVKLCLVLAVLFIACTVKKILCALFTKTSKTKQPKKKVQ

SEQ ID NO: 6911 - protein, 528 aa, Chrysochloris asiatica
MVSEKWVSLLLLLQLCWAGCGNCGKVLVWPCDMSHWLNMKIILEELTRKGHEVTVLVSPNNFIIDYNKPSTLNFEIVNTTSKEDAKKRLNDFLELAVNVMPTLSHWQSTIKLQEFFIQMVPYMKLLCENVIYNQTLMKKLKEDNYNVMFIDPVLPCGELIAELLAVPFVYTVRLSLGASMEKCAKLPSPLSYVPVPMLGLSERMTFLERVKNVMLSLILDICLQRYDAQYWDKFYSEALGKPTTLCETMGKAEIWLIRTYWDFEFPRPYLPNFEFVGGLHCKPAKPLPKEMEEFVQSSGEHGVVVFSLGSMVKNLTEEKANLIASALAQVPQKVLWRYKGVTPATLGANTRLYDWIPQNDLLGHPKTKAFITHGGTNGIYEAIYHGIPMVGVPMFADQPDNIAHMKAKGAAVDVNMNTMTSADLFNALNTVINDPSYKENAMRLSAIHHDQPVKPLDRAVFWIEFVMRHKGAKHLRPAAHDLTWFQYHSLDVIGFLLLCVATALLLVIKCCLFSYQKFGKTGKKKKRE

SEQ ID NO: 6912 - protein, 542 aa, Stomoxys calcitrans
MNLIWMILISLQLSSAEHILMVTMGGTKSHKIPFWELAKGLIKKGHHVTFLNGFKADFHMEGLKEITPMHLVEFIQNYTDWDLVGARYAQKAPLSIWKALRYPAESCNSLLEADAQSGVTVTDDLLTQRFHLAIVDGAFPECALGIVHRLGLPFMFINTVGFYTGSLAMAGNPITYAVTPHVFTAFTETMNLLQRVENSLIHRLADILHMYYTNQVHDVLMKHFGASIPHPYALMQNVSIILQNGHASITNARPFYPNVIEIACIHCRPAGSLPLDLEEFMESAPAGVIFFSMGSSVRAANVPEEFRRLLVEVFSRLPQYHVLWKWDAGGSVNTAEHMAPRLTKTTHQNMSAVTKNVRLSGWLPQQDILGHRKVKAFVTHGGLLSMFEAIYHAVPMVMLPVFCDHDVNAAKAESDGYAIRLPLETITADKLYQAIIAILNNGQYKRKVQEKSQLLLDQITTPLDTAIFWSEFLMRHNDVSHLQSPVRHMSCFIYYSLDLIGISMLVIGGILIILSKILMYVWQHGNRRHLRHRRQNKYLKQY

SEQ ID NO: 6913 - protein, 518 aa, Drosophila mojavensis
MRLLRLLLLLLASLSQAWAYSYLVIANTAAKSHFYVGQALAKGLVGAGHEVTMVSPFPQKKPLKNFVDVATPNVITAMEVHKARIFDVVKIPIVFRVPLMHAMGLKLTRTLLAEPAVQTLLAENRTFDAVLCEIFMNDAHYGFAEHFQAPLIAFSSFGASSWSNPLVGTPSPPSYVPHFLLQFSDHMSFFERAQNLIFTAFEYIYHTFFYLPQQEQIYKEYFPRNKQSFDEMRRNTALVLLNNHISLGFPRPYAPNMIEVGGMHINRKRQPLPQDIEDFIKGAKHGVIYFSMGSNLKSKDLPQEKRQAIIETFGKLKQRVLWKFEEPNLVGKPANVFISDWFPQDDILAHENVILFITHGGLLSTTESIYHGKPIVGIPIFGDQFVNMARAEQLGYGVTVAFDKLTAETFHNAINQILSDPRYAQQMREMSARFKDQHETPLERAVYWVEHVTRQKGAKYLRSASQDLNFIQYHNLDVFAMIVGGLISITFAVIYILAIVVRFIRRILQGKAGKVKKN

SEQ ID NO: 6914 - protein, 511 aa, Cimex lectularius
MRAFMRLGFVFIFVFGWSTGAEILAILPFRGKSHFLVFEPLLDQLSRRGHHVTVASYFPKAEPFPNYTDVSFVDEKDHRPVKGFYDFKSFESLKPSVMNNMRLIYGLEAEYDRLFTLPEFMDLQRRKFDLVITEYFSSDVHFGLVYKIGAPYILLSTCQHFPWQSYAAGDSIDPSYISHPFSAHPVKKNFLERLQNTVEVFGTVAVYDQLFRRNEQILAEKYLGPLPKLRDIANNASVYMIHSHFSIHGLKPTMPNSVQIGGITVKPPKPLPQKLQKVLDESKGVIYFSMGSVLKGDSMSMNKQKAFIKVFSELKQTVLWKRETPLEEKVNNIVTNGWFPQRDILAHPKVQLFISHGGLLSTNEAVTSGVPMVVVPMFGDQHHNAKALESIGFAVSVDFNSLTEDDLRQAVNKVLNDPSYKENARKTKEAFLDRPMSPLDTAVYWVEYVIRHKGAPHLRSAARDMTWYQYHNLDVYASLALMAYFAYLIVKNILKFLLGLCCGRVNKHKTE

SEQ ID NO: 6915 - protein, 518 aa, Amyelois transitella
MAGVSFLVLVTLILGHVSAYKILVVFPVPATSHNILARGVVRSLLHAGHEVTHVTPFPDTNVHPNLHQVDISASAENSHIKDQMNVTRILNGEVKTDFNMLKKFVDLMNKKILSDANLVELLNDTRQTFDVVIAEWMLTDTNAGLGYVFNCPFIWFSTIEPHSVILSLIDEHTNSAYIPDYRSSNIPPYDFVNRVKELISQAMMIAFRYFYLDSYQNERYKELLSPYSIKRGRPEISFSEIKYNASLILGNSHVSLGLAIRLPQAYKTIGGYHIETEVKPLPDELKNILDNAKNGLIYFSMGSNLKSKDFPELLKKGLLEIFGGLKQTVLWKFEEVLPNLPPNVHIVNWAPQQSILAHPNCILFITHGGLLSTTEAVHFGKPIIGIPVFADQFNNIDKAVKKGFAIRVDLAYDMKDKLKVAIDEFLREERYTEKAKELSLIYHDRPVHPSKELVHWVEHVVRTRGAPHLRSPALDVPVYQKLYLDLFVVILVVLYSLKTIVVKIFCSKKIVSKKLKRN

SEQ ID NO: 6916 - protein, 535 aa, Caenorhabditis brenneri
MLKLLPIFSLIGWVFAGDVLFIPSTLYPVHGQTMAVLAKELVDRGHQVTWLEIGPKQSDLVLPVEVTREFWPAQFGDKTLQDIYQFRNHSSHSELWSPAYYNENEQTTGWLASIRLCDSLLSRSKSKFDKLAEKKFSTVIVDDLYNPCGTLMAALKRSVYIYWSMTGLRTESAWANQSPSPPSYLPVAGTGLTDDLTFTDRMYNVASYFKQLYIHQHIVQPRIDAVYQKYYPGVATHFEIERNASINFVNTPPIFDFSRPYMPRVNFIGAIQCRKAKELSKEFTSRISEYPEGFVVLSTGFTAQWSKSPESIRHAYLQTFKAFPKILFIWQFDSTFDKSTVLPANLHIKPWLPLQDLLGHPKCLCHVSHGGLNSVIESVYHGVPVVGVPLTARGLDNLLRITARDSGVMIEKEEFGAKKLIEAIKEVIGNEKYKKEMLIFQDMVTDVPYTELYHAAFWVEFIERHQEVPHARSGADHLNFLQYFLVDVIAFFFFVIFCTISLIYYIIRTVIRTIRSVVNGIRGVPRIVTKGKKNN

SEQ ID NO: 6917 - protein, 535 aa, Solenopsis invicta
MRQITVISPIITILWILITSKLACSKRLLIITPTPSYSHQLVFRTICLALNKRGHEIVTLTPNIINDTSITNYTEIDFGFEYEKIDDTDTSQIHWNLTQLAGLKTRLLTLGHNIAEDVLSHPDLVKYYANGTDVQFDAVIAEMIMTPAIYMLAHRFNAPLIGIMSMDFQNCHRFTLGSPVMPSHLSNWELESFTGLNLSFWRRLVNFVNTWWSIYSWFNNFANKQQQIAEKYFGTDIPHIIDVAKNMSLALINQEPLLAYARPEVPNVVHFSGLHIAKTPPSLPKNLKDFLDSATNGFVYMSLGSNTKSKLLPKEILEIFVNTFANLPYKVLWKFENDSFHVPPNVFISKWTPQQSVLAHPNIKLFIYQGGLQSTEEAVHYAVPLVGVPFVFDQVYQVMKMVSLGVARYLNIVRLTTTELHDAILEVADDKGYKDRILALRALTKDKPYDSLQNVIWWIEFVMRHNGAPHLRFNGVDTTWYQQFDLDVIVFLTIILFLASCAILGAIGWISKKLYTYYDQENRCIIRKWNKMKSA

SEQ ID NO: 6918 - protein, 528 aa, Drosophila ananassae
MQLTSGRTGFLALLVLGLLSCVSAYNYLVVLHTAARSHYHVGSALAKGLAGAGHQVTLVSPFELKKPIKNIKDVTVKAILKAMQGSMSNLLESSKEPIIKQILGFHNMGLNITEVLLSDPAVVELMKSNQTYDAVISEVFLNEAHFGLAEHFNAPLIGLGTFGAISWNTDLVGTPSPPSYIPHALLKFSDHMSLAERVGNLAFVTYEYLFLNYFYLPHQEALYLKFFPNNKQNFYEMRKNTALVLLNQHVSLSFPRPYSPNMIEVGGMHINRKRQPLPEDIEKFIEEAEHGVIYFSMGSNLKSKTLPLEKRQALIDTFAQLKQRVLWKFEDPNLPGKPDNVFISDWFPQDDILAHDKVLAFITHGGLLSTTESIYHRKPFVGIPIFGDQFLNMARAEQNGYGVTVNYEDLTSSNLLSAIKRLLSDPEATKKVRDMSDRYRDQLQTPLERAVFWVEHVSRHKGAKYLRSASQDLNFIQYHNLDAILILYGGILFVLYCLFKLIGFMFRLLQELFIKKETPKSKKKAKQN

SEQ ID NO: 6919 - protein, 520 aa, Danio rerio
MACSWLLVGLFLFGSAEAGKLLVIPSDGSHWLGMKPVVEELGRRGNQVVVVIPEASLSMGPSEKTTTLTYPVNYTKAELHMVLEGNLTEILSTDFSTELSKFFVFFLQLKVLQNFIVRNAEGLLFNEDLMKKLQDCKFDAILTDPFEPVGVIASEYLSIPAIYMQVNLPCGVDSLASQCPSPPSYVPQRNTHFTDQMNIWQRCTNLVRTLLQHMACRYMYTEADEIASRFLQRRASIVEIMNRATLWLMRFDFAFEFPRPLMPNMVMIGGMATKMPKPLSKELEEFVNGSGEHGFVVFTLGSMVSQLPEAKAREFFEAFRQIPQRVLWRYTGPVPENAPKNVKLMKWLPQNDLLGHPKVRAFVTHGGSHGIYEGICNGVPMVMLPLFGDQGDNAQRLVSRGVAESLTIYDVTSEKLLVALKKVINDKSYKEKMMKLSAIHRDRPIEPLDLAVFWTEFVMRHKGAEHLRPAAHDLNWIQYHSLDVIGFLLLILLTVIFVTVKSCMFCFRKCFKKSHKKKKA

SEQ ID NO: 6920 - protein, 462 aa, Agrotis segetum
MSLVVLSLLVSGGSCANILGVFPTPSYSHQSVFAAYVDKLAAAGHNVTVITPMKRATGHVREIDCSLSVERFQELVSRSKHIKKRGAVADEFTVTKENYMGLINVVATQLETNAVTALIKNPFNKFDLVVCEAYLAYTLIFGHIYDAPVIQLSSGHGIPENFEIQGAIARDYVNHPNIWRSTFTGSPLEQMFMENYLKNEWGLIEIEQEKMLRKRFGYHIKMENLKKSVLMLFINVPAVYDNFRPVTPTVQYLGGLHLRKEQPIRDLVLNRFLESHSTIVYASFGSGIDVLDMDRSLLKELIRVFSKLPYGILWKVDDSVHSIYNVSANVYTKSWFPQRDLLKHENVKAFITQAGVQSADEAIDGGVPMITLPMMGDQFYNAHRFEQLGIGIHLDVLKLEKERLDKKIVQVVENRNYKKNIERLRHFINDVPLKSLRKSLWYTNYVIRKQKTLNVIKNVKCN

SEQ ID NO: 6921 - protein, 508 aa, Mus musculus
MLWKWISALLLLQISCCFRSAKCGKVLVWPVDYSHWMNIKIILDELIQKGHEVTVLRPSTSIFLDPKKSPGLKFETFPTSFSNDVMEIIFAKAVERWTYEVPRDTCLSYSPLLQNIFDEYSDYCLTLCKDTVSNKQLMAKLQESKFDVVLSDAIGPCGELIAELLQIPFLYSLRFSPGYYLEKYSGGLPLPPSYVPVILSGLSGQMTFKERVKNMICMLYFDFWFQTFREKKWDQFYSETLGRPTTLIETMGKAEMWLIRSYWDLEFPHPTLPNVYYVGGVHCKPAKPLPKEMEDFVQSSGEHGVVVFSLGSMVLWRFDGKTPATLGPNTRIYKWLPQNDLLGHPKTKAFITHGGANGLYEAIHHGIPMIGIPLFGEQHDNIAHMVAKGAAVTLNIRTMSRSDLLNALEEVIDNPFYKENAMWLSTIHHDQPMKPLDRAVFWIEFVMRHKGAKHLRPLAYNLTWYQYHSLDVIGFLLAFVTFIVALIVKCFLFVYRFFVKKEKKMKNE

SEQ ID NO: 6922 - protein, 563 aa, Anoplophora glabripennis
MSLIYNYLTLEKRDNLLIMKYSVFELIFQEVTMNLRDISSMTNMLSCVVFAVILVSAKSAKILGIFMTPSHSHQQVFQPIWRELSLRGHEVTVFTPNPLKDPSLTNLTEIDLSFSYDVFLNHSHKNFKWESKSEEIKALFEGFSAVFHDQISSPEMQKLLANKNKVKYDLFLVENLYPCMYAFKDVFDCPMIGITSLPLTISAVQMLGLVKHPVLDPDLFLPFSVDLSFKERVTSTIFYSIFKLNGYFNLAPKLNAETRKYFGPKTRDVYTIASEMSLILGNFNYVTQNIRPHVPAFVEISGIHLQPEKPLPKDLKQILDESKEGVVYFNLGSNVKSSLLPRDKLDAILSAFSELEYKVLFKFETDDLTNVSSVPSNVEIRKWFPQQDVLRHPNVKLFVTQGGLQSIDEALNAKVPLLIIAVFGDQLFNAHKMVSSGAGLSIDFDNLSKGELVEKINKVIQNPEYKKTVSKLGAIAFDHQVPPLEKAVWWIEYVLRHNGAHHLRYKGAGMPFYQYYLLDVFCFLGLVCALTTYSVFKIAKMLILGIRFISRNRKPNESLKKSQ

SEQ ID NO: 6923 - protein, 543 aa, Helicoverpa armigera
MNLSRWPLLCLPLLVASACCSDILMVTMGGTKSHKMPFWELARGLIRRDHNITFISAFPADFHITGLEEIAPEGLVTYVRNYMSFDLVGARMRGEDQMPVKDILRYGYEACDAFLSDPETRSFLRSGRTFDLVILDGTYPECALGIVYKLKVPFMYINTVGFYTMPLSNSGSPVPYSVTPFFGKGFTDNMGILDRALNTAFHLAILPFHAFSMQILQGVLRRNFGQHMPHVYDMAKNVSFILQNGHYSVSYPRPYLPNVAEVACIHCKEAKILDPEIEEWISGAGETGFVYVSMGSSVRTTKMPLTAHRLLVEALGRLPQRVLWKQDAEQNMTDMPSNIRLFKWLPQQDLLGHPKIKAFVTHGGLLSMFETVYHGVPIVTIPIFCDHDSNAAKAEIDGYAKKLDLQHLTPEKLYKAILEVITEPRYKIEVKKRQVLLRDQKETPLERAIYWTEYVIRHKGAYHLQSPAKDMSFFTYYSLDVFLLLISVLITVYALVSYALRLGFNRLVNYVQNRQMHKLLGKSNNLLSSSKLLTQSAMAKKKL

SEQ ID NO: 6924 - protein, 530 aa, Branchiostoma floridae
MAIGPVRKLRCSFLLVLLGLLIRHRSSAERVLLVHPNFNSHWMALAKIGRALVNKGHTVAVAVPQDTVEKHRAEWPDFQFEVFQDQGTQARMRAIQDQAWSTAGELSIFDFKNVFDASSGESKKHCALLLGDSKLQHRLKTSQYSVVISDPIFPCGAILSALLDTRVPHIAVMRADVHFLDEKATGVPIPLSYVPSLTTDFTDDMTFGQRLQNVIVSTLLPLLLRPIVSSTYDGLVRTFVGEDETMQSVTSRTDLWLYRTDNVLDFPRPSMPNMVQVGGLNVRVAAPLTEDMEAFFQSSGDDGVIVVSFGSMVKTMSTERQEVFAAAFARLRQKVVWRYVGEKPAGLGNNTRLLAWLPQNDLLAHTKTRAFITHAGSNGLYEALHHGVPMVCLPLFAEQPANAARVVARGLGVKLDFSKVTSDQLYQAILHVVTNTSYRETAARLSRLHRDQPQSPMERAVWWIEHVIKHGGLPHLRARAVELPWYQYYLLDVAGFLLVVCAAVLGTVWYSCSFVCRKICGKSGAKLKSQ

SEQ ID NO: 6925 - protein, 516 aa, Athalia rosae
MKSLFKVNTVIALLCIFSDVAKAARILAVFPTPSISHQVVYRELTVELSKRGHEFVIFTTDPINDPSLKNYKEIDMHHTYSLMPDFVKTSETTFITDWWGTAESILEQFFSHPEMQRIIAPNNTEHFDLIMLEYMSWEATCALHDRLKAPIIGIISLQLFQWGHYGIGNPTALAYSPTVLDSFDYDVTSFWHRLRLLYEHSVQAFGHRFDNMPRQERLVKKYFGENVRDLQELNAELSLVISNTNPILGYPRPNLPIIIEVGGIHLKIKMKGFEKNVKKFLDSAVEGFVYFSLGSNVKSKHLPEDKLKTLMSVFASLPYKVLWKFELDTLPGKPDNVFISKWLPQHDVLAHPNIKVFVYQGGLQSTEEAITLGVPLVGVPVFGDQIFNVVKLVSVRIAKMVHFNSLPGEELRKAIVEVASDPSWKERVIKFRELLTDQPDTPLDRAVWWTEYVIRHKGAYHLRPKARFLSWYQREFLDVIAFVIAIVLLVVYLTVKIVKRLLAYICRKVCAKVKTN

SEQ ID NO: 6926 - protein, 976 aa, Papilio machaon
MEPRLTVLYYLLCLTLSFVDSARILGVFPTPSISHQVVFRTLTHELARRGHELIVITPDPVHPKGPRNLTEIDVHDLSYTIWNKGISEMEDGSRDVTKQVEAMMYLNYEIFEEQVKSKSVQKLLSYEHDHFDLIFVEAFLGYTLGFSHVFKAPVILVSSFAGVWDNYDAIGAPTHPFLYPNSVRDRLNNITMWEKFIQLRKEYKMRNMNSNYETVNKLLKKLFGADTPPVQKLFDNVAMLFLNVHPIWDNNRPVPPGVVYMGGLHQNLIKELPKDLKFYLDSSKNGVIYFSLGTNVKPSYVPPEKLQAIINVFSRLPYDVLWKWDNDELPIRSNNIKISKWLPQSDLLRHPKVKLFITQGGLQSTDEAITAGVPLIGIPLLGDQWYRHPKVKLFITQGGLQSTDEAITSAVPLIGIPLLADQWYNVEKYVQHKIGVRIDIDSLTEEMFENSIHTVINDTSYRDNIVRLRSIMQDQPQSPLERAVWWTEHVLRHGGAHGYETSLVAYDGTKINILYYLICLTLSFVDSARILGVFPTPSISHQVVFRTLTHELARRGHELIVITTDPVHPKDQVPENLTEIDVHDISYSRWNKAILEIEDGSRDVSKQVEAMSDINMEIFEEQVKSKSVQKLLSYKDDYFDLILVESLLAFSLGFSHVFKAPVILVSSFGGVWDNYDAMGAPTHPLLYPSMKLFDNVAMLFLNQHPIWDSNRPVPPGVIYMGGLHQNPLKELPKDIKLHLDSSTNGVIYFSLGTNVKPSYVPPEKLQAIINVFSRLPYDVLLKWDNNELPIRSNNIKIFKWLPQSDLLRHPKVKLFITQGGLQSTDEAITAGVPLIGIPLLADQWYNVEKYVQHKIGVRIDIDSLTEEMFENSIHTVINDTSYRENIVRLRSIMQDQPQSPLERAVWWTEHVLRHGGARHLRSPAANISWTQYLELELLFTLAIILILALFVLVLVTRSIWNVINSNVTTKIKIKKP

SEQ ID NO: 6927 - protein, 522 aa, Caenorhabditis briggsae
MKIALFSILLILVGSASSFNFLVFCPLYAHSHHKFLAKIADTISDAGHNVTFLAPIILRKYENVKYLESTRDIVYIQPSKKLESLGVTSDYSKFWSKDATAIQFVPAIKAFTRMFQQLYEDLKNDLSVLDELKNRKFDAMVFEFLCATSYPIAEYLEIKALFPSLSMTHHPFMSRLIGEPSSPTVMPSMISSFGDDMTFSERLQNTIGDVFFNLFVHPPPMASFKNPERLIDIADMTARSPFLFMNGNPYLDYPRALLTKTVMIGGISVNATQMKQEKISEEYNQILDKNKKNVLISFGSMIFSKDMPTIYKQTIVRVIASLPDVTFIWKYEEDDVSFSKNLPNLHFSKWVPQTALLADPRLSAFITHAGLGSVTEFSYMGKPAVLIPVFADQLRNSKTLERHNGSITLSKYDLSNFDKLRSAIKTILTEERYKINAERLAQQLQDQPVSPHDLLVKHAEFGAKYGELPNLDPISRKMSYISFYMIDIIVFVGSIVFLVLALFFVIARWVLRQCLRPKLKVE

SEQ ID NO: 6928 - protein, 535 aa, Bactrocera dorsalis
MQWPIAYVGVFVFVAIAYLIPTQDAARILGFFPSPGDSHLIIHCAVADTLAQAGHNVTVIATKPNVNPKAKYNYIYIDTPLLPPSFLKNFVNQPMPFYKRYPMLLKEVSKMHNRTLWHPEIQQFLHDHGAGSFDLLLVGYFANDFHVGLGAHFKCPVILTFMVQPIFYLNELIGNPSEHAYVPTVFSGLKQPMNFWARLENYVIYLFEYYYMGPLMKSTAQKYYSYNFPASSGYPSFEEARRNVALIFANHWFAQGPVRPHVPSLIEVGGIQVKEKPDPLPTDIAELLDGSPEGVIYFSFGSLIRGNTLKPDTVHIIFNVLSKLPYKVLWKWGADYPGNSSNILFKSWLPQTDVLAHPNIKLFITHGGKGSVVEAEYNGVPMVGIPLFSDQPANMEEVRQAGFGTYVPYADLTEESLREAIEEVINNPKYRKAVREFSEVYRDRPMTPRQSVVWWVDYVLRHKGAKHMQSPAVYLTHWQLMSLDVLGVLLAIAAAVVGLLIILWRFCITKLVARLIKTNGVNGTKRNAKKSAKVE

SEQ ID NO: 6929 - protein, 526 aa, Asbolus verrucosus
MFPLSVIVVALLPLVQTSNILFVAVSPSVSHQIVFQAVWKELSLKGHNVHVITPNPLRDPTLHNLVEIDISSLYDKMREVPRDVAKYLLKKPDFFNVFLKDRVLTEYFSKFMEYAFQHEHVQKFLSEQHEFDVVIVEWLYPTMAAFGAKYNCPIIGITSLGAPIPALDTVGNPSHPVYVPDHNLPVKRDLNFKERLMSTLYSIFVRVYYHFVVLPREDALAKKYLGEGLPYMGDIEKNVSLLLLNRNLVFHRIGPSVPAIIDLGGIQLNKTKKDLEPELKKFLDNSVNGAIYFSLGSNMKSIYLPEATRNIFRDTFAQLPYNVVWKWEGGDLPGAPNNVFTQSWIPQVELLGHPNLKLFITQGGLQSTEDAIKNHVPIIGIPFHSDQTTNVDTSVKYGIGIGIDLDEINIENLNASVHQIINDARYKENVVRLDKIMHDQPKDGLERAVWWTEYVIRHKGAKHLRSHSMDVPWIQYLMIDIAAFLAGTLFFIIFIVYQSLKLISFIIFWILRKLLRCKTDRDKKNK

SEQ ID NO: 6930 - protein, 483 aa, Cavia porcellus
MLRNILLLSLQISLLGTTLAGNILIWPMEGSHWLNVKIIIDELIKREHNVTVLVASGALFITPSSQSSLTFEIYKVSFGKERMEGLIKDFVLTWLENRPSPSTIWRFYQEMAKVIKDFHTVSREICDGVLRNEKLMDKLKKSKFEVLVSDPVFPCGDIVALKLGIPFIYSLRFSPASNVEKHCGKVPYPPSYVPAILSELTDQMTFADRVRNFISYHLQDYMFETLWKPWDAYYTKELGRPTTLCEIMGKAEIWLIRTYWDFEFPRPYLPNFEFVGGLHCKPAKPLPKVLWRYKGKEPATLGPNTRLFDWIPQNDLLGHPKTKAFITHGGTNGIYEAIYHGVPMVGVPMFADQPDNIAHMKAKGAAVEVNMNTMTSADLLGALRTVINDPSYKENAMRLSRIHHDQPVKPLDRAVFWIEFVMRHKGAKHLRVAAHDLSWFQYHSLDVIGFLLVCVASAILLVTKGCLFFYQKFINTGKKIKRE

SEQ ID NO: 6931 - protein, 693 aa, Bos mutus
MLNKIILLLSLQISLLGTTFGGNVLIWPMEGSHWLNIKIIIDELIKKGHNVTVLVASGALYITPTTNPSLIFEIYEVPFGKERIEGVIKDFILTWMEHRPSPLTIWRFYQEMAKVIKDFHMVSREICDSVLQNEKLMEKLKKSKFEVLVSDPVFPCGDIIALKLGIPFIYSLRFSPASTVEKHCGKVPYPPSYVPAILSELTDQMSFTDRIRNFISYHLQDYMFNTLWKSWDSYYSKALGIHWLNIKIILEELNQRNHNVTVLASSATLFINSNSDSPVNFEVIPVSYKKSNIDSLIEHMIMLWIDHRPTPLTLWTFYKELGKLLDTFFRINIQICDGVLNNPKLMARLWKSRFDVLLADPVTICGDLVALKLGIPFMYTLRFSPASTVERHCGKIPAPASYVPAALSELTDQMSFGERLKNTISYPLQDYIFQSYWGEWNSYYSKVLGRPTTLCETMGKAEIWLIRTYWDFEFPRPYLPNFEFVGGLHCKPAKPLPKVLWRYKGKKPATLGANTRLYDWIPQNDLLGHPKAKAFITHGGTNGIYEAIYHGVPMVGVPMFADQPDNIAHMKAKGAAVEVNINTMTSADLLNALRTVINEPSYKENAMRLKRIHHDQPVKPLDRAVFWIEFVMRHKGAKHLRPAAHNLTWYQYHSLDVIGFLLACVATAVFLVIRCCLFSCRKFGKTGKKKKRE

SEQ ID NO: 6932 - protein, 362 aa, Hyalangium minutum
MGAPRFLFYAVNGLGLGHVTRLLSIARALKRLSPEAEVLFLTSSEADHVIYREGFAAVKLPSKTIRERCGLRKGSYLKLVQTVTWNTLAAFDPDVLVVDTYPTGSFEELIPALRWRQKNVFVFREQREESAGSELLQASLRLYDRILIPHEDISVVGPLPELAKARAVGPILIRERSELPSRAQARQALGLPQDATLLYASFGGGGDPEGARALTLTAQVARELPGVRLVVGAGPLWREQPPALEGAVVLQGRYPAIDFLPAFDAAVTAAGYNAVHELLYAGVPSVFVPFERMVDDQEKRAREVAAADAGLVCAPLTREGLTRAVRELMNPATRERLSAAARKRVECNGAEPAARALLELLA

SEQ ID NO: 6933 - protein, 518 aa, Drosophila grimshawi
MNLLHLCLILMACLCHVWGYSYLMISHTAANSHFYVGQALAKGLVAAGHEVTVISPFPQKNPLKNYVDVPTPSSISVMAVHKNKILDIVKIPILFRLPAMHGVGISMTQSLLEEHSVQSLLSQNRTFDAVICEVFMNEAHFGFAEHFNAPLITFSTMGASSWTTDLVGTPSPPSYVPHFLLQFGDHMNFFERAHNLLFILYQGAYEQCVYFPKQEQLYKKYFPNNKQNFYDMRKNTALVLLNNHVSLGFPRPYAPNMIEVGGMHINRKRQQLPQNIEDFINGAQHGVIYFSLGSNLKSSALPLEMREALVETLRNLKQRVLWKFEEPNLPGKPDNVFISDWFPQDDILAHEKVILFITHGGLLSTTESIYHGKPVLGIPFFGDQFMNMARAQQSGYGLTLRFTELTAETFKNSINKLLSDPSYTQKVHDMSVRFRDQHETPLERAVYWVEHVTRQKGARYLRSASQDLNFIQYYNLDVLIMIIGGLGFVIFTFIYLLMALIKVIAKKIGGKRKKAKRN

SEQ ID NO: 6934 - protein, 529 aa, Oreochromis niloticus
MELRLSACILLVLCATWSANGGNILVWYTEGSHWINMKPVLETLVDRGHQVTVLVPSSSLYMNANEPSRFRYEPFNVSFSKDAMQDFLEEFLRFSMYEIDYMSYWEIYIRFSEIIKTQMQFSIQYLDGVVKSEVVMKKLKEGNYDLLLADPIYRGSDLVADILGIPLVFSLRFSVAYNWERHCGQMPAPPSFVPGAMSKLTDKMDFSERVWNFLYYALQDIAMSHIFGKVDRYYSDVKGTPTSACELMSKADIWLIRTYWDFEFPRPFLPNFKYVGGIHCRPAKLLPEDLEEFVQSSGDDGIVIFTLGSMIKNVTKEKANMIASGLAQIPQKVLWRYRGEKPATLGANTRIYDWIPQNDLLGHPKTRAFITHGGTNGIYEAIYHGVPMVGIPMFGDQPDNMVHMKAKGAAVILNLNFITTEDLRDAINTVINDKSYKENAMRLSSIHHDRPMSALEEAVFWIEFTLRNKGAKHLRVQAHELTWYQYHSLDVLGFFLTIVLLLIFIFIKTCSFCLHRCCVRKGKTKRKAE

SEQ ID NO: 6935 - protein, 754 aa, Ooceraea biroi
MATEIKVQVDKLESEAEWARWKWQMSMLFEQYDLVSIVDGTRPCPPQPPTIATADVVKEFKAWKSNNGRAANYIMSALNKQNAELVLSCTTAHECWQKLCSRFERSSTQRRDMLFQQFFKAEHNKIEDVASYIARIQKIFIDLNSELQKQHRNTLDESVLIGRITSSLGTEYNEFQNVWEVIPEEHQTINLLTEKLCAIELRNRSTIVSQSEAVAFEAKSTAGKKNNDLQVRNKRIQALKQKTKCAICHVKGHWAKECQQNKTSQHTSDGTLHKRGHELVIVTTAPLKDPTLKNYTEIDVSYGFSIITEYNDAKWKISQMESCRQVFTITTEFMGTIWDNPEFKKIYRRDSGEKFDAIMIEPISDLSLYSMAHRFNAPLIGLTPMGFHNFQRYIFASPMLPSHPSNWEVNTLVEGYPSFWQRLQNFIDVWGYLYAWSHHVVMARKRVEKYFGSDTPDPMDIAKNMSIVLVNENPLFAYARPEQPNVIYFSGSQIQKTPPTLPKDLRRFLDDATKGFIYVSLGTTVSCHNLPTEIMGNFIEVFSKLPFKIVWKYECDEFPGKLDNIFISKWFPQQGILAHPNIRLFIYQGGLHSTEEAVHYAVPLLGLPIMFEQASRIQRLASLGAAIFLKLNELSKERLNTAIHQILNDKSYKERMAYLSKLSKDQPYDSFENAIWWIEYVMRHKGISHLRFSESDKPWYQRYDMDIIGFLAVIAFIMSLIFLYTLFRILRFCYGYYHLLYKNVQYPNTKLKMQ

SEQ ID NO: 6936 - protein, 995 aa, Ctenocephalides felis
MKIILLLGCLLLAMLQVNGAKILMVFNSVSKSHYILGQALGIGLADKGHQVTMISPFEMKSKHPNYYEIVLHEVMATSKQTIFGNMYQNRNISFIQLIKQIQIDGLFAANLTLHDPQVQKLVHSGEKFDAVITEIFLNECLYGLANHFEAIPIHLCTVGSSIWTDFLMGNPNNPAYNMNQLLPFTLPMKFHERLINTVFSMAFMPSLWLRLSDQHAAYESYFKPLYKGPKDEFPHLQDLLFNFSLLLVNDHHVISEPKAMMPNIVNVGGLHIKESPLPNHLQEVLDAAVDGAIYFSLGSNVKSSELSQTTKNAILKTFSKLKLKILWKFEDSNLQNKPDNVVIEKWMPQQAILAHPNIKAFITHGGLLSTLESIYFGVPVLGIPVIGDQMMNVARTENLGFGIGLKLDDITENTLTEALNKILYEPRYQLRAKALSRIFRDDPQSSLEKAVSSVEYVIRHKGARFLRSPALELPWYKVLLIDVMIALLLIVTIALYVAYFITKKALCVFRKYCVGSHSVYFKVTMISPFKLNKPHENYSEIFLDDASESLLAKILNTNILTASKQPIWERLPKMTQIGVDGANRTFYHPKVQQLLKSGKKFDIFIMEAFLNECLLGIAHHVEAIPIATSPAGSSTLTNKMVGNPFNPAYDLNFILPFTNPLSYKERFLNTAFKILDELYYRIHIHEHDKLYEKIYHELLGKRPENRPHISSLVTNVSLVLINSNVVVHNSRASVPNMINVGGLHIKTDAKLPEDLQAILDNTKEGVVYFSMGSNLKSSKVFLDKQDAILKTFAKLNQTVLWKWESKDLSNKPDNVIIQSWMPQQSILAHPNVKLFITHGGLLSSIEALYFGVPLVGIPVFGDQHMNMARAVESGYGIKLDLNNISEDTLTETLQEALNNPRYLQRARYLSNIFRNDTQTPIEKAVSSIEYVLRHKGAPFLRSPAVDMPVYQQALLDVVAGLLAITILFFIIIGWFLKKIVGLFTRPKININKKHN

SEQ ID NO: 6937 - protein, 523 aa, Xenopus tropicalis
MAAGRKSLTLGLLVQHFVLLQGAKILTVTFLGGSHYLWMDGISRILHNHGNEVTMFRQIADGLLPDYQMQESPYRLVTWSLDENYLKEYGEFFRDSKYNFKGSDELSSYLGLFTHLSRQCKMIFNQTSILNLLKEEKYDIAVIDSFNPCSFLASEKLGIPFIATHPFAVKSPWHSGIPNLLSIMPAYQSQLSDHMNFFERVKNVFFYIDSAVLEYKIHSLFDDVIEEHFPVGSRPSFAELYKKAALWMYNTDFTIEFPHAFFPNVLYIGGVLAKPAKPVSQELEHFISQSGEHGFILVTFGSMIPSNPLTEFVKEMNDGFAKIPQKVIWRYRISEWPKELQLAPNVKIMNWIPQNDLLGHPKARLLVTHGGVNSVQEAIYHGVPMVAIPLFFDQFDNAVRIKAKHLGTFIPSDQLKAEKLANAIRHVIEDKSYKNSAMHFSLIQRSQPFPKEQQIVRWVEHIVTVGGANHLIPYSYQQPLYQQYLLDVILFVCVCLIGACYITVKVLRLFIQRLCSVRKVKQN

SEQ ID NO: 6938 - protein, 529 aa, Drosophila mojavensis
MKLQSLSLVLLCCALAALPQARPANILAVYAFPGKSHFMMHTALIKELVESGHNVTMITAFSLSAQQLGGNYTELLIEPVYDFWHDVKLSFGVQHLFDLTQMKNYDFLKMLEIIGLKTTEHALRQPKVQALINARQTEGVFDLLLAEQFYQEAFLALAYKYNIPIVTTSTLGYENHMSQMMGLITPWSFVPHGFMPFTDRMSFMERVHNTYVSLYEDFDRLLSYFPKMDAITERYFGQVLAEVPKVRHMETQISVMLLNSHAPLTTARPTVDAMVPVGGMHIYPPKPLPADMQSFLDAATDGAIFFSLGSNVQSKEMPRDMLQLFLRVFGSMKQRILWKFEDESIDQLPPNVMIRKWLPQADILAHPNVKVFITHGGLFGTQEGVHYAVPMLGMPFYCDQHLNMNKAVLGGYGISLHFQSITEDLLRDSLLQLIHNASYAENVQRVSRIFRDRPMSPRRSAVYWIEYVIRHKGALHMRSAGLDLRWYQFYLLDVIAFLGVLALAALFLLLLAIRLLQGSGRKQRKAKTN

SEQ ID NO: 6939 - protein, 486 aa, Ceratotherium simum
MSMKWISVLLLLQLGCYFSPGSGGKVLVWPTEYSHWINMKIILEELVQRGHEVIVLTSSASILVDPNKLSAIKFEIFPTSITKHDILGFALKLTNKWTYDMPKDTFWTYFSLMQEIFWEYSDIMEKFCTDMVLNKKLITNLQESRFDLILADPIGPCAELLAELLKIPLVYSVRFSPGHKIEKYSGGLPYPPSYVPVVMSELSDQMTFMERVKSMIHVLYFDFWFQTFNEKRWDQFYTEVLGRPTTLSELMKKAEMWLIRTYWDFEFPRPFLPHFEYIGGFHCKPAKPLPKVIWRFDGKKPDTLGPNTRLYKWIPQNDLLGHLKTKAFITHGGANGVYEAIYHGIPMVGVPLFADQPDNIERMKTKGAAVRLDFNTMSRTDLLNALKTVINDPSYKENAMKLSRIQHDQPMKPLDRAVFWIEFVMLHKGAKHLRPASHDLNWFQYHSWDVLGFLLACVATAIFVITKCCLFCCQKFSKRGRKEKRE

SEQ ID NO: 6940 - protein, 929 aa, Tribolium castaneum
MKFLSLLLFLSVLHNNVESSKILVISSMPAHSHYILAFRLAKELADREHHMTLMSPYSQKTPVKNLKEVSLEDTIPWVNEFKKSLFNSPKTLLSNVQENYVLGGGTTEYALNNTNVQKLLNSGETFDVVILEHFLNEALLGIAHHFNCPVILLEPIPTSKKTNYLFANPSPSTYVPDLMGTFTKRMSFWQRLQNFISNNLDAVLREFIYLPVHRKLFDKYFKTGINLNVLLHNISLMLTTSHPSVNDAIPHTPNMVEIGGYHILPPKQPPQDIQNYLNNASEGVVLFSMGSNLKSKDLTLNVRKAILNSFSKIRQKVLWKFEADLPEAPANVRIMNWLPQQDIIGHPNIRAFVTHGGLLSTIEAVYYGIPIIGIPVFGDQKSNIAAAVSNGYAIEVPLAELTEEKFSSALNEILNNPNCFDTMSSLAVIFWLVCGVHSEKILMVSTVPTYNYFNQIFRLVEELVSRKHEVTFINPYPSIVELENLETINIDLSKKLEQVMVNRVNYVNSGAIARTLNAFDASFWTTEHVLRDKQFQKLLNSTKKFDLVIVQYFLNEAMNQLGRRFNAPVIYLSPVGETFRTNLFFARPSISSYIPNDFSSFPVQMNFWQRTENLVTNIVIDLLREFIQLPKQHSLALKYIGSGSHLYNVSLMLCNAHASVHNTFVQTPASIYIGGYHIRAPKALPTDLQNYLDSAKHGVILFSLGTLTKSSYLKPEALKSILGAFSRMKQNVIWKYEGTLSNASSNVKTVNWFPQQDILAHPNVRVMITQGGSSTMLECVYFGVPVVGLPMHADQNTNIARATSHGYAAKVSLNEITENAFYETLQEVINNPKYKENVQKRSKLMHDQPLKPLDLAVYWIEYVIRHKGAPHLRSAGLDLRWYQREMIDVIAFLTACVTAILAAVYLTIRKVICGRKSGKKPTTLEKKIN

SEQ ID NO: 6941 - protein, 537 aa, Wasmannia auropunctata
MRLIIGISPIITILWILITSNLVWSKRLLIITPAPSYSHQIVFRAISLALNKRGHEIVTLTPNILNDPSITNYTEIDFGFIYEKIDDTDLSQTRWNLTQLAGLKTRLLKLGHNIAEDVLSHPDLIKYYANGTDVQFDAVIAEMIMTPAIYMLAHRFNAPLIGIMSMDLQNCHRFTLGSPVLPSHPSNWELENLTGLNQPFWRRLVNFVNTWWSIHSWFNNFVSKQQKIAEKYLGNDIPQIIDVAKNMSLILINQEPLLAYARPEVPNIVHFSGLHIAKTPPSLPKNLKNFLDGATNGFVYMSLGSNTKSKLLPKKILDVFVNTFTNLPYKVLWKFENDSFHVPSNVFISKWIPQQNVLAHPNIKLFIYQGGLQSTEEAVHYAVPLIGMPFVFDQVYQVMKMVSLGVAKYLDVVRLTTSELRDTILEVVDDKGYKDRMLALRALTKDKPYDSLENVIWWIEFVMRHNGAPHLRFNGVDTAWYQQFDLDIIVFLTITSFLVSCVILGTVGWASKQVYTYYDIGNRCTIRKWIGSKMKTA

SEQ ID NO: 6942 - protein, 533 aa, Maylandia zebra
MQVPTYPLLLLPLSLLLLHSVAPVHGGHALVFPGEFSHWLNMRTIIEELVKKNHSVTILVPDASPTVNYNNSRDAAKFNFLVFKVPYSKEEYLSPIEEFIHFSMHDPSMLQVAMKLIDFMGRSLDFGRQQCDGILKNDQLMATLRDAAFDVVLLDSLVMCGDLVADVLGVPLVISLRLSLGSVFERHCGHAVFLPSYVPVAPVLYNDHMTFTERLINLVTYVASSVLTELGWKLTMDKYYSEIKGTPTSVCETLGKADVWLIRTFWDIDTPRPTPPNFKHVGGLNCRPANQLPEDLEAFVQSSGDPGVVVVSFGSMVPNLTMERTNVIATALGRIPQKVIWRHRGEAPPALAPNIKISDWIPQNDLLGHPKTRAFVTHGGTNGLYEAVFHGVPLVGLPVFGDQSYNLNRMSHLGTAIVLDFNKVTAEELAEALHAIVNQPSYKTSMQRLSAVHRDQPVTPLNTAVFWLEFVMRHGGARHLRLASHNLNWFQYHSLDTGAVLLITLMTAAALCWVVIRCFLQQCRRRGGREKED

SEQ ID NO: 6943 - protein, 519 aa, Drosophila willistoni
MRLVFPIGFLLLASLANVWGYSYLILAPTASKSHYTVMSSLAKGLAAAGHEVTYISPFSQSKPVKNLTEITTPNVIEAMKVSKSKILQNTKLSIWKRYPVILAMGLKITNTFLEEPKVMAFMKEKRTFDAVIVEVFMNEAHFGFAELFNASLITVSTFGASTWTTDLVGTPSPPSYVPHLMTELKDRMSFLERAINLAFISFEFVYLKWFSMPRQHSVYHKHFPDNKLDFHEMQRNTALVLLNSHVSLNFPRPYAPNMIEVGGMHINYKTKQLPKDIEEFINGAEHGVIYFSLGSNVRSKDLPLEKRKAIVETLKGLKQRVLWKFEESNFAEKPNNVFISDWFPQDDILAHDKVIAFITHGGLLSTTESIYHGKPVIGIPIFGDQFTNMARAVQSGYGASVKYSDLTYERLHNAIKAVITDPSYTEKVRAMSRRFRDQKETPLQRAIYWIEHVSREKGAQYLRSACQDLNFVQYHNLDVFALFFGILLSILVALTILTNILVRFLKTKLGNSKVKHKKL

SEQ ID NO: 6944 - protein, 541 aa, Daphnia pulex
MSTQFSAKCLLVVLSAAIGLSAAHNILVLTPITSPSHSNVFKPLVAELANRGHFVTYWNGLLQSDKSSSVIQSNQTTTNSSNLRLLTSPNLVRLNNQHQIDFNDRDSPFRLLFRMQATIERYCRAIYEDPVFHQLMNSKERYDLIILDGFSNDCTLLLAEVFDVPFIYLNCFPPSPWLLYAIGSPLALDHFPNPAGTRDKMDLWQRTFNVVTSVFAVYFHRWLVLPEIDRVASKVLRKNNLTSVAAIENRYLSLILSNTHFSINFQLPTSPAVVEVGGLHLGEARNEIPKDLVSFLDGSGDAGFIIVSFGSMLRGDGLPKDFRRLFLSVFARLPQRIVWKWEDQSKLGDGEELIPSNVKTISWLPQKELLSHRNARLFISHGGLLSKQETVFHGVPAIFLPIFADQPINAQKAEDDGYAIRLDLGKLTEEMLYNSIQAILTNPRYAKRMGQVSALMHDQIDNPMDRAIYWIEYVIRHQGAPHLRNASRDLFLLQRGLVDVFLVILAACLLMAYGAVYLCAAVCHSRYGSKKLAVDLNKKGE

SEQ ID NO: 6945 - protein, 491 aa, Nematostella vectensis
GAKIVGYPIMAGSQYIGMKRIAQELAARGHEVTLLVSSIQKFTPTEGITHAVYQVPVNKSFIENLVSRTIKSGFKALYGKNSVGAAQEMFCKATLDATDIIDPMKKSDLIITDSSMMCGAVLAEYLNITRVDYCSIAPSLSTMYQYHGPSFPAYIPQLMSGNPARMNFLQRVKNTFNYVAGQLIARVVMFPKFDEIKQRYGINPESSFAEAIGKAQMVLFLYDPAIGYAFPLLPGHKLIGPVNIQPPRPLSSEFQQIVKKSDGVIIVSFGSNVAAIANKEVDVLTEAFGRLKETVFWRQKGKRYIPANLSPNIKTVEWLPQNDLLANEKTRLFVSHLGQNSLYESGYRGIPLVGVPLWGDQFDNAVLVKDKGLGLVVDIHTVTADEFYRAIRRVIDEPGFKENAARISRLMRDRRRSPTQEAADWIEYTLRHGNLTHLRPASVHLTWYQYFLLDVMLFMGVVLLSVAMVIRLVFKLICWFCCRKQTKTKTQ

SEQ ID NO: 6946 - protein, 479 aa, Haemonchus contortus
MLLILTCTFLTISDTAKVIFNGMHSSDSHIASMLPLATRLAKEQHVVHFLETNTKPSHFNYPNNITFTHVELQKDPFFVSCFLKVMWIKIFSSIEFPRIWETGDKAFVEMLDQHPEKITKVMNESWDLVVADELFAVASYALAMKAYNNRKPFVTLSTCIPTNLIKYHFALGTPFSHRPSMYHRLAVPYRIEQFASRLYSVLHETYQAIRTQHVTRHVAVKGLHKVGIYNFDFSKLATHSAYHFLEDIDSLVYPAPVSSAIVEVGFYCRKAKELPNDYDEFINDPTSKGTILVAFGSNIIWDYAPPDIMAAMLGAINRLSDYRVVFSYNGNMEHVRFLDSHVKVTRWAPQKDILAHRKTVVFVSHGGLKSVKDTICGAVPVVYIPLFAEQSHNCEMARAAGFAEVLHKSRLTADVIERAVRKVAETPQYKESVIRINTFYRDRIMPSLDIAEFYVGTWAEVLLFGIKGLDIMFADIVTV

SEQ ID NO: 6947 - protein, 535 aa, Caenorhabditis elegans
MSRVLCVLLFSVLVSHVESYKFLVISPVYGYSHMKFMAIIANQLADEGHQVTYFQPFVIEAYLDHKLLNNSLIDVINYWHDEEGRRHIPPSNDLHDAWYSSKYQSALSAVFDMPQFLVSAWEHMCRKIFQDSELHKILKDKDFDVVIAETFDFCGLYLADYIQSKSIVSVFTGSRLIAITDPLGEPSSLHYIPAPSSDNFGSSASIFDRINDLYHKYVFGSGYSIIFDWQYNQIARLTHGKVRHWKKILKDVTYHFANSNPYLDFAAPTISKVIPIGGYDMDKSIQTKIPDEFDSILNERSLTVYVSFGSMVKAKFMPESYKEAMLRMFTANTQNITFLWKYEDPTDIFFKNRLPKNVILKDWFPQRALLADKRVKLFITHGGLGSTMELAYAAKPAIVIPLIAEQPDNGKMLARHGSAEIYSKHDIPHWEKLNRLLQKMLQHSSYQKAADRLARVLSNQPIKPRELMIKHSEMAAMFGKMPELTPSVQDMSIIEFYNLDIIFLFLIISIGTSVLLWKFLYFVLTDSGSFKSKED

SEQ ID NO: 6948 - protein, 428 aa, Vollenhovia emeryi
MAEDVLSHPDLAKYHANGTDVQFDAVIAEMIMTPAIYMLAHRFNAPLIGIMSMDLQNCHRFTLGSPVLPSHPSNWELESSTGLYVPFWSRLVNFVNTWWSIYSWFNNFASKQQQIAEKYFGNDIPHVIDVAKNMSLVLINQEPLLAYARPEIPNVVHFSGLHIAKTPPSLSKNLQAFLDDATNGFVYVSLGSNTKSKLLPQETLQIFADAFASLPYKVLWKFENDSFSVPPNVFISKWTPQQGVLAHPNIKLFIYQGGLQSTEEAVHYAVPLVGIPFVFDQVYQVMKMVSLGVARYLDIVQLTTSELRDAILEVADDKGYKDRMLALRALTKDKPYDSLENVIWWIEFIMRHNGAPHLRFNGVDTAWYQQFDLDVIVFLAITSFLVLCAILGAVGWVSTQLYIYFDLSNRCILRRYIRRIMNEKTKSA

SEQ ID NO: 6949 - protein, 497 aa, Ancylostoma ceylanicum
MRCLALIFLFVKFVQPLSIVVYLSLVGKSHVDFVSALINILVERGHEVNPMNFCACSGIFDKSGPPTGSAKHACHNKWDTQSKRDGLASGEPARFLSRKKYDVGLTSDYDFCGYILFHQAGIKTVASFTATNLFAHQAFSLGLPSPPSCVTGNFDKSSGSPRPDLFERTVRLLKSARFTFVERPEFEELGNGLIREFFGKGFPSTGELLRNSDLVFVNTNEIIEKPRPLSHKVKYIGGIALRKPKPLPDHLGILLSNTTKNVIFSFGTQVPTEKIPLHIRKSLVKAFVQFPDVTFFWNYKMQGDEGDMFANAYNVKLMEWLPQTDLLNDPRVVGFISHMGLNSFLEASTAGVPIVAIPLFADQTHNAHNAAYRGTTVIVKPEQLTTESMKRALEKILYDPRYMENAKLISQMMKGKPEMGREKFVEWIEFAAANKGLHRLLNLPGNDIGVLEYYCIDCMLLLLFAFFAALMFIWKITSKFVRIVRKEDISQGKLKTN

SEQ ID NO: 6950 - protein, 395 aa, Anopheles darlingi
MAARILIVTGLLAASCCSASDILMITMGGTKSHKIPFLELAKGLIPRGHNVTFLNGFPADFTFNGLQEVTPSGLVEYIRNYTNWDLLGARMRGDLPLSVWDVFRFPWQICDATLEDKETLDLLGRKFDLVILDGAFPECALGLVYRLGVPFMYINTVGFYTGTMSLAGNPTPYSTTPIFYRPLTDDMSFIERLSNTIACIHCKTASPLPKDLEDFIAGSGESGFIYVSMGSSVKAANMPDHLRKLLVQTFARLPYRVLWKYEASPALLTDLPENVKIGRWLPQQDILGHRKLRAFITHGGLLSMFETVFHGVPVVTMPVFCDHDSNAAKAVADGYALKLDLETLTSERLVKAIHKVIHDPKYRKAANNRRYYKIVFNASIVFAREYVGERFLTPV

SEQ ID NO: 6951 - protein, 519 aa, Anopheles gambiae
MRISWYSLVGFLLSLGVTVNGANILCLMGVASPSHHIWNRAIMDGLARAGHNLTILSADVEKNQPNNVHYVHLEEIYPTLYSGPDSIDLMEMANENVFKSVVSFYRDFVVHECAGTLKSKGLQRVMDYPDDFRFDLVLHDFTCGPCLLGLLHKFNYPPLVSVTAFNNPPYSTEVIGGHKFYSYVPFYSLSYGTDMNFFQRVHNTLLCLTDVVYRNYVSNPRIDAMMREYFRYDDLPYAPELSQRTKMMLVNAHYSIDFPEAAPPNLIPVGGLQIREPAPLPADLEQFVNASRKGAVLFSLGTNVRSDQLDSGRQRMIVEALRQLPDYHFLWKFETELGIPLPKNVIVRPWMPQNDLLAHPKLKAFITHAGLLSTHEATWYGVPIVGIPFIADQHRNLERCVRSGIAKRVAFQTMTTEELRDAIRDVLEDPQYRTNMAAQSALFRDQPEKPLARAVWWIEWVLRHPDATQLQSPVLKLGFVRTYLLDVALFFAAIPVLLVFLVKRWLRKSRSVSEGKKRN

SEQ ID NO: 6952 - protein, 534 aa, Drosophila virilis
MASATNRILLLAIVAAVFISGSQSANILGVFTSLSPSHLIVQMSMVKVLAENGHNVTVVTILKPPITHKAINVVQVPLSDEDQRMMSATIGKMVASDNSNMVISMFRVMGQMKLMFEKMRDAMMDQRVKNLYENKDNKFDLVMIGYFLNNYQLGIAHKLKVPVILAATMPPNQLFNKMLGNPQLDSHVPALPGISVKGQPMTFSQRLKNYITTCAMGIFMWILENNDAKDYKKVFGDDPNMPPYEDLAKNVSLTFFSSHAPSEGPIRPNVPGIVEVGGIQIKDKPDELPKTIADFLSDAKDGAILLCLGSNVKGAHLKPDTVQNMFNVLSKLKQRVIWKWENLYKTPGKSDNILYSKWLPQDDILAHPKIKLFITHAGKGGITEAQYHGKPMLALPVFGDQPDNAEKMVKDGFGLSLSLATLEEQPFHETIVQVLNNPQYAQKVQTFSSLYRDRPISAHESVLYWTEYVLRYNGAPHLQSPLVHMNYISANNLDVYALLITILFVFIYVSKVILTKLYRKLFGKAQKTKKIKKS

SEQ ID NO: 6953 - protein, 522 aa, Bicyclus anynana
MWQPVLFVLAILSAVCMSEAYRILLTVATPSKSHGILAEGLIRHLTEAGHEITYIFCIPPEKPLPGVKLIDVSDNMVLPVNIINLKNILDKTSDLSEATGFVPLILEQSKRTIEHPNVQKLIKDTSQQFDVVIMEFLYNTLYAGFSGLYDCPLIWFSPTNPCSSLFELIDEPTNPAYSVGIWSTNVPPMSFTQRFEELISYLNNKLIRIFWSSRFDNEEYEKHFAPLIRERRNIAPSFETLAYNGSLVLSNSHPSMSGAVRAPQNFISIGGFHIDRNVKPLTQEFQKLMDDSKYGVVYFSMGSNFRSKDLPSEIKRDLLSMFGKLKQTVVWKFEEDLPDRPTNVHIVPWAPQQSILAHKNCIIFITHGGLLSTTETIHYGVPIIGVPVFYDQFVNVGRAVSMGFAKRVDLTYEFAKDLELAILDILGNPKYTTKVHELSEIYHDRTVPPGKELVHWVEHVIKTRGAPHLRSPGFMVPWYQKLYLDLVLVVLIIVLLLKYTFGLLLYKLKKTNSVRSRKEKNK

SEQ ID NO: 6954 - protein, 520 aa, Trichoplusia ni
MGVFLYLFTCYILFTQSNEAARILVVIPTPSISHQVVFRPIMQELVKRGHEITIITTDPAYPKGGAPANYTEIDIHDVSYGIWKNSFMVANKGDKGDLYNQMKMIVTLFNVIFEAQVRDEAVQRLINDKTQKFDLIIAEGCVKPALGFYHIYKAPIVIMSSFGAFYDNFQTIGAPSHPLLYPMFVRLKLNNLTMWEKMTELYNHYRLESMFYENLLESDQLLRRLFGEDKPSLMEVYNHVEMLFLYENPVFVGPRPVPPTVVYMGGFHQNAPKELPKDLKSYLDSSKNGVIYISFGTNVDPTHLPADRIEVLVKTLSQMPYDVLWKWNGDELPGRTDNIRISKWLPQSDLLRHPKIKVFVTQGGLQSTDEAITAGVPLIGVPMLGDQWFNVERYVYHKIGVRLDIDVMTVDNFRSALFEVINNDSYRQNVVKLRTLMRDQPQSPLDRTIWSLEHLLRHGNAKHLRSPTANISWWDYLELELVFTLLAVLFAAISLVVLAVYSLYKYFVRNYVAVIKVKHS

SEQ ID NO: 6955 - protein, 520 aa, Trichoplusia ni
MGILLGFLTWYLLLTNTNEAARVLVVVPTPSVSHQVVFRPVVQELAKRGHDVTFITTDPAFPKGEAPANLTEIDVHDISYRAWKEALMKATSGNQGDLYEQMKTILSMAGGVFEDQYNDEKVQHLIHDKNQKFDLIIVEAFSRLALVYQHVFKAPLVLMSSFGATFDNYEALGVPTHPLLYSSVIRQRINNMTTWEKITETYQYFKIHSLFNEILVEEEKLLRKLFGPDVPTMKEFYDRVEMLFLNENPLFTGIRPVPPNVIYMGGIHQKPQKELPKDLKSYLDSSKNGVIYISFGTNVNPTLLPADRIQVLVKAFSQLPYDVLWKWNGDELPGRTENIRISKWLPQSDLLRHPKIKVFVTQGGVQSTDESITAGVPLVGIPMLADQWFNVEKYVTHGIGARLDIETITVENFKETLLKVIKDDSYRQNTVRLNNLMRDQPQTPLERTIWWLEYLLRHGSAKHLRSPAANISWAEYLELELVLTLLAGLLTAISLVVLCIYYLFKFFVKNGVSNSKVKRS

SEQ ID NO: 6956 - protein, 532 aa, Caenorhabditis remanei
MRMLVLSALLLLLSLNGVNSYKILVYNNLFGHSHIKFVAAVADTLTDAGHDVTVLMPVIDESQRNKTALKSTTRQIFIDADEEVAEMVGKTDEFLSSLWTSETSNPIKMWWKSGHLINLFGKQCNKVMKSKEILDQLRDEQFDIAITEPFDSCGYGIIEYLQIPAHVSVLSCARMDHVSDAIGQLIAPSYVPSTQSVYGDRMTMYERMMNFLQYLYGRDMFSAIGDFEAENAKAILGIKRTWREILPESAFLLTNNIQILEFPAPSLDKIVSIGGLTVNTNKEALKLEHYFDTMVSMRQKNVIISFGSVIKSKDMPDEYKKTLVQLFELMPEVTFIWKYEDLADKKHTCGVLNINRVEWIPQNELLADSRVDAFITHGGLASVTELAMMGKPALVIPIFADQTRNAEMLKRHGGVEVLHKTDLANAKKLEKALRKLIYDPSYKKNAQHLAERLQNRPTNAKEVLVRHVEFAAKFKKLPLMDPYGRHMTFIEYYLLDIMAITAAVVTVVVYVVFTAFRFVIRKCCGPKKVKFE

SEQ ID NO: 6957 - protein, 518 aa, Photinus pyralis
TSLILNPMFSIMSVFIILLWWILRSDGARILAIIPTPSFSHNTALQPLWRELSLRGHSVTLLTAEPIGDPQLVNLTEVDLSFSYKTMLKNLQEKIYTNRLEMYKFGYLRHAEVCDEQLGHPALQAIIRNESEWFDLLITESSRLPVLAFAHRFRCPSIGVTVLDVYPTMHSLLGDPTHPLVYPDIWLGLGDCTSIVGRIRCVLYDLGTSLLQTRVLFPLYDQMIEKHFGEGYPPIGELVKGISIQFVNTDPVLHKVRPLVPGVIQVGGTLHRLSRDPLRQDLRSVLDKATNGFIYFSLGSYAKSSSLPPKVLEVILETFAEIRYTVLWKFEDVLNKTENVITLKWVPQVDVLGHPNIKLFITHGGLQSINEAIHFGVPMVGMPIFADQQQNVHLIVSRGCGLSANYRNLDRAGFEKTINEVIDNSRYATAIKTLRDRVRDQPMTGLERAVWWTEYVLRHKGAGHLKSGAVDVAFYQYYLLDVLTIVIALFTLIIFGFYFVLASFFRIIRLSCYFLCKN

SEQ ID NO: 6958 - protein, 533 aa, Toxocara canis
MSRNISIIGGRLKPFQLSENDSIGCQELLVRLSKPMIFINIGLAVFISLGIQASEILLGVMPQGKSHAGSFMPLLHELIQQGHNVTIYMDNYGMNTLGVRVNEWFINVTDHKDPYNDTDFSRGIWKNRFTFISQVKPFYYGALSCKNVLNDHRTDFERLVNYPWDLILTDSLFAVCAYGIAELSHAHHIVMHSTDVESGYGTSKGYARNYLMMPRYFLEFDYADVDITHFNDRFWSAYEWFGTWMTFATVSNSHMRNALSPVISNFDISKYYAESSMSFTDMPLHLYVPMATNNELFIYGAYCRSYRSLSGEIATFVDDHQSKGTILIAFGTIVDWSIAPNEKLNTFIEALNQLTDYRIIWAFNGKELPIKKHIKFVKWLPQNDILNHKRTKLFITHGGLKSIKEATCATVPMLIMPMFAEQVRNSWLTRHHGFGKMINKVNFTSASLVESIREMITNPDYKNNVKRLRRFYDDTPIPALKEAAFKINRLLKYGGRMPDYFYTRSTKLSFFTFLNIDLLVLFPALLIFLLSIR

SEQ ID NO: 6959 - protein, 418 aa, Dufourea novaeangliae
MASVACEAGLNHPDVKDLVKSGEQFDVVLTESFNTHCFFAVFHRVDAPFIEISTHQLMSWTVDELGISNEASYIPTLFSHVPRPMNFFQRTWNVVAMMIEWTVANTLFKWNAQSVAEKTHGPGMFDLKEKSRNVTLMFVNTHYTLHGAQPFPPNVIEVGGLHIPRKTNPLPQDIAKFLDDAHEGVLYFNLGSVVKMSTVPEDKLTILLNMFASIPRKVIWKWETDDLPHKPSNLLVKKWLPQFDIMNHPNVKCYFGHGGLLGLSEGVHTGIPMILMPLFGDQYQNAMAARARGVAIVLKYSELNERDLRHAVDEIFNNTRYRENARRLSKAYRDRPATPLETAVWWTEYIGRGNGVPYVRTAGANMSWCTRNLVDVYTFLFTVLLTIIYVLYRLAKYLLLVRKKSKDIDQRASTKKRD

SEQ ID NO: 6960 - protein, 322 aa, Caenorhabditis brenneri
MLGLTAYHFQFGLLFDKQYEQAMRLTGGKVRTWQEILQKSTFFLTNSNPYLSFTTPTISKVIQVGGCTIDTPKSTKLDEHFDQVLSLRKNTILVSFGTVIQSSDMPAHFKKGLVETFEKMPETTFIWKYEEDDKELKKKLPENVVLSKWVPQPALLADSRLDVFVTHGGLGSTMEVGYAGVPSVMIPIFSDQGVNAEMLSRHGGAVVYSKFDLPDSDKLVKTFRNILSNPDYKKNANRLSSILHHQPMDPKQILLNHCEFAARFGQVESLEPHANKYNFIKFYCLDSFALVVFVLSFVLIVIFKLLFFVYNQINMCFKLKRE

SEQ ID NO: 6961 - protein, 530 aa, Chinchilla lanigera
MAPARSPAPLPLYLCLLLASGFAQAGRLLVVPMDGSHWFTMRSVVEKLVQRGHEVVVVMPEVSWQLGQSLNFTVKTYSLSYTLEDLNRGFKEIIEGTWKTREDSLFSIIKGASKDFFELLFSQCRSLFNNKELVAYLKGASFDAVFLDPFDTCGVIVAKYFSLPSVIFTRGALCAYIEEATQCPSPLSYVPRNFLGFSSAMTFKQRVRNYISYLEEHLLCPYFLKKTLEIASELLQTPVTAYDLFSHTSIWLLRTDFVFDYPRPVMPNMVFVGGINCHEGRPLSKEFEAYVNASGEHGIVVFSLGSMVSEIPEKKAMAIAEGLGKIPQTVLWRYTGTPPSNLAKNTILVKWLPQNDLLGHPKTRAFITHAGSHGIYEGICNGVPMVMMPLFGDQMDNAKRMETRGAGVNLNVLEMTADDLEDALKKVIYDKSYKENIMRLSSLHKDRPIEPLDLAVFWVEFVMRHKGAPHLRPAAHDLTWYQYHSLDVIGFLLAIVLFVAFVAFKCCAYGFRKCFGKKGRGKKAHKSKTH

SEQ ID NO: 6962 - protein, 528 aa, Chaetura pelagica
MWRHQIQAGLLLFLSCWSLAEGGKLLVVPQDGSHWLSMRVVLERLWEKGHKIVAVVPEAALFLKSSQRFTIKTYSVPYTQEFVDKFYNSLGEYSFVNPPFLEKVYFVLKNISEVTSMFSSSCRSLLYDEELMKYLQDSKFDAVMVDPVLPCGPILAEHLSLPSVYFMRGLPCTLDYKATQCPSPYSYVPRSFTDNSDHMTFMERVKNLLIGFSEHLLCYVFYLNHENLASEFLHRDVAVLELFSKASIWLMRYDFVFEYPRPIMPNIVYIGGINCEQKQPLSKEFEAIVNASGEHGIVVFSLGSMVSDIPRERAKEIAKALGTVPQTVLWRYTGEVPPNLPKNVKLVKWLPQNDLLAHPKTRAFITHGGSHGVYEGICNAVPMVLMPLFGDQMDNAKRIESRGAGLTLNILEMTSEDISTALKAVINDKKYKDNIQRLSDLHLDRPIHPLDLAVHWVEFVMRHKGAPHLRPAAHDLNWIQYHSLDVMAFLLAVVLLSLFISLKCCLFCCRRCCCKKGRTKKATKAKSH

SEQ ID NO: 6963 - protein, 517 aa, Neodiprion lecontei
MALRTLFVIIMTVCLTDGARILGIFPYQGKSHNVMFEPLMIGLAKAGHTVDLVSHFPLKKPVPGLNHISLKGSLHSYVNNVTASLARGYNGIYGMVHSVSVKSALDLCNLMRLPQLQNIINTDTKYDIMVTQVFGSNCYLAVAHKLKIPVVGVVTSVIYPWSYGPFFGDANPSFIPSQLGTFTNEMSFVERVQNTIEHYYAKFLFHYYDRTVSDPLAKKYFDDLPPLNDLYNNMSLLLVNSHLSIHGVRPGNPAIVEVGGLHIDTTQVLSEELEKYLNSSKDGVVYFCMGTMVRSDTFAQEKILAIYESFSALSNYNILWKSNAEDLPKPFPSNLKVIPWAPQYAVLNHPKVKAFVTHGGLMGTLEAVHAGVPMIGIPFFGDQAFNVLGYVHRGFAVHIDYDDINQLTFSKALNEVLTNPMYQSNAARYSRLFKDRPLSPLDEAVFWIEYIIRNGGEPLRSSALHLYWFQYYLIDVILFLLAVPTLFLLSLFHVLKRVLRTNKGTKTRTIQKKKKTS

SEQ ID NO: 6964 - protein, 539 aa, Megachile rotundata
MKLCIILLCTLAICHGYKILGIFPFHGKSHFVMFEELMKALARKGHQVDVISTFPLKRPYANYTDIVKIQAPEQLLNNLTFDGVAVFTSAEAGYIVASMLGNPLCEHLGSPEIQRLLNPGENRYDVVIVEIFGAHCFAAVGHVLNVPIIGVSSSALYPWAYEYIANPENLAFAPNILLSYMENMNFFQRLYNFLHHKYNVHVFRQASSIQTEMIRKYVSPDLPDIRELEKKLAMILVNSHSSWNGIRPSTPALIEVGGLHVQEEGVELPPSLEKWMNESKDGFIYFSFGSMVKIESFPAKYLKIFYSSLGKIAPVRVLMKIAKSEELPPGLPKNVHTLSWIPQVKVLKHPNIKAFITHGGLMGTQEAIHYGVPMIGIPLFADQFINIDVGTVKNITIGLNLDTLTEERMDEALNAVLNDPKYRNAAKKLSERFLDRPLNASETAVYWVEYIAKHGADALRSPAVDLAWWQRELLDVYAFLLVALLISLYALTVVVRFVFQLVNANDSAAHKKKDEYNATYIVINGSVHSKNISKQSGNR

SEQ ID NO: 6965 - protein, 720 aa, Papilio machaon
MLRRYFGAAVPRIAELNNNIHMLLLATNPIWAGNTPVPPNVIFIGGIHENPDEKLSEDLKYFLDNSKNGVIYASFGSNVKTNKISAKITRILAHVFTESTLNVIWKLDQNELPKQSDHIKIMKWLPQAALLRHPNVKLFITQGGLQSTEEAITAGVPLIGIPILADQWYNTEQYVHFNIGVKLNYDTLNKKQLQESIYRLTLDDSYRKNVVKLRQQILDQPQKPLERAVWWTEYVLRNGGRHLRSPSANKSWISLELELLFFLTIGQAPRNIIEIDVRNESYAVMNETTKEAYKNDTSSFRKVELLSQLFVRAFRAQLENEEFRAVVKLDEDYFDLLLIEACATPTLGLSHIFKAPVIQVSSLGALMSNYEALGIPMHLFFFPTSVRKRIHKLSLTEKLATLLEFAVSKYVMRTTRNLENDLLREHFGEDTPSLDELTNNIDMLFLNTNPLWANNYPVPPNVIFIGGIVENARKDLPKDLEAWLNSSKNGVIYVSFGSNVSNKTFSQKTKHVLSNVLSNLPYDVLLKWDEDKLIKKSKNIKIAKWFPQVDLLYHPKIKLFITQGGLQSTDEAIAAGVPMIGIPIFVDQAYNTEQYEHFNIGVKLNYNELSEEKFKRAIDTVIGDDKYRENIVKLRNIINDQPQSPLDKAIWWTEYVIRNKGAQHLKSPTANISWIKYLEIELIAIVTAIFLLFIILLISIVKFLVRIINGIFRKFKVKRE

SEQ ID NO: 6966 - protein, 225 aa, Vanessa tameamea
MSFGTNVKPSLLPKEKIQIFTNVFSELPYDVLWKWDKDEIPGRSKNVRISKWFPQSDLLKHPKVKLFITQGGLQSTDEALTAGVPLIGVPMLGDQWFNVELYVKHNIGMKLDIETLTEEKLKEAIETIITNKSFRENVVKLRNIMRDQPLSSLERAVWWTEYVLRHEGATHLRTAAANIHWTEYYALDLVLFLLSSFVILLLILTFIIRKTLLKLKYTRIKRKMN

SEQ ID NO: 6967 - protein, 616 aa, Trachymyrmex septentrionalis
MRKTHSFIVFSLIIVFSTCCLAVNQTFVNPMQTKFKILGVFGHPGKSHFDVFKPLLEELARRGHELTVISYFPRTDNAKVKEPLPNYKDVSLVTAKDGIFVNVVDLHQINHGWFRPMLDLHMLRFMADYACSTGLRSSSVKKFLQSDEKFDLILTENFNTDCFLGFIHRFKAPYMALSSHQIMPWTNSDMANTDNPSYIPVILLGLTKPLDFFSRIKNALWLLLSKAIYEYYFRSVDQVVANEVFGTDLPKLKEIALQSQALLVNTHSSIHGSRPQLPNVIEIGGLHIPSRVNPLPKDVAEFLDSAHEGVLYFNLGSMIKMSSIPQEKLNAILKVIGSIPRKVIWKWEADKLPRKLDNVMARKWLPQFDIMTRREKVVGEEAFRYSVLSARRTIERENCVIGCDAGFRCLTHLLLVRVRYSSDSCSPIFIIILLLCTKYYHRNVKCYLGHGGLLGLSESVYVGLPMILVPMYGDQFHNSAAAETRGTAVVLAYDNLTEETLRSALDKVFNDTSYHENAQRLSKAYRDRPATPMETAIWWTEYIARGNGRFYFRSDSTGLSWYQRHLVDITLVLIIVSIIFIYILFRLVKLLLLLLRFFKRTSRNQVEEKRKLKKDN

SEQ ID NO: 6968 - protein, 418 aa, Vanessa tameamea
MELARNISRDLIATPEVREVLLKEKFDAVVTEWFFSDTNSGYAAVQQVPWILLNSMVMHTHMESLVDTVRSVPTIPAFFIDSPIPMNFWSRLQNTLLYLLMSTGSLLDYSMLKSDYETYFSPFAKARGVTLPPYNEAIHDISVLFVNSHPSFSPAQSLPPNVVEIGGYHIPEEIPPLPKDLQDILDSSPQGVVLFSMGSIIKSVALAEHTRRDLIKVFGELPYTVLWKFDENIEGLPKNIHIRSWMPQTSILAHKNVKLFITHGGLLSTLESLRFGVPIIAIPVFGDQPSNAQKSVQGGHALMIDFSPEMGGPLKDALKEMLSNDRYYKRAKYLSQLFVDRPVNTTHLIQHYVRHAIETNGAHHLRSKALLYSWYELWMLDQVAFLLVILYTIYRVFKKIVGCFKRHKSIKTGKEKRH

SEQ ID NO: 6969 - protein, 1038 aa, Bicyclus anynana
MYKLFKLFCIISLIGKIEPAKILAVFPVASISHQVVFRPLMHELAKRGHEVVVITPDPAYPKGQSPQNLTEIDIHDLSYKIWNDLLETGMGQNRITSVEMRMFLGLMTKAFEAQMKSEDVQKLLKDKSKSFDLLFTESCVRPAISFGYRYNVPIIEFSSLGSIFGSIYGTGVPTNYLVYPSPLRTRVYNLSLWEKISAVYNDYKIDKVIEEHKEEENKVVRGLFGPNVPDLSELKKNVHLMFLNVNPIWDFNRPVPPNIIYLGGIHQNLHKDLPKDIKSYLDSSQNGVIYMSFGTNARPSLLPVETLKVFTNVFSELPYDVLCKWDKEELPNRPENVRVSKWLPQSDLLKHPNVKLFITQGGLQSTDEALNAGVPLVAIPFLGDQWFNAEQYEKLNIGIHLDLETITEKKLKNAIEKTIQDKTYRENVVKLHSLMRDQPQTPLERAVWWTEYVLRHGGATHLRAAGAHMHWTEYYAIDVVMLLVFGVLAILIVIIITITRLAMQLKDFKIKMKISDITNQTMYYLLKILCVINVIKAMESARILAVYPAASISHQVVFRPLMHELAKRGHEVVVITTDPAYPKGKAPQNLTEIDLHDLSYKAWNDILETEIARNRLTSVEVKIFLHVMIKTFEAQVMSEDVQKLLQDKSKSFDLLFVESCVRPALSFGHRYNVPIIEFSSLGNLLGSVYGTGAPTNYLVYPSSLRSRVYDLSLWEKISAVYSDYSIDRVLEEYEEEQNKVIRGLFGSNTPTLSELKKNVHLIFLNVNPIWDFNRPVPPNIIYLGGIHQKPNQELPKDIKTYLDSSQNGVIYLSFGTNARPSLLPTETLKIFTNVFSQLPYDIICRWDKEEIPNRPQNVRVSKWLPQSDILKHPNVKLFITQGGLQSTDEALMAGVPLVVIPFLGDQFFNAEHYVKLNIGIRVDLETITEDKLKHAIENAISNKTYRENVVKLHNIMRDQPQTPLERAVWWTEYVLRHGGATHLRAAAAHMHWTEYYAMDLIITVLAAFVILIVVIVLAIRFLLFKLQLRSLKFKIKIN

SEQ ID NO: 6970 - protein, 521 aa, Acyrthosiphon pisum
MAFESKKMYLPLFSILIYTFAGSWIPAAPAEGARILAVETVGGKSHWNFMSAILRALVDNGHNVTVFTPFTDGNRENYTEVSTSTEATVLLDGELEDLIDKYGDPIKIVGQMAKMSRHFCDVVYQNSKMIEVLANKRSDFDIVLIESLYSECVSYVAVKLNLPLIYVLPIPTMDITSRLFTGHMSNPAVVSTSMARFSVPKTFVQRSANIAFLIYASIVYKISELILMYNEPREYDLHAPIPPSLVFVNRHFTIEPASPIPSNVVEIGGIHLKATKKLPKDILEFIEQSPHGVVYFTFGSTVKMTSLPEHIKKAFMDALAQIPQRVLWKYEDEMENIPKNVMVKKWLPQREILLHPNVKLFISHGGISGLYEAIDGGVPVLGFPLFADQPKNIDSLVNAGMAISMDILSVTKDAFLKNVLELINNEKYKENGKTASKIFRDRPMSPASLVVYWTEYVLRHKGAPHLTSHAINLSWYQYYMLDLIAFILVFIIFVVFVSYRIFKSISKYFSSYSRNIKSKSE

SEQ ID NO: 6971 - protein, 491 aa, Lingula anatina
MASKAVLSLAVLYVLLLRSSTSDGGRILSLVYPGKSLLSLTVTVLTELKSRGHDVWAVYADTFEISASMLRESGINLLTFTSKEKMFLDDPEVQRDILMAAVENPELRTSLFHLTSTIQKFTSIFESYLEEMFVDKELDRKVRELKFDLMIVCGYWFFAKAYLFPHRYAVPYVSIVLDMQQLAGVPMLPSFVPSLAITAKYSDKMSLPQRMLNIVPYVLLKHSIQPITPELSQKHAPGRPYMSTPELMAESELWIVDGGQPAIDHVKPSLPNVKYLGGLVTRPAKPLPKDLETFLKKHDHGVVLVSFGSLVKYMPDRVVQELFEAFKNVPYGVIWKYNGQPLKNVPDHVKIVSWMPQNDILGHPNTKLFITHAGNNGQMEALYHGVPMISIPLFGDQDYNAARAEQKGIAITMDAAFLKSEDLISAINMMMENETYAKNMRRASAIFRDQPGTPVELAGFWIDHVIKYGGSYMKSHARLLPWYQFYMLDVI

SEQ ID NO: 6972 - protein, 514 aa, Papilio xuthus
MLLIFIFVIYISSTQCARILAVFPTPSISHQIVFRPLTQELARRGHELIILTPNPAFPKGQAPKNIIEIDVHNESYAIKNQTTKEAYEKDTSSLKKVELLSQLFVRVFRVQLENEEFRTILKLDKDYFDLLLVEACVTPALGLSHIFKAPVIQVSSMGALMSNYEALGIPMHLFFFPSSVRKRSHNLSLTEKLSTLVEFAVSKYVMRKTRNLENNLLREHFGDNIPSLDELTNNIDMLFLNTNPLWANNYPVPSNVIFIGGMLQNARKDLPKDLEAWLNSSKNGVIYVSFGSNVSNKTFSHKTKHVLSNVLSNSPYDVLLKWDEDVLIKESKNIRIGKWFPQSDLLYHSKIKLFITQGGLQSTDEAIAAGVPMIGIPIFVDQAYNTEQYEHFNIGARLNYNELTEEKLKETIDTVIEDEKYRNNIIKLRKIINDQPQSPLDKAVWWTEYVIRNNGAQHLKSPTANISWIKYLEIELVATLTIILLSFITFLILTVKFLVRITIGMFRKLKVKRD
